United States Patent 10,329,575 (REGULATORY SEQUENCE FOR PLANTS) - sequence listing, part 3

SEQ ID NO: 2131 - DNA, 3000 bp, Unknown
  misc_feature (1)..( 3000): cDNA_ID_2047393_gDNA_ID_1620491_Annot_ID_158610 3000 nt of promoter + ATG
tgttcctttgtatgatcgcaaaggcgagagactagtttcagttacacttctcatgcggtttcactttctttaaacacagagtttccttaaaacagagtttctttcttctttataataataataatacttcaaagagagtggaactttttggcatatgaaaaacggactaaatcaaaatttgtcactcgttaataaaaaattaaagacttggtcttttttgacaacagattctttatttgacttctagaataacactgaaactggatcatcgtattaatctaatttaattaaaatcaattaaaagaaaaccatcaaggttctctctttctctgcagttgcgtcccaaacacctatcttcacactcttaaaaccaaacctctaaaagaagttttgatgcagtgagtattcaatctcatagactcatagcaatggcgaatcacaacagtttcacttacatggaccatagcttcagcgatataagtctcaactttgattcctctgctttcagcgattgtaacagtgacatatcctgcgagtttccaacaactacctccgagagccgtcaacgaaaactcttcctctcttgcgccgttgataattccgatgacgtgatcagaaatctcataacgcatcttgagtcatcttcttcgatcgaggaacagaagcaagctgctatggagattagactcttatcaaagaacaaaccagagaatcgtatcaaactcgctaaagccggtgctattaaaccgttggtttctttaatctcgtcttcggatcttcagcttcaagagtatggagtcactgcggtgttgaatctatctctctgcgatgagaacaaagagatgattgtttcttccggtgcggttaaaccgctcgttaatgcgttgagattaggaacaccgacgacgaaagagaacgctgcttgtgctctgctccggttatctcaagtggaggaaaacaaaatcacgattgggagatcaggagcgattcctttactagtgaaccttctagaaaatggcggattcagagcgaagaaagacgcgtcgacggctttatactcgttgtgttcgacgaacgagaacaaaaccagagctgttgaatctgggattatgaagccgttagtggagttaatgattgattttgaatcggatatggttgataaatcagcgtttgttatgaatctgttaatgtcggcgccggaatcgaagccggcggttgtggaagaaggaggagttccggtgttggttgagattgttgaagcgggaacacagagacagaaggagataagtgtgtcgatattgttgcagctttgtgaggagagtgttgtgtatcgaaccatggtggctcgtgaaggagcggttcctccgctcgtggctttatcgcagggtagtgcgagtcgtggtgctaaggtaaaggctgaggcgttgatagagcttcttaggcaacccagacaacaacaacaacaacaacaacactttgaatctaacgacaacgagagataacactttagtttgggctttttattaatgggcctttgtagaatacatatcttgttaattatttggacggcccaagctgaacacatatcttgttaattattggtcgatgtgttttgcatcaaagttgcattacttgcgtagaatgatctatacaagagtagcatcgaaacaaaacaaatacacgtactgtctatttaggagataatgttgtgaacgatttagagaacaaaatccctatagaactaacaagacaaaaaataaaaaagagcaatagattctttcacaaacaataatggagtactacactgtcaacacagaaacaaatgcaagactaaaacaaaaagctaatgtccccacaaataggaagatgggttaaggatatggttcaactcaagattttcttacttttttcaaaacaacattcaatttaaggatgcatttattgtataaaggttttggttggataaatttaacattcattcaaaaagactaaaacaaaaagaaaattaaaaaccatgcgatatgctttttttatcactatggaacaaaaaaacaatgaaaagttgaaaaccgtaaactacatgtagaattaggcatgggcatttggggtaaccggtccggtttcggttcggaaacttaagtatttcagttagcaacaaaatcactgaagtaggccaaaattaaagttgggtttgtaatgacaaaatttcggttcagttcaaacaaaaaacaaatatttttggtttggtggtcctcaatcaaaccggccatccaatgatggactttcaggccaaaagttaaaaccgaaatctaagccggcgaattgccaaatttgagctcagttgggttcaaccaaactttcagttcaggttggttcgaccaaacctcagtggccaattcgattcggtccgagtgccatgcttatgtagattgtagaaagcaccactttgaaaagttttcctatagcaatgaactacaatcacatcatccttaatagtattgaccaaaaaaatcaataatattgacaataaataatctgtattgacaattacatcatgagcgaaaaaaacaaaaaggttaattaacacatgagctgtttcacatgatgatttgctcatcaatgacaaattaaaatttgttgattttttcttacggcgacacgcctaccaccattttctcagccattggctacacacacttcgccacgttttttttttactttgggtcaacggttctgttttcagtcagcggctctgtttcggtttataatactaactttatttcggacagccgacagatcattctcatttttctttctttatctatttttgtactaagaataattcatagattttttcctagaaaaattcatagatttaattggttcattgagatagagatagagatataaatgtgtttcacgaacaagaacaaacacatcaagtctctctgtttcttgtttttctctctcgcttaactttcacaagaaaaaaaaaagatg

SEQ ID NO: 2132 - DNA, 3000 bp, Unknown
  misc_feature (1)..( 3000): cDNA_ID_2047406_gDNA_ID_1620491_Annot_ID_158606 3000 nt of promoter + ATG
tatcggagcaacaaccacacctcctttgagtcctaacggtgtatcctctccaataggtggaggaaaaacgtggatgaactggcctaacataacccctcctgcattgcagcttccagggagcagattgaaatctgcattgaatgcaagagaaatcgatttctctgaagagatgcaaagtcttacttctccaactacatggaacaacacgccaatgtcatctccattctccggaaagggcatgaacaggcttgcaggaggagcaatgagcccggtgaatagtctcagtgatatgtttgggacagaggataatacatcgggtttgcagatccgacgcagcgtcattaacccgcagctgcattccaacagtctttcttcatcacctgtgggagccaattctctgttttcgatggattcctccgcagtcttggcttcaagagcggctgaatttgctaaacagcgaagccaaagcttcatagaacgcaacaacggactgaatcaccatcccgcaatctcttccatgactacaacttgtttaaacgattggggctcattggatgggaagcttgactggagcgtccaaggagacgagctacagaagctcagaaaatccacttctttccgtctcagagccggtggcatggaatcaagactgcctaacgaagggactgggctcgaagagccagatgtctcatgggtggagccgctggtgaaagagccacaggagacaagactagctccggtttggatggagcaatcatacatggagacagaacagaccgtggcttgaatcaaaagttttgaactttcattaaccgttccacaagaagcaaagtcagaaagattccgagaggtcgatgctaatctatttcattttatttgtttaatgctttgttatttttctttagaataaaaagaaaaaattcttaggggacaaaagagagttcgtttgtctctctctctgtctccaaagaaaaacagaggtgaaaaaaggtttcaaaacctaagaaaccttgaattacctcacctcacttccttgattctttactattcacaatgagtaatcgatttttttttttcttggtaacactctcacgctgaatatatatgttttttagtaataatataattggaatacagaaatgtatttacacttgtgaagttagggaaagtgttgtaattgtttcttctaagagttgatctaagatgtttgagactatatcttcgcttatgattccttctatatcttcgagctttaaagcttttccgttaaaccaatctgaaccttcaaggtcagatacagtgagtttgcagatcatgagccacatctcttggtagccatgaagtcggatttcttggtcttttgatctacttgtcaatgtgatgtgatcttgttcaatcgtttcattgagcttactagattcaagttctgaagacaaccgtcttcttgaaatgtttcctgttacaaggaaacaagtatgctttaataacacaagaaaggacatttcaattttcaatactgaagaattaccaacctggtgatggagttactcgaacaccagcataccggtcataatcaagaaccgagacagggctcgaatcatcgcagcttccacactcttcttcttcttttgttgatctcacttcacaatttactaaatcttcttctttggaccaacaaccattactttggacccaattctccttctcgatgttctgtctcaacttagtttcttttcgttttcttctgctcttacgtttctcctttctacgctgcatcagttctccaatctcaagcctctcacgtcctggtgaaacgttcatggcattgatgttgttctctttaccctctaggtgtgtttgatcctctgttttgctctggttctctctagtatctctcctcttcttacaatttctagttcccagctccttatcatttttatccttctcgaaactgagaatgaagaaatcatcatcttcaagctcaacatactcaagagtggacttaactcttctatgctttccctgaatctcatcgtcgtccctcttcaaatgattcactgaatggctccttgagagaaatctggttttgtcgatcacgggaattgagtccaaacccatgagcctcgccacagctcctggcccatctcctctgcctctgagtggctcggggatgaaatcacgagacttgaaactgggttcagtaattagatcagatgggtaggtagaagaggtgccggaacagagaaatctttgaagaatgatagagatacagccgaatgaccgagtcttcgagccgagtgagagagaactagccggagaaggcgatgacttcatcttcatggtctatagtgtcagtgtttcgaaactaacggagaagtaacgcataaggaaaataacttttgtctttacttttttttttcggttgagtgatgatggagagcaaaacaaaaagtgtgaacaaactcagagcgggatctagaatttgaactaacattctcagtcaaaaacaaaatgtaaatcagctttttttgttgtactttttgtgattgagaaagcaatagacaacagttgagacgctgtgcactgcacgcgttttgacaagtcaattcccggagaaattcatgtcgtccggtgccgcttttttataacaaacctctgtcacttttgttctttttagttcttgaaccgagtcaacaagaaaaaatagttgcggatcaaatatttgggccgttttgatacttttcagtgggctttatgttacttctattcattcaagcgggggtgtaagtgcaataaaatataaatacaggggtatttaagcaaatatttcaaaatataagacgtcaacaacaatgagcaggataataatattccagcatccaaacaagtcttattgaactctctcgttccgtcttctccgattcgctttacactacttcttccctcgtctctctctctcgcgcttcactgtgaattaatcgagagatctaaatatccgcc

SEQ ID NO: 2133 - DNA, 3000 bp, Unknown
  misc_feature (1)..( 3000): cDNA_ID_2025059_gDNA_ID_1620491_Annot_ID_158599 3000 nt of promoter + ATG
ttgaagctggatgagatctctggtaatgccaatgcttggcatgacgctgatctcctcatcttcaacactggtcactggtggagccacaccggatctatgcaagggtaagttaccacacttccaatgacttgattttctagtgtgaaagtttctttatatatcttcttgtgaacacagatgggacttgattcaatcaggcaattcttattaccaagacatggaccgttttgtggcaatggagaaagcacttcgtacttgggcgtattgggtcgaaactcacgttgatagatcccgaacacaagtcttgttcctctccatttctccaacacacgacaagtaactcagcctctcttgttatattggatcatattttctgatgtttttgaaatgaatgtcctgacaccatttgtatacattttgggattgatcagcccgagtgactgggcggcatcatcgtcttcaggatccaagaactgctacggagaaacagaaccgatcacaggaacagcttatccagtgagctcctacacagatcagctaagatcagtgattgttgaagtgcttcacgggatgcacaatccggcgtttcttctcgacataacactcctctcttccctaagaaaagacggtcatccgtcagtatacagcggcctcattagcggttcacaaaggtctagaccagaccagtctgcagattgtagccattggtgtttgcctggtttacctgatacatggaaccagttgttgtatacgcttctcatctattagcttctttttaaatctctttccatcaaattattcggttagtaatattttaacacattcgaagagagaatcttaagattaatcacggaatcagtcaattgtataaactttttgaggaaattttctttcaaatgaattataatttttattccatgcaaacaaagcatagtaacaagaaatttaacaatggcaagcccaaaacaaacagtattgggcttttaaaaaaatacattcgatgggcttattggaaaaaagccttttagggttttctcaaaacctctctactataaatagaggaaatccaactttagagtttaagaagaagcaatccaaaatcaattcactgaaaagcttcgtttttaatcctgtagttttcatagggtttggtgttctctctattgttgttattgggcttgccttttgtctaggattatcatgatttatgtttattgaaagattggcttcatcagatagtctatgtggatttgttcgttcccatatgattcgttcccttgaagcaaaatcaatcgtgttgctttcgttatttatataattctccctatgaatcttcggtgatttcgtatttatacgatttttgctgatgttgatttgggagaatcacaactgagcagctatatattattcgtattgaaatctagatttgggtttttgtataagtttttggaagaacagtgatgagtcagtttacagacctgtaatgattgcggtaatgatcgcattattatgaacatctaagggactgagttcttctttctaatatgatttaacaacttcaatttgtttttgttggttaatgtttttttgtttaatctgataaagaggctgatgaagattagatattaatggttactgaaatttcaataagtgtgttgatatactatcttcttgactaggactgctgaggctaatctttgaattctaaggaattatgttttctctttttgatttaatgaaattagattgtggatgatgagaacaaatatgaaaaaacagttatccctgtctgaggattttaatccctttgatgattcatttgtaatctgacacaaccttccagttcatatcgttttgggttttgcttgttgactatttatttcagaccctaaattatacaaacacgaagatttgtcattgaaacaacgcagcttcattcaaaaacggattttaaaattggaaatcagacaaatgactaagcgggtcccttttgactttagcatcaatattcaatattaccgtgccagtaataagagttctcgagtccatgaaatgatgttgtatcagttttcgttcagcatttcaataaattcacgatgttttggtcaaaatatcttactacctatcgactgttatcggacttcaggttctactctttgagtcgtcgacaatgaaaacgtttctttttcctactgtaacgagaaggcaaacaagtggtattttgttacgataaaaaacaggtcaaaaaaaaaatttgttaattgaatgtttaacacgtttccaaaatttataaatgttcatattcagcttacattgtactagcatcggcagtagttgattgaatactagtgtcgagtgacatcagcttgatatcaaagcatgattgattacattatataatatccatttgtaaataatccacctctcaaaaaaaaaaaaattaataaataaataatccacctccgttcatatataaagattgtcacggtggtctaccttaacactacaaaggcagtccacgactgagaaaaaaaaagcagttcaaatttttttcgtatgtgttaaggatggagtacattcatagagcatcatctacattctactccaagataaatgtggagtatctgtattacttttagttttgtaaagagattatacataatttaaatatggtacattactcattacaggtctttgagctgtggcgttccttagccatgatgtttcatcctctatattgtcgatacgagttcacactttctagcttcatctacataccaaaatcatgaattgtcgtatagggccttaatgggcttaaatgaccgagataatgacctgttagcccactagagataattcagaagcctaactttggatataaagtttaaaaaccctggttccagttttttcttctggttctcgaaacttcttctcccaaattgaacaaccaaagaagttgcagagcacacacacacactttcaagtttcaatacagagatg

SEQ ID NO: 2134 - DNA, 3000 bp, Unknown
  misc_feature (1)..( 3000): cDNA_ID_2047420_gDNA_ID_1620491_Annot_ID_158602 3000 nt of promoter + ATG
gatgtaatcaacaacctctttgcttccaaacaaggcagcaatcataagaggcgtcctctcctcaaaacccatcttctttgatcctaatctcctcccataccacaaaccagagccatcaatgctctcaagaccttcttcttcaactagagacttaaaaccggacaaatcattgcaggctgatgattctagcagaagagagaatttgaggtgagacagctcatcaactcccatggcaaaaaaaagcaacaatcttttcccgctctattgatttcactgcaaaaaaaattgcagaacaaattgaaaaggatgaatcttttttcttctgattaaaatggtaatatacatagaacaaaatcatacaaaacagaaataaaaactgcagaaacgattaagctaaggagagaaggaagagtttgttagtttgggatacaaagtttccaactttaaaacaaaccaaaccaaaaataaacaccaacagatccataattaaccacttttgcaacatcgaaaactaatcatattgttaactcattttccaatcagcaaaacaattaaaaacaaactgcaaactctaaaacaaatcgacatatatggattcaactgaaactaaattagtgactaatcaaatcaaagaaacaaagagtaaagattttctacctctgagtcacagagacaaactctctcttttctcgaccaccactaccaaaaaaccgctcttcacttcctttaaacgagtactcaattagtcaatttattgaaaaaacaaatccgaattttttttcttcttcctcaaattatgttttttttcttcttcttcctctccttgtcactttcttcttaaggtcaaaataatagaagtttttaaaaaaatgaagaagcttactctaaataataaaacaaaaccaccatctccatcattcttcttctacttctctctcgtcttttttatttctatttatttattttactttcaattttaatttgtaaagtctgaaggaaatgaaggtgtacgttagacttcacacagaggatcttcgctcatcggttttgtcacgcttcacgcgtttttccggtttttggtgggatgacgtggaaaccatgcatcgtcagcatgtttttaaaatgagctacttacttttcttctccattcacgagctaaagataaaaccactgcctgttacctagagttatataaccaattaaccatagctttttaattggtttgtcaccgccccagaataatctcaacatgcaccaaaacacagaatcggaaccgtctcgagtgggtttcgcttgatagcaactctcttttgtcatagctttgatttgagttatattcatcaaaattaattatcataaagtttaaagataattgagataattattataaagtcgagaaattgacgtttatgttcagtttttttcggtcgacaattccaacaaaaagacgattaggtaatacaaatatcctaagagactaaaataatgtgtatttaaattcggtaatggaaagaattcgaacaaaccttaccaaactttgtattttctgtcgctatgcttgtattattatattaaaagatagtgattcgtgatccatgacaatgttgtactactatataaaagtagtcataaattgcaaatgtataataatatttttttgaaaacgactactgttttgtattgcaaccagaccaaatccaaatgcatgcaaccgaacccatcaatgctttttgcagcggcattaacgaagctgctccactggctctctctcacatcataacacaaagccatttattttctcttcttctaatttacagttctaataaataagtaaagtcataatattaatatgatagtgcaaatactgtatatatacacgacaaattattaatttttagataattatatcctgtttcttaacataaacactgttgattcccaatgtcaaatcaatatttaaaaatttgttataagtcagtcactcaaaagacaatggtatgaaaaatgctgaaaacagacggtcaagatcttgtattcacgatgagatatattgttaggttaattttgatataaagcgaaataaaaagggaaaaaaggtagaaaagtctaagtgtacaattaggaaaaggacccacaagaatccataatctgactagaatgaatggaataagaagcatgtgggaccaactgaaagcgactaagcattgctatttgctattttatcagccgacgtcgctgcgacaaaaccccaaatggcagagccttattggacagaccatattgacttttatggtcctaaatgcagtgaattatctctcttcgacttggcgccaagcacttctgggccagaaataccgatgcggggctatacgaggataatgatctgtttcaaagcccataattaaagacctaggtttggcccattagtctatcttcttgatttaaaagaaggaagccaatttcttcttcatggacgtaaataaaaagaactggtaactaatgagatagtatcttactatcttcacaagtaaaagtcatatggtgaatccgaagaaagaatgtcgtattcatgagctatatctgagaagagtgaaaaacagagtcaaagtcaaagagtgatgagcaagctttaatagtacgaaagtagaagaaataaagaaataagagggtgaaatgggtaaattttggatttttaattaggaaatagtgcaaattgaccaaaattaaaaatctccactcttttcgcgtgtatcaaccaaaaaacaacatcaatgtcctttagttttaattaatctcgctgtttaattgggattagactaaaaaagttgcagagactagtacagcgttacttggggagaaagctgctactcacacaagtacctcccaaatctcttctcttacccacaaaaatcttctcttcaatattctccaagctctatcggaacactgcgttttttgtttttgttttccctccaaatttctcactcgaagcttttaatg

SEQ ID NO: 2135 - DNA, 506 bp, Unknown
  misc_feature (1)..( 506): cDNA_ID_3066102_gDNA_ID_1620492_Annot_ID_158641 3000 nt of promoter + ATG
actatccatccactagaccagtaaatgaaagagaaaaaaaaacatgaattttcaaatttgaaacattttaatccccaactttaaaaatatatggattaaatcattaagttttttttttttaacttagccatttaacatatgaccaccatccatttattttaacaaattaacataattatatagggtaaagaaatgcttttcttatttttgacattctaattctagggtaaacaaatacatttatatctaatttcaatatttaagatttttttttttaaataaaaaaaatgattgaatctggtttaaccaatttgaaccacaacccaacaatttatccggttcgatttggaaatagcaagtgtgggactgttatgaggtcatcacaatcaaagtaaattaattcctccgtgtgacctaaagagtgaccgttcccgttcactaccgccgcaaagtcttgtggctacagagcttagggtttaaactttcttcacgataattttccgatg

SEQ ID NO: 2136 - DNA, 3000 bp, Unknown
  misc_feature (1)..( 3000): cDNA_ID_2151342_gDNA_ID_1620492_Annot_ID_158646 3000 nt of promoter + ATG
tacaagctctactaacacatataaaggaagaaaacaacttaaaaattttggtttttttggaagaagacttaccaacaatcggttgccttatcctcgtttactactttatacactcaggtggtggtagaattcccaagttatgatctccttactttcacatgttttttggaggtggtgcactgccgtacgaagtggccccgctgcccacactctctataattatgattacccttaggataattgtccattacatggccaactttacgcactagccacgattgcttgaatccatcaaacaaaccctccatgattcctattattttggtacactttgggcaatggttatgacaatgtcattcatcagtgcatcacggttatcccatgcacgccgtaagttgtcagagtgttggtctcgtattactcaggtccgtttaagtcaatgtgaaaatcggttaacggtttatataattcaaattgataattttaaaaaaaatattttttaaagttcataaatgcaaaatgctagagtttgggttggaaaaaacatttgtttaggtttattttgaccttttttcctcgaccatagaggttttgaagaagcgttaataagttaattacgtgaccttataataatttatgacaattatggcctttttatgacaatatttgtttctaacgtattcacatgtagttcaaatatacaatacttattataaagacaaaagttgtcatttttaaatcacataatatcaagtcgtatcaacatcgtttagccaaactgtcttagtttttttaatcttctatttaataaatttgtatcgtacacaatcataatagcaaatttatatttaaattattatgtgacagccatagaataacaacttgatgataaataaattataatgcataattacatatgacaaagtttacattatcacaatagataaaaagatcatagagtttgcaaaatattttaagaatatttaaacaaaattttataaagaaaaacaatcttagatacttgaaaatcgcagtaaaagacgtatctctgcggctagaataaaatgattcggagctttaaaacatagaaactttacaaaagccaaaccgatcaggacaaaatccaaactgatcggtcttatacgtttttggtaccaacaggtacttgtccatgagaagctccaaaactctttactctaaatccaacaatccataggagttttcagtatctccattgtcttctctttacataggtttagtgaaagagtatgatctcgctgagggtgtatagatcacaattacactgtcgtctaccatgtagggtacaatgctctgtacatgcatggtggagtgcattgtagtgtaccatgttgcgtacagaccctgtagagcacactattatgtatcatgtagagtagattgttgtgtactatgtggagtacatcgtcatgtactctgtggagtagactatcatgtattatgtggagtagatcgtcgactaatctacgaaatacaccgtcatgtactctgcagcgtatgtacctggaacacactcttttgtaccatgcggtgtaaaccaacgaaaccaaggtcgaaagataaaattgtcgtgtgacatgagaagtagacagtcatgttccatgcatcgtataccatcatcatataccttgcatagtacaccctcatgtaccatgcttactacaatgtcatgtatcatgcgataatcctaccatgcgaaatacaccattttgtaccatgtggagtagaccgtcgtgtactatgcgatatacaccgccgtgtaacccgctaacataggtctgtactccaaagtgtacaagatcggtgtgaaatataagttgtacgatctttgtagcatattatatactaatatacagtgtacacataaaagaatacaccgcttcgtgtataagattagtgtggagtatatggtgtatgcatttttcttaatatacatcgttttctaagttttttcgtctttttaacttctcttaagttcttctaaccccatcacacccttcgtctaacccttttttttatcactgggaccaatcataaagaaagaaaacaaccaaaaaagttgattcctctagttcaattagattattcgaaatttagaaactaaagaaaacaattttctactcttagaactaaaatgtaaccgggactaaaatttactctaagagcctgtccaacgcgggactttaaacaagggctctaggttttataggattaaaattaaatcaaaatacctaatattggagagggacgccccttgtttaagaggtttaagcacttggaaggggccctgacgtgtcaacatctcagtggctgagctactttaacaaaataaaaaaatgtgtctctctctcttcctctgaaactattcggtttttctcgactggattatgagaaggaatgcagctgaatacatgatgacataaggagaggaactagttctagcttggcttggttttaagtttgtctgaaacaaacatacaatgtctctttggtctttaccattgttaatgatttattgttaaggccccaaaataggggtttaccattggaggaataaaaaaatagagtcttctcataaggctctgaactttgaattgtgcaaaatttataactaaaatattgtaaagagcccccatgttcttcctcttccatgtgaaagaacgattctattaatataaataacattaaaggcccgtgcgtagcgtgggtcaactactagttcattgtaaatagtagttatttgaacaagttcattaataatagcaaaattattataagcacgccacatcatatatacttttattttcagattattagaatgatgattgaccatcttccctttaaaattcacagccaagagacacatgacgatacacccaaaatcaaatcactaatattcacaaaacacttcaacacagtgagagagattgagctcaaaatttatccaaaaatcctaaaatg

SEQ ID NO: 2137 - DNA, 3000 bp, Unknown
  misc_feature (1)..( 3000): cDNA_ID_3066096_gDNA_ID_1620492_Annot_ID_158643 3000 nt of promoter + ATG
acttccaagactatgactatatgtgagtcttcaagcatctctcagtcacttggatgatgctcaaagcacctataaggttgtctatcagttttcaagcatctctgagtcaatcaaatgttacttaaagcacatttaatgttgtatgttggtccttattcctaagtcagccatgtattgctcaaaagtacctcacacatcttccatacaattgaatatacctcaagcatttctggagctatttgtcagatgctccagcaccttcttctatacgagcagtttttgcacacggcctttgcaagaccgttagtcggtcttcaaccaccctagtcaggtcattgcctaaagtacctcccatctttattgtcatttccgaaaacactttctagtcaatttgttaccactcaaggcacttctcatctcgtctttcactagttaaagcatttccaatgtaagtcgatgctcaaggcgtctctctatcagcccgacaacatccaagccgcctcctactaggaatcatggcaagctatctccatcatatgttgccaacaaaagtacactccacactccacactccaaaagtgttggtcttctactcttctttgctccttcgagaaatcaaataagttaatttcttcattatttcatggttgccgacatgactttccaaatacgtgtattaaccgcaataaataaatagttcttataaaaagtaagatgacgtgtcatgtattgctcatcaataaagtaacgctttttcattttatttccattgaccgacacaacaaacaacacgttctctctcatttttcttcttctccgatcaatctagggtttactctcaccggcgacgaacaatgatccacctcctttacacagtgatcttcgccgaaatggcactgatccttctcctcctcttcaaaactcctctccgaaagctaatcatcctcaccttcgatcgaatcaaacgtggccgtggtcccgtcgtcgtcaaaaccataggaaccaccgtattcgtcgttctcttgtcgagtatctacagtttggttaatatccaacgccgatctgaagatggtgctgttcttaatcccactgatcaagtccttgcgtctaagcatcttctcgaagcttctcttatgggtataaatcacaaaatcctcgatctcttaaatccttgatcataagatctgatatgaatttgatttgctttttgaagaattgtgatgtttctcttaaatcagtaattaaggatgtaattagatcaaattttgatccttagtgttgttcccttattcgatttccaaggaagtagatttattgggattaaggagtgtaatttaggtcaaattgggattagaagacgaattagatattgattgagattatatatttgaggaattgtgttgttcatctcttaaaatcagtaattaaggaggtatttagagcaaattgtgatccttattagttatgtagatctgattatatgaatctgatattggttattgaattttgtatattacagggtttgtgttgtttctctcgcttatgattgatagactacaccattacattagagagcttcgtttgttgaggaagacaatggagactgcaaagaagcagaacagaggttttgaggatgggaaaaccacaagtggggaggaagtgaaagcgctcggggaagagatcgcggcgttaaaagcgaagataaagacgttagaatcggagagtgaaagtaaaggcaaagaattgaaaggtgcacaaggtgaaacagaggctttgagaaagcaagctgatgggtttcttatggagtatgataggttgcttgaggataatcagaatttgaggaaccagttggagtctattgggcatagtcctgagggaaagaagggtatgtaagagtaaaaactaaggattctgttttgtagagaacaaagtaactataggaaatgtggttttactgatttttgcttcatgtaatatgcaatatcgtctcctcttttgaatgtattttactattatattgcaatctagtaagtttggaacaacatgattcacctaagttttccattagagaaaatgagtgcgaacaaagaggaaggaggtatggtaatgttttacaatcaagaacacaagaacaaaccctagatattcttgaggaattctcttattctcccactaatctgttttctctctttcatattaatactgttcaagtgccagtcacattatctctgatgatttaacctctcaaactaagcaacacagtccacaatgactcaaaaggattgaaacatgttttagtaagaaagcatgaagttttaataccttgcagaagttaaacaccaaatcaatctcacaaacattgctgaagaaatgatccaaaatctcaacgaacaaatggatgcatttaaggtaagccaactcattattcaacgggcatagcgtctatatatcaccttaatgtcttctaaactgcaaaacagttcaaaacaaaaagtcactaatacaagaaaatgattcaaatcccgaatcggctttgatttcttggatctcaaggcctacactagttgattttgttcaacaactattcctccaaaatctcagcctaagtatagaatgagaccaatatgatacatagagtacatagtgtaacgaccagacttttgaatcgaaccgtgaagcccaaaccgagctcattggtttcttatattgaattgtatattgttacttgtatttagtttttttttgtttaatattaaaacgtttaatagaaaccattaaatttaagttttgtaaaatatttatttgtgaaaaatttaattaccattaaatataacgttaattttatttgtatttttttttaaagttactttgtgattttgatatcctatataaaggttagataacttcatttttcaaataataaatacaaatcattttttcttccaatttgtttcgtaaaataaaaatatttcttgtatatttcaatcataagtagatatg

SEQ ID NO: 2138 - DNA, 3000 bp, Unknown
  misc_feature (1)..( 3000): cDNA_ID_2151571_gDNA_ID_1620493_Annot_ID_158660 3000 nt of promoter + ATG
gtgtaagttttttgagcttttggtttgcaagtgtggtgccaaaggaatgttttctttttggaaaaaaaagaaaaaaaatcaagtatagatgttctactttcttttgctcttatggtttagtgaattgaaactgaaaattacaagtgttcattggtctgaaatcttggtttgcatcactatgatgtctttaggtgtagcaattaaagggaaatgaattttaatatgttgcatcatgtctttaggaagatatagaaaacaagatagaagtcgcagatgctttggcgactaaacttttacagaggtttaaccactctgtttctgcaatgaggacaactgcccagcatttatctcaaggtaattattgtagcgtagattaagatagagatggatttgccactggactgcattatccactgatcttatatatgtggaacatatttctagttcatggtttgcaggtggagctcggggagcttaaaggaagattgacagaggtgatcagcaactgcgatacattatgtaagagaattaattctgagggacctgaatctctgaggtccacagtggcgcctttttctcttgcatctcccgattcggtcagtataaatactactacaactctgtcttctaaacccgaggcataagagtaaatactcttaatggtagttagattggtgaatcgaatacgtgtagttctacagcatactttctgatctcctctgattttgcatagatgcatgatgatgctattgattgatctttttgttacaaatcattgttttcttttgtcatttcatctttaggcttttcgatttgtacaatcgcttgtgaccagtaagaaaccattgttctgataaggggaaaattcatatgtaataaatatgctttgtttgccttttgatacaaaatccacaatggacgattggcagtgtatggagttgaacaacttgaaacaacgaaagagaacaacaacaaatgaaacaaaattacatttcaatgaaaaagcagataatgattactcttctttgccacctccccatatcaaggttgctgctgagcgtccatgtaaccagcgtcggcgagcactttctccctcttggccagctcaaggtcttcgtccaccatcatcttcaccagcttctcgaaccctacttttggcttccaccccaacatttcctttgccttgcttgcgtctcctttcagattgtcgacctccgtgggccggaagtaccttttgtcgatctcgacatggtctttccagttgagccccacgtacccgaaagacacgtccagaaactccttgacggtgtgtgattcctcagttgcaaccacatagtcatctggtttctcctgctgcagcatcagccacattgcttccacgtagtctcctgcgaaaccccagtctcttgaagcctgtatatttcccaggaagagcttggtctgcaatccgaccttgatccttcccaaggcccgagtgattttccgagtcacgaagttctcgcctctgcgaggtgactcgtggttgaagaggattccgttgcaggcgtacagaccgtaggcctctcggtaattgactgtgtaccaatgagcagcgcatttggacgcagcgtagggagatctcggatggaagggcgtggtctctgactgcggaggaggagttgacccgaacatctccgaagagccagcctggtagtacttgatggcgcggccattgtcaatgttgtgagatctgacagcctccaggagacgaagagctccagtagcgacaacgtcagcagtgtaatcagggatctcgaaggagacggcaacgtgggactgagcagcaaggttgtagacctcgtcaggcttgatgacgtcgagccaacggcggagggaggaggcatcagagagatcaccgtagtggagcttcatgagagctttgttgacgttgtggggatcaacgtagatatggttgagtcgctgagtgttaaaattggaggatcgtcggatgaggccgtgaacttcgtagcctttctcgagcaggaactcggtcaggtaagatccatcttggccagtgattccggtgaccagtgcaatcttcctcggcttcacaatgtcggaatcgccattgagagatctggaggccattgatgggtgggtgcagagtcagatcggatcagaagaaatgattgggcacgtcgcgctttctgtttttgattttagcgtcaactgattcgatgacttatatataataaagcccaaggacgaagaagacagagagagagggttacttctgtaaactttaaaggtgaatctgtatggctacgtaaagttgtacttgtatggcaaatcgccggcaagcgttgaccgattacgaatattttactatctattgggccaagatgggctttaaattactgctaattttattgggcttatatatatatatagctctacgggttgcgttcagactaaacatcattgtggactttagtaatttgccttaagttaacccatttagttatattatactcggccttataataaccattgatttttttttttccccacacgatctcaacttgcatgtcctatttattagattcaaaattcaaaaatgaaagcgtaaaaataaaaaacacgtaacgttaaaaggagtaattgtgaatattaaaagaatatgagtggtggaaattaaatcggtgaaagtaataaaaaaaacgattaggaatgggagccaatcagcgcctctctatttgatagtatttatttttctccactgggaaagtcaaaaagtcataaaaagtgtggttagggttttctctctctctgttctatctctcccacagaacacaaaacgtatcgccgacgcctctcttcttattcatatctgtctttctcattgtcgagtttggtctaacatctgatttctcgtttcgtatagaatctgagaaagtggttagtgaatagactttagaaagagtttgcgattgaatttttgtaagagaaatagtaatgatg

SEQ ID NO: 2139 - DNA, 3000 bp, Unknown
  misc_feature (1)..( 3000): cDNA_ID_2151611_gDNA_ID_1620493_Annot_ID_158672 3000 nt of promoter + ATG
atttcagttgtttcagaatatcaaactacagacaaagtaaaaaactgaagatagttcatggatttttccaaaaggatatggagagttgactaataagaagaggggcactatagtcatttcctagtggaaatacccactgttgtgtaaaagagagaatacatttaatgaaagtgaggttgtaaaaaatacatgtatttatgaaatggatgaaagttattgttgacataaacaatcagcaaaatcatctatccaacctcttcaccgtattgtaaacaatgttaatgtgtatctatgaaatagagtataaaagacaactttaaatttgatctagaagctgtaaatttcagaaatcaatttggatgttttaatggttttcttgttatgacaatcttaatgtatgtgagggtttgtactttgttgaatgcaaaaattatgagtgactgaaatagaggagaagaaaattggggatagagttcgatgaatatatgcaatcatttaggaccgagaaattaagagagggagtgggcaaaagggacagtgacattctctcggattttattcttgtatataactaaattacaaatccataaattccaaatgtattggtaacatcgattatctttgcaaatagcaacaaactcgcataatgaaagactcaccatgagccaaaactattaaatttcttttattttggagtttgaatcttgaaattagtacaaatagaatagtcttttttttccaaaagaaaaggtttaaagtatcttctcgagcactgtgttcttcttttctttaagttttcagtgtcataatttatacaaatttaggtaaagttactaacattttcttaactatttaaccttccatttcatgtcctagcaatttttctaaaaacgttgaaattgtttccactaccttttctgccaaatatctgcacttcaaacgcatctagtcatctaccattctacttgaccccggtaccatcttttggagatttagaatgtatgttatgcccattatcaataagaaaacatggaaatgtggaaagaactttataaactagagaataaagaaaagtaagtttggagcatagtgtttgttggcttctaaatatcacttgtacacaattacacattattaccaataaagagaaaatcacttcttaatatatatttttcttacataggcagaaagagaagagtgtttactacaaaagaagcacgcactgatttgtttttttcactttcacccattcattgctcttctacactcttttaaatctctccttttctcttcaactttgaaactgaaaaaggacataaaagatttggtgggttatgtttcttttctttggagccaataacggagcttagagattcttgcaacttttttcccccttgcatcctcctttactcaatagtaatttatgtgtattctgtatctcttcacaaaataataaacaaagactgtctttcaccacaaaatctcttgagaagctgcaaagttgggtaaaacttaaatgaaatgtacacttttttatatactacatatccgttttcagaaatagatttcataaactatgtgttccatatggatcccatttcaccttcaaaggccccctttacatttatgtatattaatgattatatgtttctcattgctcaagagaagattgcatcattgaataaaggaagaaagaaaaaacatagagagtgatttggttcatgtgggtcccaaggaagtggagtcatggttcctccaaatgccatgctcatgctcatgctcatgcacatgcagagacgcgtatagtctttctaagctgatatatcaactgagttattagatgcgacaaaatctacttatataatccactcgacttactttaacccaaaatttcactaaaacaaacgtgaatcacataacaaactcgcaaaactcaaccaaaacagttttgctgttgtatgttgaaaaatggcaagatataactaagttgatagatcgggtgctcatgggttattgaaaatcccccacactagaaacgaagggtggtatcaaagttatagtatagaggctgctgtaaaaaaagtggaccactatttttcacgcctaattttcttaattactctattattgttaattccgaagttacaaaccctaaattataaggctagcctttatatttatagcatgttcttctgaagctgatacagttttcaacacatgtatccatcataggagaaataaaaacaccaaaagaaactgaatcgaattgtgacgctttttcatgtgataatacacattattttgttttttgtgtgtgtttattttgcttaattttaacattttcatatgagtaccatagggaattaatcaagaaaagagtggtgtgtgactgaggtgatataatgtaaagtagagagtgttgacagatgtcatgataatgaaaaaatcaactgaaagatatatatgtttacacaataaatcaaaatttggatggaagggacaaaaggaagcatatataccgtccgatcatgtagaaaagagatagcaattacaccgacgagaatagtaacttggcaacgtcatgctttcttttcaagattatatgaattttcaaactttatgttcttccaaataattagacgacttcatggctctcacgttaccatttgagtacgtagtccactagcgtggtccaaaattctatatccatcattttttgttctttttcttttattttacaatcaatcaatctatggatgtacatataagtaaaagtctacgccaattggatgattaagaattaagataagcgtcgtgaagaaataaaaaataattgggccttgggctaaaggaatatttgagaagcatataaacaattggcccacaaggccacaaggatctccttcaaacgctcggaagtttccgctttggattcctgtcaccggcgatttcgtgggatgataacgacgccgagctatatttcgtgactgaagcaaagtg

SEQ ID NO: 2140 - DNA, 3000 bp, Unknown
  misc_feature (1)..( 3000): cDNA_ID_3066136_gDNA_ID_1620493_Annot_ID_158664 3000 nt of promoter + ATG
tatttattacagatgtaaactggaataataagaaaagtcatcgatattgaaacagtatctgtcaaattcaaatgaacagtaatagtctaatagataatggtatcaactttcaaaatggaatcatgtagtcatattaagtacttaactatgatatttagaaatcagttcactgtttaaatgaacattagcacattattttctaaaagttttttttttttttttaaggtggtatctttgttattctggttgagttcttttatactaaggagaaaaaatggagtagagacaagccagtgtaccgaactcgcctaacttgttgactttagaagaatcgtacgacgtcaacgtgttttcggctttttcattcccaacggcttactttcgttggcacaccataatgggccttagcactaacccatcaacggaactatcaataatgggaggaggtgcttctgtaggccaactgtgtttttctggaacggctcaacgttgttgctgtaaatggcagggtaaaaaaaagccaacaaaaataactccgttacttttctactttcttttgattcacaaattcgttccatggacttaccattttgtgccattttccctctttgaacggcacactatttcttccgtttgttttgactcttttgggatgtgtgttttgcgattctctaatttcgtttatagaaaaaggaccgagtggctgggtctcatctgtgatctgtcggtgtactaaggcctatcttgtgggcttaattattaaaatatgggctttaatgagaagagccgacccatttgtgacgaggccctaaggtagaaaaaaaaagagagtaaaaggaagtagaagcgttgacttgtccgcatcatcatgtgacatctcataattgagagactgttaggttttgtccacatccacatcatgtgcatggccctctaatttattacatgtctatatctcccaaagatccactttgacgttaattttgtagtgtatatagtgtacactgtcacggaattatagaacgattttttcttttttaaaaagaatacccatcatgtaattaataaataatacaaattattgcattgctttcaatattaaacgatacaaaaaacacaagtctcttcaatacttcaactaccgaccacgatatagattagtattcatgcatgaaccaacatctgtatccaataaatcctaacttgaattaccctggtttagactctttttgtcaaaacaattgataaaacaacgaggcattaaaaaaaaaaaaattcaagtaactttcttaaactagtttggaaaaatgaaacccgtcattgttacattataatgcaaatgttaaagtgggcatcaaagctcttctttatgtaaatgtacttagggtgtaagtaagtaaaagagaagtgcacatgcattgcctcagcgatatagcattatttaaaggcacaaaaacggaacacccatgtgctgtgtgttttctgtttttctttttaaatttgtgtgtataattttttgtaagaaattattagtattaattataaggctataaatccttaacgatagataaatgaaaggaaaagtaatgttagttggtagaagaatcaagaatgaatcatattgcttgcaaaagcatattacaagtttcattgtgattgtgatgtgctactaagatcatcgataggtgattaggtcaagtagaaatgatgtaaattgccaatgagtcggtacaggaaaacgatgagctaattaatctgaggtaaatgttttggaaaaacaaaaatatttggttggaaaaagtttgggaatgtattaaacagatacagcgaaaggttgaaagatgcctagttaatggcagataggggtaaaaaggttgaaagatgcctagttaatggcaggtaggtacaaaataaataatatgagctttctttagcgcggcagtttccaagtcggagaaggctaataataataaatggaatgagagagcagagggaaggaggattttgccagattgcaaaaatctcacaacgatgacggtgcagaaaacgccattaacaacgattacaagagctgttgtgcatttccgattattgaaaggctgatttgtccacgaagagagagagagatactaggagaaattcgtcgcttcccctggatctccttcttggggtttatactttatagggcatccggagctacgcacgtcctctgaggtatgaaatttgtttgaatgccggctaattttacgcttccggatgtgtaatcgtcgaatttgaaggtccattgtgagtcattgtcccttttttataaatgattatcggctatcctcctctcctcacccaagcttagaggttcatgctatagcaaatgcatgtcacaatttccagatgattctgttttttattaaggggctaaatgtaatttggattgttgttgtttggaagcaggtaggtaggtgtctttgaaacaaggacgaataattcactgcacatgtgattccttgagagagccagatcgaactttctacagaagaggctgtgatatatcatcttcttaagtcctcccctcttcttcttcttcttctaaggtaattattcatttcattcattagtttttgttttgttttctagcaaatgcaattataatatttatagcctcttaattaggcaattgtaatttatgtaacaacactttgacagactgctcttataggggaccaattatctccatataactccaattcctctcctccttatatctttttttattatttgagcttgtgtttgtctctatctcagacacttctatgactaaggaatcttggttttctgactttgctttggaatttgactggactttccagctgcaatcattgacttgttgattacaattattcgtgtttgtctctcatattacagactttgcctctatctctctctctatatatatataatgttgttgtcattgtttcctttgtggtagaggtagggtagaagatg

SEQ ID NO: 2141 - DNA, 3000 bp, Unknown
  misc_feature (1)..( 3000): cDNA_ID_3594375_gDNA_ID_1620493_Annot_ID_158666 3000 nt of promoter + ATG
aatatgatttgggcccattttgtaggctggtggcccagttgatgattaggtcatatgaacagaacaatctcataaccaacaatatcgagctatgagaattctatatgcagattgcttgggctttacatgttgggtcatatttatagagcccatatgatacgataaacaaatgaaagtgatctcgtaggcccgtcttcaaaatgaaaacaacctaacaattaggctgtacaaatagaaaatgacaaaacaaaaggggtgttccttcataaaggaaatggcgccaccattcattcattcatttgggtttcatcaaaagtcaacactatgagtagatgacaacctcctctaatgtctcatacagtatattcttagttttcactttcggtacgtctttttagatagttttgattcctcaaactcgtttcatatacaaaagacaaataaaatttgcttttcttttatatttgaaaaaaaaaatcgtaatgcaagaaggtgagatagtttgaatagtctaccacggtcagtatgtgacaaaattgaatgattttcattttcccgctccaaggtttcgaatttgatatgttgtctcctttgctttctatgtcttaatgcataaaaccaaacaagtgtttcttatttacattaacaaatcgctgtcaattttgttttttctctatttttaatgaacaaattcatatcattggtggtacgatccattccatagaaaaaaatgggagatggaagattcaaaagtggctaacaattctcgtgggactttttagctcctctctctcacactctctgtcatagcttctcttactattcttcttcttcttcttcttcttcttaatttgacatttcaaaatttaaaagaaaaaaaaagtacaacaaacataaagaccccatatcaagaaacgcagctttgccgacggatacgtcgaggctagttttgtcatttaatatttagcattgttacaaaatatttatcttctcagattatccatttcattgacagaattagagtgatttatgaatatacgtgttttaatttaggcaagagtgtgatgattttccaccctaaataattgtgaaaacaaaacatcaatggattagccgtcggggaattctgattggtcgactcacgtcaaatgcatgagatacagccaaacagagcacggcacgtcagcattacacgtggctactacttctcaagccggcggctcggctccgaagaccttttccactttttttttttttttttttttatctcacctaaatttaaaactttcctaggattgcattttaatcctttaagattgagacaaaaatgtttaaaaatatttgtatgcacattttggaaataaagtatagccaattcattttgatgtataattacaacgatgcctttgtttggaagtcataatcatcacgcattttccaaatataggggggagatttccattgctctaaaattcaacagttttaaacaacatgcagattctgtatatgatacaaataaatgcaaaatgccaaaactattgttcaaccaaacaaacaattaaaattaaaggctaagcaatagtaatatttactccgaattggataatgctaactaataaaattttatccaccaactcaactaatagttaccaaaagattagaagagaatctacacaatttgaataataaggcagaaatttgtagaaagaagaaaagagaatctccaaagatatttttcttttatctattttgtctgaatggatattttttattttattttgtaaaatgaagaataatgttttttaatttgaaaggtttgaaggataatgtgagtgagggagaatcattttctcgtggtgtgttagaaggacaaaagctggcccgccatttgtcttcggtttctgcatcatctcagttcctcactttgcctttactccgaagacatgcttttctccattattactctttagggttattttcgttatttcaccttaatccaaattcacactgcttagtgctgcttacaataaaaatactttagtgttggggacatttaacttttttattctaaataaagcgttttaacttaaagatgtgaaatcaaaaaccaatgagcgggaagtattaatttcccaagatgagcggctaccaatgcggtcaagggcaaattaggaaagacacgtaactttttatttttatttttaaaaccaaatctttgaaaaataaaagaaaacgagtgaatatgattttaattcgaagctttaggaaagaaatactctgatgatgactgatgaagatcttattttatctctgtaattgaacagtgccgtttttttctactgatacataaaatttatagatttattgtcagttatttcctatcttaaaaaaaaaacactttttttttggttgcccttttttatgttttaaaagaaagaaagagagagagtaaaaagcgtttcttctagagataagaaaaagaggagtttttagtagccaagggagaggctgagattaccaaattgaatgctttaccaaactcacataaccatctcttcttgacccttttctttaatctttaatctctttcttcttcttcttcttcttcttcttctcgccaccgctccttcctccctccttctctctgtatcaggtactttttcctaattcctgtccaattttagggttttcttttaagggtttcgtatgtctcttttcatgttcttttgaatttgcttcgttcgttgcgttttcatttcagtctcgtgactgactctgtttgtgggtcgttttcgtaattgagtttccccggtcgtcttttttttttggggttcgtgattttttttattccttctctctctcttggaattgcgaaaaagaggaacgtttttttttacgtttcgtttgaaaaagaatgtgaataaattggacataagtattgaattctttttttcattttttttctggttgttgtttagtttttttctcgataggaaaatg

SEQ ID NO: 2142 - DNA, 3000 bp, Unknown
  misc_feature (1)..( 3000): cDNA_ID_2992143_gDNA_ID_1620494_Annot_ID_158682 3000 nt of promoter + ATG
atcacaaaaggaaggggaagctagtcagcagcatgagatccctgctgggacttaccatcacccagaagcatcaacagtttccaatactacaaagtccatgcaaccagatatgcaggcagttagtgttgctcaatctcataccgagacagctggctatcctacaccggcacatggtgaagcttcacaaccacctgctggagcaattggttacacacaccaacctcaaagtgtagcgggtaattatagcacgcattcacagcctgggaatgtggaagaaagtacacaatcatatgctggaacagatagttactcacaacagcaatattatgcagctatggggcctactactcaactccatgctggtggatatattcaaaaacctcatgaaattgggtactctcagcaacctcatgatgcggcaaccgggtactctcagcaacctcatgatgcagcaaccgggtactctcagcaacctcatgatgcagcaaccgggtactctcagcaacctcatgccgcatcaaccgggtactctcagcaaacctatgctgcagcaaccgggtacactcagcaaccccatgcggcggcagccgggtacactcagcaaccccatgcggcggcaaccgggtattctcagcaaccccatgctgcagctaccgcgcacgctcagcaaccctatgctgcagcgaccgcgcacgctcagcaactccatgctgtagctactgggtatgctctgcaactccatgctgcagctaccgggtacgctcagcaaccccatgctgccgcaactgggtatgctttgcaaccacatgctcaagctgttgaatacacaatgcaaccacatgctcaagctgttggctacatgccgcaataccatgctcacgctgttgtatacagtcaacaaggtgtgacgcaaggttctgtaccaagggctcctgggacaactgattgtaatgctgcaaaccaggcatattctgcaacaggagattggaatgcagtgcatcagtcttattaccctcagacagcagatgcaaccacaacgtattatcaaacatcttaaaacgttaaagcaaagtgttgctactctggtatgccaaagaggattctgttaagtctcgtgtatttaaagcattgtttcggttcaggtgagaaacgatttgctgaaaacctatttgcattggtattgcaggatctgagaaacttgtgcgtgatgggtgcggaagcatggactcgaactggtgcactcagtggaaaagaaggtcaaggacataaaactagagtctccagctccgtttactgtaagtttaaaagttctatgttacggtttgatcatattcatttctgagctgcgcatgaggaaattcctcaaaccatcaaaacttctttaagtcccgtttcaggagtgcaatctgaaatgcaattctgattgggatttaaagttaataaaacatattataactctgttatcattacttatgctaaaacatttcttttagtatggtcatgtttaatacttgggatttgctattaagaatactaccttcaaaaaggttcatcttaaacactctctcaaacgaaacctagggaccaagaatatgcttattggctctaagattaagtggcctaaaccctaagccatatctattggtagacaaaaaagaaaagaaaagactcctaagtctcccactatgtatgtttgagcacttgcactgcaattcacatgttctttgttttttctctttctctttcaaaaaaactttttatctatttctttcttctccaataaaaaagattttaaaagacacctatctcactctttccacctactttgttttgtttgctacagaatttacttaaggctctggtcttgccctcttgtttctttttttttgggtcaagggtcccgtatgtttacagctttgttggttgtgtcacagatcatcaaaatattattgacgaaggaaaaaatactgaaattgggaaaaacatgatcagatccaactctctgaattgtctcgaggtctttttaattggaattgaaaaatgcaaattttcctgataaatttggagttaacgttggcttctttcaatagatgtctattatattatctttatccactttttgaaagttatagtccccatctatcatcatttactgatatgatctgtgggatttttttctacaaaatttctgagttgtgtgaaccttacgatttgtgttaaagataaacaaagtatgacctccatggtaataaactactaattatctttgtaaaatgttctcacgtgaaactctctcactatttcctattgctcactttatgtccccatagcaacaacgacttgtactcgtctgaaaatttctcaaatttcatgtaaataataataataaaaaaattattacaattcttcgctaaaagcatcacagatccagttggcaaaaagaattatatatatactattagtgcattgcaaataaaattattaaagaccaactgtttgtcatataaaatattataaaggatttcatagataatatgtatttgatataacaattataatcgataacaatattctgatattgtaagctggaaagattatgtcacagaagttaattgctctaattaaatatgtctgaggttaatctgatattgaccaacacgtcgtttactacaataaatacaaaaaaaaaaaagagagcgaatttctcagaaaacagcttaacgtttcttggatatttcgtaagtcaatattaatcaaatgaaaacaaacaaaaaaaacctatataagaaggagacgctgtaaaacagagcgagtcaattaaaagaaaagaaaaagcgcgacttagacaagtgggtcccatttactgctctcccagattatcattttcttctgaatcttcttcttcttccgaaattcctcacaaaaaaatgtttgtctctgttgttcgatccaggtacttttgaatccgcagttttttttgttgggaaatcaaaaattatg

SEQ ID NO: 2143 - DNA, 3000 bp, Unknown
  misc_feature (1)..( 3000): cDNA_ID_2151461_gDNA_ID_1620494_Annot_ID_158685 3000 nt of promoter + ATG
accgatatcacttaggtttatccgatatatcttatgtaaaatatttttcagagaagcaaatagagaaattagaacttcaaagacctttttgcttctatctctcctcttctttgattgtggcttctcctttgattgtggcttctccttcgattgtagcttctccttctccaactcgtttaaaagatctgcttctgctgcatctgacttggctttggattccatattcacaatttcgttctggatgagaagagacataataacatatgagaaacaatttaaaggcaaaatttgacggataataaaatctctctgtatataacagtttcaaaccaaccagcaagaaaggtttaagcagttgaaggatataagtgcggttgtcaaaagcagaaagccttgtgaggttgtttagcaaactcatccttgaattatcaatcagcaagatctttgtatccattaaaagaacctgcaagtcatatagacacttttagatggacaatttcatgttattctgttgttaatgaatattaaaagatgaaccttttgggtgaccactgatttcagaaggtctatggcctgcaacactttatcgtcactgagacttttgtgctcacgtataaaattcaagcaatcttctaaatcgaggaaatcaagtgttggatgcaatgctccttcgaaaacatcccgtactgcacacacgaataattttgtagttagggaattttcggggactctctcttcacacacatcgcatagaagagatgcatatctgctccattgatcttccggcagattccttctcctttcattttctctcacacacatgttctcgacatcagtaagagctgcatcatagtccacgacctgtaatttctttgcatatttgtttcccagagtcctacaggtgaacttaacagctttcagaacagccaaccagatatcaagattgtgttccctgataggtctgggaaaggtcttatctactgaattgtagtcagttaaccaggatatgatatcatctccatgaactggtgtcttggcgtagtgaacactgggatcaaaaacattgatcgtcccttcatcatcatcgaattgatcatcattgattttcagcagtcttttatctagaagcagaaatgaaaactgagggtcaaagtcgatcttttctttaactcgagtacgacccaagacactgtccactgctctgcaaacaagatctgtaccatcattccttttacatttgatgtggtttagaaactcaaggatttgagtgagttcctgactttctagaaaacagatactatgaggtgtttctactaagcgagaatcgacaagactctgttcagaaacttcaagttttccaagatgcttagctggaaaacacatcatccagtctcgaatgctacaagagagaattttaaggtcgcaaaaagagacaaggagcaatttgatttccttgagtaacttactgcgctcttcatccacagctaaaggccattctttggaccatccattcttagctttagatgcaaacgctttcacatctgcgagctggttcttgatcatttcagtggcagcgactgcatccactggttcccaacttccaactattatcttacgaacccagtcttttcctatcctcttgactatatccttttctgaagaaggtttgaaatctgcagcatgttgttgttcaagatgattcttacattcttcagcactagagaacttcctcgaacacaaagttcggcatatccagaatttccattctctgtcttcctttgccgaagtgagaaccttctctaaaacttctcgttcctctttgtaatgtcctactccctcaacaaaacttgtaagctttgcaatgcttactttcataaaatcccttttgatcttgacatccaatcccacccagtacgacctcaatcctttaaacgcatcctcacgcgggtcttgacttttctttgactccacaacttttggtttagtgttttttacagtagaaccaactagagtcttggaagatgcgatctcggactctgcgtcattgattaaactcaacagtgctttattttttttgtccaattctctttgcgcttgcaaactcagttgagcaacagaatctgacttgcttgggagagagttaacagataaaccttgtttcgctttcttcaaagacttcttgtaatacaatactgacccaagcatttggcccaacaggaagagtgaactagcacaaattggtgataacgtaccatcttccgagaagcattcagcagaagccaaaaagtaagcaaatttcacgtcaggatcctctgttttcttcgctaggtcatcaaacattttaccttctctgatatgaagacgccatgcggttatatcttccccatggactaaaatcaaatcttcaattatctccaaagccttgatgtgatctccattatcaaagagtttttgagcatcttcaaggagttgtgctccctcatcatcttccatgaaagaagaatccatagtaaacgaaacgattctcaagattcttttgctttctttttctctagggtttttcttcttcggagagaaatctgaatcgcgagaagaagcagagtcgacgcggggaaactcaaacgaaagtaactgactaatgacagcaaggcaccgtatcatcacgtgaaagacacgtgacaaggcttgatagcaaaacagagacacaattttgatcattggggaattctatcaaacaccttgtgtgcattacccgtttgagaatttcccggaataaatcatcaaaataatgagtgaaaatcttcaaatctagctcaataattgaatctagaatcgtcttcatgttgggtatgaacaaaaattcgaacttgaaaagatcagcaacaagagagagattcgacaaatcaagtgaaagaaataaaaaagtttttttcatttatttactccactaccactaataaagataaatactaaagctttggtttgagacaaaaaaaaatg

SEQ ID NO: 2144 - DNA, 3000 bp, Unknown
  misc_feature (1)..( 3000): cDNA_ID_3066165_gDNA_ID_1620494_Annot_ID_158688 3000 nt of promoter + ATG
atgagcttaaccgaacattctaaattggtgggttaccgagcattttaatcggattaaaccgacttgaactggtatgatgaaaaccttcattgaaggaattggacacgttgcttacgagggggaaaccaaaacgttactccagttaaataatggcagaagtattttttgattgaatgtgatcattatttaaatgatactactataaaatgtgtaaaagaaacttgtaatgaagccaaacaaggccaaacagaatcattacgaagtggaagtataaaatgacgtaaggtctgaccaaccggtttctatatatctcagattttcaaaaatggtttttgtttcatccaatactaaaggcagtgtacttaaattcaatggaataaaagattgcattgtccgacggagatcccaacacaaaacacttgatgaatctttaagctaaacaagtaaacatttatatactctatagagtagaatacataaatagtaagtaacatttaatatggatcacataaactaattcaaagataagaagctgcagtttttgtaaaatacattcacagacgagatatcgtacacgacactcaccttcagccacatttcacggccgattggctagctacgtgaatgcatttccattctattcctttttttttttttcttcctatttttgcatgttaacttgagacaaaaagatgaatacatgcattaatgttggataactattttttttatagtccaataccagtctccgatatttataccatcttttaaaaacgttttattttagatcatcttttgatatttccattaagtagttcgaacctagtcatgctaaatctgataatatggagagatttaaccatcaaacaaatcaacttcacttgaagtcttcaatagatgctagctgattattattagtatttagtagtttatttttgttatggcgccattcattagattgtactacaaacttgtaagaatataaaagtgagacttgacttgagaggtagggaaaacaacaaaacaagaatgataaagacagtgaatatagaagtaaaagcaatgattcaatctcgtcaataataaaaaaaaactaatgaatgaaaatagcgtttataagatataatcttgaatcaaccaaccaaacattatctacaaagattattcaatgaccagatgaagatttatttctcggtaacttatttagcaacataagtatcttttttttttttggaacaaacataagatctatttatatctcaaacaaatgtgaccatatataattgttataataagatttctttttgggtttaaaaaataaaatcacattttcaaattttatttttgcaaagagtaaagaaaccttaaaacaactagtaccaaacatctttcttaaactctaactaatataggattaatgttctttttgcatttaaaatcatgtacgagactaaaacataagcaaaaatgtgtcaactaaaaatgtcaactatatcaataacattaaaacaaccttttaatactattttcttccataatactaagatttgaaattctaactttaatttgtgcaagtaaagttttgtagataaagcaaatgaatcacatgtttaaaaagaaaaccaaatggtccattgttttcatagccggctactttggttattagccgggactcgacgacttgccgtcgagactctcgtgtgagtccgtaattatttattcttcaactaaaatcaataaactattgagttataatcataatcgaatggtccagattcaagctcataccataccactaaatccatggtacatacaacgtagcagagtccttctctccttccttccctcttttgttttttcctctccctctcattttttttgttctctaaaccaactaaccgcaaaaaccaaaaaaaccccccaaaaaaataaaaatctctctctcctctccgtttctctctctgtcggagggagtgccggaatcgcgcgtcgacgggaagaatatcgccggaaaagctcaaaaatcatcgccggtcgcacgaattattcgttggaaacaacgcgtcgtgagaggaggggaaattcgaaaagagaaagaaaaaaaattgaaaacgccgattcactttttttatatatataatataaaaaatttcttttacggaattaaatattctgtgatggatgcgattggatagaaggaaacaaaaaggaaaggaggaagataaaagagagaagaaggaattattctcttctctcttctctttcatctctgtctacatcgctgtttttttttttcttcaaggatcgtgatacctgaagaagaagaaggtaaaaaataagagttaacgagatccactgtttgttgaaaatctggtttgaatttgtttaagaggaagcataattgtgtttgtttgtgattaggtaagttttcttatttttttggtagctggtggtgattagggtttttatttttatggtttaataatttggaaatggtttaattccgtgccgaatttgtgaattaggtaagagttggttcgctgtttgattataatgagctgcacaaggatccggtattaggcgaattctactcttattgcttctggatgtacctaatcgtctcttctagatatttctatgagcttaaaatgcagcgatttgatatgttttgcctctctagtggttgaagttgctaactttgttttatccttggacttcgcgtaattctagtagaaatcttctgtttctctacttttgtagttcttttgcttgatttttttggcttgtacgtgagtaattgagcacttttatgtgtcgtttttgcaagatcttcctcgcaattgagaaatgcattttgtttatgtagacactggttttgacttgaccacttttttttttttttttcaggttttttcaggggaagtgatatggttcgttgaaataagtttaaagttttaaaagattttgattctggttttattagtcaaattttgtaagatg

SEQ ID NO: 2145 - DNA, 3000 bp, Unknown
  misc_feature (1)..( 3000): cDNA_ID_3066159_gDNA_ID_1620494_Annot_ID_158690 3000 nt of promoter + ATG
tctgtgaatgtattttacaaaaactgcagcttcttatctttgaattagtttatgtgatccatattaaatgttacttactatttatgtattctactctatagagtatataaatgtttacttgtttagcttaaagattcatcaagtgttttgtgttgggatctccgtcggacaatgcaatcttttattccattgaatttaagtacactgcctttagtattggatgaaacaaaaaccatttttgaaaatctgagatatatagaaaccggttggtcagaccttacgtcattttatacttccacttcgtaatgattctgtttggccttgtttggcttcattacaagtttcttttacacattttatagtagtatcatttaaataatgatcacattcaatcaaaaaatacttctgccattatttaactggagtaacgttttggtttccccctcgtaagcaacgtgtccaattccttcaatgaaggttttcatcataccagttcaagtcggtttaatccgattaaaatgctcggtaacccaccaatttagaatgttcggttaagctcatagggctaagtatggcaaaatttaacgagaattctcaaacaagatcgaaactgaattcaaatatttatattgtaaaacgaaaatttacttaaaaacaattagatcaatccaactagtcacaacattcatatttctagcttaaatttcttttggcaaatatcaagaagtggtgatctagtagtagatcatatatagtcctttttgaaaagggttgaaacattgtatttataatttgatatttgttttaaaaggattactttactgtaactttaatttccgtttaaaagattgtgtggactccattcaaaagatttcaaataacaaaaaattgcttcttttagttcgattatgcttgcttactaaataatacaactagacaattagttagaacgtaaatccaaacttattaggggcttaaggccaatccaaaaacgaaaaataatggaaattaacaaaataaaataaaagtggtccaataatgtttcttaaaatagttagagttagaaaatctcaagaacaggattagagaaaatttctattctagtattagtcggccaagccaagctgagctgacaaaaaataagccgagcgtgagagtggcgtgagagagagggtcactgtccgctattttaaatgctgggcgctgcgtgaaggattagaaaagcatttattcttaaaagatgctcttctcaacgtaatccacgtgtcaacttaccattagtttacacatcaaaagctgaccagcaaatcccaggatgggctgtgatcacctacttactcctccatctaaaatctctgtgcaccttttctcccacgagccgttggattcatccaaattacgtgtgcaacactcacttttaagacgatgttagccgtatttaaccgaacctaaccggcgctgaaccgtcttccagttttgctaatcaacaagcgagatttgattatataattaaaaagcctttgttatagacttagtagtgtcacgctggtctcacatgcctattgcctacatgcttggaagtttgaaaatctttaatcatttatttatatgatacttaagttaacatctaaagatattcaaaacttgagaatgaaatcattgctaagagaataatttattttctgaaatactattcttactatgttaaatattttaattctttcaagtacattgtaatgctactagatactttgcctagcaaaatagttttatattttatctgttgtaaattgtatcaatatacactaactttcattaagaattacagacataaataaacacaccaaattttagtttttgagagtcaaactatatatgaaatatcgctgcagtggaaattgtataatatttgatttaaccggcttgaatgattcagaactaataccatggaaatataaatagtataagagagacttcacgtgctaaatcttgaagaagacgattggacagaacaataagacagaagcaataaccaatggaattatggaacatcatataataaacttttttaataatcatttggataattaaacaaatagtattataatcatttttgaattatttggttgttaatatggtccacgcggtctcttctccagatcccgttatctgttctaagatttccgtcggtctatttatttattatctttaattttcagtatcaattaataccttaacataaattattattccatgctattttcctaatttctacaataattgataacaaatcttatggtttaaattaaagctgactttataattattacgtcaaatgtataaggtttaccaaccacttatctatatgtgttgaaaatattaaacagctaataagtctacggatatgtgtagtttttgcctttctagtattatcaaaggtggatatgtatagttttaagatgagtacatataagttcatataaatttatgtagttgtgtttttacatgattgtaaactttttgtatacttctaaacaatttttccaaaaaataagtatatcccaaaataaattcgttgcgcaaatggaaaataagcccgagaggctgacattaaatgggcctggtcctaagaggcccatatatacccagattaatctggacttgcttaccaaaaccccaaaacctcaaatttcttcgtcacccacccgtttcgtttctaagtctctcgtccttttcttttaaccacactccttgcttgagattcaatcgaaaactgaaattcgcaagcctccactgctcgccgtcgcactcatcggaatattccattggcaccgtactaccctgaaatcatctcatcagatcaaaagtatggaattagttgagctcaatttctattgtttggtttttatgaatccctcaatttaaatatcgcgtggtgatttatttttcttcttttggtgtgtttcttcagcgggagtttaactagaattgcgtggatta

SEQ ID NO: 2146 - DNA, 3000 bp, Unknown
  misc_feature (1)..( 3000): cDNA_ID_3066169_gDNA_ID_1620494_Annot_ID_158687 3000 nt of promoter + ATG
tagaagcaaaaaggtctttgaagttctaatttctctatttgcttctctgaaaaatattttacataagatatatcggataaacctaagtgatatcggttttaagttctcggaacaagtcaataacgtcttcctatcttatagggatatcatatcttctatgtagatatcgtttccttacttgtaggattccatggtttgtgtatatactacttgtgagattgattgatcttcttggcgaaacagaaaccttcaacgagcatatctagttcccttgataagactgttgaacagtaagtacctcaatggccagtttcgcatgttataaattgttttcgcgttttctctgaccaaaacgttttcttacatgtacagtaaaccttctgtcaaccttaaaccggagagtacatcttcatcactaagaacgatcgaagaaggttctatggaaccagaagatgctcttgcaagtgagacgggtcaattgaaaatttcatccaaaactgaaattcaagtggaagctactaaagatgaccctggtagttaaaagcttctcgatttgagcaataatttgaattatattcttgtgaggttcataacttcttatttctttcattgaccattttaaagatatgcgaaacatgcctggagaagattcactgtcggaacatttggagtcagtagctggagaagctacaaccagatacaattcagcatttgacatgacgctgaaggtaaagcaattatcaatcaaaacaagattcaatacctgaactctcatcttttgattccttattctttttgagaagttcacaaaaacatgtggtattgcaggccctcttgaacattaaggttctcaaagaagatttgctgaaccaaccatttcaagaccaccaggaagaacaagttcctattgcactacaaaatttatttactgctgttgtttcagaagcgatacaagatgagggtgtctacagttgcctcttgagggacttacttacttcccaagaagaagttatttccatggttcgtgtggagaagatatgcttctaagcattattttgttaattgtttgttgtcattaatcttatttaatatcctaaaggtattctatttttttgctctttgcagtcaagtgatgctgctaatgtagtagtagccatccttgatttttggcgttgctggaaaaatccagaaagggagagcttggtaactcgcctctttacctcggcggaaaataaaagaatgagttgtataaaatgcagaaggattacaaattatccacagcaaagttgttatggcattgttacggcagcagatacaatcagagaactgaaggtatttatcatttatcatcctcgttgtctttccagcagaaactgcaggtacttccccttatatagttgttttgtgcttaaacacatgcagtgtgctttggggaatagaaattttgtagatatcctaaaggtgatccgcttgagatataaaatggtatgtgacgcagaaggttgcggaaagacgaactctgttcagcacatttcaagtagatgcccgcctatcttcacaatcggtaaggttttgacccccatgattgtgatgttttttttgtactcatatcatatatttatgttggtgttttgtgggtttgcaacatcagtattggaatgggagaatagtgcaactgaaaacgaaatatctgaaacaacaaaggcttttgactgggagatagatatcagcaggctgtacgaagaaggcttagcaccaaacactaagtacaggcttgtgtcaatggtaaaacatctgaaacagggtcatatatgtttgtgctattgttcttttgtatttcttagttacagtgtaagaatatctgggatgtgatccaggttggttacagtgaaggagatgaagaacacatatgcttagcttatgaagaaaaccggtgggtcaatctcagacgtgagtgtatagcaggagaggtaagtcgaaacagttaccttttgtctacctcagaattgtatagtgaatttagataaggtagacatgaatgattgatatatgtgtggtgatggcataggatgttggtgactggaagaatgtggtcagattctgtggagagaggaaggttcggccagagattctgctttacgaagctgcctgatcgatggcctaacaagtgacaatgtggagaagtctagcattgatgtttccatctaccagaagacacttttttatctttgctttggttttttttttgatgagatcgatgtgatccaagtataactacggtacctcttaattcactatcacttgagtcttaagagtgttgttacacaagatagaaaacatagagagcgagaaaaaaaagattgaaagaaaatgcagagcttgagctaaacgtcttatagcgattacctcaaacgacatcgcttaacatcatcaatagatacaaccacttaaccggctcggttatctttctggttcgtttaaatccccgaatactccgagcgagttagagtctttccttcaacggcaaaaccaaaacctctcaagagttccttttattgttttttcaacatcactctccattttttgtaaaaataaaaatatctaatttttcttgtgtggctctccaaacattttcacgaatgttgttcatcatcaacatgaagaccattccacattcaattcttaacccatattcgaagattcactcaatttttgggtctttttttgatttttttattccgagaaaatcccaaacggataatgcacacaaggtgttcgacaaaattccccaatactcaaaattgtgggtctctctctgtttgtttaaggcttgtgtcacgtggctctcacgtgatataaaaagccagcctcttcttcttcagtaccttacggttataatcgttgattgttcccgcctctactctcacaaatctctctgaatcatcgtgatccacaaaacaaaaccttcgagagcaagaatcatcgtgaagaatcgttact

SEQ ID NO: 2147 - DNA, 3000 bp, Unknown
  misc_feature (1)..( 3000): cDNA_ID_2151453_gDNA_ID_1620494_Annot_ID_158683 3000 nt of promoter + ATG
aggacgtcaacgatggaaattcagaattggcagttacttctactactacacttatacaagaagatgatcgttgcaaggaagagaagaagagcttgaaggaattaagcttcgagacgatggagtcatggtttgaaatggttttaggggtcaggaaactgatggagagatacagagtgtggacttgtgggtattgtccagagattcaggtgggtccaaagggacacaaagtaaggatgtgtaaagccacaaagcatcagatgcgagacggaatgcatgcctggcaagaagcgactattgatgatgtggtcggtccaacctatgtgtggcatgttcgggatcctactgatggttctgttcttgataatagcttgaagaggttttacgggaaggctcctgcggttatagagatgtgtgtgcaaggtggtgcaccggtacctgatcagtacaacagtatgatgaggctcgatgtagtttaccctcaacgcgatgaggtcgatctagtcgcttgacctctttaagtattcagcattgcttaatgatttagtatggacacagtgaaatactcccctgtaatcttaggttcaggttcatctcaattcttaaaccttgaaccagttcaatttcttgaagtcctataaatttatacaagaaatcttaaagttccagattggtatcttaaaggcgttcactgttcagaatagaactagcgattgtctattagccagattcgtagattaacccggtcttgtttttcgatgaactgacattgttttacacgagaggcactaaagaatgtattaagatggctgaagacaggttgaccaaaaaaaaaaaaaaaaaaaaaaaagatggctgaagactctttgtttaggcggtagaataatctccttcgtttcttctacattggtgtttaattctcagcagatgttgtgatcgaccattcaagcacttctctaactcattactctctatctttttttcagaagaaacaggttgatatagaaaaaatgaaaactcatatacagctttgatcctcttgcgatccttgcggttcttgtgatcctccctatatagaggagcctcttggtcagcctacaaagtaaaaaccattcaattctcgacagctttgttccttgcggttgagatctcacttcgcagcttctcaatcgctttaaccgctccaattatcttcctctccatccctttcaattgcgcaagtttctctacgttcccactcttctcttcctcgaactctttcctgttccatcaaaccaattggttaaaaaaactgatgatgaatctttaacagttacttgacacgtaaaagacaattcttttaccgtaatctctgatgctcctctttcaaccgctcaagctcttgactcgacgcctctaaactctctgcctcaagacaaaccttcttcaaatctttcattcccaacttcacctttgaagcaagctcctcacgttctctcgccaatctatgagcctcaatgtgagctgattgcacttccctccttatattctctcgattcttgaccataccctccattttcgctattttctcaagagtcgatcggatctgaatctcgtggtctgtttccgtctttctgatgtgagctcttagcccctggacttcgcggtcagccacggttaagtcttccttgagagctacgtagcttgaagctagttttcggttgtcattagagagccggtctatctcagcagcttgaactgcaatcttgttttctagaatatcagaaagtgaaatctggtggtctcgaagatgacgaggatccgaagtcgaagaaatggtatcgtggtgcctcgacgatgatgatccactagttgacataccttggctaactcggctatgatgatttgaacctatcctctcccttgaagacattctggaagaaagaaaaagacaagactccactcaaaaacttagattgaacaaagaaaaacaaagagttcctttttaacctaaaaacttaaactttaagaagcgaattgagtgcaaattctaaattcaacactatgctatcttctttcagacaaattatctatgcaatgagattgagtaatcgaagacaatggcaaatctgtagacatcgtatcttgacacgagctagaagaaaacccagaaagaggaattacgaattagattctcaagctaacaacaagacccaatttaccaaatcctaagaaacccttatatcatccttatcacaattggacgaacctgaaattcacaaagagagatgatcttcgattaaaattagctgaaaccgaacaccgaaatgagataagtgtcgcaaaattaagagctttatgctctaaaacctgatctctaatcaaatcaaagacaacgatcgattccacaacagcaccagctttggtctcggcttgtcagaaaaaagttccagttctctgtaaattgtgatttaaaaaccattaaagacgccaaattagtttcgtttatagatttgggccagtattaatccattaaggcccattagatagtaattggcccattttaatagtttcccttccatgcctgtcacgtgaccttcagcttccttctctgaaagtcatcttcttctcccgacttttttgaacaagggaagaagaatccaacttcatcaattcagattcgcacgcttgaaattatctgaataaaaatcgaaagctaataatgagctgatcgctaaaaatatctctcgaattcaatcttcctgattttcaatttctgtctctagggtttcaatatccgataagtaagttttgttcttgctcttcttacctcattcacatatctctctttgattttattttttctgaaattcaagaagctttttctgttagattctcataacctaattcgttttgaggtatttattattatttcttgatcccacatttgtttcaatcgctttaagctccaaatttgtaatttcagtgtcatcttcgtacttgtactgaaatgcattgaaaatg

SEQ ID NO: 2148 - DNA, 3000 bp, Unknown
  misc_feature (1)..( 3000): cDNA_ID_3066185_gDNA_ID_1620495_Annot_ID_158694 3000 nt of promoter + ATG
tacagttgatgtatctgtgtaacaacattatagctcttttactctttcttattcttcaattgagataaccggtttcacattatgattccggttcacttcggtttggttggttaagttaatgccagtgattcaattgattcttctctatgtagcttgataacttcaaatttaataggttacaaatgtaattatatctgtttgcttagtgacatttgttattggtttggttttgtagaagcaactcctaaatcggttctgaagctgatgggattaaaaggtttaacactgtaccatctcaagagccatttacaggtccaaatttatacaaatttgagtatataataatgtataatgtctacaaattgttggtttatattctctcttatgatgtgtttctatatgcagaagtatagacttggtcaacaacaaggcaaaaaacaaaatagaacagaacaaaacaaagaaaatgctggtatgtatgattattatcaagaattcaagatttatatataattcagcttatagtagagtataatatatatatacatatgatgtatttaaggaatattaatgtagataacatttgagaaaccaaagattgattgatttttgtattcacaggaagttcatatgtgcatttcgacaattgttctcaaggaggaatctccaatgattcaagatttgataaccatcaaaggtatattatatatgaatttgccttctctcgacataatggatttgtaaagcttgagtttgacataatgttaatgaacacacgtagacaaagcgggaatgtaccttttgctgaggcaatgagacatcaggtcgatgcgcaacaacggtttcaagaacaactcgaggtaacaaatctcttctttcttctctcacaacaatgaataaaagttttaaaccgaagtttttgcggtgttataggtgcagaaaaaactgcagatgagaatggaggcacaaggaaaatatttgttgacattactagagaaagcacagaagagcttaccttgtggtaatgcaggggaaacagacaagggtcaattctcggatttcaatctcgcactttcgggacttgtaggaagtgatcgtaagaacgagaaggcgggtttggttactgatatctcacaccttaatggtggtgattcctctcaagagtttcggttatgtggagaacaagagaaaatagaaaccggagatgcatgtgttaaaccagaatccgggtttgtgcattttgatttgaactccaaaagtgggtatgatctcttgaattgtgggaaatatgggattgaagtgaagccaaatgtgattggagatagacttcaataggttaaagagacactttctttaattttttattttattttattatttctttacatttcttatagaatgttacaaatttggcttcatggtttctcagtcaaatatcaagaacatatttgaagtccaaagtagttgatatcagctaaatacggaataattgggtttaactaaataagttatttttgtgaataataaagtgtagcatcttctctcgcttgttctgcaaaattcaaaacctatttgcttgtttcttaattcttttcaaaaatatgtctatgcatctaattgtctctttctaaaaaatgaggatcaaacaaagatgagatttgattctcatgattgattttctcagttaaaaataagggaaatttaatagagtaacccatattttatacataaagacccaaaaggaatgctaaaaatatgagttatttgagtaataattatacctaaattatccttgttttcctttgcagagaaaaacaatattacagaaatgccattactatttaattccagcaaggcaataaaaccacatttatttacgaaaatgccatcgtcgtttttgataaatctgtggctcttgttgcgacggatttgttatcgatcacagatttgttggtcaaccacagattttttacaacagacttgttttgtaccccagactttcctgtgttatgttacgccagattttttttttttcgcagattttttaaccgtgactaatttgtttcatatagtctccacagattttatttaaatttcaaaagtaagaatgttgaaaccaaatctgtcactgatttgtttttcggaccacagatttttctttatggcggcaacagattttctatttgcacccaaaaatctgttgtgttataacagatttgttaacctcgaaaaatgttatataggcatgacagagttgttttgtgtaatcacagatttaattaacttgttaacaaatctggtgttttacaacagatttttgttaaaaaataaaattactacacagtcacatagtgataacagatttgtttttagtgatgacagttttttttttcagtgtcaaaacataacagatttactcatgtcaatgttatggccgatttgtttatgactagaataacctttttagtaataacagactttttttggcagatttatttttaaaatttcgaaattttttgttatatgagatttattagctagccctcaattaaattatttccggtttgattgtatgttaaatccggtttgacttgattttttttttttttttttgaaaacgttatgacagacttttattaggcgacagatttttccgaaatattaccatatttgagtcaaggaatattctcgtaacgcctagggtttccaatgaaaaaaactgccattgtcgttttcttttttcttctgtaacgcctaccaaatctaatttcaatacaatccattattcttctacctattcgagatcttagttgcttcatctttgacacaaattcgattcccttgtttatcgattctctctttggtatggatcaagtaattctcgtgtgtggtaaatgggtatatgagaaaacgagatggatttttgtggttgatagtacaaaaggttgtcgtgtacttgaaggtaatagtcaaaccagttatgatgatttcatccaaatg

SEQ ID NO: 2149 - DNA, 3000 bp, Unknown
  misc_feature (1)..( 3000): cDNA_ID_2151548_gDNA_ID_1620495_Annot_ID_158697 3000 nt of promoter + ATG
gaataaggtgttgttaccttcaaatgtgcgttgtggcgcttgccttctttccagcgacggatggtaccatcatttagtggtttaaacctgtctttgaatgacctgagatatagattcaacacaaaaaaaaattgttgagagagacgcccaaactattactaacaagatttgttgataatctgggaatcagaagtttcagcacgtacgaataaaacttaatcttgactttcttgacttttgatgtgattggagtcctaggtctccacttcttcttccattttgccattttttccttagaagtgatatttcgtacttgaacaaactgaaggcagagagaatcaaacgtacataagataagcaatcagatataaatcaatgttggtacttcgtagtgatgatactcaagcacaccgcctttatcatctggcttaacgaacatgatatcaaaatgcaagagctactatgaacaaataattctattttcggaaaacacgcaatcaaagccatgacgattcttctttcctatgatcaaacaaggggcacaaaattcaagaaccgtacacaataaatccgaatgttaagattccaaagaaaacatgtatgtatcttatgagattgagtaagctctttttttttttttaacaaaagagatttagtaggttaaaacttgcaacgtagtgatatatgcaagcactgacttgtatcagttggattcaaaacaaagtgcaagtaagcttattaacattctttgaattagtatttagtaatccatgttgttgattttgtttcaacagaacatatagaaaattcagaagaagctaaaactatataccaattcaaactatctagctcgtcactcgtcagatcttgtcctcctaagatttgtctcaatcagcagatatatataaagcaattgaagctaaattctggaaacttacgtgatgaggaacaaaggtagtgcccatggagctaacattcgacggaaaaactccggcggcgggaacgaagctccatttggtggaattggcaaaacctagggttgttgttgttaagtgacgactcggagaaggagaatggtgaatgagacggtgaggagaagcaccgtaaaaagagagattccgattagattggagagaaatggaacgtagcttagtgcaaaacctctgcattgtcgtctccaaggggaagaacaattttctgattgaaatgcgaattttataaaagagaagaagtgtgtgtgacaaagctttggggtttttgggaaatgattttgagtgtttggttattaggataactctattcttttttactctttttttttcttgtcatcattctcttttactttgataatggtaaaatgtctttgggaaaaaagccaaaaaaataccaaactaatttgttttttttttgtaggcgaaggggacaacgagtccccttcaaaatattattataaaattaaaccaaattacaaacaaatacgccgtgaatacgagatcccacgatagtcttcatcaaaaaaagatgagatacaatccgaacaagaatctagtaaatgcaaccctaaaaggcataaaaatgcataattagccaaaccatccgcaaagtgattcgcctccctatacacatgagacaattggaccaaccaatcctttgataaaaagccatagcacaagcgtgctaggaacgacaagggatgagtatcgcatatccccgtcttaagaaaccccgcaaccatcttcgaatcaacttccaactttaaccgagtaatcttgttctcccatgcataataaagcccatagtagaacccccaaagttctgctaaaggagccgtacatacccctatattaaaagcaaaaccttggacccagttccccaccgcatctctaatgaccccaccagccgtggctaaacccgggttacctcttgaggctccatccgtgttaagtttgaaccatccttcatccggtcttgaccaagcaatctgacgctccactctaaccctcttaatctgacctccattcgcaagacaatgtgcttgatacacatcttttgatatctctttcacaaactgggtacgatcacggcacttcctattctcaccaaaaacgttcccgcatctccactttcacgcccatcacattgccatactgaacactgtcccccacggtatcccctctctaaccacctgacttcccacgtttccataaatccactctagtaatgtttgagtgtaaaaaggtctctggagagtaggtggaacaatacggttccatatccccatcatcgccggacaatccctgagaatatggagaatagtttcatctccactcttgcaaacttggcaaatagctgtatcacataagtgtcttctctgtctctcagtgttagtcataataacctgatgaacaactagccaaagaaaaactcgcactctttccggtgtccgttaacagctgggtttgacaccgttaaaatttgacaccgttagatgattccgtaaaatttaacgccgttaaatgattctgtaacgtccgttaacggttgagtttgattccactaataatttatatctgagatattttgtgattacaaataattaaatgaggtatttttactctaatttaaaaatattgggtattaaacttttaaattaaaattagtttttttttttttttttccaaatgtttttatattctagtgtttatgcttattagctacgtagacaaattttgatacatttgggcctgtgtagctaaataaattgggcctttcacatgagtagataaaactaataaacctaaaagaaatcgtcttgttgaattcgccgtttggatctggctccattggaaaaaaaaactagaagcagatctgttgaagttaagccgagattcatcaattcgtgttatttgtctctcttgataagcaaaaaacatcgtacgaagaagaagaagatgaccttaattttttctgaatgaaatcttaaaattcccagaaagaaga

SEQ ID NO: 2150 - DNA, 107 bp, Unknown
  misc_feature (1)..( 107): cDNA_ID_3066219_gDNA_ID_1620496_Annot_ID_158700 3000 nt of promoter + ATG
tctaagagagaaaaaaacaaaccttttttgcagattgagagagaaatttgaagtaatttaaggtaacaagaagagaacaattttgttctgttatggtgggggcgatg

SEQ ID NO: 2151 - DNA, 3000 bp, Unknown
  misc_feature (1)..( 3000): cDNA_ID_2151501_gDNA_ID_1620496_Annot_ID_158702 3000 nt of promoter + ATG
ttccaaactcaattgaatttagatttcagcttattttttcgtttcaaagtattacataagtaagagttagcatatacactatttaaatacataaaaataatggagtttgtttgaacataacaattaatacagctagcggagtacatcatcaatgaaacaaaaatacataccaaagccaagaacatacagggtcttgcagcggttgatcttctcgataaagatgatgcaaatttcccatctatcgcattaaagtttggtggcgagagtcacaaagaggaaagtgtgatgcattcagaggctttgcaaaatgcgaggaatacaatcacggttgtcgccatcttgattgcatcggttactttcgcagtggggatgaaccctcctggtggcatctatcaagagagtacttcctcgaaagggaaatcagttgcggcaaaaacagtagctttcaagatcttctatgtaagcaatagcatcgcgttgtttacatcattatggatcgtcattcttctggtcagcattattcctttcaagccaaaatcactcaagaatgtcttggttataacacataaaatgatgtcagtctctgtggctgccctggcaacttcctatgtcgcagtgggatggatcattttacctcattttgaaggaaccaaatggttactctataccactcttggtatttctatcgtcatgcgaggaggtatgtatgtttttctatggtttaagctggccaaacacatcttaaggaagatagatacggaaagagaccctgatgaggaggccgcaacgggaaaaggctatgtcatgtattggaaatcataaatccgagcacctatatcttaagtttattttgttagatatctattattgactaatgtatacaattaggttagtgatgcagggcaacttgtgttgctttcttagtttgttttcctatttcatgtttgatttctataaggttgtaatgtgtgatttgaaggcttgcgtgacttatatagccttcatgtgtggtgttaatgcacgaattaaacaagtacgggtgagtctctggggaaggtgaagaatcaatctctaatccacgagctgaacttgaagctgggcaattgacgggctgaaaggcttattgcgaactgagaacgtagttgagggcgctacgaggcgatgccgtttcgagctggtggttctggtgagctggctcttcttgctaagttggcttgtcttgacgagatgtcttctctcgacgagctgacttgtaccgatgagctggctcttctgggcgagctggctgatcttgacgagcagacttctcccgacgagctgacttgtgtcgatgagctggctcttctgggcgagttggctgatcttgacgagcagacttctcccgacgagctgacttgtgtcgatgagctggctcttctgggcgaactggctgatcttgacgagcagacttctcccgacgagctgacttgtgctatcctttctccaggtctcgaaaaagtcccctttcccgagactttctattccttatttatacccgtccgtatagtagggtacgcaaggtgaattctcgagagtgccccttttctacgcagccgaactcacatcctgaccaggccgggcttcggcctggtgggccggctcgagttctaaagtgatggtcggggctgggtcgttattccttgaaatgggccggttgatcactgaggcccaattgatgtatcaacatgtggtttttataaaaagagtcgtgagaagagttttctctaaaaatcccttgtgtttggtaatcaaacttcattcaaccaacgaattccaaaaaaacaactaaattgttcgggtatataaaatgattggtaatgatatatcccatagaggccgtagacataggcccaaaaagtttccataactagcagaaattgaaacttgcaagttgcaaatattattacactggaaaggcaacaagtcttgaagtacaaactacaaagacttcttgtttggatggggacgactgacgagtttgaataacttaagagaaaagggtcgcaatcgaaattagacaagaaattagtcctcaaaaagtaaattctgaagttgaagctccaatgtctttgttcaaagactttatttagatgtaaagttatgtcttgtaaccaccaaacagctccttttcatctacactcccaatttttttaacatctatgttttgcattgcctttgacttgtctttctctctccaacttctctccttcaacataaagccaaatcctaaatccaaatcccttaaaccgaaccgaattaaaccgaagctgttgaactatcgcaaaatttcagatcttactaatcataaacatgtgacgtttaattcattttaagagtttcatgatttgcactgaatggtattccgagtccaccggaaaaaaacttttcctacaagtagaaaaaggataaccccataaatccaaataacctaaccgatcaaacatataccaatataaaccaaaacaagattcagattcatcggtttagtaatcgaagtaatgtactaatgtgtaatattgattccaccaccagcttagagattcgaaccaaaaaccgaatagcgcataaccgagaaaacccaaagcttcctaacaaatacataaaaccgtggtgtttctaattctaaccaacacacgtttcctttttattcacaagaaacatcagagttatgatctgccattaataacctaaacacaaagcaaggttaggtaaatgatatggacccctaatgaataatcatacaatacataacaacgtaagatccagtttccctcttcgaacatccatctcctttcagacaaaaaccatacaaagacataataaacaaagaaacagaggagaaacagagagatgcagttacatatatctccgagcttgagacatgtgactgtggtcacagggaaaggattgagagagttcataaaagttaaggttggttctagaagattctcttatcaaatg

SEQ ID NO: 2152 - DNA, 3000 bp, Unknown
  misc_feature (1)..( 3000): cDNA_ID_3066201_gDNA_ID_1620496_Annot_ID_158707 3000 nt of promoter + ATG
agaaacttcgttgatcttggaacgtcatagaataccatcggacatgtcctagattttttaacaaaaacttttcttggattatatgtaatatgtcatatctatgacctaagaaactattgagaattaatgataatatagcttatatacttgggacgtacatgtagcgcattaggataagatcacaatgatttatttatctaaatcaatctattagttgtgcgtttacttccgcgatcaagctaatccgaagtagatgtcaattaccaaaaagaacttcaaatgaaaatcgaaccaagaaaataaacgaattgacatatacctataccattgtaatgtaatataaattaaggtttgttgttggaattaacaaacaaaataaataaataaaaatacaagtcaagagcatgcatgctgttgtagatgcggagactcgtctccatcattcacttgacacatgcacacattactgaacttcgaacacctaatccaaacaaaactccattcgtgttatgttccaaatgctcacacacaacctcatgcttattacacgtgaatgccatgcaaatgtcctatctcctccataaatatattcattcccactttcacttcacttcatccatccatcactcgccaaaaaccttgaaacctttaaaaaatcgaaactatggctaagctcattctcgttttcgcaactcttgccctcttcatcctcctagccaacgcatccatctaccgcacagtggtggagttcgaggaagatgatgacgtgagcaacccacaacaaggtaagtgccagagggagtttatgaagcatcagcaactaagaggttgcaagcaatggatccgcaagagagctcaacaaggaagaatcggatacgaagctgatgactttgagctcactcttgatgtcgatcttgaggacgatgagaacccaatggggcctcaacaacagtcatctcttaaaatgtgttgtaatgaattaaggcaagtggacaagatgtgtgtgtgtcctacactgaaaaaggcggctcaacaagtcagattccagggaatgcatggacagcaacaggtgcaacatgtgtttcagactgctaagaacttgcctaacgtttgcaaaatccctaccgttggatcctgccagttcaaggcatctccttactaggaccatgaagaggaccaaactataaaagcacacacgtacacatggtggttttgttaatgataataaaaagtctctctcttgtggcgtgttcgtgtttgtatagtagataaatgtttgtactgtatgagttagagtcttagtggcaatattacaccttctagtgtaatgtaacttgccctacccccttaaataaaagatgttcttgggtattcaaaaatctttagcatcacactcacactctcttaaatctcatgtttgtgttctaataaattattgagaattgtgtgacataagcttatatatatgtatacttgggacttacatgcagcggattaggataagatctacatgattagtcttggattgagaccttgacatggttcttttctataaatagatttggtactgaaaagattaaaagagtgtttgaacaccattacagctattgtcttcatttgatgatctttccggccggtgttcttcttgtactactttaccaaagacaatttcataggtggatagtgaagcagagagacatggtgatgttttacattttctcctacagtaaaacagaggagaagtaacttgctcgccaagttttcattttagttatggtcaaactaattatggacttatggtcaaacaccctccattaattagctacttagtgagcctaacataagcctaataattattcaaacatcaaatgtcgtatattgtcctccggtcagttttttgagctagtgaccggttcaactaaaccgagtcgaaccaaagtattttatttaaccaataaactaattaaaaacacattagaaaaaattaaactaatgaaaatcttcatctaagactagcgcacgtcacggaaaagaaaaaggataagactagcgcacgtcgtactaatttcggtggatttgattggtttagagtttatgaatgttaatacatataagctaaatttagttcaaactcggttcttttttttttggtcaaaccaccggtttgttataaaattaaatttaccacattaatgggtaggtaaacactacgagaattaaaatttcaattaataatttaggtttgtttggtttaattattggtataagtataaccaacaaaaccagacattctcaatgatttatgttaatttaaaatttgaataaaaatagggaaagagacgtggaaggtgagtctctctttctcgctgtagtaaatacaaagacgatacgtaaaagaacaacttaatccaaaatttgttttttgatatataaataagaaaccaaaaacaaatcatttatgaagttttttgaaacaacagatttctaaaacaactctttaaaggtcttcttcatcttcgctctctcttcttcttatcctctaaatctcttccccttttcttgctcttaaacgttaccatagtcctaatcagattactgtttccaaagtcttaatctttctttctgggtttttaatctcttctaattcttttcaatttttacaagaaaaaaaaaactcacaaatcatcgattcgttcttctgggtttttgtaaaaattcgatctttttgtttctttctattgattgtgtgtgtttcttgcttcgtgacatttcagagtttgcgtgtatttttgtttctatttttaaaagattctaatcgaatttgttcaatttcgctcttaaaaattgtaaatttgatctctcccccgtctttctcgtcgattcatttttgcttggatatatctcaggcgtcgatatagagaataaaaatcgacactttgtttcatttggaggctaaagatcaaagctttttgatagtgaagagcctcctccaccattatg

SEQ ID NO: 2153 - DNA, 3000 bp, Unknown
  misc_feature (1)..( 3000): cDNA_ID_3066205_gDNA_ID_1620496_Annot_ID_158706 3000 nt of promoter + ATG
cagagctgtgaagacaacgacttttgcccatctgttcaggcttcagcgcggttttactaatgcggtaagcagagcccttcacttacacatgttgaaaaatgtgatacttatttatttaccttaatgtggattttcaggtgatacaagacatatgtttcagcaaggatagcaatttgattgtggttggttcttcaagagggacaagtcatctttttgagattaatcctgagaaagagggggatgctccggttcctatgtctgcaatcagtaggataagaagcggaaacagcagcggatggattgggactgtgagcggtgcagcatctgcagcagctggaatggttgcaggctcggttccgggtacagtcacatccactttctgttactgcgatgaaaagagtaacaataactactatggttctgttgctgatatgtgctccaagacaaatcttctggtgtttgctccttctggatgtatgacacagtatgcgttacgggaacatcaggttggtgttggtcatgagactgctgcaatgacggggtttgattctgagtcaggtctagagacagaaggaaaattagcggtagatccaataagaaggtggtccatgatccaaaaccaatctagaagagagacgcatgacccccacagtgacatatatggaggtggaacatcagtggattctaaaagtaaagtgtttccagaggttgttagaaaacaaagtgttgaggaagcttggaaagtatctaagaaaggaactacccgtgtggtggataagcgtcatttgtacatatatgaagcagaacaacagcaaacgcatctgccgactcagctacccttatgggcaaggcgaaaggtaaagtttccttttttggggaatatggttatgtgttgtttggatgatctctcatacttcgtatattttgcacaaaacagtttaggtttcaagaattggtattgaatcggggtgaagagattagtggtggaggtggaagggagatggagattgaaggaatccaaactcgaactattgaagcaagaacaagagatttggttccagtctggggttatctccaatctccaaggtctcagcaagtgataaacgagtgagttttctgatactaattatactcgacacttgaaagtttttgtctctgtctctgtcacagtttcttgacaatgatactatgacacagatcaatacagagtccaagtaccactacacaagatgacaaagtggctactctggagggtcatggaacagagactgatctcggtgctgtacatagcgaagaacagacacaaagcgagcctgtagataaagaaggtattgcagaggagaagaatcacagtgaagatgaggatgaagagcaagtggattagaagattggtttattttttctcacacatactcgacttcaacaacagaatagcaaaaaaataactctggaaaattgtatagaaaagaaagaggaaaattgacatatcttttagatgtaaatagctttagtactttttcttcttttttttttacagaatattattagcccattgattcatgaacatagttaaaaaaaaaatacattattttactaccaccttttgtattcaagtttggaaagaaaaaatttgtcatgctaaatttttgtatgtttaagaaacaagcaagaaaaaaaagaggaaccaacgaactagtctgccattacaagaacatggctcgatgaaacataatccgagccatgttgaaattttattttaaacataacgatcattactacttctactataatagtctatccaagactctccataataatagtcttgaatagactataaaccgtactcacctagttgaccctactctaaacaaagcctacgcaaaagaacttcaattggcttgtcccacgaaagttgacccaaaagtcatcattaacattgacccggtaagccccaggaagtttcacaacatctactttaaaaatctgcaacacggcaaatgactcttcacctctgaccaggttctcttcaccgacaaccgcagcagaccattcgttgatgcttgggctaacgactcacttgccttcaaccgcgcctttgtcatctccatgagaattaaaactcggccgcgttggcatcaaaaagtcttaaaatatttggcttttatcaaaatcttgaccgactataaaattttaaaatgtatttttggaaacactaatatcaaaaatcaatttgaaaaaccacaaccatttgaatattatcccctaagaaaaaaatagttaaagaaacaaaaatcaaatcatttgacatcttaaagggactgctatttaatatgttagatgcaagtggttgtggtttgacttcttccaggaacaaacggtagaagaaactctcaggaaaagagaagcaagtggacttgagacttgagagttgagacatatatcaataaaccctcaaaatgattggaacttagaccatacacacatattcatttctatctctcacagaaaatgaatctatacggatcatatctagacgacattgcagaccagataccggtcgacaggagtcggagtcagatgatcagaaagtacttaggtaaacaacggaaaaatttagatttgatagatgaagtcgtagaggccagacttatacgtcagttggaagccaatcaatcgattttggagaaaacagacaagcataaatacgactacgaggaatatgcgacgattttgcatagggaagagtacgaggaatatgcgacgaagataatcgacctctgcccttcactcgttagagttgctaacgtcgacggaaacactcctcttcatttagctgccgaaattggaaacgaatttatcctctggaaaatgttgaggtgtggagaagcagactgcaggaagattaataagcaaggacaaacagcattcatattagcatgcctcaacaatcacgtcgctgttgcacttaccctcctacaatatatgcggtctatgacgatg

SEQ ID NO: 2154 - DNA, 3000 bp, Unknown
  misc_feature (1)..( 3000): cDNA_ID_3066215_gDNA_ID_1620496_Annot_ID_158701 3000 nt of promoter + ATG
aactaatgttagttatattttaatatgcttgtaatatttagtacttttcgaaaacataaaaacgtgaaaattgactaatactataaatagtaagaatactggatcattttttcaaaccatgaaaaagtggtatacttttttttgtgtgcaaaatcttgtttccattcagtagatcaagtagttacagaaatgaatagtttagcaaattcaaagtttaaatcaacaatactaaacgcatttttgaacaacaataataaaggagataggatatatagaccgacggtaagatcaaatggtttccagacaataggtatgaaccaaattgtcacatgcaagccaaaaagtcgatataccatttatctttcctttttctttcaatcaaggtgtaatcatatatatcatatatgaagcaaatttggaaatggaaataacacataacagaatgggacatgacggcattttttgcccactccgaggaacaatgtattccattgatcaacttgaaaccccacttgattagctggttctagataaatgtttgttttctatttaggttgttacagatttcgtatagttaaattgagctacatgtacaccagataaaatcaagatgttgatataagaatcattagattcaatttgacttgaatgtggtgtgtcaattgtaaaaacaattgtgatagggtcatactctattttccctataactataatcttgttttgttggacactggagtaatatatatatataattctgcaacaacttaccaaaaatatttgaaatcatggatcatatgtcattttttttcttccaaaaatgattttgccatatgattaatgcattacgctcgtatgtttgataaatctggttcgtcacataaatatcacttcgaaaaaataacttttcatagttcattatcggtacatgtaaacgttaattcaattatagtatttcatatgttccaccatctcactattatattggtcatttgatatttcactactaaaccagataactattgttcttaccagatttcacacgtaatcattgtattttctagaacatcgaacgaatatagcctacaaatattatatgatttagtcaactcctgttgaatttcttctaaatattgagataaggtaaactaaataacatctgaaatcatggcaaaattcatgccttcacggaacttgggaaaagaacaagtcaaactttaaaatatttgtgtaattacttgtttattaacatttgtttcaaaatattgtactccaaatagtcaagttgatccataatgccgcttctgcattcattaatcaaactaaaagcaactggcttagccgatcataatttcaaataatagtagtgaagagtataacaagaagaaaatgataatctcctatgaaaaaaataataataattgataatctcctttatattttataaaatagaaatatagaagataacaagaaaacaagaactataaaaatataatttagtacaaaacaagagaatatacctcacagtatgagtggatattcctaatcaatagttgataaatctatttatttatcaatttgggtttcgttatattcttggaagaaaataagttgacgcgtataatttgagtactggttttaaaaagaaagaggtgctattatataatttggggaagatattaaagattatatatcgtacataaaagattcttctattttttttctttctatttcttggaactaccgttcttaattaaattacccatatattgttaaattttggattttgaacctgagatgtcgatgggcatcttatcttattatgttaaaaagttgaaacgaataaatggtctcaatgctagttgagaagtttatacttttagtgtgtatcttaaaaaaaaaaaaaagttcgtatctatgtgtatgatatattattgtttatcaaatgtgctaatacgtaaagtattattggaaattttcatgtatgtacgggaggaagcagaagaatgtataatctcctagatcacgaccaaacgaccattccaaccatgttctcgaatattatcggttcgttccaacgaacatggtcacaagttttctttatcaatttaatttgttaaaagctaaacggacaaatagaaaacacatactactaaaaccaaagaatattgaaacaaacaaattaatcaaaaccagctttagtggtgttagattgataggtctttagattcgtgcttcttacttattattgctaagatagtcgacacacacaaaaagaaaaatccattctcttttgttagaaaacatgaatacttgccactataccgattttgatttaaaaaaacaaaaagattgttaatggacaaattttgtctttctagtgcatatttacttaaaaattgaaattattaaaaaaaatttaaaacgtatggattatatttgactatttgttttggaatttaatccaaaacatatgaaaattttgaccgtttatgaaatgttgatttttattttactctttaactcacacacaaaccacatactttaaaattcgaattagagaattcactaggttaatgccctgattagttaagtttgttgtaaaatgtattgatatttgatttaatatatatatgatgatgtaacacataaaataaaataaaaacacgtaaaatgaattaaaaataaactaacaaataaaataaaaacccttggtatgatgggccttggaaagcccaaaaaaaaaggaagagtgcgcgtgaaaaccactctaatttctctggattccaagattccccaattcgtctcctccaacagttttcttcttctcttcttctttgggtgttccttccaccaacggcagaaatcgatttggcttaaatctccccctcctttcgatctctctgatcgccgccgggaacattcaatttcccgggagttcaacaaaaaaaaaactctccgtttttatttttccccctttttcaccggtggaagtttccggag

SEQ ID NO: 2155 - DNA, 2300 bp, Unknown
  misc_feature (1)..( 2300): cDNA_ID_2151725_gDNA_ID_1620497_Annot_ID_158713 3000 nt of promoter + ATG
gatcctctctaggtaaatattcttactttggtcgattttcgtatcaaagtaatcaatattgaaatggttgcatgtaaggtatatataagaacgtgctatgactttttttttggtggaaaaaaaattagatatctgcaaatttggtcacgtgcttcatgtttcaatacgagggaaacaaatatttataaagaaaaatggtagtttttctttttctttttctagtgagtatatgtatatcaattttgagtctgaagaagtattaagtatatagagtaatgtgaatctaatttgcaattgattgtgagtggtgtctttacaatatttttattttacatgctattatgatttcaatgatccataagttaaataagttttattatgtatgtgtaaatttaaaatgtatgtttgttttttcaatatatatttgtgttgtctttttgaaattttaacgatcatgtgtttgaaaaaaatcaatataagacttgtgaatctgacttttggatttgtgaaaagattggccacatgtagtgtttgtgccatgtgaggtttggagcgatttggtttaatatactttccacaaatagaaagtcgaaccataaatttgagtggtgagtggatttcttaaaaaaaaatttgagtcattagggaatacattttctgaaagcaagattaaagctaaaggtaggtatagaaaagctgatatagtggatgaattaaaacacgtgaagcatgttttacaaactattcacaatacgcaagtcacgtgtttttctctttgtttacatgattttgaacatgggtcattaatatgactttgatcaatattgatattgaaaagatgtgttaaagggttttgatgtttagtctgactttagtattcacgacacggaccatttggcccacgactttatggcatgaccttatgaagaacactacattaattcatgtactaagagaggatggtttgagcaattctttttctctaaaccgagtttttatagagttgtctaattgttttagggaccttttatttttttttgtcatctaggaagtagaaattcttgaattaaacttgtcgtggaaccatacaaatatacaatatgtaaaacgtccaaacgaaggaaattatgcccgtggacgaatatacatccccggaaactaaagcgataccaagagatataaaaattacagagcaaaaaatttaaactcgaaatagaaagaaatcgaaaaatttaagtctgaaaaacataacgtgattgctttttgggatctgaatccattaaagccattacacaccaatctatttattttgttgtcgaaagcatatgtaaaacgtgattgctttgtttaacaaaacacccctttgggttgttagtttcttgatggaagtttgagtttgggcttatgggtccctattgatacctccaaatgaaaaaggcattgataagacggctcaatcacgtttcattatgtttttgtcaaccaatccaccgttttgtacacaagtataaacctcccatgtgtaaattatacatatcaagattgatattagcaggagtaacatattagtactaaggtctatgtgatgcagtgatggtgtttaagattttcttcaagggaccaaaacacacaagttgatacacttgcaaagtaggcaagaatgtattcacaatctactttaatcccttggaattctttgtatttttctttgtttagcaatatacatcaaagtgccagaagacaaggaaaacacatcctatcaagtacgaggggattatataaataaataagaagagtatatgtgccaaattgataacttctaataaatggagggtgcaattaataaataaggagagacggaaaaagagacgccgttgaaacaccgcaaaacagagaagcgccttttgattgtctctctcccggagatctctctttctcttcttctccatccttcttctctcggcgcgcgcttcatccccaccaccttcgaattcgtgtacgatctctaaaatccagttttgctatcgacttatctcttattgcgccattgttatgcataagaaggggattttaacaatctagggccggtgaataagatcatacttgaaaaatctgattttgtagatgaaatcgttgtgggcaatttgcttgtttggttaggtattgtttttgagctagaccctttagatataatcgccatggaagcgctctgctttgtttggatcgagaaatatattgtaagaagaagagaattgcatgttttggctatattgtattatctgatgttggtttgtaatatg

SEQ ID NO: 2156 - DNA, 3000 bp, Unknown
  misc_feature (1)..( 3000): cDNA_ID_3066260_gDNA_ID_1620497_Annot_ID_158720 3000 nt of promoter + ATG
atattggcttgtgttattcttcaagagcaagttagagatttaggttatattagattagaatttgtttttttttggttcttgaaaagtcctctgttccaaaacagagatttgttgtcttggtcttttttttggtcaaatttttctaaagtcttcttccagctgcacgatattgttttctttcaaattttgtcaaactaaaaatctcaaccatatatgatacatcgatatggagacgactccatcaaggatataatgaatcaaatattcattggtatttttgttatgcaatgtaatccataattatgttttcttcgaacctttgtgtcgttaggcagagagaagatacgtaaaaaggaataacgaataaaaggagtagaattaaaatttaattcttataaatagggttttaactcaactataatcattatttattattttataaaaggggaatagacttttattccaaagaaaaacaaaacaaaaccctaatttggtaagccttccagagtagctaaaaccctactggtccgtgtagctaaaattcttcattcctattgggatatatccatatttatgttaaataaatatatttaggagatatatactttatgttaataaactttatctccaagtttagtttaccgctcttgtatatatataaagatgtaatcatatgagatgaataagagggaaaacatatcctaaacctagccgcctctagtttctacaattccgatcatatgatgatgtctgatcttcctttggatttggtagaagaaatactctcaagggtttcggccacatctctgaaacgattacgatctacttgcaaacaatggaacactttattcaaaaaacgaagtttcagccagaaacactttcatatagctccaaaggagtctatggttctcatgttgaaggagtacagagtttgctcaatgaatatcaatctcaatgtttctcctccatctgtagagtttcaaggtacacttggcataaaagatgattcccattctaatttaggacaagtcgagatagtcgaagtttatcactgtgatggtttgttgttatgcgccaccagggacaatagactcgtggtttggaatccgtgtttgggggaaaccaggtggatccaactcaaagatgaatgcaggagatactctacgtttgctctaggatacgaaaacaacaaattttgtcgtcgtaactacaaaatcttgaggtattggggttggtttcacgatcacataccagacgacggcggacgtttcaggtttgaaatatatgactttagatctgattcatggaaggttcttgatgacgtccctgatgaccgcttcccaccagtaagtgtcgtgtctttaaagggaaacacttactggtttggttctaataaaaaggacttcttacgtagttttgattttacaacagagagatttaatcatattggtcttccgccatctcgagatcatggttttatggctctatcagttgttggagaagaacaactctcagtgttacaagagattgagacatcaaagatggagatatttgtaaccaataaagttggtactgaagaagctgctttgttgtggagcaaatcctttatagtggatttacccattggcggtcattgttctgaggttttcgcgagtcttttaatcaacgaggagaagaaagtggccttgtgttgtaatttagatttcgagaccgacgggaacttgatattcactattggagaagacaataaatattactcagaaatcccttatgctacaaacaagccatggtggttatgtagattttctgaaaaatttacaaaaaaatggtggtggtttccatttatttacaattatgttccaagtttggttcaaatcttgtaagagagatagagagtaaaaaagagaagaaaaaaaactagtcgataaaaataagatacactagtcctctctcatttgttttccctttggttgaataatttaatgaaagttttttggtagtttattctttttcttcgtgttgtatagtttatgattcttacctttgagagcctgctctaggctggatttcagaaacaaatgacaatcatcttgttatcactctgtctggagaggtttcgatcatcgctagcggaatcaaaaacccgaggatatcctacttcgacatcgtcaagatggattcaaaatcatcaaattggggggaaaatcgattttattgcgaacattttgggtaaattttagtaatgatcagtttcatagatacactgagattcgtctatattgtttgaatggtggcggcggtcgggatggacaaatccactcagcagtttagtttgctctatttttaggatggataacaaaccgatgtagatcaactctatttgtatatataagcacaattctatgaatggtaaataactacagacacaatttatgaatggtaactaaatatcggtcaagtccataaacggatttgtccgccttaaccgctgcaaccattcagaccctatggtttgaaacaagtaattgcgtccatgatattcaaaccgagaaggttgtccaatggtttcaacagtttgcgacacagttattgttagatacatcaaagaaactataagacactacacaaatacgtctctgttttggaacagaggatttttttaactttttaattatattaatctaattaatcaaaacatgaattaaaacggctgacgaatatcaccagccaagtctatagaaaaaagattattactacaagcttttacttaaaaaatgtccacagtttttgagcataaacttgcggattagtttgtcttttcgtgtgctacaagtcttttagtcaaattagacgaattttacgctttcttgtatacattgatcctagagttccgtaattgctataaatagatgtcagtttaggagttaccaaatgcaaaaaaacaaaaaaaaaacactatcattaatcaagttccactgttcattttcgatctgcataatg

SEQ ID NO: 2157 - DNA, 3000 bp, Unknown
  misc_feature (1)..( 3000): cDNA_ID_3066252_gDNA_ID_1620497_Annot_ID_158723 3000 nt of promoter + ATG
tatggatatttaagctaaaagagtagcttcgacaaaaacaagatccgagccgacgaataagagataggagatcctccaggtggcattttagtaattaaccacgtggaaatagactgaaaccacgtggatattttagaattttgttgtgcacgcgctttgtaggcgcgtaacgttaaaaatgtgaaatctactggttagagttactccactgttattaattattagtaagagttatgaatcctgaccattgaccaaagattgttggtgttttcaaattcaattaattacacaaaatctatattttacgtggggcctaatccatgtcactatcattcttatatttaactataatcactaaatttatgtattattttaaataaatatagagtattaaacatttgaaaatactgttattgggttatgaagtaaaaatagaaatcctactgtattcctagtttccttttatattcccacgaacgattttgctgtatgtactcgtatgtatcttacgaagtgacgttttacaccatgtcagaatatgttaacagtggtattaaatagaaataaaactgtactttaatttagttatttttgttaattaaaatattaatatttaaatacaatatcctatattctaattagtttacaaaaaaagtcaaagttaacacttttgcttaactgtaattttatcttttcaatatgttaaaattattaaatggaaaccaaaataaaattcgaaaacaattttttttaaaaagtgaatagaaatacctaatatttagaaatatcaattcaaatttttacccatcagtaaccttggaaaatagcgaaacaagccaacttttatttttttttggcaacataccaacttcttcagaaatacttttcaaaagaaaaataatttataagtgggggtaattaaaaagagataagagcagtgaaagatgatttccacaaaaggaaaaaaaaaaaaagggaaaagagaggtgaaaaaaataaaaaataatgtaaaaagagcggtgaaaaaagtaataattgaaaagaaagaaaaaagatgataagagcaattccacattggcagctaactgtggaccccacacttctcggaagttccgtgaccgcgacttgagtgaataaggtcccacatgcatttccctctcttcccatctcagccgtttaatcttttctaaatcgaacggttcagatcaacgggtcgggtgccaactcaacgccttttttagtttttattttattttatgttttttttttggatgatgttttcttctgccaagtcagattgtttaaaaaccaaaaatagaagaaaataaaatactaatataatataaaacgatctaacggttgtgagagcatttagctaattggcaacaaatggtattggccgttgatttgtaattaatgagttaaattattttagactatggtaggacctgtttccttactttataggtttattgtttagcttaccttccctaatagaattaaaaaaatctaaaggatattatatggtttattactattttagaaatatccaaatatgaccagatttaattagttttatagaaatttatagttatgtcaatttgactaatctaacctaggaattatcaagatttaatttctcttttagattttttcattataaattaagaatgttgataaattagtaattaaaaatgtggtagatacttccaatattattctccatatattttcatttttaattattagattctaagaatttaaaagatcaattttgcaaacctggcatatttgaaaaggtaaatttaatttaacagcttttattgcatgcacgtaagaaatatcaaataaatcaataagaaggaaagtaaatatttgaatatttattttccatgagttgaagaaaaaaaaatagttagtggcaagtaaaaaactatttagccatttgatcttaatggagaaaagtaaaaaaaaaaaagatgaaggtagagaagtggaacctgatgtgattaatattaccggttggatcggtttgtataggtggtcacaaagattccattctgatcgtagattgcctttaccaaggtctctgtctaccggtaatagccggtgatacatcttctcaagacacattttgaattttaataattaaaataacatcatatttgtgcgtgtatatgtcagtatttttgttttcttttcacacgagtcatcgcgattagtggacaacagtacactaccccaggagcctttttattgcacaatatactattgatgattatttttagatttaaatattattatcttaatctttccgactttcaatatattttattgtttttttatttgtttgtttatttctagacagtgcaaagtcaataaaatattggtagcgataatatagacggaagcgtgtgatgtcaaactcttgacacgtggcagcttctgtttaataactggtaacagtccaaaataattttttcacatgaatccgactccgaaaataatattcttttaaaaccgaaaaattaaatgttatcaaatactaaaatatcataacaataagatatcatttttgagtgggtcctacctacggatgctgactaataaaataattaaagaatacgttttttaatttaataataaaataataatcggtggtaaaataattaataaaagaagaaatatcggttatttattattatatgcgagatctcttataacggagggccaagattttgtcacgctggtatatagcgtatcgtgaccgttggatgtattcacaccgacggtgaagattgagaaaatgttttacggcaggagatatgagccgtggatttattcgctactctgcttttatgaggagcacaaataaaggagataatgggaagcaagtagagagatagaggagagagagtttgataaagagagagaaaaaggggttgcgatttgggagaagagaaatagagaggagaagcattagagaagaagaagaagaag

SEQ ID NO: 2158 - DNA, 3000 bp, Unknown
  misc_feature (1)..( 3000): cDNA_ID_3066241_gDNA_ID_1620497_Annot_ID_158732 3000 nt of promoter + ATG
gatcctctttaccatgatcagtttgagtcgtcacagatatgtgagatcgatcttttcgctaacgatgatgaagatcatgtcgacatttcgattaaagggaagagaaacggtgatgatgggatattcttgagacttagaatatctgatgctgaaggtatagtttcaatctttttcgatagttttaaaatcatcggtcttaaaaacgtaacacgctttcgagttttgggtaatgtaggacggataaggaacatttacttcccgtttgagacggctattgatactgcatggagtgtagcggttgagatggtgtcagagctcgacataacgaatcaagatgttgcgaaaatcgcggagatgatcgatgcagagattgctgcattggtgcctgattggaaaaatgatacagaaagttcccaaaatgtaaacaacaacaagaacaacaacactgcaggattctgtggagagtgtgcttcaaacgggtatatacaagagactgtatcatcaggagaaaaatctcatcataatcatcatgagttcgatagttctgaagacaagagctgttcttcggttcacggtaggtttgcggatatgtggggtttgcgagaatcatattctgatgatggagaaaaacagagctcaaggaaggttagaagtggacggtggtcggagaatgagatgagacgagaactgagatggcttaaggcaaggcacaagattcaacttatgaaaatgagaggtcaaacgatctgcgagacaccgatagagatctctcttacaccgggaacttcagtttcgttacctcttctttacagggctatatcacttcctgtggatgccgtggatatgtgacattattgtaaagtctgatgatagttatcacttatatttgtatgtttcgacatttttaacttttgttaagttaaaagttaatgacatagtgtactttatttaaagagaagaagagtaaacgaaaaacataaattaggcattgtaaattgtggactaatcatctaggttttttccttgatggcacatatctcccatagactacatatgtctcttcatgtgcaataagtctagatatgttttcatcatcacatcgacgtttttctagactgctttcttgtttcctttggcatcctggaggttgcttgatttgcactaaacttggaacataagagcacacaaatagtggggaaaagtgtttgtcaacatcaacaggttgtcctagatgcagttctttaacgtttccagcctctcccacgatgtaaactgtctcgcgattcatcggtatatcaaaaatcatagcaactttctttacctcgtcaatgaaaaaactcccttccagaaggtcaacatacatattcactgtcaagaacttgctccacgaaatcttgtcagtctcaatcttagtcgtaatccatacctcaacagtagcattgttacaaaacaaaaccgcaagcttctcttctctaacacaagatagagtcacaaggcttccggacgtatatctaacaaacggcaaaggcataagcggaccaaatctctcacttgtaaaatcaaaacagattatgtgatcaagatcaacaaaccaattagtgtttgacttccttcttatagcacaccagtaagtgtttcccttgagagtaacaccacggttataacaaccacggggagggaaatttataaaccattgtggagtaacgtcaagagtcgtccacaaatcagagtcaaaatcgtagatttcataccaaaaagggaaatcgaatgcaccatctataaacctcaagattttgtgactacgactcttattattgtatccaagagcgtacacgtacatgtacctgccataacaattctgtatccgggaaaaatatctaggttcgatccaccttgtttgtccccaatacggattccaaacaacaagactacacttatcgtcttccaagacgcatagtaacaaaccctcgcagtgaaagacttgagatatcttgacttgttctgaatcgtcgtataggcaagtaagtttacctctttgctctgcagatggatcaatgtcaattccattgaagaagatgctcattgcaaacaggtttttatccatcaacacgatcatcctagactctccttcctttgctgctgcttcttctttcataaagctccggtttttgaataaagagtcccagtttttgcaagtcaatctcactgctctcgtagactttaatggtactctagagattatctcatctaataactccgttggaagatgagagattgtcgtcgtcatagtcattacaagttgcaacaaaggttttctcttccttagatctgttgttgcgcgcgcctataggaatcaaagacacataaaaggtaccacgtaaaccttttaatatcggtgagacatctaaatggtaaccgccttgtacaaaaaaaaaaaaaaaaagttctaaatggtaaccagaatctaactgattttttttgcttaattaatctagctcaagttttagtgatttttgttgaagataactgattttttattttttttcattggtaacacttaacagctgaattagttttactgattttaggcaaaatctagcaaaataattaagactttaactgaaaatatcttcaaataattatgaatattaataaaataactaaacaatatctaaataaaatagataaagttatccaatagtctaattaagtcttgtactaattaataaatactaatataaactaatattatataaattaattaattatctagtcaatgtatggtttggtcttagttgatgcatggttgatgtcttggaccggttataataaccaaactaaatcaaaatttcagttacttaaccgaaagtagtcaaattatttgtcggttataatgtaccggttcggttcggttataagtaagattctgcattagctcgagattccattagctcaaggagaatcaaagcgtcgtctcttgttccttccgctgccaacaaa

SEQ ID NO: 2159 - DNA, 3000 bp, Unknown
  misc_feature (1)..( 3000): cDNA_ID_2151775_gDNA_ID_1620497_Annot_ID_158725 3000 nt of promoter + ATG
tcaatactaaaaattaggcatctacttattctggtttatttacacttgcaccaatattgacttaaacgataagatgccaaatcaagaaaaactttggcctctctagacttgttcagaacttgactatgtagtttgatctttaaaataaaataaaattcaaaatataaatattttatttatagtactatttgcatatggtttagctagttttcatagtattgtccttaaaattttaattcacttaaccaagtgtcgttagctcaattggtaaagattctaggcgaaccttagaggtcgtcggtttgagtgacgcttgggacgaaactaatattacatgatatggtttcgggcctgaaagattatgggtttcgatccagatcctcctagatttttttttttaaaaaaaaaaaaaaacataatccacttaacgtcaacgttgtggcggatatttggggtaaatcatcagcctctgataaatgtctttatccataaaggttatggtttttgcaataaaatctagtcgttgaccacaagaaaacttggataatatatatataacgactgaatttattcgataattttgaaagattatggagatggacgaagattaagttatggatggaaacaaggatactttataaaatttgacacaaatttgagtatacttacttattctttttggtcctataaaaagaaatgttaagtttaaatcctttagtaaggcatctctcgatcgattctttcttgtaattttcttcacatgcttttgtaatagacacgagttttgtcagcggtgtctcttttcttttactatttactgatttgttattataattatcacgtttggatttctctttccataaggttaggttttgcttatatatatgaataattaatggttgtttaatttcctactatgattataaaaaggaaaagtattcggtcattgttttctctttgacgataactttctcatatcagaagccatccaacaatttgaagcagttgcttttggtttttcctccacggcttgatgatatgaagtgattgaagatttgtcaacgaaactttggcaaaatggttttgcttaccaaaatgcaaaatcctatacgagaaacatcaccaaagatgttctctgtttctgtatttctttcgttttattcgtttatgtaaatgttacagcttgactttcttagtgtgctttgggtttagatgttgcattatttgtttgcgatgttgcatgcatctttggttagtgaattatttagataaaagcaaaaacataacaaaacaagacaaacgtagacataaaagcaatagaaacagatagacaaatatagtctatactctatatgaatagttgaccatcctacatatgtggaactaaaatagaatggcagtttaaagttgatttatgatggctggctacaagtaggatggtcaactattgatgtgtcaatctcataactctgtactatttccagttgtgcctattgccaatacataagagaatatgaactatttcattagcttataacatacaagttttacaaaaaaaaaaaaatgatctctcatatatggaattcatataatgacttatattagtatcattatcttctcactaattaaattcatatttgacgaaatgtacgtagtatgtttttaacaataaaagtccatttcatttggctagctatttcattttctgccaaatattaaagtctatcatcagatagtttcacgtaggtaggtacagaagagaatgtgaagaaaatacttttcaaaaagaccttgacttaggaaaaagtcattcaatttccacagatacttactatagaaactttttcgatcaaaaaaaggagaggaaattgctaagttatttcgcaccgtacgactcatattattccaaattatgtatgttaataagttacaacattattatatacacacattcactcatgtattcaataattgattctcaaaccattagctatgtacgatacatatgcttgtttcttcatacgacattattgtttatataggtttcactaaaaaaaaacatgcagacggaccagatattaaaatattgcaacaaaatttttcatactctaaatttacaattttgctcatcttatctaaagctataacacataacttaaagcaatatgatgaattcattgatatgtataccgtaaatggctaaaccgcgtgaaatatcttagcaggtaaaaaataaagggaatttaaatcatatttatatctttatattttaatcaaatctaaaacatcttctaagactattagaattgataaacaaaaaatatagttttattaatatatcccaaaactatacatgaaattgttattcatgtatagactgactcaaaacaaaatttagtaatgtttttttttttgtaaaactctacgttttaatttaaagactaaattcaactttgcaaaaatatatttgttactatttttatttatttttcgttgttaacgtatgacaactagttgtaatcaatttactaggtacagtggacaaaatattacattaacatccatatttcagattcatctccttttctccaaaataaaacaagattcaactccttttctttttctgaataaacacggttgatatatatttcagtacataccacttggtgtatagttttgggaaagaaaaaattactagagttggagaaagaatttattgtagcaaaaatgtaaaaccattgtgactgttcagctctagctagattcaatataaatatagtatcagatttgtgttatatgcataaaaagaacattcttataatcacacatctctctctcttcattccccaagcatagaatctctccctctctatctatctctctttcaccttttcttgattcttactcagagaaaattctgcaatatatatcgccatgatccacaccgacatcgcagagatcttatgcgtcaaacccaagacaacgaagaagacaaaaaca

SEQ ID NO: 2160 - DNA, 3000 bp, Unknown
  misc_feature (1)..( 3000): cDNA_ID_3066256_gDNA_ID_1620497_Annot_ID_158721 3000 nt of promoter + ATG
gtctatagaaaaaagattattactacaagcttttacttaaaaaatgtccacagtttttgagcataaacttgcggattagtttgtcttttcgtgtgctacaagtcttttagtcaaattagacgaattttacgctttcttgtatacattgatcctagagttccgtaattgctataaatagatgtcagtttaggagttaccaaatgcaaaaaaacaaaaaaaaaacactatcattaatcaagttccactgttcattttcgatctgcataatgatgatgagtcgtcgctatggagccaagctaatggaaactgctgtgactcacagccatcttttgaatcctagggttcctctcgtgacggaaaatattagggttccggcgatgggagtcgtgagagttttcagcaagatgacatttgagaagaagaaaactacggaggagaaaggatctagcggtggcaaggctgatcaaggtaacaaaggggagcaattaatcgttagctactggggagtgaagccgatgaagatcaccaaagaagatggaactgaatggaaatggagttgctttagggtacattacatctttggtattatattagaactctgtggtcgatttatatgtatgatttgagtttttgtgtggaataactgtagccatgggagacatataaatcagatctgactatagatttgaagaagcatcatgttccatcgactttaccggacaaactagcttattggaccgtgaaatctcttcgatggcctaccgatcttttcttccaggtgacagtcttagctttctatggttttgtcatttcaaatgctttgtatgtttggactaatcttgccaacgagttaaccgcagaggcggtacggatgcagagcaatgatgctagaaacggttgcagcggttccaggaatggttggagggatgttagtacactgcaaatcgcttcgacggtttgaacaaagcggtggttggatcaaagccctacttgaagaagcagagaacgagagaatgcatttaatgacattcatggaagtcgcgaaacctaattggtacgaacgagctcttgtgattgccgttcaaggcattttcttcaatgcttatttccttggatacctaatttctcccaaatttgctcatcgtatggttggataccttgaggaagaagcaatccactcttacactgagtttcttaaagaactcgataatggtaacatcgaaaatgtgcctgcaccggctattgccattgattactggagacttgaagctgatgcgacgcttcgtgatgtcgtcatggtggtccgtgctgatgaagcgcatcaccgtgatgttaaccactatgcatccgtaagtagtgtgaattgtattataggaaacttacttatgtttaaaagatgattagattgttttcatggttttaataaaaattgcaggatattcattaccaaggtcgtgagctaaaagaagctccagctcccattggatatcattgaatctgaagagcttctagctttgttttgtcgttttgatacggtccagttttgttttccttgttcctaaatgggctttaatgggtatttgttaaaatttagtgggccttagagtaagcttatttgtgcttgctttctttttgcttcataaaagagtgttttgtttgttttcattctcctaataaatcagtgcttacatgatatgtttacatatacacttaggctagaaataaaactttacaaacccaaggctttgaagtttgaatataaccatagatatgtccattaaaccccactaaaatgaagtaggcttgaatccatcatatataaatgttaaattaataggggtgggaaaaaaaacgaaaaccgaaaaaccgaaccgtaccaaaccaaaacaaatggtttggtttggttatggttttgtataaaaacccatttgattgtaatttttatttaagttttggtttaggtttggtttgattaaaaaccgtaaaaccgaacgttttttttgtttttgatttaaattaaaaataattgtatatatatatatataatgttcatttgataacatgatatctatcaaactatcgaaaaacaaaaccctaactgtaacctaaactaaaattctatataaattacatgccgtcatttaggatttgagtttacaaattagattttgattttatttatgcatcacacttataattttttttggtaaaaacatgaaaaaaccggaaccaaaccggaaccgatccgaaccaaaatacatatggtttttaaatggttttaattttttaaaaccaaaaactgtaaaactgttaaaaccgaaccgtaaccaaaccgaattttatatggtttttatatggttttacttttcttaaaatcgaaaaaccgtaaaacctaaaaccgaaacgaaaccaaaccgaaaaactgaacacccagcccttaaatataatgaaaatcgaataaatttgtttgaaagaatcgaacaaaattgacaataaaatctaattaggactattttcgtctaattttgacttagttgaaacagaatattagcaaaaatactaaaacaccacaacgcgtaataatacccacacacgatatcattaaatttgaccaataagaatctagctcttggcgaccacgcaagtatcttccatcttgctctccaagaaaaatctacaccggctttaaatttacataaacaccctcagtcaaagaaaagtcgtaaacatagtctctctcatgaccacaagggtaacacagtcatcctaaatataaaccacacaagaaaactgttatactttatacacgtgtcatagtctcattacatctacgtgaagagtttcgatcatcaaccgttcgttttcttactatataaaccttgctcgagacctgcgtgtgaagcgtataaagacgacaaagtaaaccaaaaaaaaaaagagttctcctacaattttcctaaattcttggatttgagatttcactttttccgatttgaaaca

SEQ ID NO: 2161 - DNA, 3000 bp, Unknown
  misc_feature (1)..( 3000): cDNA_ID_2151741_gDNA_ID_1620497_Annot_ID_158717 3000 nt of promoter + ATG
gggatcaagcagccgttactctggtggttcagaccgctcatctggtttcggaagctttggttcaggcggttcttcaggaggatttggttcagaccgttcttctcagtcaagtggaaggagcagctttggtgggtttggatcaaacgatggtaaaagatcttactgagagaagtgttgtgttggttttgacccgactcagcaataatggagttgacttaggagagaactcggtatctcgagttgagtagtttacaaggagtcgagctatatataaattctgtagctacttcttgtctcataaaccaacataagttatatcattatttcatatcctctaattcatttttatttctcaatttgagtgaaatgtgtttcccttacttcgccacttccatttatgaatcttgttagattgtgagaaaaggaaataatgtggttgatcaaagattcaaatcatccctagttttgatttcttgttagatcttgcaagtttttggtagaaccatacacaagaaaaattgttttaagctttaattctcatatctgaccaacaaaaataaaacacagtcgacaattattgttcactacaaaaagcattactcttatgtttcacaactaattagccttcatttcgcaaaacttgatgcactgcatagcaagagcatgcaactagctgctgaacgaaaaggcttggctctgcatagctagcataataataccaagctccttgggtgtgatcccctttgcagtgaatccagatttagtttcatccagtcttataggcccaagaacgggttcttgtacacatacttggtgattctgagggttacaaagctgagatcccataaacgttgaaaggcgttcaggtggtggtataagaatcattgagatgagtaaaacagtcaacaccacccacaagggcatgcaaatcaatggtagccatctcaacaccatcccccagcttctccatttggagacattttgaaaaaaactcaagaacggcgcctgtacaaccgtcaacactcatccacagctgatctgaagtcagtaatactctggaagaagtatcagttttgaacattttaaaaattgatatttacgatttttttctttttagggtgttaaggaatggggattatcgacaaacaagtgatgaatcagattattaacaaaatatggcatttgttgggatgaacaaatacaaacaagtcggaatcggatcttgcaagtttttggatagaaaactaatacaaataagttgtttcaagctttaatttctcctatcggacaaacaaaaataaaacacagtcatcagtttggtttagtacaaaagcattactcttatgtttcacaactctcagcgttcaattcgcattacaatccacaaaagccttttgctttggcttatacaacataacgataggtaacataacgaccagccgtttcactcggacgaatgatcttcacgacttgcccacgttttagtccaaagtatcttgcgattggatcagtcacttggatccttggaagctaacaacacccacaaagttccaaacatttaataacacaacaaaaatttcatcaccaagaattcaaacaaagtttctatatactactaacctgtgtctccttcactgtgtatctctccagtaaagttttcttctcttcagtggtaagaacttgatgctcaggaacaagaacatgttctttaatgttcactagcatttccgcctcctgcagcatccaccaccaaatcatggtttagtaggattgtgatgtggatacatcatcatcaagagtcaagacacaaagtgatttgttttacctggaaaacttccagatgaaacttagaagagatctcactaatgcaagttcgagcaaacggggtcaagttctgttgcacaaccaaaatagctctgaacacattctctgatttcatcctgttcgtgtacattttcatcgtcttcacaccaactttcgcctcatcagggaagaatatatagagctacaacaagagcacatgaatcagcgactaaatcaaacacacataaacaatctttctaccatatccacagcttcttagagattaaagagatgacatttatctatacttttgtcaaaatctagctctctgtaacattccatgtctacttactattcacattcaacaactagataaataatgatagtctccagctaaagaacactaaagagaagctgataatcacattgaaggagagacatacaactacaaacctgatcactattatcatttcgcttagccttaagagtaacaagatcctctcttttcatgttatcaccatgtttcctaataaactgttgtttagtcatcgtaagttcagaatccgcgataaaatatccacgatcccttaacatctgcatcaacgtcttctggattctgtacaatcttttgagctcctcttccgtcaacatcttcttcaccaagttatctgcagctttaccaaaaccatatcaaaattagggtttttcaaaaattgacagaaacaattaagagtttatcaatctctttgagaatatatacacagatacgaaaacttacgaatagagacaaatccacagagatgattgaagaagcgatttacagagagaacgacagtggaagaagaagaagaagaagcggcgtttcaagctttctccttttacctcgaacccttttctcaattctattatattgaagcttttattgcatttgaaactcccaatttataccgactttatgttttaaccctcaactttattttcgatatttaaactccaatccttaatagcctgataaaggcccaatgggcttgtacgacccaacatacttaaaccctttagttgatttttctcaacttattacactgttcttgttggaactaaaaccctttgccttctttcttcatctctctaaatccctaattctccaaattttggggttttacattttccttatcaagagaacacctgaatctgaaa

SEQ ID NO: 2162 - DNA, 3000 bp, Unknown
  misc_feature (1)..( 3000): cDNA_ID_2151729_gDNA_ID_1620497_Annot_ID_158714 3000 nt of promoter + ATG
cttcattgataccctagtttttctatgtcaatatgactgactcgtaggtttttttttttctcattttgtttactataaattatcgtaatcaaattggaatttgtatcattttttttttgtagatgtcagtggacttaaagcgtggagaaactcttccaattcatgtaaatatgacgtttccatctttaccttgtgatggtaagagaaatccattgatcacttataagtcaagtctatattacttttcttccgccataccttctggaatacttgtcattgtagacgtaatcatttgattttttttctttttgtagtactgagcgtagatgctatcgacatgtcagggaagcatgaagtggatcttgatacaaacatttggaaggtaagatgaatccagatgctaatgcaaatcacaaatttcttcagatgttttcgtttccacctttttgaaattaccaaagttcattttgtttgattgcgcctaagacattatagctggtcatactgttcatatataggttaaacattatatttgaagggaactatttgaatatttctcttcgcatctttatctcacttcgtatggcattttgctctagttgtactgttttatactcatgttaattgctcactaattgtgaatatctgcagctccgtctcaacagtcatggtcatatcataggcacagaatatatatctgatcttgttgaaaaggggcatgagcatggccactcacctcacaagcatggtaacattctcaactttatgagcctttaccgagtttgtaccttttctgagagcttcttttcccttaactgttgttgaatgtaatttgtcttgaatcttttggaagaacagatagtcatgtgcactttgaaactaggttcatgtcaaaacttgtagtaacaatactcagatataactgataatatgatgtacgataatcaagtatgttgtatctggagaaccgaattactctaaattttgtgcttccaagcaaatattaataggaatcttacaagtctaattgaggcttcttagtaaggtgagtggtagatatgtaagagagccccagcgatagttttcatggtagctaaatgtttttgggtataagaagaaagacttaatcatgtatacactttatcttttctgcttgctgaagatggcaaagaagaacacaagaatgagactgaaaccgaagcattgaatattcttggctttgaccaagctgctgagactatgattaaaaaagtgaagcaagcattggcagatggagaaggatgtcgggtattaaccgtttctcttgtcattacacaaactagagattttgtgttcccggcgtttaagaaaacagagactaatatttggctattttccaggtttatggtgtcctagatgtacaacgggttgccggaaacttccatatttcagttcatgggctgaacatctatgttgctcagatggttggtatcctcatctcgctttattaaccatccccttactaagaacatgctttaaattcagattcgttaaagtagtttaatttagtaccgtatgatcattattgacgtttgtttccattgatttgtcaacagagaaagtataaagccagaatttaacttatcaataaccgataaattactctcataatttgtgtttgcacctcattcactgacttactacttgatattccttgttagtatataactagtctctttactctctgaacagatatttggcgggtccaaaaacgtaaacgtgagccatatgattcacgatctatcatttgggccgaaataccccggaattcacaacccacttgatgacaccaaccgaatactccatgacaccagtggaacattcaaatactatattaaggtgtttatccaaattcgttactcttcttgtactcgtatctctccgctggctgtatattttatatacttcattatttgtttactttgaagtttgaaatcatttacctgtatgatccattttgtttcacacaaatccgtatttgtaaggtaaggtcactaaattctttctaatatggcgcagattgttcccacagaatatagatatctttcaaaagacgtactgtcaacaaatcagtactctgtaactgaatatttcacgccaatgactgaattcgaccgtacatggccaggttagtcgatcaaacttcatttccagtatgcacctggttcttattactctctttctgttttctgatgtatctttttttcttccagctgtttacttcttatatgatctttcacctatcactgtgaccatcaaggaagaacgccgtagttttctccacttaatcactcgtctttgcgctgtattaggcggtacatttgctttgacaggttagtcccatctcagtcttgcctccaatactcaatctttcaaaatcttttgcctaatatagtttatctcataccttaaaacaggaatgttagatcgttggatgttccgctttattgaatctttcaacaagaagccgagtactagagcgtaaactagctgaaacagagacaaaacaatgagaaacaaaaaaaaccaaaggaaggaagaagaatctctcaaatcccaaaacttgtatctgccttcttcagacaacaacacccaccagagattccaggattgatgattacattactcagaaactctagaatccatggatatagtttttttttgagtctctcttatgtattactctgattatctctggttaaactagtagagttaatttgtaatttttattcaccttgcttcctgggattttaacatttttgcatcttttcacttgtctcagtaaaaaaacaaaattatactgtagctcaccgtaagataacgtacactcgtcacaggtgatcctgtcctcacaattctctctgatttcgcttactctttcactgaaaccctaatttggggtttttcagatttccttcaatctctcgtcgtcatttcttcgtctcaccgttgaatctgaaa

SEQ ID NO: 2163 - DNA, 3000 bp, Unknown
  misc_feature (1)..( 3000): cDNA_ID_3066268_gDNA_ID_1620497_Annot_ID_158716 3000 nt of promoter + ATG
gcctgactgagaagaacggtcagagccaaagtccccgaaaccagaggaacgattgtttgatgatccgcctgaacgaccaccaccaaagctgctccttccacctgactgagatgaacgatccgaaccatatccctcaggagaacgcataccgaagctcccaaaaccagaacggtcagaatcaccagaataacggttgcttgatccgcctgaacgcccaccaccataaccaccactgctgccaccataaccaccaccgcctgaacgaccaccaaagcttgaaccacgatccctcatgcctcctccaaaggaaccaccggatcgagaacctattccttcaaacatgcttgcgcttccacgttccacagcaatgctagggagctgaattcaaaacccaatggatacaaacattgacttcatacattcaggaaaagaaacaaagaagtaaaaagaaagtcagattatctaacctcagtgaatcggctcccaacttctctctcaattatttttacagccctggattgatcttgactgtagatcagaatagcacttcctttctttccagcccgacccgttcgcccggttcgatggacaaatgtctccgtgttattaggaagctcatagtgaatgatctattcacaatcacaacacggatatataggtttagttagatgagaaccaaaactcgttaagagcaagaaaagtgtagttttgactcaccaaatcgacattaggtacatcaagtccacgggcagcaacatcagtcgcaacaagaatattgaaatgcccatctcggaaaccagcaagcgttctttccctctgactctgggatatatcaccgtgtaaagcttcacatttgaagcttctagccaatgcatatgaaaggcgatcagcatctcgttttgtttgtgtaaaaacaatgcattttcctcctttggcatgctcctgcaaggaaaattgatattattaactctttccatatacaactgacaactccgaaaaaatacacaaataacttactcagttactgaataacacaaaatttaactcatactcgtttaatagcaaagtaaggaaagcataccgttacaagaggaccaataatggatgctcttccataagaatctgctatgatagaatatgtcgtaattccatctgctagtttctgatcagaatctccaacctgaataacacatcacagttaggcaaacaaaaacatagaagcacatttcacataagaaatcacttcattaacaactctgctaactccaagatcaattattcagaattgtgagaaatttcagagggtacaagactactcacaagatcaactgtcaaaggattattcaggtacttcttagtgagagatctgatccaactcggcattgttgcagaaaacatcatactctgacgtttctcaggcaacttttccaatattatttcaacatcctcagcaaatccaacttgaagcatctgatcagcttcatccagaaccacaaactgaacttccgatagattcaaagctcctctcttcatcagatcaatgacacgacctggagttccaaccgccacatcaacaccatagtcaagctgcctcatttgctgtccaatcggtgtacctccataaagacaaatagtatccaagctcggagcagactccctaaactccttctcaacctggcgagcaagctctcttgtcggtgccaaaaccaaacaaagcggattcctccctcgtctatcacatcaaaaaccacataaaaccccaaaaatcagtaaaccaaccagaaaacataattctctgaacctcaaatgactcagtaaacacaaacccatgtttagcgttgtatttgatgattttgtcaatgataggaatcccaaaagcaagtgtctttcccgttccagtcctagcacgaccaatcatatctcgaccctccatcgctggctccagcacagctttctactcaaaaccacaaaacttaaaacccacttacccttcttccaaaaacatgggaacacgaaaagctgaacaatttaaaattttgatctcacaacattacatacctgaataggaaagagtttctcaatacccttactactcaaagctttaacaatctccggagatatcccaagctcagatatcgcaagcccatcaccaccaacactctccgaatcaccaacccttctctcgctactctcagagatcgcaaatccagcttgagaaaccatcgaagctctaaaatccaacggcccagattgaaaatgaattcctttcgcttcaacaccaaacggaaacccagctttgacatcggaagatccaattaaggctaggtcggagactctagtggcggctggggccaggttgtgaaacagaacagtattgattgaggtcaacgaagcggagagattcctcttcgacgcatcaaggagagatcgtcgtagcactgtagtgatcattttcagattcaggtgttctcttgataaggaaaatgtaaaaccccaaaatttggagaattagggatttagagagatgaagaaagaaggcaaagggttttagttccaacaagaacagtgtaataagttgagaaaaatcaactaaagggtttaagtatgttgggtcgtacaagcccattgggcctttatcaggctattaaggattggagtttaaatatcgaaaataaagttgagggttaaaacataaagtcggtataaattgggagtttcaaatgcaataaaagcttcaatataatagaattgagaaaagggttcgaggtaaaaggagaaagcttgaaacgccgcttcttcttcttcttcttccactgtcgttctctctgtaaatcgcttcttcaatcatctctgtggatttgtctctattcgtaagttttcgtatctgtgtatatattctcaaagagattgataaactcttaattgtttctgtcaatttttgaaaaaccctaattttgatatggttttggtaaagctgcagataacttggtgaagaagatg

SEQ ID NO: 2164 - DNA, 3000 bp, Unknown
  misc_feature (1)..( 3000): cDNA_ID_2151733_gDNA_ID_1620497_Annot_ID_158715 3000 nt of promoter + ATG
cataatttgtgtttgcacctcattcactgacttactacttgatattccttgttagtatataactagtctctttactctctgaacagatatttggcgggtccaaaaacgtaaacgtgagccatatgattcacgatctatcatttgggccgaaataccccggaattcacaacccacttgatgacaccaaccgaatactccatgacaccagtggaacattcaaatactatattaaggtgtttatccaaattcgttactcttcttgtactcgtatctctccgctggctgtatattttatatacttcattatttgtttactttgaagtttgaaatcatttacctgtatgatccattttgtttcacacaaatccgtatttgtaaggtaaggtcactaaattctttctaatatggcgcagattgttcccacagaatatagatatctttcaaaagacgtactgtcaacaaatcagtactctgtaactgaatatttcacgccaatgactgaattcgaccgtacatggccaggttagtcgatcaaacttcatttccagtatgcacctggttcttattactctctttctgttttctgatgtatctttttttcttccagctgtttacttcttatatgatctttcacctatcactgtgaccatcaaggaagaacgccgtagttttctccacttaatcactcgtctttgcgctgtattaggcggtacatttgctttgacaggttagtcccatctcagtcttgcctccaatactcaatctttcaaaatcttttgcctaatatagtttatctcataccttaaaacaggaatgttagatcgttggatgttccgctttattgaatctttcaacaagaagccgagtactagagcgtaaactagctgaaacagagacaaaacaatgagaaacaaaaaaaaccaaaggaaggaagaagaatctctcaaatcccaaaacttgtatctgccttcttcagacaacaacacccaccagagattccaggattgatgattacattactcagaaactctagaatccatggatatagtttttttttgagtctctcttatgtattactctgattatctctggttaaactagtagagttaatttgtaatttttattcaccttgcttcctgggattttaacatttttgcatcttttcacttgtctcagtaaaaaaacaaaattatactgtagctcaccgtaagataacgtacactcgtcacaggtgatcctgtcctcacaattctctctgatttcgcttactctttcactgaaaccctaatttggggtttttcagatttccttcaatctctcgtcgtcatttcttcgtctcaccgttgaatctgaaaatgatcgccggagtattgcgccgatcttcactcccgtcgaggcagactctctccgccgcgttagcctccttcaattcgtgtatttcgcacaatctcactccagccaccaccggagcttccgtcagctctcgattcactctcgcgtcgtctcctaactcgtttggcatcagagcgaggaacatccacattagatctgagccgtcgatgattgttcccgcaggaatcgcgtcacaaggttacgccactgtcacaaaggatcgcaaaaacgagattaagaaagctaagattaaaatttctccagacaatgtcagaccattgagtaggaaggagatcgctctccaggtatatgcatttttgttcaaattcatagaatattattcaaagtgcttcatcagattcaaattcgaataggaatcggaatgtgaaattcattgaaatgatttagaactgttgtttatgttgttgttgttgtgtgtttggggttgaattgtagaaagaggcagcagaagaaagcacatcaaagataaaaggaacaaagatttgtatagcgattcggtcttttgttaacccggaaaagcaagcttggtgtcttcctcctcacactcgtaaagtcgcaatgcccgatacacgaactctgtacacggtgctaagatcgcctcacgtcgataagaagtctagagaacagtttgagatgaggttcaagaaacggtttcttgtcatcaaagctcagagtcatgagttgagcaagaagctgttttggttaaaacgttatcgtattcttggagctcaatatgaactccagttccattgcaagacccgtttggatatgactcaagtgttaggcaacatcaatggctccaccaccaatgcttactgagatggctaaagacatcattttgtagaagtttcaagacccaaccgggtactatgcaataatttcgaaccttacggatccatgaaaccagctttgcttcacatcagatcaagtagttattttcttgcttagtataaacatgtgtttttggacgattttgaaagatacaattgagtttcagttacagtgctttccatttattcattagccaatcaaagtctttatacatcaccaaggattgagacacatttagactgctaaaggtgtcattttgagaagttatagaaacctttgacccgaccatggaatgatgtcgaactttaaggatccaagagctcacattttaggtgtattcattcattaggcaattctaagacttttacattgtacataatcactaatgatttgagacatatggtataggttaatttgatagatctgattccgaacctgagctattgccaatttgccacactacacaaagttacaaaaaacagaactcattaactctttgcttcacattcaagaacacctttgggctcaagcaaaaaataataatcaactctgtttccttacacaagcttgcacgtgtaggaacataccatacactcacccgcaggtgattataacaaagttccctttatacccgcctttgattcttcttcttaaatctctaaacccttttgccgtctccctaaaaccctaattctcatttctggggtttcacatttcatcttcaccagaatccatcacactctctgaaatctgaaa

SEQ ID NO: 2165 - DNA, 3000 bp, Unknown
  misc_feature (1)..( 3000): cDNA_ID_3066272_gDNA_ID_1620498_Annot_ID_158745 3000 nt of promoter + ATG
tattgaatttgtccttttgtcgttatttaaagttgcttttcatctgttatataagactcataattgttttttcccgttatcttgttgcaggctatgtttgaagggattcttgttgatataccatttgcaacgtttttcctcagcaaactgaaacaaaagtatgtaaatttaatttctacctcaatttcctgtcacttcattcgttttttaagcccgcatagactttttgaacatgttgtgaaacttctattgttctttggctaggtacaactatttgaacgatttgccttctctggatcctgagttgtataggcaccttatatttctgaaggtgagttttgctgaacattctatttaattgttgctttgtagaacggggagatagttgctagcatagatgtgcgagaatgctgaaatctgtttgtttgtttttgtttcgaaactgaaatttgtttgtttacctacctacgataattttggctcttttttttttttttttttttgcttcttagctttatacacctttttatgtattcattatgatatttgcagcgttataagggtgatatctcagacttggagctttactttgttattttgaataatgaatatggagagaggacagaggaagagctacttccagggggccaagacatgcgagttacaaatgagaatgttataactttcattcatctggtttccaatcatcggttaaattttcaggtactggggaaccacttacctctcatttatcttggcatacctgaggtcaccctgtaaatcaacagctattgatatcatctcatttgcagatacgccagcagagttctcatttcttgagggggtttcagcaactcattccgaaagaatggatcgacatgttcaatgaacatgagcttcaggtgccaattaagtgtataattatacttgctttgttagttgttccctcgaggagcatgaagagagaaattttacctttgtgggctttggttgcaggttctcatatctggttcagttgatagtttggatatagacgacttgcgaaacaacactaattatgctggaggctaccacgcggtgagtggttcttcactgttagccgaaatgccattgtgaattagtgtagggacacttttggagtattgttatatatgattatatcgctatgttgttgacacttgacagggacattatgtgatcgatatgttctgggaagttatgaaaagcttctcaactgaaaaccagaagaagttcttaaagtaagcaaactttgcagttactactacagtctgtgtacgcaatgatttaccggagtctatgaattttctaagggaactaagaggtacctctatttttcaatttcaggtttgtgacaggctgctcacgaggaccactgctgggtttcaaatacttggaacctgcattctgcatacagaggtaatatacacagactcacaatcgttttgacttttgatgggccctggacaatagaatcataaaatatccatcctcgatggaatgtgtatcagggctgccggtagtgcgagtaatgaatcagttgatagactaccgacatcagccacttgtatgaatcttcttaagcttccgccctatcaaaggtttgtcctctcataacacaaactctttggttttgcttagctaagagacttgttttgttgccaaatagcttctcttggtgttgtaattggaaaaagcaaataaagcatgtcttgttgttaatgatgcagcaaagagctacttgagaccaaattgatgtacgccataagcgcagaagcgggttttgatctgagctgatggaatagcttcctgccttaaacacagacttcaatggccccaaattgacacccttttttctagcattcctcgttatggtataaaccgggtaacctgtagactgaggcaggcttgttggctctaagcatctaagagacggatctagaaggagaacatgtagtagagattacttgactaatgggtttcatttgcagctctcgggtattcgctttcaaaaagtgtgacaaaaaaaaaaaagtgattacagggaagtctttatttggaagctcctgagagttagtcttgggttaaaaattcaataaaagaaatggtaaataagactggtctcaagaggaacttaaatgctgtaaattattttgcttaattaatgcatgttacacagaacatagatgattattttgatacttatttgcatcataccatatatcttctataaaaagatgcattttagtgacttagtggtaagaatatccttttttttttttttttgtcatatgataattattaaaacagaaacaaaatgacagaaaaataacgagaaatacaaaatgaaatttaaactttactttccttagacacttgattgtgaagtcatgaaggctctccaagtgctaagtaaaacttagactgaaaccttctgtcttgaatcacactcccaagaaatggaacgcgcgatcagatttgcgtttgtggcaatatgacggaatgtacaagattcaaatgcactaacaatctcatggatttgtgttaaccaatttctatagaaaggctatttggacggctgcaaaacggcgttaagtgcggctggacagtccaactctattatcaccgtggtaagaatatctctatatacattttttgtcgcacttatcatgattaatcaagtaaacataattgttacaaacactttataaattaaaaaagcttcaattcaatttgcacagaaaagaaaaaaaaaagaagaagattcaatacagagtataccaggagcatctggtaatgtttatatctgaggacgttttatttaattttttggaacgaaaacaataatccgacgatcgtatttgcacgtcgcaaatccgctcttttaatcaaagatctcgaccgtccatttttagttaagactttagagagctgataagtggaatagtggagatttgcattcgcaggggataaggatcaaaa

SEQ ID NO: 2166 - DNA, 3000 bp, Unknown
  misc_feature (1)..( 3000): cDNA_ID_3066296_gDNA_ID_1620498_Annot_ID_158772 3000 nt of promoter + ATG
tgatcacaaagcttgtcgggatgtccctcgttgacggattcagatgtgaacaaaaaagattccatttttccgatctgattcacgaaagaaacctaatacagagcagagaaatcaaacaagatcaatgagaagtagtataaacacacataacaaactcgaatcaattaaaaattggaatctagattcaataaccagatctataaatcaacacttctctcaaacaaaaatcgacacttggttcaaattctacagaaatgcaggaatcttgagaaagtatgaatcgaagaaaagtgaacataccttaaaaggagattagtaatgaaggttgagctaaagaaatgtggtggtagtagtagtacgaaggtgaaggaggagcgtataagctttatatatacgagctcgtcgagggggttggtgtaagatcgtaatttcgtccagattcattcccagtttcatctaactgtgttcagacaatgagatctagatatctgacggttcagattagatctagaaatgtaagaaggttttaaaccgttggatttgcttcactggaccaccgcgtgcgagtacaacttgacagcatctaatgaagaagattgcgaatcacgacgattataataatagttatcggtactcaaattaatgctgcaaattagatatttttgagcatgtaaagtgaatttaaagagttaatgataattaatgtcgtaaatcatgaagaagttgtgtgattagagaagggtttgtgtgattgtgtcggtgaacataattagagattatacacacacaggctgtctctttactcttttatagaagggtccacttgccaccggtaaaatgacaacatagaattcttcttttgtttgctttttagtagtgtcggctagcttaggttgtcaaatatgactgactattgttgggtggtctaaatctgatcttgtctgatccgaaaaaggtaaaactgcacagttacgccaatatgcgaagttcatgtccggtctgaaaaggctagatttagttattgggctcaaaatgggccaaggccttgcaaataacgaaatacaccaagcgataaaatttgaagcccatgactatgaggcagttgttatttgttaagttagagaagaaattggaacaaaatacactaaaaccttctataaattaataggtcaagggactggcacctcctagaggattccgatccgctcttatccaaagatcggagctttacaaagaagcaccgtgctcaagccaaagcagcaacgaaggagaaattacctgcaaaaatgatgacattgtccgatcttccaagtgatttggcagaggaggttctgtctaagattccggtgacatctctgagaggggtcagagctacttgcaaaaagtggaacactttatccaaagatcggagctttacaaggaaacaccttgctcaagccaaagcagcggcagcaagggagtttatggtggtcatggtgatggattttcaggtttatttgatgggcatcaatctccataaggacgttgacgcaactataaacggtcaaggtaaacttattagcttagacgattccaatcaagtcgatatatcttacgtctatcactgcgacagtttagtcttatgcatcccaaaagactgcgctaggcttgttgtttggaatccgtattggggccaaaccttatggttcaagcccactagtcttcgccattttccgcactggtatatgtatgctattggataccagatgcgaagaggaaaccgagacgcgaaaacttcaaggtggttgttgacttgtagaccgacgaccaaaactatcacaaagaacacgatcgatcacctttgaaagtcaaaagatagatactcgcttcacatctatattttacaactttattatattccacacaaatcatatactatacatacattagtctccttttattaaataccagccgtctattttggtttttcttattacatgcttaaaaataccaaatgcacaaagaaggatacttttacccactacaaaatatggacttatctgaaaatttttatcgaacacatttttcttattgaaatagttacctatgtattagtacatatattttgttacgggaaattcaaaaaattttatatacaaccaatcaaatggctaattaataagtggattaagacctttgacctcaaaacacgaccaagtaaaataacttcaagttgattgataaaggcgtactataaagagtagacaaattgctaacatgcgcctaagcgcaccctatatatcatttactgtaaatttccgccgggaagaaaagtctgcgtttcttcaccaaccctacacgaaccaagatagatagaaaccttctccttcttctgcttcttttatcatcggagaattcgaatcttcttttcctctttttgagattctctaattatccttttggaagaggtaattcgctatcttcttcttcttcttcttaccaactcgcttaaatttctcttttttgggtctttccccgtatttatctgtaaaatttgtttctagggttcgatttcatgccgattagattgtgttaacggatttttcggagtttattgatagttatttcagtttgaaatccattttaggggttacgatcgttgacttgtgataagtctaggtcaccaaatgtatcatttcttagtgtctcgatttttatcgaattatgctctcgtaatgaaacttcatcatcatgtagatgaaggattttactcttctgatacaaaaatttgttttttgtgaaaaaaaatctgtttccttttttgttctgcttaaaccctataattagaaactttcgtcgagcatttctctataagtttgtacagtttgctctatttcatttggggaagaaattagttacttctaaattttcgtatgttataaagtcttgttctgcaacaccattactgacgtttttgcgttatgaatatactgatacagtttcgtgtgagagagaagcgta

SEQ ID NO: 2167 - DNA, 3000 bp, Unknown
  misc_feature (1)..( 3000): cDNA_ID_3066330_gDNA_ID_1620498_Annot_ID_158757 3000 nt of promoter + ATG
aagggaaagcctactcaacaggaccagactttaatacttcgacattgtcacacctccaatctcatttggatagcaccaaacatcctctcacccttggagcctgaacatttagagtgcattatgggatatccaatgaaccacacaaacatcggtggtggaaggttggctgaaagattgaagttgtttgattactgcttccaaacagacacattgggttaccatctctctgtactcaagtctatgtttccccaaggtttaacagttttatcactctttagcgggattggtggtgcggaaattgcattggaccgtcttggaatccatctaaaaggcgtagtctctgtagagtcctgtggattgagccgtaacatactgaaaagatggtggcagacttcgggacaaaccggtgagctagtgcaaattgaagaaatcaaaagcttaacggcaaagaggctggagactctgatgcagagatttggaggatttgactttgtcatttgccagaacccatcaacaccacttgatctctctaaagaaatctcaaatagtgaagcctgtgaatttgattatacgttgtttaacgagtttgctcgtgtcacgaaacgtgtcagagatatgatgtagtgaagttgaccaagagcctttacgtcctcaagaacctggagacttgtctaatctcagaaggagtcttccattttctttatcgtggagactttcaattacggaactgtttttcttgttttgcagttgatgctttaatgaatcagtctgtaccataatcttcatagaagcgtggaatatcgtcttttttatttttttgctatgttacttctcggagagataagcagtgaatcatgcggtcaatgttgttgtgtactgttcacaattatgtataatattagcactttttttagctcaatgttgttgattgcataattcatactcatcttacgtcaaaagtaactggaaatgatctgaacttctgaagtgtctaatccaaaatataaacaaatctaagccagagtaaaaaaaaaactgtatgattagatttgaaatagagaaccacttgattgattgcacaggaaaatcctcaatgttgagtcactgaggcttctcgatcaagtctattattcaagccaacttagttgcattgttagcctacaagcattgactagagagatagagagagaataacaatgggagagtctgcaaccagactgcatcaggatctctggctaaccttgcctcctgtcagcttcgctgactcaaacaacatgtgattgatgagtccccgagcagcactacatatacagtaccagagaagtttgagtctttccaaacttttcaaatagatgtatacaacatacttatcccaagagtattctgtaatatatgatctcaagcagctgtatatgtgtgtgtttgtgtgaaacatcatcttttgcagaaacatgcctcaacgaacaagttttacatctgatctaattataaggttttaagttatcgtattcagtagagattggggaaaaaaagaaaactcactcatctttaagcttctgaatcttctcagggtctgtctcattcatgtgtttcttaaattgttgcctcaccataccaaccactagctcagtgttgtgttgctgcaagacacaaacgtaaacataacaaaaagttcacttcatatatctcctccactccaggatatctaatcctaatagaaacacacaaatctctttctcgaggaatcaaaacagaagtgacgataatatcaatctcaaccttttctgcttgcagcacatcaacacatattttcaggcttcaatcaaactgcattcgtgtataacttacctcaagagaatcgactgacacaaatgaaaacctctctacattttgctctaaattactaagtgactaaaagtgaaagcatgtgaaggtaacgaacagtgaaataaactcgatttagcttcaaagtaataaaaatgaaattctttaatccaacattatactacaaacaagaatagcaatcaaaccaaacacaataccatatattctgagtcagacaaagcaggttcatattcaaagctcagagaaacaaactagttataaacctcacctgcttaccaataaatttagctctacgaagacattctcggtacaactgcgcataaaaaagagacaaatagatcagtgaaatagcatcaaggaaaggtaaaacaaatcacaagtcaatgtgggaattgttactgaccctaaccacattgttagcgagttcaggaggcagagaagtttgcagagacggcattttcacaagagatcttgagcttcttcaattatagtttcttttcctgtaacgtaaaacacaagatcgcaactatcaatcagaagagacgatgaaatacacagaaccaaaaaccataaaccctaaagctgcagtcactcactgaagagcaaagcttagtcattgaagtccacaactcaaataaaagttgatcgagaaggcagagagattggattaaagagaagacatagaagaaatcaatacaacatttcaagccaaatagagagcgagaggaagagaaagacaaatagatcgaggcttaccggagaaaagacagggcggcgaaatttcgagcttgagagtctcggagacagcggtgtcagcttccgattttcagatttcaggtaaagcataaacgacgtggtttcatggtttatttcttactaacggcccaataagtaacggcccatttatatttgcacgtagatatttaaaacaatctcatccgtccattaccaaccgtagattttactcgtctcagagggaataaataatatcctacgtggttatagcttcagactccagtggcatttcccgccaaaatcatcactaagactctagcctacattgaaaactggaatcgtctcttcttcctttaattcgaaattccctaattctctctccgtaccgttcgtctcctctcctcccaaacagttgctatg

SEQ ID NO: 2168 - DNA, 3000 bp, Unknown
  misc_feature (1)..( 3000): cDNA_ID_3066313_gDNA_ID_1620498_Annot_ID_158763 3000 nt of promoter + ATG
caaaagaatatgcttttaaggttagactttcaatgaaacatcaatttatcaagaaagaatcaaattgtatcaaacaaagcgatcaaatggatatgaaatttaatactggaatttgccaacttgggttttccataaactctcaaatgtttgattttgataaactcttaaatgtttgattttgcaaggaaagaaaaaaaagtaataatgagagagagagagagaaaaaagaagaagcgacgaagaagaaggaaaaaaaaggaacgtggagagatgaaactttttttttaattataattttttaattttcaaggacaaattggtcaaaagtttaatgaaaaagttggaaaagtgcctcatccctgacaagtgcctcaaaaggaataaaattctctaaaagtacctaaacgtgtcacattcccaaaaacaagatcgatattatttaagcttaaattaccatatgaaagatttcacaaattattaataatatcgactgtacagttgccatttggacacgtagatgctagacgaaagtcgatcatatccgaatcttctacaatgttacttgtataataatttatgtacctctttttaaaataaaataaaacaaaataaagggtttttgattgaaatgcaggaaaaactttaggcgttaggatgttacatatcagatgtgggagatatacttactatatataatctggtataaaccaagaaaaaaaaacgaatttggtgtaaattccatttccatagtattaataaaaccctgataaacaatactaagtaagcacaatatggcttgaattttcacagattcacgatggattgtaaccactaaaagctatcaagattctaacagagtatttgattgttttatttaaaattaaaatatataaataattttaaatatctctgaataattgggtagactttaaacaaaagatccaccccaaataccagatcccccctataaatatttggggaaaatacaccagatgatattctaaaaattggatttatctatacagtatacgtttgataaaaaaaatgtatacagtatacaaaatttaagttttttttttttgttttcttttataaaatgtatcaactaaattagaaacctaagaaaatatgagttatctacaaatttgattagaaaacataattaagttcagaactcacgggcaagaatttgacgacaacaacaaatcaacaatagtaacgtaggtgggacgattgacgagcccttgccaaatcttcgccttgatctctccaaaatatgtaaaaagatgatacgcatcacacatatttatatacacatacattgtctactataattaaatatctttattttaaaatggaaatttgaaactcaagaataagtaaagatattcctacaaaaaaaaaagaataagtaaagatatttctttgcataaaaaagatatgttattgactgtcaataatttttttatggaccctgatcataacaaactaaatttggataagatgtcacaaaaatgatcttaactacagttggatgcattaaagtttatattataaagtcacactgtattatagtattaattaagtaagcttttacacgtgttcaatagtatgataccaacgtaccgtgtttagttatacttcgtataacacaacttttgaatttatttttaagatctcatatttatatctagaaaaaacttgtagatataatatctttaaaaagtttaaaaaaatattaaaatttggtagccaacctaaagaaaaacgtatcagttgaatgatttaaatgataaagtaactttgcattatacatttttactccttcgcaaagtgacttgagtccattataatgtaattattaatagacatttgtagttaattgacgtacttatttatataacataacgttcgaatttatttttaaaatacgttattcaaactaaagtaaaaaaaggtagaaagaaaatttgtatatataatgtctatagttaaatatcttcattataaaatgaaaatgaacaagttaataataaataaattaagaaatttaataaattgaaattcattgcattctaatataatatattttcttttaaaaaattaaataaatttaataaattgaaattcatagcattttaatataatatatatatatatatatatttaataaagtaaataaatttggttagatttcagaaactttccattgactagagttggatatgctttaaagtataaattatatgctttaattttttaaaagttgttggatattttatttttttctgtcagcattatatatttggtgtcattagatgaaagaagctagagtgaatttaccttccacatagagactcaacatagaaagggaccaaccgtatcagttagcaggtctacaaaaaaaactatgctcttacatacaatgaacatgccaattaaaccaattagagatgtcatacaacatatatttttgtccacagagaaaagatcaaaacctaacaatagaaaaggactttaaataaatgagacaacgtaattgttggaataatttacatcataggtggtaataatgctgtgataacatatatcactacgaatataatgtatgataaactaagctaatacaaccatttaataactacatcgtgtagagaagctaaccaagacaatgatcattaaactaaacattaagtttttttggggttaaatttgccaaataccctcaaagtctagtctccaaacttttagctttatcagtatacaacagtacaaactaattgttaaattcttcgaacccaaatcttttcaaagtcttcgaacccaaatcttttcaaagtcttcgaaattcaaccagacttgttttttattcattcttccgtaatatataaagtaacctgaattattcccgccactgatgttccccaaatttcatcagtaaataaaaaagtttggagggaagaaaatgaaaaagcaataagaaaaaaaagaaacgcaatg

SEQ ID NO: 2169 - DNA, 3000 bp, Unknown
  misc_feature (1)..( 3000): cDNA_ID_3409333_gDNA_ID_1620498_Annot_ID_158768 3000 nt of promoter + ATG
ttttatccacaactaagtacaagatacaaatttaacgatggtttctgagtgaaagctgacctataacatggagtttggttgtccaagagcatgattctttaaacaggcgaagacggtaaatcggagcaccatatgtaatctacagagaaccatctaaatatcactttgcattcaacaaacatagacacataagaataaaaagtgatacgaaaatattaccaggatatagactcctttatccttgaggaccctataggtttcatcaactgctttcattataggtgaaagaatcaagaaagaaatagaaaaagaagaagctagaacagataaacagaaaccattcaacatttcatgccaagtacctccaaacctcttcaagcatttgtgttgagtattgcctcgaattactcccacactaatacatgtaaaaagtataagacttagtgagaaatcgagcatctagagataacataagtaaagagaaagtagacctcactcaccaaaatggagtctaaggttcctgaaaacacacacacaaaaatccaaaatgttatacaaatgaaacataatgcattttaggctagtaatgatattcaaacaagtagtaagaacacctttatcgataacagcatcaaaagaagcatcttcaaatgctttcatatcacgcacatccatcttcaaatctgttttatttttcacgttatccaaaaatacacaagttcatgctaaatctagtaatatacccgattaaggcagacacagatatgtctcttcccaaattgcaacattaagtagaagaatcaacaaatgtaaaaaaaaaaccaaaaaaacaacgttacatttgagctgaggacgatcagagtatttcttaatcatggtatcaatcaccactgatgatatatcaatactgactacatcttcgtatccatcatccaccattccttcgctaaacgctacattaaaagttcgaaacaactaatgaccaaaacggatccataatacacacaaaactgtgaaatcaaaagagttgttttcttctatatacctgagtttccacagccaatgacgaggactcgttgattacgttgaggaacatagagattgatgagaggagctaaaggtgaatacttctggtaccaatcaaacggttcagattcattcttgtaacgatcgtcccaataccattgctcgctgtaagattgcgttggtgcctctgtagccatctccgtcgttaacttttccgatttcgcttcactctctgatcaaaaggaagaaggagacagaagaaagatacacgagcgaccacggtggtccaaatcttccacgtggcatatttatttaataaccgaccggttcaccggtttgattaaacatttaagattaaacccgttaaaaatcgaaataaccggaatacaaaccacttttcagcagtcacccctaaaagcaaacacaccaaaatcaatcagagggttacattgtttgataccatgctactcttctgcagtagcattgccactgcctttcttagttccttcctactgcataactgtggcaaaatatcacggaacgttatcgaactagaatacacaccattagaaaccatctcctggaaaatgtctaaggcggtattaaaatcaccaacttgacgaaacccatgaatcaaagtggtgtaagtaattacattagcaactattcctcttcgatacatctcgcagaaaagattcatcccatctttaacccttgttgctttacagtaaccattaatgagtgtattaaacgttgagcagctcttggatacctttctcgcctgagctagtttgttctgcttgcagagtccatggatcattgagttataggttatagtatcggggactagacctctacggatcatctctgcatataatttttcagccctacctaacgagctgaatctgatcatcatattgtaagtttgaacatcaggttgcaatccactgatgaggagattagtgaatatattccctgcttcgtcaaacttaccagccttgcacagtccatggatgatgatgttataaccagctgtatccatatccatgttactctcccgcatgaccttaaacattttcaaagccttttctagtttcccattatcgcaaaaagcagagaaagtattgatcaggaagctgctcggtctgggttatacacaatttcaacaccttgaagatccaattccactgttttgtgtgtgtttttgatgaagacacttcatctagattattagtgagtgactttgaaaatcatttggcttgtttaagactcttggtattgtttctcttcattgatatacaaactagaagatgcacactgaatcttatatatctgaatcaggaattaaatttcaacaagtaaaaattctttttcattatttccaagtgatgcttatcctcgtttatgtgtttttcgttcttttttttgggaatccccttgtttaaggggtgtagtatatatgcttgctaagttgatgtttattcttgctttttgattctgcaacctcacagggcataagtctaaacatggaaaaagctaaaatccttacaagcaaagtataaaggtttgatcctaaaaaacacaagattcattctataaatagaaatttaatatactgatgcttatctgtatattgactagttttctctctcgtttctgcatatcttctcatggccagttccggtgattatgatggtatcatctcactctccctctatattcttcacttaccctatctgattaaatacactgacgtaccagccgtgaatggtatatgtatatgtgcatatggtcctatagatagaccattgaatgatatacatcataggaaaccaagtgtgatagttaagatttcaacctttggatgatgttgttgccctgttttgttacggatagtgtaattagattgatttctccttccacttaaaggtaaaatgtataagtaaatttgcacaaaggtaacttttgtgagaa

SEQ ID NO: 2170 - DNA, 3000 bp, Unknown
  misc_feature (1)..( 3000): cDNA_ID_3066303_gDNA_ID_1620498_Annot_ID_158766 3000 nt of promoter + ATG
acttggatctgaagagaggaggtaatggtaggttcttgaagactgctgcctatggtcactttggaagggacgatgctgatttcacctgggaggtagtcaagccactcaagtctaacaaggtccaagcttgaaacctgtcagcctctgtttcacttctgtccagaatcagtcttgttctctgtattttaggctctttctgcctctttagtttcaactctgagatgggtttattcattttgttttcaactttgaagaaaaaagctaagcagctgggaatttatataattatttatatggtattcttgtgctaagaaagttaaattcataatatgtatttcttacttattttgagaagaaaatcatataagagaataatattcgacattagtctcctttgtttgcattatcaatatcaaatattttggctttgacgagtccttaaacagagaggcaagtgagactttattgtaagagttaaaacatgatgagattagattgcactggtgattccatgaacgcatacatcagcttcaacaagacatacatctttgagcaacagaccactgtttggctgcgtgaaataaaccatggatacatatttcacccatccatgctccgagcttgatcgactaaaccatttagtaactgtaaaccagagaacttacagatcaagaggtgaacacattcacattcatataacaagtatgtgattgagtttgcggtgtttacccttcccggcaatgtgtctgccttgtaactgatcaaatattcgaattgtaaactctacaaatatctttgtaccatctgaaatggtttcaggatcaacaagggtcagatagatagaaagatgggttcctgttccttgctttgttcccgtaggataaaactctatcttcctgcattagtagtaccatttattagcttaaagctacggttgctttgggattgttggcaaatttgtgttaccattttctatctccagcgaagaaagcattagagtcatagctctctttgtctaacttggagaaattctcaattttccagacgtgtttagagctagtagcatctttaatcattgataaacattctcctctcccacttcttctctccttagaaacaaacacatcagctccaaacatacatgtgtcttccataaggtaaccgtttgacgcatcagagaaggtaccggttgggatgaatttatcaaatccccattcgcgcttcaccgaatgaaaccgtctctcgtttcctgcaacacaaaatgcatactaagagtgggacaaggatgagagaaacatactgtttgaagaagttaaagataccttgtagaatcaaatagttatctttgttttgatccagtaaatacagacggaaaactgcataaacctcccaccctggacttaatgaactagagtccgcaagagacaagtaaacagaaacatggtctttcgtattcttgctcttgtttccatttgggtacagaaccagtttcctgcaagcaagaccacatattatgttagacatgttaatactaatgcacagtaattgactaaattcaccgtatttaattggacacaggaaaatagaaacaaagatgggtccagatttcacatgagaaacgatccactatgagttggaaaagttgaaaaccatgaccagagagactttatactagtccactacttagagagaaaaagaggatgtaacatttacttttgaataaaagaaaattttccaaaacataactactgaccacaccctaaagcaatgtagaatagaatcccatcaacaaaaagcactgaaaaagttgaggcatgttccaacagtaaacagggtttaagataccagcacgtgttatgatgattaatcttcaatcacaaaagggttttgttaattactaaagaaaaggttgtgtaacaatgatggcataccatttgtagccaccagcttcaaagctctcagtttcatatctctcaatagcatgctttgtaaggagtgagaaagactctatcttgaccatgtaatgtgttggtggggcatcagatatagactttataatttctgcaagcatttctcacaaaagttacctttgtgcaaatttacttatacattttacctttaagtggaaggagaaatcaatctaattacactatccgtaacaaaacagggcaacaacatcatccaaaggttgaaatcttaactatcacacttggtttcctatgatgtatatcattcaatggtctatctataggaccatatgcacatatacatataccattcacggctggtacgtcagtgtatttaatcagatagggtaagtgaagaatatagagggagagtgagatgataccatcataatcaccggaactggccatgagaagatatgcagaaacgagagagaaaactagtcaatatacagataagcatcagtatattaaatttctatttatagaatgaatcttgtgttttttaggatcaaacctttatactttgcttgtaaggattttagctttttccatgtttagacttatgccctgtgaggttgcagaatcaaaaagcaagaataaacatcaacttagcaagcatatatactacaccccttaaacaaggggattcccaaaaaaaagaacgaaaaacacataaacgaggataagcatcacttggaaataatgaaaaagaatttttacttgttgaaatttaattcctgattcagatatataagattcagtgtgcatcttctagtttgtatatcaatgaagagaaacaataccaagagtcttaaacaagccaaatgattttcaaagtcactcactaataatctagatgaagtgtcttcatcaaaaacacacacaaaacagtggaattggatcttcaaggtgttgaaattgtgtataacccagaccgagcagcttcctgatcaatactttctctgctttttgcgataatgggaaactagaaaaggctttgaaaatgtttaaggtcatgcgggagagtaacatg

SEQ ID NO: 2171 - DNA, 3000 bp, Unknown
  misc_feature (1)..( 3000): cDNA_ID_3066354_gDNA_ID_1620498_Annot_ID_158751 3000 nt of promoter + ATG
aaactctctcttcttcgacttctcacgtgtcatcaaatctggttccctcttgccacgtgttctatgtgctgtttacaacaccgttttttcagtgaaagggtttctgtttgggcttttgggctttcactttgttttattgtattttttctttgtataatatggcctgtttctttcggcctgtttcttttggttttgtaaaataatggcatatgatttggctttgtaatatgaataaagaacacttgtgaaaaaagaaaaaaaaattgtcactcagagaaaatttgattgtttacgtgtaactttacctagacatacaagtacactacataaaaaaattaggagtgtaaaagaaccatgtgtaatggtggcggtgtattggtaaagaggcctaattggtttgaaagcttgcactcactcatgtttcccacgtgttgctcactaatcaccattagacaaattaattattcattaatcttttgtcttaatttgtatttaacacttatttaatatttggtttgaaaaattagtgtgaacacacaagcatttaaaaacacctaaatatagtatttacaataagatatttttaccagaaacgtataaaaataaataaagtttattacatttgtcaaaaaatcatagaaataattttataccaaaattttttatatatatagtctcaaacatatcaaggtaaacctattttgttttcatttttttgtaatttatccaaaattaaaatgcgtacaagcaaagcttcagtgacccaaacatggctgctttacacacagctttgtctttggaaagatctcataatccgctatgtccgtcagatcataagaagagcaaaatcgatgcttttcagtcaaaacatggtcgctgattccgccgagatcagtgttatcgatgtcaagtctcatctctccgttgcgaaagatcctagtaactttcagattgccgaaattcgaattcatgattcaatttgtattgatattccgagctctgaagaaacgcctcttttagaatcggtatgtgtttgggtttttgtttcttttctcttttttgtgtaatctcaattttgttacttttgaattttttaggactccgtaccattctagattctccgttgaattcgaagttagaaattgaattggattggatagataaagtcttattctttgataattccgcttgctcttctactcatggatttgttctgttttgtgaattctgtgatggttttgtgatgttatgaaggagaaaaacaactaacactaaacaagctcttatgttacctttgttttcaaacagatcaagagttgttctgcaactactattgaagagcatgttactgagtttgtaccaaatataagctcagggagttatgcagataagggtgactaccgggagtacatggaagatgaacacatatgcatagacgacctttcagatcatcttgggtcttccttttacagatttccggtgcctatggctttctacggtgtgtttgatggccatggtggatctgacgcatcacagtatataaaagagaatgctatgagcttgttctttgaagatgctgtttttcgacaatcgccctctgttgtggactctcttttcttgaaagaactggagacatctcaccgggaagcttataggcttgctgatcttgcaatggaggacgaaagaatagttagtagttcgtgcggaacaaccgcattgactgctcttgtaatcggaagacatttaatggtcgctaatgttggtgattgtcgtgcggtgctctgcagaaaaggaaaagctgttgatatgtcatttgatcacaaatctacatttgagccagaacggagacgagtagaggatttaggagggtactttgaaggcgagtatctctatggtgaccttgctgttacaagagctcttggagactggtcaataaagaggttttcaccccttggtgaatctttgtcacctctgatctcagacccggacattcaacagatgattctaactgaggaagacgagttcttgattatgggatgtgacggtgtttgggacgtgatgacaagccagtatgctgttactttcgtcaggcaaggacttaggagacacggtgatcctagaaggtgcgctatggaacttggaagggaagcgttaaggctagactcatcagataacgttacagtggtggtcatctgcttctcatcatccccagctcctcagagaagaaggatacggttctgtgtttccgatgaagctcgagcccggttacagacaatgctagaaggctaactgatgaaggttttttagcggtcttgaggagggcacaatgtatatattatagcaacaaagatggggttttgagataacaaccctcccaaggccaaattatttgatgacattattacatctctctgatattggatgaaataaaaggaaggcaaaaagagaagatgaaggacttcttctttatgttgttaaaatgttcataagtgttatagccattttttatctatttattctgtaggattattgagcacttatgtacaaaaactgattaagattaaggaattcaggtgattaagttaatcaactaattctctacccatttctttgaaaattgtgatcagagttttgtgtctaatatctctttcattacatcttcactttgtatatgttttaaaaatcactaacatatttgtcccattttgatatatgtttgtgtagtggttgatcatatgatgatgatgtatatgatcactcagcttggattattagggttatattatatcatcataataatatgcttattgcttctggatcctcttagttatgattaacgaaaattaaaaaaaaatcagggaaaaagcgaagaggtcctttttgttttcgtctttattcgacttttcaaagagccaaagtctctcttctccatctctctctctctctcagaaacttcgacggaagaagaacaaaacaacaacaacaacaacaataacgatg

SEQ ID NO: 2172 - DNA, 3000 bp, Unknown
  misc_feature (1)..( 3000): cDNA_ID_2151635_gDNA_ID_1620499_Annot_ID_158785 3000 nt of promoter + ATG
ggctcccaaccaaatcctattatcgcctctttattcgccctcaatatacaactttggtttgtacgaaattattattttatttagttagtgatcatacttcttcatatggaaacttataattatagtttatgaattagaaaaccttattttatttttctagcatctggtatttcttcggcacatgcatgcatgatgcatccatggaccataaatacgaaaacaaatccatttcatatatatttacttcaataacaaattcgtttatgagtgatgatactattaattataatgtatttattccatagttttttttctggtttatgtaaacaaacttacatcaataacagagataaattcccagaaacatttacatgtgtatgaaactctaataatccgcaatgaacttagaaatataaaccggtaacaaaagaaaagagaaatttctgaaaaattatatatcagaaaaagaaaagaaaaaagaattacagtgagactgacagtgatagattcatgagcgccggcagcgagtgatggcgctgcagccacgagagtaaggattggcctgagcgccacgtcgacaattgtagtaagatgcgccgcgacgtgagcacggaattgtgtttctcctcagcgcaccatagctgatgtacctcctcgtagctaatatgcgccggttgatctctgagtccatctcgaactcctctcccatttctcctccgccgtagaatagatctcctccgtctccgagggcggcggaaacagagcactcggcaattgtaccgcggcactctgtttcgaatggagggaaatctccggcgaattcggtggattgagaagatacggcgacggaccagttatgaacggcgagaatgagtagaatcgcgaatatcgccgccgcgccggagtttctggagagtcctctcattttcttctgtacactgtagctttagctctctctgtgcacgaactatgaagaaagagatagagagataaaagaaaaggtttttaaaagagaaggagcttaatgaaatgccactgaaagatggaagtaattacgaataataccacttggtgtcgtaaagagacagctttacaagtggccttttgttagcttcagatctaaggatgttttaatgcgccaagtgtttttgatggagacatccactacttatttttcttttttttcttaaagattttgttggtcacttttacgatatactaaaatcatattcaccaaccatccacacaattttacaaattagtaaaatttcttttgttatataaatgaataatttacattttgctaatttattttggaaagtatactgttttaaattgttataatttattagaatcgtaagtagaaatacagtgttcttttctaccaaaaaaaaaattaataaaaagttctgtttatgtttttgcttatgtttcaaggtactactatactaacaagaaattaaaacgatagtacaaaggtagataagacttaagagtaatatagaacgcatttacttttattttgtacaattatgagtggtctccttccatgatttgagactatttcaaatgaaaaaaaaaactacctattaaaatgccaacatatattaatgaagggagtttaatgtacatctcttgtgtattgttcatatttgtgatttccaatttcatcaaaatggacattataagtttgtaactaatttataaaaaccaaaaagaaaatcaaaatggacattattaaaaaccatatcatgacaggcataacgacacaaagcaacaattatgaaatgagagtggacactatttggattatttttttcctaagacatgatccgaagcgggtttgcaatttgatggtttctaagttgttctgaattattgaatgatgtgtgtgtgtttttcatattgaaatcgtaggttctccattacgatgttttcgaaggttcgaatcctgaaattggaatcgatattgagaaagggaaagaagtttatatttaaaaatgttgatgaatcaaggcgccaagaatcatttatatgtacatgaaatttcaacaaatgttagtagctgatgtgttgagtgtaatggtctgcttgagtgttcacacaaggaggctggaaatctatatctcagaccattgcctgaaatttcagagatggtcattctacagtcaagaaaaaacgcaagattggttatgttattcatgatctacaataaaatatataaatacattgtaaattttgtgaaattatatttaaaaagatcttaaaagttttaagtattataaagtcatcttctaaaaaaataaagaaaatcaatggtcatattattcatgatctacaatatacaaaaagagatatgtaaatcgtttttaaaaaaactattctttaaaaaagtaatatataatttgtatagcatatgttgaagaaaattttattagctaaatgttcaaaaaaaataactcattttcttaagacattttatttggatttatatgcgaaggttttatagtttttaaatcgttgcaattttaggtttttaggtgtgactacaaaattttaggttcacaccgatttactcgtttccttcttatgaatactaagatttggagtataaatttcaatgactcttcaaaatacaagatacaagtaatttattatttatacaacaattttgttctcaaccaaagatattaaatctactgaaatttagtaatgaaaaatataaaagtaataccctttttgtccagtacagagaaaaagaaagtccaaatagactattaaaacgggccccctattaaaactcaaaaaaaaagaaatataatatttgaaaggcccaaacaatcaaggcccaacaataaatggcaagacgtaaaatatctggagaagcggcttttagtcaacttgacaaatacacgtagaaacgtaaaagttttgaatagtttggtactttagtgttgactgttgaccgcgacgaatccgtcggaaaccggaatcaccatg

SEQ ID NO: 2173 - DNA, 3000 bp, Unknown
  misc_feature (1)..( 3000): cDNA_ID_2151674_gDNA_ID_1620499_Annot_ID_158800 3000 nt of promoter + ATG
agggtcattacagaacttatgtagctgatgagatatgggaccttgaagatcatatcctttgtccaacctttctgtcttgtctcatcatctacctgttatgggagattctaaaagggaacagcgtagcttatgacaagagagcatgagaagccaaacctttagccagagttccaggttattgggatccagcaccattgcctttggtagctataacaagataaaacaaaccaaaattaatataagaggctaagagtgtgtttgctatcagtagctaatgggctatgtttgttacgcatatttatatatcaactggtgacgacaagcattccagtctcagtaatacataaatcccagtggacgcaataacactaagcaatctgctatatgaccttagctgcgtatactgtgatcccggacaagcgtaataattggatccattcaacgtaacacatttcccataaactataatgctaatcgtcacatggtttggtgaaactagcattttgagaaacaggcgtcagatcatgacttacaacggagctgatgggggtgaaggtatcctgtcctttagcaagcgtacatgggagaccagatgcctgaagacgagaatttaaacaccccatgatgatatatgcttaagtaaaaaattgcattaaaacattgatgaaaacacaacacaaatttaagatttctgtttacaggaaagtatggatagaaacatggaatcaattggcaaacatatgatataatcccacaggggaaactcaaccaaattatggcttacgagcttataaagaccgtaaaggacacaggacagatcaattagtaaatggcaaagctcgagcatgcactaagattattattagtgggaactatgtatatgtacaaacccatacaaatccattgataacaaagacaagtggttctctaccatggcagaaacttggagttccctagcagtcatatcaagagcaagcgcatatcctagaaaacaagaacaccttacatattaaaaagggatataaagactaagatgaagaacaaactcacaaacattggcttatcgctatctaacataaaagactacataccacaacacaactaacatcacatacaaaaaggttcacattattctacgatctcatatccttgatgttacttgtaagaaaatgaagcaggctagtaaaaatacctccaatgtaattcatggctaaccgttctgggacatctcttgctttctgtccaattactacagcaagttccacctcatggtgaagtgaatccagtggatgtgggatctctattgttccaccgttttccaggtacgacgaagttggctttaagaacacaatcgggtcctacttccagcaaatcacaacacaaacacagacagagggtttaaatcgagacccatttgtgttcttacaaatcaacgatcctgattcaattgacgcggcaactttcgaaaacaaaagaatgtgaagaagatagaagtaaagttggtacctttgggagggcattgccaagttctttggcgtgagaagcgtaattgagtccaacgccgacgatctttgtgccttgtttgaacaatctctgaatcatcgaagtcgccatttttatgtcaatcaagtcaacaatcacaaagactcttctttttctctctttaagatttgttgttgactgagttacttaccgagttcagtgattacaacattacaacattcagtgattaaaactatttggtccgaaacttatgttttcataatcgagatatatggcccattattggcccatataatgcaactatggaaatggaagggtttctagcgaggccggttggacaaagccaaagggtcataaaataaagctttgaaagttactggccaaaactggaaaactacttaaactatttggacctattgcaaataatttagcaaccgcgtgtttcacgaattttagacagtaggataccatgacgtggattttcaataaaactgattacttaagcctaaaattaaaaaattaacattttgctaatcaccacatagaaggggcatgagggcatatgtatgtagagtttaactttttctacatgactcacattagcaattatcaaataaccaaaacttgtgaaaacatgttaaggatcaagtctcgaaaatttgatctaaccatatagagaaacttgatagttctatatcaccaatcaagattactattttagattttttttttcctgtaggaatctttttttttttttgtgaacctctcttatactcattcttaagcttaaactttatagtatttttggagtttttggatcatactagtagttttagaaaacaaaccataaaatgtggtattttatttagaattatccatctaatttctatgtctattatttctgtttaactttgatttttttttttaagtttaggattagcaaaataatgtctcttattgatatattactatatacatgttcaagcatgaagtcagaggtatgtgttattttagttcaagctgtttttttttcttaatatgagtttaatttatttaagttttctaagagtggagttcacattaccggtcgatgtccgttaattatgttctcgtgatactacaactgttcaaatctttattaaatcactgttttcaattccaataggtcattaaaaattaagaacaaaagaagaaaaagaattattcaacctgaaaagtgagaacaagctatgcacgacgcgactttcatcctaatcaaatattcacatgctacacgagctcttttagtctagcattaatgttctgttcattttgctgtcttgaaagagaatttatatttcattaatattttaccaaaattaaatcacatatatatatttgtctttcgatatgtggaccggacaaacacaaagtagcgtccttataatttgctatctctctcatcctatttcaagtctttctctatctactttcctcagaaacccatcctcagagatg

SEQ ID NO: 2174 - DNA, 3000 bp, Unknown
  misc_feature (1)..( 3000): cDNA_ID_2151695_gDNA_ID_1620499_Annot_ID_158806 3000 nt of promoter + ATG
cacacacgcatggtccatggatgagagaggaaacggtattgagcaaagcaatgtgaaggattatagatatttgagggttttttgttttttttctttgagtagtatccgtatatatgaaggatcaaccagccattttggttaggcggtgaacagtacttctagcgattctattcccgggatcaatctttagaaccatccttaggtcttcagctccgagtttgtatttctccatgctctcgtataacagtgctcgttgaaccagaatggtcacattcttcttgtcgtgatcaagtacctgcaatcacgttttcaaagtgaacaaaaaacatctgtgaagcataactgacaatcagaacaagtttcgaagatgttggttttgttctgagtctacaagaaaccatctatggagcataacaaccaatcaactagctacgatgacgcgatcccaagaactgtttagttgtggtatattttcctacaaagcaagacactaaaactttctatacgtgcacagtatttctaactcgtaatctatcttaagattccataagaacctaaatctcatattgtcaagtttcatatacctgaaaactcttatcagtatcaatttcatcaagagtccttaaactgattccaatacaactagagacttcgtaaactaaggatctgagatgagaatgatatgaaccatggtccatgatgcatccaaagaaaaatgtgcctttcttaacatacctttgtgcagtcggctacagctttcttatactctccaacttctttgtaacacgaagcccttgttgaaagaacctcggctgatccagcttcatcaccagctctatccataagaatcacagcccaagagagccactttatggcatcagcatactgaccttgtctctggttatcaatgcccttgttcttagctgatgtagctgatacacccggtggaggcggtggcaaaccatcaagctcggtggtggaaccagccccaccgtcaaaactttcaaatccccaatcttcggtctgtggcgtaggtggtgcagctgagggtttggaattagagaacattcctaatggatcatcgtttgcactcgaagattgtggaccacttggttgcacaccaaaatcaacgtttgaagcattgaagctacctcctgatgagaatgtgtttgatttcgaagcctggaaacccccaaagtcgttgatttgagtagttgttcccgtagaaccgccactgttaaggttcgacactccttgaaaattcccaaaagtatcattctgtgcattgttgttaacctttcctggtttgcttcctgatgattttgatccgaaaccaaccaaagaaccaaatggatcactattcgaaggaagaccagacccatttagattgcccccagccatatttttcattgaaggacctccaagattagcattaaaaccaccggagctcgtgtaaccaccagaaaaaccactcggattactgctataacccataccaccaccagttttcatcgaattaccagatttaggcaacgaatcacccaaattccccatagaataaggactcttactcgaacctgaagccgaaacaggcggtgcattcttcaacggcacgtttctactagatttaccttgacctatcgcagaaccaaccaaatctccaaacaaactaggatccttattcacaatcccaatacccgaacccgatcccgaagctgacccccacgtcttaccatgaatatcacccaccattgaagtcggtccacttccgatctcagatcggatcgtactctgcttcggtgcaggttgatgcgtccacgacggcttaccaggctgccacgcaggtctcggctgcgaattcgagctcgaataagaagatgtttggctcttctgaccattcagaggtctaccttggctcgatccaagccccagatcgaaatcaaagctattggtcgatccggatgatctcttcccgaagttggaattcatgattttatcctcagaactttcagatttaacaagagcaaaattgattccagaagatgatgaaaacggaagatcaaaatgagaattgctcgatggattagatgatactagaggaatagagcttgatccgtcgtcaagaaccgaccgtgagagattcttcgaatccacaagcgatctagagatttctcctttagcgttgttgtccagactccagagccaacgaaggggagaaaacaaaatggaacttcacaaaaatgcccctcttttttaagttttcattcaattcatccccaaattttaccattacatttttttttgtgcgcatttagtgaattgttttgcaaaaagaaagttattgtagtaaaattttaattggtatttttttttttaaagcttttgtttgtatatacaaaagagaaagtacgaataaaaaaatttcattgatttgtatataaaaagataaagtagtttaaaatatgggtaaaatataatatatgaagctgatgtgaaacagggtttaattagactcggtttgaatttaatgagtaaaccggaaattgagctggttaagggttaattggagaaaaccaaaacacaagggcgacggcgtcgtttatgtcttcttcttcttcaatatcaagttatcgagatgtttagttgaagctgaagcagctgggttcagagaagagaagaaatcttatccgagagttagttagttattccaaccgtttgtaactgaaatcaatttagagtcgtcgagtgttaaacctctatatataaagcgcctgtgtgagaaatgggattaagagttaactatttcctttggtattcttgggttacagatacagtagagaggaatttagtttcttttccgtttcttcttttctcatatcgattcacagagagattgagagaggagagagtattcaattgacgatttcattcattgaatcgaggttctaatcggttagaatctaaaatcggcgacggaattgcagaagttacagatccatg

SEQ ID NO: 2175 - DNA, 3000 bp, Unknown
  misc_feature (1)..( 3000): cDNA_ID_2152010_gDNA_ID_1620499_Annot_ID_158809 3000 nt of promoter + ATG
atcattcaaaaacacaaacatatagttttttctaacctttttagcaaaaaggtaaaataatatttctggaacttacggaagatgataaaaaaaaaatatttgtggttttggtaatgtaatttatcaggattatttaattatctgtgtggggttaaaattgtaaattttgaactttggggaatccggtgaaaattttgaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagtaaaagaaaaaaaataagtttaaaaaaagttaaataaagtctgtaatatatatgtaaccgccgttacttttaaaaggtttttaccgtcgcattggactgctgatgatgtctgttgtgtaatgtgtagaatgtgaccaaatggacgttatattacggtttgtggtattattagtttcttagatggaaaaacttacatgtgtaaataagatttgtaatgtaagacgaagtacttataacttcttaactgttttgtggtagtcctgattcctgaaactaatgggaattagtttgtatatcaaacaggggttcctaacttgttattattaggttaggtggaataattctagggtttttattgacaaaaattaacaaatagtggtttttatggaaaaaggtgatggtaccagtatagtgggaatacacagaagaatttgcagcctttctcaattcttatacgtataattctcgtatgtctatgaaaagggttatacgtatgatgatttatgagtagtgagtacatacatctttttcactactttacatgtaatatttatggaaaaggtctgatccgtttgctctatcgagaattggaattgtgagatatcttgattttaacagtttcaagattaatgaagaacaaaaacaatggcaacaacttacaaattaacattcggaagaaagaaaaaaacttacaagtgagatcaaatttggatttagtattttagatgtaagttacaaatatttcataaactaataatctattaaaaaaaaattattcattgtattttactttataccgtaacctaaacaataaaatacaaatttataattgaaggattttaattgtttaaattactctttctaccatatttgtttttatttctttaaacttactctttctaccatgccatttaattatttttgattgcaaatattgtacgtacctttcaactgtgaactagtattatccttatccctatcgtttcccaaatttcgtcttacgtatagtattaatacatgcatgtgattaaatagaagataagaagatgttgatgtgttgagacttaagactttgatgcatgaacctctaaagcctagttggtaacttggtataataagatttgaagtgggtccataaaatgttttgaagattgacagaatctatttgtttcgcgatattgtctatttctttgacgttttagagaatcattagtaatttaattagtaataaactaataactaagcggcatcttttcgatgtgataaccaaaatcatataatgatgcgtgtcttagactcttcgatacatatgtagataagatagcctaataaatctcgattggtttctaaaatttgtgtttacttcatgttataaatagtaaacacaatactaatcgaatcatgatattcacggttacgacaatgagttgacaatcagatatacttcaaaagaattgtggttaatactaactaatataacttgttcgctcaatctatatatataaatatataatcaaccttcaatattatgaaaccagatgcttatatatatctacttcgtaacatttaatcatttatcatgcattcaggctgatcgtttacggtttacccaaattcaatatatggaaaaggtgatggcatagtgacgttattcaaatagagtaagtgaacttaagttagttctcttgcatagaaattcgagcatgacattatgtttgaattttaattaaaacaaactcttatgcaagaaattcgttgtgttatgttatgtcgtcaagaaatcgtagccgacagtataccatctctgtgtggttacttttctcaagcatccccaaactttattcttttcgatcccccacttggaattatccaaaatgattcgcatttatttgacttgcaatcaaataatgtaatccgtgtgcgtattgtatatatattttttcattgtcaatgcaaacgttattgttattcatcagttttcataaatgaaacaataatgggccaaagtaggcccatttataaagcgaacgggtcgaattatcaaaacatttctgtgtaagtgggtcttaacgaaattggagtggaactgaaattagacccaaaaaccctaaagaattgatatgtcttcgatttataagtaggtcatttttttttgccttaacaaaaaagccctaaacggagagaggcggagaggagaaggaagacggcgtgaagca

SEQ ID NO: 2176 - DNA, 3000 bp, Unknown
  misc_feature (1)..( 3000): cDNA_ID_4282274_gDNA_ID_1620499_Annot_ID_158808 3000 nt of promoter + ATG
ttttattcgtactttctcttttgtatatacaaacaaaagctttaaaaaaaaaaataccaattaaaattttactacaataactttctttttgcaaaacaattcactaaatgcgcacaaaaaaaaatgtaatggtaaaatttggggatgaattgaatgaaaacttaaaaaagaggggcatttttgtgaagttccattttgttttctccccttcgttggctctggagtctggacaacaacgctaaaggagaaatctctagatcgcttgtggattcgaagaatctctcacggtcggttcttgacgacggatcaagctctattcctctagtatcatctaatccatcgagcaattctcattttgatcttccgttttcatcatcttctggaatcaattttgctcttgttaaatctgaaagttctgaggataaaatcatgaattccaacttcgggaagagatcatccggatcgaccaatagctttgatttcgatctggggcttggatcgagccaaggtagacctctgaatggtcagaagagccaaacatcttcttattcgagctcgaattcgcagccgagacctgcgtggcagcctggtaagccgtcgtggacgcatcaacctgcaccgaagcagagtacgatccgatctgagatcggaagtggaccgacttcaatggtgggtgatattcatggtaagacgtgggggtcagcttcgggatcgggttcgggtattgggattgtgaataaggatcctagtttgtttggagatttggttggttctgcgataggtcaaggtaaatctagtagaaacgtgccgttgaagaatgcaccgcctgtttcggcttcaggttcgagtaagagtccttattctatggggaatttgggtgattcgttgcctaaatctggtaattcgatgaaaactggtggtggtatgggttatagcagtaatccgagtggtttttctggtggttacacgagctccggtggttttaatgctaatcttggaggtccttcaatgaaaaatatggctgggggcaatctaaatgggtctggtcttccttcgaatagtgatccatttggttctttggttggtttcggatcaaaatcatcaggaagcaaaccaggaaaggttaacaacaatgcacagaatgatacttttgggaattttcaaggagtgtcgaaccttaacagtggcggttctacgggaacaactactcaaatcaacgactttgggggtttccaggcttcgaaatcaaacacattctcatcaggaggtagcttcaatgcttcaaacgttgattttggtgtgcaaccaagtggtccacaatcttcgagtgcaaacgatgatccattaggaatgttctctaattccaaaccctcagctgcaccacctacgccacagaccgaagattggggatttgaaagttttgacggtggggctggttccaccaccgagcttgatggtttgccaccgcctccaccgggtgtatcagctacatcagctaagaacaagggcattgataaccagagacaaggtcagtatgctgatgccataaagtggctctcttgggctgtgattcttatggatagagctggtgatgaagctggatcagccgaggttctttcaacaagggcttcgtgttacaaagaagttggagagtataagaaagctgtagccgactgcacaaaggtatgttaagaaaggcacatttttctttggatgcatcatggaccatggttcatatcattctcatctcagatccttagtttacgaagtctctagttgtattggaatcagtttaaggactcttgatgaaattgatactgataagagttttcaggtatatgaaacttgacaatatgagatttaggttcttatggaatcttaagatagattacgagttagaaatactgtgcacgtatagaaagttttagtgtcttgctttgtaggaaaatataccacaactaaacagttcttgggatcgcgtcatcgtagctagttgattggttgttatgctccatagatggtttcttgtagactcagaacaaaaccaacatcttcgaaacttgttctgattgtcagttatgcttcacagatgttttttgttcactttgaaaacgtgattgcaggtacttgatcacgacaagaagaatgtgaccattctggttcaacgagcactgttatacgagagcatggagaaatacaaactcggagctgaagacctaaggatggttctaaagattgatcccgggaatagaatcgctagaagtactgttcaccgcctaaccaaaatggctggttgatccttcatatatacggatactactcaaagaaaaaaaacaaaaaaccctcaaatatctataatccttcacattgctttgctcaataccgtttcctctctcatccatggaccatgcgtgtgtgtattttttttctgagatttattggttcgtctataatgcggcagcttcttgtagtaagtgggtcatgagtgtatttttttggatggtgcatttatatgttgttgattttcttacacactaattttttttgagtttatcatgaaatgtttgatcatcgatgtcatatgaaatgccaaagatgaccgtaaatttcgcatcgtaactcgcaaagatgaaccttactttgagacgctgcctgcgtgatggacgtgagacgcataacgcatactattaaattaccagacgctcgtggacacaacacttcaataccgaaaactaaactaatcacattgtgatacgttttgtattcagagagccaaaaaaaggcttacaattttgtcgttatgtggattagccttcaatttgttgtaaccgtcatgtatcaaggaacataaaactattagaattattattctaatataaagtaattcatttcactcacactttattaccataaaacatttattttgcgcctataaaggcatttcagctccaccgtaggaaactttctcttgaaagaaacccacagcaacaaacagagaaa

SEQ ID NO: 2177 - DNA, 3000 bp, Unknown
  misc_feature (1)..( 3000): cDNA_ID_2151687_gDNA_ID_1620499_Annot_ID_158804 3000 nt of promoter + ATG
atgtgagatcattaagcttgaggtctgcgaatgtaaatatctgaatagccttactatctctcttttctcgccaatttcttcagatcttgaggatgtcttgatacgctccagaacagagtggttggaccatgaggatttaaggaacatactcggcaaacgtgaagatttacttacctctactgtacccgtcccattccctgaagaagggttatttctttttgatgttgatgagcaagatgtgctagatactacagtctgggacttaaccaattttaacaaaatgcatggagacttcgacatacggtatagagttgaccagtgctttttagttcccattaacgagggagtcagcagcacctatgaaagacgagtctacaaatgtgaacaactgtaagtaatatcttttctttcttttcttttttgtttcattaaattgttttagtgaacgtttgttgacttacttgtgttaatgtagctatgggacgtaccgggtggtacactacagacgctatcatatgagtgacgacaatgattacggtcacaacagtggtgaggacactgaagactcgcaaaatcttggcaacagtgataatgactctagtgatgatgacggcagtagtaatgatgatgacggcagtagtgatgatgagagtcacagtagtgatgatgaatctgccggagatgataatatagaagctcatgctaatggtttttgactttttgtgcatccggtattccaaaagtgaagggaaagattccatcttgaccaacagatttttttcttgcaagtaaagagttgaatttggagatgtaaaaactcttttcatttttaccaagttggctttttaataataaccctttccaggccatgtcacacaagggttatctccaaattaatgttcaaacatgtcataccagcaaaacacaagtccatccctcagctaaagcagacctgatgatctacgatgatgagcttttcatggtgagacatgcagaggtagaaaccaatttcattcccctataattttgtgttcaggtcaggtatgcttagctctgtcctctaacaagttattagtctggaaaaactatgtggcggaacttagagttctgggcacaacaactagacaaagataaaaaatctccaagacaaatcagatacataagaaaagaaaacaattgaatcgattggttgcctcgtggtgaagcttgctagatttgcactgagcttggaacgtaagagcacacaagtgaggcacaacttgaaactgtagattctccaagatccactttttcgaagtaccccttcttcccaatgatgtaagctatgttgcgagtaaatttataactgaacctgtctttatccagaaccatggcgacctttttcttctcgtcaacaaagaaacttgcagcgttaatgtcaaactgaaaaccagtgagtgatttcatatcaaccgctaagaaaaccttcctccacgacactgcattgggctcaatcttgcgactaatccatatcttcacggtagatgcactacatggctgaaataacactgcaagtttcttatctctaacactggatagagtcacagtatcttcaacaaaagagtggaaaggcagaggcaggcgcggtccaaatctctcccttgtaaaatcaaaacagagtaagaaatcagccatatctgatattgttatcactcttccgcgtggtaatggtggaagcttctcttgagcaaaccagtaagtattccccttgagagacaggccacggtgataaaactctacatcccagtcgggagtgacattaacaaccttccatgaatcagagtttaagtcgtagatttcaaactcacgaattaggcgcagtgccctgtcatcctcgtaatcatccataaatctcaagattttgtagcaacgacacgacttgttcttctcttcgtatcctaaagcgtacctgtccaatctgtggtaagaatttctaggtttgatccaccttgtttgcccagaataagggttccaaaccacaagcctagatatgtctttggtgatacataacaataaaccgccgcagtgaaagattttagatatgtcgacatgatcttcaacgtctaggctaataagtttacctatacgctctattgatggattaaggaggttgacgctgtataaataaaccctaaattgaatcatcatgatcacctgaaactccttcgtctgcttcttctttgctgctgctcttgctccacgcaggtgcttctttgtaaagctccgatctttcgataaggtgttccactttttgcaagtaaatctcactgctctcatagatgtcaccggaatcctagagagcacctcctctgtcaaatcccgtggaagatcggaaatctgaaccatagtttcgaatcgaatctgtaatggaatcaaccttccaaagctgtttccttttccaccgattgcttcccgactgtgttaatttactccatctgaaaaagaaaaaatctatctggcttcatcatcatcaggacggatacttccgcatccgaccaaaagtacccacataagtggggtttgattggtaataagtttttgacttattagtaatgggtccaaggcctgttaaagtctcaatacagcccaaattaattaggcccaatagtaacactatttgcatttgatgagaagcgggaaaatctagagaagtcaaaataattcgtatctctctttcccaaaactctcaatctctctctctctctcacagttcctttctatcttcactaatcacttgaaatcttcgtgttacatcgcacaatcccttcgtctcccagaaaaatttctcaaatttcaccacaaaatcagatatttctattgaaatttctctttatagttggaatcccaattcagagtttttagggtttcagctttttctttttgggggtttgggattagggatatgaattatccaatctctccatatagaagcttaaattccgtgagtcttcaccgagaatg

SEQ ID NO: 2178 - DNA, 3000 bp, Unknown
  misc_feature (1)..( 3000): cDNA_ID_3066374_gDNA_ID_1620499_Annot_ID_158795 3000 nt of promoter + ATG
cttcgtacggatatcccatacctataagtagaaaagaatttttgacaacagttagagaactcaaacatcaaaaatacatatgtttataaccacaggatacatcttttcagtaaatgtcataccctgcagacagagtctcgccctccggttagtacaacatcaagagtaggatgaagagctaaacagtaaacgccatgcaaatgaccatgataagatcgaataacctatcaaagacaaattccaaagacattggacatgaaaagttcagatcaggagaagagtaattaatatacagatgagatgaaatccatcatcgagtttaaaccttattctgctcaaggtcccagcatttgacttgcttgtcatcaccagcagaaaacatataggtatgtctattgcttacagcgaggcctgtgaaacaataattatataaacttagagagttgaaacttttacactggtacttttctacaagagctattgataaactaacaaattgagggggaaaaaaatagtagtctaacctcgtacttgccctatatgtccagtaagtgtgagtttcagaactccagtcgctacatcccatatctagtgaacaagagccacagaagcaatcagtaagattaattcatgagatataggtaaatgttgcatgaagaactaaaaaacgggacctagcaaatgacaattcatattatagaatccagaaaaggttacagaagaatgggaaaaaaggcattgaattagattttcaatagagttgatccgttaccttgatggtacgatcagctgaaccagtgcaaaaccattcattgcttgggtcaaacgcaacagatctgacccaacccaagtgtccctggagcacctgtcaaccaaaaaatgcatcaattcataagaacataaagtactctctggacgccaacaaatggcctaagaatacctacacacttaaatgttatatccataagatgcagaaatattacagtaacacagatcttaccctgtaattcttccatggtgcatgccactctggacggggccatctactaggcattctctccattaaagcagcagttgacagatttctgtaacacatagaggggaaatgatggacaaataatgaataactgaagcattgatacaagttagatgcatttcaggttaaataaatatggccaaatttaaatttcatgactctgaaccaccaattcaccttagtgcggctttatgtaccacctaggtatcgcaatctagatgtagtgtcgttatagagagtccataaaagtagataaggatgcgacacaaacctttcggaaaatgatccaggtgcaggaagaatggccgtgcttttgcctggattaccagtattgttccttcaattcaagaatcaataattatcagtatcaatcagcacgataagtagagcatcaatcacaaagacaaaacaggaataacattcttgagaatgtcgtaaattatttatactaactatatggactagtcacattccaaatgaaaatgtatactcacaagtctcttggcggtaaagttggaccaacaactaaagctttctctgttgcgctttttcgaagttccttggacccttttggacctgcggagaaaataatttggtctttcagaacgagaaacaatagtcatgaaaaaggctaaaagattacactaacagcgtttttagtgcagcagaagtttgtttgaaaagatactcttaagaggatacattactgaaacttgttttccaatcctaattatagacatatatgaatgaaactcacaactaatataaatagatatcagggaaactagaaaataggaaactagttttgtctcacaacaggaaaaacagataaaagaactacctggaagcgcaagggctttcaatggagccgtcttttcactgttatggtcagcaatacgtgtaggcttacttgcaggttctacgcctccaaatgcaacttgaatctatacaagtaacgtccaagtcattaacttttatattctacttgatgttcactaaaacgcttgatgcaaactaaacatcttactataaagatgagggtaatatgctagaaagcaaactcaaacaatagtagctgatgagaagaatctaactccagataaaaggtaaactataaaagtgataagccattgactgttcgatttacaccttataaaattttctcaggttcaacgtctctgaagcttgctataaagctatccattatcaaactcaaaacaaagaagaagcgaacaaaattttcaacacgatcaaagataaaatttaaaaaatattcgaaaacccccttaccttatggcagagccgaattcttttgctgcgagacaagaacaaaaacagacaagaagaagaaatcgtcaatacacataaaaattctgagaaatttcgagaaaaaaaagtggacattgcaagcgaaactgttgattaacctttcaggatcaggctgaggaaattggccatggacgggggagaaaatttcacgagctcgtctaacagattttagactgagttttttcagtgactgagtttcgacctccctgttcaaagctatcatcgtcattctagggttttacacgaacaatcagaaacagaacgagaaagacggaagagaagagagggaaataggattttatccgacccgaacactatttatacgtagcccaacactcgaatccccacccgttggaccaaacccggctcattaagcgtcggttcagatttatttcctttatttaaaaaaaaggaaagggtaaaaaatagaaaattggaaacagttaaagcccaaaattgtaatttaccgagaattgtaaatttacctgaaaaccctacgctatagtttcgactataaataccaaacttaggacctcacttcagaatcccctcgtcgctgcgtctctctcccgcaaccttcgattttcgtttattcgcatccatcggagagagaaaacaatcaataagcgaccatg

SEQ ID NO: 2179 - DNA, 3000 bp, Unknown
  misc_feature (1)..( 3000): cDNA_ID_2151652_gDNA_ID_1620499_Annot_ID_158791 3000 nt of promoter + ATG
tcaagtacccattggacgttcctctaatctcattgctcgtgctaatctgaataacagaggagcagggcaagtaagcatccgcgtaaacagctctgagcagcttcaacttgctgtggttgcacttgttcctctgttcaagaagcttcttacttattattcccctgagcaaatgcaatatggacactgatgagtaacatttaactgttttgattttttcttgaaacatgtttttctttttttagttgtcggaattcacttttgttttaagtctttgatgtttggttgtaacatatgtctgaaacttaaaatccattatcccaatgtttctaagtcttcttgaaacctgtattcgctcaaggaatctggtcttaggtcaggtcattcatcagcatcttcttaaacgctctcttacgttaagttcctctacagtgctcgtcaatttaacacgtctttacgcatcatgcaatgaagtggaacttgcacgccatgtgttcgatgaaattcctcatccaaggatcaatcctattgcttgggatttgatgatcagagcctatgcttcgaatgatttcgcggaaaaagctttggatttgtactacaagatgctgaattctggtgttagacccacgaaatatacgtacccgtttgttttgaaagcatgtgctggtcttcgagcaattgacgatggtaagctgatacatagtcatgtgaattgtagcgactttgcaactgatatgtatgtatgtactgctctggttgatttctatgctaagtgtggggaacttgagatggctataaaggtgttcgacgaaatgcctaagagagatatggttgcttggaatgctatgatttctgggttttctttacattgctgtttaactgatgtcattggattgtttttggatatgcgtagaatcgatggtctgagtcctaatctatccaccatcgttgggatgtttcctgcactaggaagggctggtgcattgagggaagggaaagctgttcatgggtattgcacaagaatgggttttagcaatgatttagttgttaagactgggatcttggatgtatatgccaagagcaagtgcattatctatgcgagaagagttttcgatttagactttaagaagaatgaggtaacctggagtgctatgattggaggctacgtagaaaacgaaatgataaaggaagctggagaagtgttttttcagatgttggttaatgataatgtggcaatggtgacgccagttgccattgggcttattctgatgggttgtgcaaggtttggagatctaagtggagggcgatgtgtacattgttacgcggttaaagcaggcttcatcttagacttaactgttcaaaacaccataatttcattttatgctaagtatggaagcttatgtgatgcttttaggcagtttagtgagattggcttgaaagatgttatttcatataattctctcatcactgggtgtgtagtgaactgtcgcccagaagagagttttcgtctatttcatgagatgagaacatctggaattcgtcctgatattacaacattgcttggtgtcttaaccgcttgctctcacttggctgctttgggacacggttctagttgccacgggtattgtgttgttcatggctatgcagttaacacaagcatttgtaatgcactgatggatatgtacacaaagtgtggaaaacttgatgtagccaagagagttttcgacacaatgcataagcgggatatagtttcgtggaacacaatgctgttcggattcggaattcatggtcttggcaaagaagctctttctctgttcaacagtatgcaggaaacaggtgtgaacccagacgaggtgactcttcttgctattttgtctgcttgtagccattcaggactagtggatgaagggaaacaactgttcaactccatgtctcgaggagatttcaacgtcatcccaagaatagaccattacaattgcatgactgatcttctagcccgtgccggatacttggatgaagcttatgattttgtaaacaagatgccatttgagcccgatattcgcgtgttgggtacacttctctctgcttgttggacgtacaagaatgcggaacttgggaatgaagtgtcgaaaaagatgcagagtcttggtgaaacaacagaaagcttagttcttctatccaacacctactcagctgctgagagatgggaagatgcagctagaattagaatgatacagaagaaaagagggcttctcaagactccgggttatagctgggtcgatgtttgattaatgatatgaaattagggttttgcagtggaagagaaaaacgtaatcgagaaggcaaagagaattgcttactctgttttcagcttcctacttgaaatcacagccgttaaaaacaatttaactcctgaaatcagataaggaccgttggattagtatgtgtgtaatatatatatagcaatcttattgggccaaccgactttactaataaagtttcgtagtattgaaggtatatggagaagaatatgttaatttgtttctctttaaaatatgttccttgcgatcgtctatttatttctctgtccaagccaaccctaacaacagtgcgattcttatcctcagactcgtatcatctttatactaattacgttccaataaattcggattctttctctgttcttgttctgccctgttcttacttttacctcctcgtgaataaggttttataaaccctaaacctcaaagttagtaatgtttgattgttcaatttttaagaatgcataatttcgataaaccctaaacctcataaataatgttgcttaatctggttttctatatatagctacagctatatagtcttctttgctaaaataaccgtttcattaactaagaggaactaacactaatgtcttttgcgtggcagagctaattctttttcttagaactcaaattcttggttctgagatcgaaaagaggtttaaggatggatgatacaatg

SEQ ID NO: 2180 - DNA, 3000 bp, Unknown
  misc_feature (1)..( 3000): cDNA_ID_3066376_gDNA_ID_1620499_Annot_ID_158793 3000 nt of promoter + ATG
tgcatatggccaaacaggtatgcaatgacattaatgttcattgggaaatacactgatagttatactcttgctaacagattccagtttttagaggataatagattaatagtttcttcatgctttcatggccctaatgatgttttgcttattcaggtagtggtaagacatttacaatgaaaccattacctatacgagcagttgaagatcttatgaggttgttgcgtcaaccagtatacagcaatcagaggtttaaattgtggctcagctattttgagatatatggtggaaagctgttcgatcttctcagtgagagaaagttagtgttctttctttttctcatttcttataaatgtcgtctttgttgaggggttttatgttttccttttcttttggcatatactttgttcaggcatatactagcttataattgttatttcgatgtcagtatatcgtaaacattggcacttattcatcctatcagtgtcaatactttccattgttgtctactactatcgcaaatgcatgtttaccattgtctaaatcattcagttattgccgagtaggaaactttgcatgcgagaagatggtagacagcaagtttgcattgttggcctgcaagaatatgaagtttcagatgtacaaattgtaaaggattttatcgagaaaggaaatgccgaaaggagcacaggttcaactggagcaaatgaggaatcttctagatcgcatgccatcctacagcttgttgtaaaaaagcatgttgaggtaaaagacactagacggaggaataatgatagtaatgaattgcctgggaaagttgtgggaaagatttctttcattgaccttgctggcagtgaaagaggtgcagacaccacagacaatgatcgccagacaaggtaaagattctctttgcccctgtgattgagtagtttgagaattgacctaccactaatgtgtagattaaaatttatgcctctgttggacttgtgggcattgataaagtggcactttgctgctacctttttactttaggaccaccacacttcagatctaaatgcttcattgttttcattgtggatttttcttaggattgaaggcgcagaaatcaacaagagtctcttggctcttaaggaatgtatacgtgcactggacaatgaccagctacatataccatttcgtggaagcaaactaacggaagtgctccgtgactcatttgttggaaactcaagaacggtgatgatttcctgcatctctccaaatgcaggatcgtgtgaacataccctcaatactctaagatatgctgatcggtatgttttgtacaaactatagcctcttgtgaaacaaattctcaatttcatcgtctattaacctctgttggttatgtatggaataaacagagtcaaaagtctatctaaaagtggaaatagcaagaaagatcaaactgcgaattcaatgcctccggttaataaggatcctttgttgggcccaaatgatgtagaagatgtctttgagcctccacaggaagtgaatgtaccagaaaccaggaggagggtggtcgagaaggacagcaacagcagtacgtcgggtattgacttcagacagcctacaaattatcgagaggaaagtggaatcccatcattctcaatggacaagggaagatcagagccgaacagttcttttgctggctccactagtcagagaaacaacatttcttcatatccccaagaaacttcagaccgtgaagagaaagtaaagaaagtgtcaccacctcgtgggaaagggttgcgggaagaaaaaccagacagaccacaaaattggtctaaaagagatgtcagttcgtcggatatccctaccttgacaaattttagacagaacgcaagtgaaactgcttcaaggcaatatgaaaccgcttcaaggcaatatgaaaccgacccttcgcttgatgaaaacctcgatgcactgcttgaggtaaagtactcacctatccctttaaaacatgagatgaagctgtgaatttgatttgcaagtaacggtagttctgtttatgtcttatcgtaaccatcacatgacttttttcaggaagaagaagctctgattgcagcgcacagaaaagaaattgaggatacaatggagattgttcgcgaggtatgtaaatcacatcattgcagcgcacaaaaaacgattgtagaatgttatcacatcattcaattttcttttctgttatatcattatcaggaaatgaaacttctagcggaggtggaccaaccgggaagcatgatagaaaactatgtgacgcaactgagctttgtgttgtcccggaaagcagcagggctagtcagtcttcaagccaggcttgctcggttccaacaccgtctcaaggaacaagaaatactgagccgtaagagagttcctcggtagttggtagaagaaggaaaaccaaaagtgtggtgttgtttaagtgtgaaaggttggttgggtgatctcttcttatatatgacaaagaatgacagaaatgtccttcatgtttgtgaatttgggcatttctttccttttatttttgaatctttattataaagttataccttttgtgtttcttatttttctcttctcctctatcctcccagaaagctggatactgtcaatgtgaatcaaactcttttatcaatcaactgaaaaagtataaaaccatttatcatctgaaaatgtttcaaaatttggtgagccatatataaaatcaaatttctaacaattaataagatcttcaaataccatctatatagtgacaaccaatgaaaagacagttgaatagctccaaaagaacaaataaagcaattctctcttgtcgtaaagataaaatggccaacaagattatgcagcccaactaaaaaggccttggcccacactttactattgatcacgtgacatgcctttttcacgattgcaatataagagccattttccaccgtccgatgttaaaacccaaaccgatttaaaccgtccatg

SEQ ID NO: 2181 - DNA, 3000 bp, Unknown
  misc_feature (1)..( 3000): cDNA_ID_3434240_gDNA_ID_1620499_Annot_ID_158794 3000 nt of promoter + ATG
tctgggaagtagaaggaaaggtcagtgtcatcgattctacttcaagttttgttttgattttgttaaatttttgttttcctgttctgaattgggttttgattttgttatccagtgggttactgtgggagctgtagatgttaacattggtgccaatccatctgctgaagaaggtggtgaggatgaaggtgttgatgactctactcaaaaggttgttgacattgtcgacaccttcagacttcaggagcaaccaacttatgacaagaagggattcatcgcttacattaagaaatacattaagcttttgacacccaagctcagcgaagaagatcaagctgtcttcaagaagggtattgagggagctaccaagtttttgctccccaggctcagtgacttccaattgtaagttaccccaatctatcgtatcttgcttgttatacatgacatatatttcatctgaaatctcatcaatgcttgtgttgtctgattttacagctttgttggggagggtatgcatgatgacagcactttggtctttgcttactacaaggagggttcaactaacccaacatttttgtacttcgctcatggtttgaaggaggtcaagtgctgagagagaagctctcgttgggttactgtggtcggtcgcagcgactctctaagtttatgtttctttatattgtcctgtgtttcgtcgtcgtcccctattaaaattacctgccagtttacttttctctcttcttgttttctgtgttggaagattctcaagttatttattccgcaaaaaacggtttatcatttacaattagttgaattttggtcgttactttttgtgttatttggtgtgatatctcttcagctttgcttttctaaattaaactcccgaatctcgaggcatgtttatagtagatgtctaataattttggattcagatcttatggacgtgaataaacgagtgggttactctaactgttagtaactttaaatcatggaatatgctgtagaatgattcttttgactttagtctaatggtgttttatccctttaaaaagaaaaagtttcgtacagacatgatgtcttgagacatcatcataggcatgttctgctccttatcaaggatttctatctcacgtgcggaatcgatactaactagagttctgtcatcttggttttagttgtgagacaaatcacaatgtggccgtaataataatgtattatgtgtattcttttactttgacaaacaacacaacctatcctatgctttactattcttttagtttgttggttttattattcgaactatttatttatgtatgtgtggtgtccgtatggatgagagggcaaccaaaatgcgttggtacgtatttgtgtctcacgtaaaaggaaacgtgatttggtcttggtcggtttgacgttgctccaactctcttgtatcttatgtatttatcgtcattatttcttcaaactttgttgttcctttcgttttaggcttttagcctacactatttaaacatttcttatgtaacaagtagtatcaacttctatctatatgactatattgacgtagccatacaaaggaggtagatcatctaaacttacacaaaactagagagaccaatgtttttaggaaggataaataaaggaaaagctcctttcatactggtttatatagtgattacttaaaatcaggaatcctttagatcggaatgctttaggctaaagcaaaagctttttgattcaaaagaaaggaacccacaagctgtattagccccacttcgctacttttgcatattctcgttcgtatattttattggattaacacttttttttggggtttaaacagtacacatacatacacaagattggtacttttgatatacactcacttatattcgcacatctaaacaattcaaaatttgaaaccgtataaaaatttaaacaaacataagaatatataagattagatcattgtcatgtactaaaattccaaaagttgtggatttcatgtcgagaaaaactcatgtcatcttcctcggacaatttcaaatttcatctctattaccatagatggtccaaaacaacatccttaaataccataaagtagctaaaatctgaaaatgcacataactgatcaacccaccaaggttatattattagttatactacatatataataaaccaatcaatgtttatgcaatctgctcaaaaaggtatgagattcataccgtatgattcaagatgagaacatcaattctatttttatgtcaccatgttggtatatgtccttgtgtcacgatctcagcaaaaaaataatatttcaacactatcttttagaatatataagaccgttcaaagaagattgtttcaaatgttttggactagactgtacaatcttaaaaagtaggacaaatcggtgaatatttctgaagttaaagggtgatctaactgtcacttttttaaaaaacttttaaacacctcaaactttttaatttattgtgtaagtgtcttatactttgtcaaatcttcttcaacgcccctctctttctcatctctctgcgcctaacgtcgcttacggaagaagacgaaaattttgaacagaagctctctctctctatctctctatctctctatctctaacgctattcgatgtgcgtaaattagggttcttcactcgtcggatctgattgtatattgtgaaaatctcagatctcagatctcttatctaacaccgttgcgtgtcttcgtttccttctggtaatcattactttggataacatcgatcttcttctccgattattggatgcaatttattgattgaatttcagattttgaaggaggtgaagcaaagtcgggagctgtacatttccgctttcatgttctgtgttgaatccgaattctctccacattgtgagtttctcttcgatttgaatctaacattctattgttgaaattaggaattttttgatttgtaacaaatgggtgattctggtttttgtatggatg

SEQ ID NO: 2182 - DNA, 3000 bp, Unknown
  misc_feature (1)..( 3000): cDNA_ID_2151638_gDNA_ID_1620499_Annot_ID_158786 3000 nt of promoter + ATG
acttctacattcctttgcttggagggttttagtcttgtttcttggtttgttttgttaaacactagtataatcgttaacaaacataatgacacttttataattgatgtttttgcatcttctcttcattttcttctccttccgcctcctattcaggtttaaaacgtttcacacacacaagttattatcaagcttaattggcggcatttgcccgagtaaactatgaaattctagagacatgaattgattgatgtttgattggtttaaaggattaagtttgtgcttctaagagatataaaaactcatcatggtttattattttgaatcggttatgtatgtttgactagcattgggccggtccgagtctaccgctcgagatagctcacacaagtctagtggtccaaagagtcggttgcttgatctatactccattggaatcacatcgtgtatttagctgatatatgaatagatggtaggtacaggatttgcttatatccaaatctattaatagttcacagatcccaaaataacaataaaaatatcaatgccagctgcagaaatttgatgtgaccaatgtgtattgaatctgcgaaaagaaataaaattgtaaacaatgctgtttgtaagagagaaattgtataagtgtgtgggaaagctaagtccgcgtgacaaggatgcggaagatgatgtgcttgtcgtttcttgttcatatgcacacgatagagacttattacatccatataaaattatgtatagatgagcctcattattggatcatcaatatttacatataataattctgaatgtataacaatcggtgagtgatggggaagtagtggtccaaacttttggtgattttaacttgttatcttcttgtattgttgtgtcaaaatgtgacaagaggaagtgttagacccgttagattttgagtgcaataaatcaaaagtatctctaattgaattgttgttagttgtgtgatatttaatgtctcaaaaatgggtccttaaccatctgtttctcttttaaattaatgtaacgttttttctttttctttgaattttttttcctacagcaacctttcaatttcgttaatcacgaagagcttatgtgtttggcttataggtatgagtccccgtgacaagaaattttcatatagaagaaattgatggtgtattaattcatagtgtgtgcaaaatgtatcatataataataaaatcaatattacagattatccctacacgtgtggttgctctgccgaaagctggctttagttggctcccaaccaaatcctattatcgcctctttattcgccctcaatatacaactttggtttgtacgaaattattattttatttagttagtgatcatacttcttcatatggaaacttataattatagtttatgaattagaaaaccttattttatttttctagcatctggtatttcttcggcacatgcatgcatgatgcatccatggaccataaatacgaaaacaaatccatttcatatatatttacttcaataacaaattcgtttatgagtgatgatactattaattataatgtatttattccatagttttttttctggtttatgtaaacaaacttacatcaataacagagataaattcccagaaacatttacatgtgtatgaaactctaataatccgcaatgaacttagaaatataaaccggtaacaaaagaaaagagaaatttctgaaaaattatatatcagaaaaagaaaagaaaaaagaattacagtgagactgacagtgatagattcatgagcgccggcagcgagtgatggcgctgcagccacgagagtaaggattggcctgagcgccacgtcgacaattgtagtaagatgcgccgcgacgtgagcacggaattgtgtttctcctcagcgcaccatagctgatgtacctcctcgtagctaatatgcgccggttgatctctgagtccatctcgaactcctctcccatttctcctccgccgtagaatagatctcctccgtctccgagggcggcggaaacagagcactcggcaattgtaccgcggcactctgtttcgaatggagggaaatctccggcgaattcggtggattgagaagatacggcgacggaccagttatgaacggcgagaatgagtagaatcgcgaatatcgccgccgcgccggagtttctggagagtcctctcattttcttctgtacactgtagctttagctctctctgtgcacgaactatgaagaaagagatagagagataaaagaaaaggtttttaaaagagaaggagcttaatgaaatgccactgaaagatggaagtaattacgaataataccacttggtgtcgtaaagagacagctttacaagtggccttttgttagcttcagatctaaggatgttttaatgcgccaagtgtttttgatggagacatccactacttatttttcttttttttcttaaagattttgttggtcacttttacgatatactaaaatcatattcaccaaccatccacacaattttacaaattagtaaaatttcttttgttatataaatgaataatttacattttgctaatttattttggaaagtatactgttttaaattgttataatttattagaatcgtaagtagaaatacagtgttcttttctaccaaaaaaaaaattaataaaaagttctgtttatgtttttgcttatgtttcaaggtactactatactaacaagaaattaaaacgatagtacaaaggtagataagacttaagagtaatatagaacgcatttacttttattttgtacaattatgagtggtctccttccatgatttgagactatttcaaatgaaaaaaaaaactacctattaaaatgccaacatatattaatgaagggagtttaatgtacatctcttgtgtattgttcatatttgtgatttccaatttcatcaaaatggacattataagtttgtaactaatttataaaaaccaaaaagaaaatcaaaatg

SEQ ID NO: 2183 - DNA, 3000 bp, Unknown
  misc_feature (1)..( 3000): cDNA_ID_3098960_gDNA_ID_1620500_Annot_ID_158831 3000 nt of promoter + ATG
caactaggaaattatgttcccctgtgtttagacctatattcaattattatagaattttcaagagcaataaaaaaagaaagatccaactaagaaagataacgaacacatgcatgagattgtggtgcatgtaagtgaaaataagtcgtaataatcaccgacaaaacgcgttaatacttattatagatccttataaaacgagtccaaatgtcttccttcttcttcaagcaaataagcaatcaattgtgaactcaaagctttcttttctcgacctctctttctttcatcacgaaaaatttatacttatctcaaataaaataaaaatatatatatatggatatgaagggaacatacttagtaacggttattctcttggttagtacgttaagtgtggggatgtgttctaacggttggataagagctcatgcaacgtattatggtgtcaatgatagccctgcttcacttggtaaaaaggccattaaactattgtttaatatacgtttttgttacttcaaagtttgtatggtaaatttgttttttagatacaattttataggaggagcttgtgggtatgacaatccgtaccacgccggattcggagcacacacggcggcgctaagcggtgagctattcagaagcggtgagtcatgcggtgggtgctaccaggtgaggtgcgactttccggcggatcctaagtggtgtctccgaggagccgccgtgacggtgacggctacaaacttttgcccaacgaataacaataatggttggtgcaatctccctcgccatcactttgacatgtcctcccccgctttcttccgcattgcccgtcgcggcaatgaaggcatcgtccccgtcttctatcgccggtaacttattcgatgctataggagtcaattgcttttttatgcatatagtgttcatcctttttgataagttaataaactgaaactatacattaaagtatattttggagttttttttttttctttttaaaatgtaaggtagagaacattatacaaccctatcattattttaagttattaacattattgtttaatttatttcatctacatatcattattttgctataatgatcattagcaagctaggtcattatatattatagcaaaatttataaggaaagaatggatgaagtttagatcaacatcacattataacatgtacatatacgtacgctcacaaacagaaaaaaaaaaaacaaaaacaaggccaatccttcaaaagaatctggaaaaaggtttaaatggactttagttaaataaaaatatagcatgtaattactgtgatatttatgcaaaatatctaatagttttgtaatgtgtatatatagggtgggatgcaaaagaagaggaggcgtgaggttcacgatgagagggcaaggtaacttcaatatggtaatgatctcaaacgttggtggtggcggctcggtgagatcagtagcggtgagaggctcaaagggaaagacttggcttcagatgacccgtaattggggtgccaactggcagagctccggtgatctccggggacagagactctccttcaaagttactctgacggacagcaaaacgcagacatttttgaacgttgtcccttcttcttggtggtttggccaaaccttctcttctcgaggaagacaattcgtttaactacaaaactaagtcgtgctctggtcaaaacgcaattctttgcttatttctgaacttgcccttgttttaattgggcagtgttcctttgtttctcttttattgctaaataatttcatgcttaattttatttaacggaacggtttctcatttatgtatgaagcattactcgacaagttaaagagttttgcagaatttatattaatggaaataacattttttacaagttcatttgtcaacaaaattatcagagctaatagacaccatgaaaaaagactattatcagataaaagcttcataaaacacagattagtatataaatgtaatgttacatgctagctttaattgaaaaagaacgacattgtcaggtacgtaacttgaaataactctttatcttcttttttttgtcaatgaaataattctttctataaaataataataataataataataataataattctttcttacataaagataaaataaatatataaaaactataataaataaaacagagcaataaatatataaaaacaatttttaaaaaacaaggtgctggcccatgctttttaaaaaacaatctgttgatttttcaaatacaaactaaatatacttagaaagttaattaaatatcactaaaacctacttttgggaaggttattaaaaatttccctccaacttgggaagaatgtttgtgagagattaacaaaaaatagatgaaggtttcacaccacattcagttccttatcaacagattgatgtgagcttttaatgaataaaaagctgttttctttttgtcatcaatttcttctatacataactctggtccattttttattcatgttttaataatataacaaagaaaaagtggaatcattgtatttttaatgaagtggatggcgttacagttgcagtcttgcagatctcaaagagaataagaacaaaaaaaagcttgattttaaaatctattcaaaaaacagaacaaagatttttaaattaggtttaatactaggattaaaggaaccatttaaaaatggtcataagaaatctcaaagcccataagaaccagacatggattcttttcatgtgccatggatgatataagattgaacagaaaccatttaattttatcttttaccaaaaagaaaataacttttaaacagaaaaagacataaatacccttcaagtgctttcacactctcttctcgaacaatgaacacagagaaagagagagagagaagacacttagtaaagaaggtctgtgtgctgttctctccgaaattcctttttttggtctcgagggtttttcagactgtgaagagacatagctgtggcaaag

SEQ ID NO: 2184 - DNA, 3000 bp, Unknown
  misc_feature (1)..( 3000): cDNA_ID_2025006_gDNA_ID_1620500_Annot_ID_158859 3000 nt of promoter + ATG
cacacactcgaattattttatactaatagatagatacctttcattcgagctcttctggcaacatttttggcaataatcaaaagaatatacaaaagccacacacataaaaaggacgcatgtaacgtaaattacgtgtttttatattcttttgttacataacttacgtattgctgacgataaattgagatggttattttagtgtctaaggtttccgtagtggtcactggttcgtgtgatgataacacagtacgttaaaaaagggtccttactacaacccaccattttgttggacaacattcatgcactttttttttcgtgttaaatattcgttccttgagattaacctcttgaatatgcgttcgcaatcgataagtgaaagctattgaatctaacgagagtacgagacaatatctcaaatagaatttgatttcgaccattaaaatatcagaatttagttttttctgtcgtccaaaattcatcagtagctatctattcgaaatagttcaatatcctgttatagatatgtttttgactacaaataaatttcccatggatgcagatgcatttacgaaaagaatagacttttcttttgttctattttgtgttatgtgaaaagaaaaatggtgtagcaagtaggaacgtaagctttagactttagtgtttgttattcaaaaaagatcacttaataaagccggtggggttaatgcctctccttctgtttcccatactcgttttacgtttgcttacattttgtcaaaccattggaccccaaaaattctaagtttatagtatatttctttacttttgcattatatatactattttctataaataaagagtgtgaatattcagcgggaagtttttttttaacatactttatcaaaaaaaaaaagtatgatctaaaatattagctaatgattatatctttaatttgttttccatacgagacagtttgtctacatcaaaataaaatataatggacctaattgagtaatcttggtttagaaacaactgaaacagaaataaggttagtttcggtttactagctgcagttaatatcgacgattatgagaaattatcggatttgtgtgtttaaaagcagaagatggaaaaagaatctagttgctgtctgatcgtaattacaaggggtctattcacctaacaactaaacaagaccacgattagcggagaatcaaatattaacatgtattagtataccacgtgtcgtcctgtaaagtggtgagagtgtaagatgtacggctgcaatttgatgaatgaacttaccgatttacaaaaaatcttacgcaacggatgttctctccttgtctgtgtcacctccacctctttgtccatcatttgtttcatcgcatttcttcaactatagtccataccaataaaatagatatcttggatttgaatgatgatagtatttcgagtggaaacaaggataatgttaatggatagataacatagatgaatggtagattaatcttactactaattaaaaatatcttcatcaacgtcacaacatggtaacaatattcacgatattttcatcaatattttctggatccttctctagagacatacacatttctctatttgttttgtttttttgtgtggaaaattgcaggcgatctcgaatctcggaacacagtgcatgcatgataatagacatatctatttacgattcaaatctcgcgtcgtctctgttggtagctccactggctatcaaaaaccatattttatacctgttacagtatttacaattttaataaaagagagatatttctattttctatattaaacaacattatctcgaagatgcatacatagttccatactttagtctttgtcgcctttataagctttctcatcttgaacgcgcttcttctttgaagagacttttacacatggtcagtctctctcagctaattctttttaagaaatttaaattttctgtctcagtgttcaaagataggatctgagtaaaaccaaactcactcattagctagtgatcatgtggtaattaaactacagaataatcagataaatattcttatctttttacttttagttaataatatttgtctcttaatctatgataaacaaaaatttcttaaccagttaacagaaaacaccataaattgagttaaaaaattgcataaatgcatcattaaataaaaccaaaattatgaatgtttgcattatcaaataacatgaaatagtggttcatgatactttcattactgtgtgaccttccacatttcgtaatttgtataatgcatggtgttattttacaaaaaatcactaaaagttagatcaactatttaaatttgaatcaagagctttaattagtgttcactgtaaacaagagaaaatattacgtatgaaaatgttatgtatacagtatttaatacttaaaggtatcttaaataaatttaaaagaaaaaggttagctaatgattttctgttagcaacctccaaattaaaaatctagcgactttacgggttttttaattcagaaaccagtggtttgaaaaatgcagaaaccgacaagcatagagtgaaaaagaaagcgcgtgaaaaaattgtaagaccaaaagttgcaaaaaaatatccctttccataattccttcctttgccccatttttattttcttcttcatccataataacttcactctctcccccccccccccccccaacatgttcctgtgacgacgatacactctttcactgacttacccctacctcaaaatcaccttcttcttcatcgtctcagctcaggaattgctaactacctgtttttgaatttgagatctgtttttgtttctagaagaaaacagcttgttttcaccgtctctgatcctctggtacttgctttttactttgtatgttagttattcagagtttgaaattcgaattttcaaatttaactaactcgtagatcggatttttgtttgtttttgtttgcatcagatttgatcggaatctaatg

SEQ ID NO: 2185 - DNA, 3000 bp, Unknown
  misc_feature (1)..( 3000): cDNA_ID_3066411_gDNA_ID_1620500_Annot_ID_158858 3000 nt of promoter + ATG
atttacaattttaataaaagagagatatttctattttctatattaaacaacattatctcgaagatgcatacatagttccatactttagtctttgtcgcctttataagctttctcatcttgaacgcgcttcttctttgaagagacttttacacatggtcagtctctctcagctaattctttttaagaaatttaaattttctgtctcagtgttcaaagataggatctgagtaaaaccaaactcactcattagctagtgatcatgtggtaattaaactacagaataatcagataaatattcttatctttttacttttagttaataatatttgtctcttaatctatgataaacaaaaatttcttaaccagttaacagaaaacaccataaattgagttaaaaaattgcataaatgcatcattaaataaaaccaaaattatgaatgtttgcattatcaaataacatgaaatagtggttcatgatactttcattactgtgtgaccttccacatttcgtaatttgtataatgcatggtgttattttacaaaaaatcactaaaagttagatcaactatttaaatttgaatcaagagctttaattagtgttcactgtaaacaagagaaaatattacgtatgaaaatgttatgtatacagtatttaatacttaaaggtatcttaaataaatttaaaagaaaaaggttagctaatgattttctgttagcaacctccaaattaaaaatctagcgactttacgggttttttaattcagaaaccagtggtttgaaaaatgcagaaaccgacaagcatagagtgaaaaagaaagcgcgtgaaaaaattgtaagaccaaaagttgcaaaaaaatatccctttccataattccttcctttgccccatttttattttcttcttcatccataataacttcactctctcccccccccccccccccaacatgttcctgtgacgacgatacactctttcactgacttacccctacctcaaaatcaccttcttcttcatcgtctcagctcaggaattgctaactacctgtttttgaatttgagatctgtttttgtttctagaagaaaacagcttgttttcaccgtctctgatcctctggtacttgctttttactttgtatgttagttattcagagtttgaaattcgaattttcaaatttaactaactcgtagatcggatttttgtttgtttttgtttgcatcagatttgatcggaatctaatgggtaaaaccaccgggaacagagattggactcagatctacgctatttacggaatcgaacaatggcagacactcgtcttccttctcttccatgctttcttcttctctcttctctctcttctcttcctcatctacttcgatcagatttgcttcttcctcgattccttcttcctctccggcgccgccagattagccgcgggtttcaccggtgctgtaaccgctctctccgcggtttgtctactcttcgccgcagctaatttcgtttactcagatgttccgcttcagtacgagatggctcaacgcatggttagctccgtcggtgactggtcttgtgtcaaaactgctctcgatctcggttgtggccgtggtatcctcctcaatgccgtcgctacacagcttaagaaaaccggtagctccggtcgggtcgtcgggttagaccgctctaaacgcaccactctctccactctccgcaccgctaaactcgaaggtaactgatcaatttctcctaatttcaaatcgaatttgagattctcattgtttttgtgattcaaaattgtgtaggtgtgcaagagtatgtgacatgccgtgaaggagatgtgaagacgttgccgtttggcgataattacttcgacgtggtggtctcgtcggtgttcgttcacacggtggggaaagagcatggtcagaagtcggtggaagctgcggcggagagaatgagagtgctcggagagattgtgagagttgtgaagccaggaggtttgtgtgtggtttgggatctcttacacgtgccggagtacgtgcgtcgtcttcaagagctaaagatggaagatatacgagtctcggagcgagtcacggcgtttatggccggaagtcacatcgtttcgttccggaaacccagtgaactcgtcgccgggccccgtgaagtccgcctcgattggagatgatgacgtggtgttcaaaacgacagtgatgtgtgtcggttcgttatataaaaaacggcacgtagttgaagaagtctggaggttcgacactataattgtaatatattaattacgaatctactactactacactagaaaatcaaaatgtatgtggcgtctggggaggcgaagcggaaccagatgctttgatgaagaggcataacgctgcgtttgcgtttttgtcttgtatttgtataacctatagtttttattaacatattaagctgaatcttaatatgtgattcagagaagagtctttttactgttgcgttttcaaacgcgggtaaaaaactaacgtcgtggagagaagtagctgaactttgaaactgtgtacgaaaaaaaaataaaaaatttggagctttgttgagtgaatttcaagaatgtcgtctgtgtagtagatatggttgggcattaaatgacttgtcattgtcacttcacgtcaatgtggtatctgttccctatatattattaatttattattttagtatacttgggccagatttgggccaagccttaaagctactcttgcttcatttttgtctgttaaacacccggcaaagcatgcacaagcgaattctcaaaacgttgagttgttttgcaagatgcaatgcgtgtcgactgtacaaagtagaacaccacgccgtttctcttaacttcagagtagggcacgtgtatccattcaaatacctccacgtaagcgtttcggagatgaggcgcgccaaagaagaaagctcatcgtttattctccctatccttgtctctgtaacttgcaagcttcccatcaatg

SEQ ID NO: 2186 - DNA, 3000 bp, Unknown
  misc_feature (1)..( 3000): cDNA_ID_3066403_gDNA_ID_1620500_Annot_ID_158863 3000 nt of promoter + ATG
tatatccgcagaaacgggccatatgtcggaagattgggttagaagctaccgaatcgaaagcccaacaagatatcgaaccaaaccctatagttttactttggcatactttaaacagattttctgtatctgacgccgttcatttgttttactttctccttaacatccgacgactattcttatgataaagaaataatatccaagttaaataaatatttactcgactaatgcgtccgctaaacactcgtgctttccttttatagcttgttgcctatttgtcggacaatgttttataattgttaaaaagtttattgaacattttaaaattgtatattttggagtcgagaagaatcaaaagttattactaatatttattaatgaaaatgactaacacaatttaaaaacggaaaagttattcgcaatctaaacgttacataaactataaactaaaacgttacagaacctatgaaatagcatacggcttagggctcactagttattgagagttctaaattttgacttaactaaaagtccttatgaatcaatatttttcattaacagtaaccatttcagtatttctacataggagagccttctttttctgtcatcacttattactgttgcctgaaactattccggtaaagattggtttttaatttcccttcatgcttaaccagatattcacctgattctcccagtacacatgtaatttatgtgctttacataaaacttaaaaaaatactgacaataattaaaatattcgtttgcagtttcataatttagtttatgctgcttatggacgtgggaacatgcttgtagtttaacttttatttggtcgtcaatttgattaaaaattataccttcattgattctttttgaaagatacgtattgtgaataatgtataaaggatttagaacataattatgatccttgagacttgtaatattttattaactaaccgaaaacataagcaagagaatcgtggataacgacctaacgtataagaaacatgagacatgtcacaatcactttaaaagttttcctatcaaaactcgagtagaagcacatgaaatttctggatattaaaaataaataaatcaaaatagccttatattattgctgtcaggaaataattctatttagactacctgaatttccagttgaacggcgtttttccaaattgcaagcatcatatattatgctcatcgtatcattagtgcataaataaactatggaccaatttcatggtgaaaaaggggcttcggatgaaatttttgatcaaattatatttgtttattgataaaacaaacgttttttttaaaggatgacagttgtgcgtttgagatgaaaaccaaacactgctcccactcaaaatttgtaaaaatggaatttataaatatttggtgctacaaatgtcgtttggtagcctttggaaacattaaaggtaaactagagatatgggagtatggaacttaatctctttatgtggttgtatttcatataatttcacgtggcccaacttgtttctgtcaatccattgatcaaagttggtagacaagagtgaacccacacacactcacacacatacacacggtcgatctttttttctattctcgtgtccctacgtcctctaaaccccatcattatacttcttgtgttttattggtatgctgagctagagatagttaacaactacccaacaatgcgggtctggcttagtttgaacctattcgaaactagttatactccgcttgaagtcattggttcgagactaactttggagatgagtatcataaacagctctaacttaagattacaatacatcctcttgttagtctaagttgagaggtgttgccattgactatatatttctttgggaatttggtttaccaggatgttgcaaagaagatttaaatagttataaattagtacaaattcaatccatatgatatgatattcaaaaaacaaaaaaaaaaaaaaactgatctaaaagtcgaaccaaattctaatttgattagagcatgtatataattgaatccctaagtaaaattcaacccaatacttgagaaggtagttatattcttataaattatggatatgatttgattaaaactcaaacctgaacccaaaacatactagaatatacgtttttactttgtaactatttgtcacattccaaaactaaactcggtactatatttgattctgatccatacaaattttgtatatctggtttatattctccatgtgagattaaagcggtgaccaatcaaaatcattgctggaatatcttactattaagctaaatgttgttagttatatacaagccaatccaaaaaaactgatgcaaagagagataaacgaacatatcccaaaatggtaggatttgatttaatattcccatcctcttattagaaatgcaaacaaatagactatagttttatttatttattttcactataaaataactaaataacatgaacttattgaagaaaaagtatactatagttgtgattctgtgatatactagttagaacaagaatctttacaaaaaaaaaacacatgggatgttaggagaaggagattcggattccaatgatccaacggtcagagaaaaatcagaagaaaatttcacaaccgtaggatctgttcccttaaccaccttgtaatgccggtctttattaattttgagaaaaaaataaaaacagcaccaaacttatgtctctcatgtgaccgaccaccgcatcctcagttgacctgtctctgcccccactttgtctccccacacaaactgaataacaagaagaagaagactttagatatcaaatgactccacgtgtcgatattggattggttttcattggttgtatcgtgtggaccaacgaagcaacatataaaaagcacgacgcggtgccattactacaataagagaagtgtaggagaagaaagttctcatttcataattgtatcaaattgtgagaggaaaaaaagaagttcaagaa

SEQ ID NO: 2187 - DNA, 3000 bp, Unknown
  misc_feature (1)..( 3000): cDNA_ID_2047614_gDNA_ID_1620500_Annot_ID_158836 3000 nt of promoter + ATG
aattttatagggaagacagtgacaaattcttgttatttataaaaaaaccaaatttgaaaatcgaagagccaaattgcaaaataaatttaacatttttttatcggatgttacaaaaataaattagatatccacataacatgtgcgaatgttattgataattttgtattaatcaacaaaaaatacatgtcgggaaagaaaaaaaagtgtttcatttattgttatgaaccctttataagttatgtattaccaaaatagcactcattgttttaaaattacaaattagtccgttcttttattcccgtactcgttccttcttcttcttcttcctctcatcgtcattttctcgattctcactcttccggtcaccgactaattctggttagctcacattccttatgctcattcatccacagttccctaattaacgctacgaattttgtttctcctcttatttcttctttcctcttgtagaataaggtttatcaaaagaataagaataaggtttatctcttaaatctccgataattagcagagttttttcaggattgagtttgatttgctgttttggaatcataaattttgcgttttagtggataaaaagctagctttgaaagagttattgcagagaaaaaaaatgggatcgagagggattatcaacgataagtggtcaatgaggattctatggggttgtgctatcggaagtgctattggtatgattgatccatctttcccacattttcatcttagagactatggtttttgttactcaaattcatgagctttttgtttgtatgggacactttctttaacccataattgtttaggtttatacatggttgctgtagagagacaaactcagaacagggctcgtgctatggctgagagtttgagagctgctgaatcacaaggtgatggtgataatgtctaatatctaccaagtagtgctcagttgaatactctcagttgagtttttttttttggtgtttgtttttgttataatgacttcttctgccaagatggtgttgatgtagtttcttttttgcaaataatcgtaataaggtttcgaaacttggagagttgaagttgctgaacatacgatttgtgttatcgcaaaaaaagttatttcttatgcctgtcatgctatgtttgtgaattcgatttttaatgcgtattttcagcaaggcgtcttgcgtttaggggatgtgttttctattaagtaaaagtcttccttcctataaaagcatgagggatcattttatcaggaatgtacagcaggatcaacttattacatagaaataatggctcagggacaccaaggcttatgctttgggtttatcttcttactatgcttcttcagctctacttttgcactcaggattcttaaggacctccctatgatggagccaagaaagctagatctgaaccatgaaatgatgcctgggatggttatgctacagccagatcatgaggtccaacctgagcacacggtcaagcctggccatacactccagtccatgtccggtgtatcagaacatccagagcacacggttaagcctggccatacactccagtccatgtccggtgcattagaacatcctgagcacaaggaaaagcctgaccataaactccagtctatgttgggagaacatcctgagcacaaggaaaagcctgaccataaactccagtctatgttgggagaacatcctgagcacaaggaaaagcctgaccataaactccagtctatgttgggagaacatcctgagcacaaggaaaagcctgaccataaactccagtccatgtctggtgaatcaaaacatcctgagcacaaagtcaagcctgatcagataatgcagaccatggcgagtgaactggaagaggaagatcctgaccacacaagtaagcctatggggtatggtgtaggtaggggctatggaagtggtgggtctggtgttggctatggcgttggaattggctctagtggaggcagtggctttggagaaggtattggctctagtggaggcaacggctttggagaaggaattggctctagtggaggcagcggctttggagaaggaattggctctagtggaggcagcggctttggtgaaggaattggttctggtggtggtacaggtattggcattggagaaggaataggatccgggtctgcccaacccaattgcggccctgtcacgggagctccaggtagcggattcggtgaaggcataggacaaggtagtggtccaggggaagggattggtatcggtataggacagggtggacctagtgtagtagtcccaggcacaagaatccctccgatagtggttccaggcgcacagattcccggttttgtgattccaggtatcacagttcctggctacggtactggatgccaaacaggtggctgcaatccgaacccaccacactactatatcccaccaagctgtccccattgtccacctttcacatcaggacaagacaaacacatgtcagacaaaggagccatgaccgaagctcttgcacccacttcaccggagatacatgtttaagctttaagagtccatgaaacaccagtctaataaatcactcataatgaaatctattttggtttataaaagcttcacagaaagttgaataatacaactttcttgctcaagtaaaaagatatataagggaaatgcatataagaataagtgagaagtactcagagacagaaaaagattgattaagaattaggcagctggtaattgcatttccatggctgtgtatctgtatgactgacaaatgagtttaaatagaccggtccacaaatcaagttaagctctctactttaatggaaaatacgaactttagcttatataatttcttaatttgaaatgacataaaaagaggtgaatttttcttaaagcattaaactttccgaaaggagagtggtggcactgtaataacgacggagaagaacgaacgaacgcgagagatcgagagagagagaaatattta

SEQ ID NO: 2188 - DNA, 3000 bp, Unknown
  misc_feature (1)..( 3000): cDNA_ID_3098881_gDNA_ID_1620500_Annot_ID_158843 3000 nt of promoter + ATG
ttcattggtgatctttatatatatatatattttttttaaacaatctacttttatagatagatgataaggtttccattatgtgttgtatgacagagaatggtgcttgtgattgatttgaagtttgcaataaactagattttaatagatgttgggatgaattagtcatagttaattttttcttttttattaaaatatctacgttaacgaaaaaattagcgatatgaccttgattttacctaaaagggtcttgaaaacatagtttgtaggttaatcatatatccagcggtagtttctcgtaatactttgtcactaacatgtattatacgttttaatttggatgatgacatatagacgacaaacaccacaaacatgaaacaactatagatcacattttcttatattatcatctcgtttggttttatttatgtctgcacaaaattatgctttcactcgtgtcatgtgttgcgatcaatgttgtactccatcagaaccagcccaacaccatcgagactcaaacatttaacttcgcaatgttatgtcactcttcaaagcttcgaattctttctgacatacctatatcctctttgtccatttaattgatttattgaaggtgtggttactaaataacgtgaaacattgttgtaaatgtatgcgttaaaccaagagaaaatgcaaacacagcaaaaagggaaagaaaaaacataatggcgcaaagagagctcagagacttttatatggaaatagaagatcctgctttttcatttattgtcacctcattttcactcatttataaattttattttccttcgatttcctagctttcattttagatattcctctgtggtgtatagagtctactaccaaacaaaacttcataatgcaatcttgggtttattcgcacgaattagcataaataaacttttgaattatcacataaaaacattcacatgtttcacatcaaatttcaaactattactaatgtgatatcatcaaatcatttggtgtttgttgacaaaacaaatcattttatgttgatgatttaattaagcatgcgacctcacatgtcgctgatacaaactgagttcaagaacataattagtacgtaaagaaatagagagctaaacgacacgaggaatcaaatctatgtaactacattcatgtcaagctctctcgagcttaacaaccatctccaagctaaactacacaatctaaaccggcgctaacgagttaactttagtcttaaccaatcgttgttaatatagaacaagatacaagtaaaccattatatatgccaatattgtggttacaaaagtgaatgatgtatacagtatatatggtttttgatccacgttatatcatatatttatccaactagtccaaaacaacctaaacaaagccaggaattgatatagatcttccaagaaatgtcttacaaacaaatcaaaaaacttaaatccataatagtctcgtgatttgatatattcatgtctttgtgtattaaacatgtttatactagtggtcggttatatcattagttgtcaaatgtttattttgtttttttgtttggtttaacgtttgccaagtgtttttgcataatgctcttgattagcatactaatcataatcggtataaaaaagaatggtcccggagagagagagaagaaacggtgttgtaatgtaaataacggtgggacgggagaaaatagagtagggaaggggaagagaggcatgtgttactgattagctgtcctcttctctgcatttactctttgtgggccttacaggcccatttctcctccctccatcttgtttccacttttttttttttttcaaaagttttatagtgtttttgaaacaaaataaaacctcgtataatcactaaaagattgagatttgagcgttacttatggttcttatttccaatttcttttggtgttgtgggccttttgaaacgaaagatgtgtagattttattaatcatcatctttcttaaacctttatgtgatttgatttgatatgttgggagttaaattgatggtttagtttttgatatacatgtagtactcacatttttttctccagttttttctttcttgtacacatatttgttcaatcttagagaaactactaagtaacagtgttattcttgttgttctatgtacctttaaaccgtggcaaatatttatgataaatttaaactcaattttaaataataacttcaaacttttaaatttggttttatgaaatatcactgaaattagtttgtgatgtattttatatataatatttcctgtaatatatatgtaaataaatactatatactattttgtggtaaatattttattttagcaagaaaataaatcaacttaaataatgctatacacgcccttctttatttaatggacactaatcaaagcatatggcaattacattattgattgtcctatatacatatcatatattttcaaaatcaaattaaaaccatataatagtatatataataccttctcttttgtcggaattaaaaattaataatttaatacttttaaagatctaatttctggatgaaaaactttggttttcagcgccttacaaagtgcaaaggtccacaaaccaaaaattaaaacagagagctgaacccaaaagaaaaaaaaaccgaaacaaaaaaaagttctctctctctctctctctccattgatttcttctacacagacatctctacgaacccccaaactcatctctctctctttgctcttcatcggatctgactttttcccgaaaacccacaatctcattcttcggatttttcaacgacaaaacccccaaatcacaaaatccccaaaaagtttcaatctttttgacttgagaaaccaaatatatttatagaatttgctttataaagtctgcgttttttttgttttgtttctgtttgatcaaattcaccggcgaaggaattttccgatgggaatgtcttcgctggcttcatcacagctacgaccatg

SEQ ID NO: 2189 - DNA, 3000 bp, Unknown
  misc_feature (1)..( 3000): cDNA_ID_1024969_gDNA_ID_1620500_Annot_ID_158847 3000 nt of promoter + ATG
caatcccaatcaaactcttatcttctgaatgatcgatctcttccctgagactctctaagatttggatgcaaaaacttagaattctccttcataactttctttctccgaagagcccttttcattttctcaaccttcatcgcatcagaatcggcaatgccgagatcgtcacttgaagccaaatcttcacttattgaatccgtagaagtagtgatgttggttttgtacttatgagaaagttcccttacaatatgtgtaatttcatctccccgcatattcgtgtttagaatcttgactatctcaaaacccacgacgtttccttggcgcaaatctacacactctttatcaaacttaagcccaaatctttgaacgaagaagctccttatgtgttgaagatcctcaagctcgccaattcttgatgcagcaaatataattccggccattgcttttttagtttcttccggtaacagatcaacattgctggcgagagaaacatgcggaaattagggtttacgaaccgttttggtttccttatgctaccgtatgttacaagatatcaataacaacttacttttcatatttcaaagaagatatattctgcaagatggttgtgcagaagagctcaacctgatcatatgccgataaccttctctcatcttcatagaattgcttcgcctagagttttaaaatttgcaaatcagaataagaaagatgaatcaagggataataaccaacaaattaagtgatgtgatagagattttgatcaaataagcaaaaatctaccaggtgattgagattaatctcagataccttaggaagagcttctgaatagcgaccataagaaaggagctgagcgatatcggaccgtgattgtctgaccatacactctcttctattccgatgtaagttaacagaacataacagattttggatatagagtttgctgcaaacaagacagattaattaattaaaaaaaactcgaaacaaaaacgaaatcttaaccgtgtaaagcaagtaaaccaagattcttaccacttcgaagcttttcgccatcttgaagaacgagaccgaagaacaccaaatatgttaaaaaagcacccaaactttgattctggtttcttggcaaacatgatttactttcctctgtgaagaatgtgaacagattcttataagtaaggcctaataatgagatgtgaatatatatagcaagaaatctacatatattatccttaaaaagtggtacattaaagataattactaggaggatttactttgtgtattaaatctggaaaaccccgcattttcctttccaatatgaaatgtgaaaatctaaatgcattaacgttccttgtattaacagattcatcagtaacttaactaaagggaatacaaaaagcatttcatgaatcatgagtttgcaatattccatttattagaggcggcaatttaatcgtcgcctgatattttttaatcaagatttcagttttagtaaggacaatcaatgaaatcatcgttgtgttatagtatcaaaattgcaatatacgtacctatttttttttttttatacctatgtttactaaatcctcctttcttaagtaaaatgttttctctgttttgtagcccattgggaatatatatcgtagactaaattcaaaattatcgatcttaaaataaataaattattttccatatcaaaccgataacgaaacaaatatttactgtatcttttaaatcatttattattttaaatctttaagaattgaatagaaaaattaataatcttttcttgtcaaaaataaaataaacttaatgatcatttaaagatatatacatatagtataattatcccaaaaaacaaaatctgtaaaaagaatcagtttttacaagctaatatttgtagtcttgtagtaaagctaatataaatatttattttggttctttttttttcattaataacttaggaatttcgaaccaaaactcaaactaattttttggataggtgcaagtcattttatgtctatagtcgtaaaaaaaaaaaatcgaacaatgatcttttactcgtaaatataaaattagtggaacaccatgattagttgatcttttaccagaagatataaactactctctctgttcctagaaaaatgatgttttgagtttttcacataaattaaaaaaaaaaattttaatattatttttattacttttttgttaatttaataatataagttttacttctttcttttctctattggttactaataaaaatattaataaaattaacctacaacattaatattcatggaacaaaaataaaaaccaaaacatcaaacttcatagaacaaaggagtattcattagcatagtcaagcccaagtatcataacaatatgggccttttatcagaaagtagcataaatccatcgtatactaaagttcacgaaacataagattaatgtgttataaaagtgatcattacgtactactatatgttaacaaaaaaaaaatcaaaaatatcattatgcgtgtatgactaatataattgcaaataagacacactattgaccgatttcttaaacactgacctgcaatcttattggttacttaacaattaacatacttctgtgaaaaagaaagccgaccgacaaaccggaagaatcagttaccggtaaaaaccgacgcgtattatacagcagtcgacagatcagccggttaaatctaaaccattcaatgtgtcttcttcgttaatagacggtgacttttaactaatccactttttaaaacgtttttaatttttgcacattttcacacttaatcttcttaaatgttttcttaaacagaattaaaaatatttaaatcatttaaattcgaaaattgggtcaatgtctctttgacttcatcgtcgattaagggagaaagagagagagagtgagagctgagaaaatcaccagaaagctacttgagagagagagatagagataagtgagctctgagaaaatccagcaatg

SEQ ID NO: 2190 - DNA, 3000 bp, Unknown
  misc_feature (1)..( 3000): cDNA_ID_3066416_gDNA_ID_1620500_Annot_ID_158851 3000 nt of promoter + ATG
tttataaaaaaagttaaaaatgttggcaacaacatcatccgatccatatactcttatcaggaacggaaaacaaaaaggtcaataacaaataaaaaaatataattggccataagtagtgaatagtgattaaatatgatttatcctacaattattcgttaataactaactaaaaatatattttcttataccaaagaaaactatacaaactacttaaatcaaacttgtaagataagatatagttggatgaagtgggggtttgatctacgatggtcatcttcattgtttgattccccctttttcgtttctattctattttaagaatatgaaaagacgtataatatgcacaagttggagagaatatttatcagcttttcagagtttagtatactatatatgatcttatcgaaatttataccttttctatatatatatatatatattaaatcgaaactttctttgttatcagtagcttaatgtttagaaatattcttattatagtgtttgattaaatatgtttctagaatcgaaaaaaataaaaagaaatcattatattaaattacgataaaaaaagaaaaattaatttaataaaaaagggaaacattatttcatttaactagctagtattttaacaaacaactaaatagttgtaatttattgtcataatatatatattctgaataagaaaaatccacatatgtagcaaatgtattatacatgtgtatgacaaaagttttacaaaatggttgaacttaaaaaaaaaatatgtcttaaacatacgtaagactacacgtaatatcaaaattaacatgcttagacatagtaattataaagctttatgtaaagcaagactgattctattaattaattgatggatcaacacttttagcaattggggatattgtactatttactggattatgcttgtggagggagctcatggtgctccagattatcaaattttatatatggtagaaaaataattataccattacaatgtaaagcattcgagttcgaatttcattggcgcactttgattttatataggaagattgaggttaagttgtaataagtgtgatattcatattattattggaagtttattggtttagccatatggtttattcagcaaaccattaactaaactcacatgtcaaaagttgaaacttataccaccttgatatccacgtcatcaattcttaatacacttttgtattttgacccaaatttacggggttacacgttatgtaattatgatatatgcatgacatacacgttatgatatatgcatgacatcgctaaaatagcataatgttaattagttatctaaaactaaagacctgtgtgtggatattatcttccaacattaacaaaaaaatcccgaaaaggagaagaacaaaagcttttaaaaaaactttgatcaccccgttctataccaattgatgtatctttaatggaagagaaccattataaatagaaacgaattaacaccaaatgcaccgtgacacgaaagatattgagtgtaagaaaccccaaattccttgttatattcgcttagaattatttttacagcaccatgtacatgtgatcacaagatatcaattaaagttagctaattaactttatttttcattttttgggctactagtttgctaattaactttttaccgagaaaaaactatcagtagaaagccaaaaaattcaatgaataagaaaaaaaaaaaaaaagcctaaacttacatacatatatgatatatctacgataaatttgctgataaacgatctgacttctaactaagattcctgttttacctattttaaaaaaaaatcgagaaccatgaatcaaagctcaactatgttaatcatgattgaaatcacgtacgttctcgaatgcttaaataaatatgttaatcaataaaccgccataaattggttaaatataaatctacttgcaagaaaattgtaattgaactttattttcaattggtaaaatgttcctttttcacgtacacaaaaaagtgtttgaagagaagcgtgtttgtgttatacggacttacgaaaatcttgtgttcccatttctcaaccacaaaagcctaatttcttggtacctctgattgtatactatcgtttcacaattacagtttcatctgatttcaatcaaaaattacagtctcatatggatcaaatagaaaaataacgagagtctgcatcatcaactcgtgtttgttgtttgtccctctctctgatctttaacggcttttgacgaaagaaaaatatcccgcctaactcaaccaatagacacaagacatgtgtcggcttgtggtagttctatccgtatgaaaaacgctttccatgttaccatccagtgaactcatcccatcattcacttacacgtgttttttcttcttgacgaccaaaaaaaaacaatttggcacatacccattaaaaaaaaaatacttcttatttttcataatacttttcgtagattgtcactgttatgtaactcattcatagaaatttaccgcgtaaattgcatgaaaaatcactagtcttaagaatcacctaatttgtttttctgaacttacaaatattcgcaaattactttcagttaactccctaatacttgggaagaccattgacaatacaaaaaaaaaatcataagaggaggtacagtcacacacacaatattacaacattactaatataaataatcaactttatggtataggttcaaagaaccaaagggatcgcataaatcacgacgctctaattgatccacgtgtcatgataaacataaagtgggacccgtattgaggctgcacgttaacgaagattgggcggcggtgtaatattatattatatatatacatacacgagtagcagagcttcgaaatctttaatctcagaatacaaaaaagaaaatcaaagaagatagttttgtgattgttttctataaaaagtgcagatattttctttgtcctagagaaagaggtgataggaaaa

SEQ ID NO: 2191 - DNA, 3000 bp, Unknown
  misc_feature (1)..( 3000): cDNA_ID_4254482_gDNA_ID_1620500_Annot_ID_158841 3000 nt of promoter + ATG
gaaccattctgctttcgtattgcaatctggacaggttggtagcttctgtttcacttaaaacctatcctgtgagtatattgtcgtttgccataatcactcatatttgaaatccggcacaggttctcacttgtggggataattcatcgcattgctgtggtcatttagatactagccgtccaatatttaggcctaagcttgttgaggctttgaaggggactccttgtaagcaggtagaattgataccaaccctatctagacctattgattttctaaattggttctatcaaacattgacaaacttatcttctataccaggtggctgctgggcttcactttactgtgtttctatcaagggaagggcatgcatatacttgtggatcaaatacacatgggcagcttggtcatggagataccttggacagaccagtacccaaagttgttgagtttcttaaaaccattggccctgtggtgcaaattgcagctggacccagctatgttttagctgtaacacaggatggctcggtttactcgtttggctctggttctaacttctgtcttggtcatggagagcaacaggacgagctccagccgcgtgttattcaggcttttaaaagaaaaggtattcacatactccgtgtctctgcaggcgatgagcacgccgtggcacttgattccaatggccgtgtaagttctttgtttctatctcgttctgtctccatttggtctcagaaaccaaaagaactcttgttttaataattctttcttgcaacttaggtctacacatggggtaaaggttactgtggtgctctaggccatggagacgaaaacgacaagatcactcctcaagttttggtcaatctcaacaattgccttgctgtccaggttagattcgtcccccatctgtaccatctcaatgtctgagataatgatccctttacaccttgttcctatattctctaagaccttcagcggtctctaagaactaataagtgatcagttcaattagaatcaaaacttagcacaagtattttagtttagaggattttcagtataacattcagtttatttttcggttttggtaaagaaaaccgaagctggatgtgttggcctttgtttgtatggagttttgctccgtttaggatcagttagtcagccctgatcatgactctgcttttacttgcaggtgtgtgcaagaaaaaggaagacttttgttttggtggaaggtggattactatatggatttgggtggatggggtttggaagccttgggttcccggacagaggagtttcagacaaagttcttaggccaagagtattggagtgtctgaaaccacaccgtgtctctcaagttagcaccggtttgtatcacaccattgtggtcactcaacgtggtcgcatttttgggtttggagataacgaaagagctcagcttggtcacgactcactccgtggctgcttagaacctaccgaaatctttctccattgtggccgttctcgtagccggctttgttgatccaaggtatagataaacaaccatgtttgtatgaaccggattgagattggatttaccggttagtgtatcttgtattgatttgtatctgtttgatttcttcaagttgtgagagtaatagaagatatttccagacaccttagtgcagagaattatgacatgagttaattaatctaagaagttttacaacttcaactacataataacaaataccttaactcttggtgatagtagatccactcaagacttagcaaaatatcttagtctttagaacattatagaatgtaaaagtaaaaaactgaaaacaacctagaagcaaatgaaggaatcattgtaacgaccaagatgcaaaagaataataaatcactcaacatcgatctcatcatcttcaggaaacatgtgtgcaacaacttcaatctttacttttatcttctccaatttctccagaggtgaattcaatatgctttgaatttcttcagcaaatgttttcatgatccctagatacggaggaacaccaacatcattgaggatttcgtagattgtggctttgatttgttcttcatcttgaccaatgaactcgtctcgaccatatctttgaagttgatttgtagtccttgttttaaccttactggacatgtagtcagattctccatcactatttggctcaggcacttttgtgtagacaacttcaaaatcaaacaaaaaagtctgacgatcttgagttgtttctttcgaataatagattggcgtcaccatacatgtactatccgatacatcatccacaatacactccataatctctatgcaatgatgggaaaaaaagaagttaagagagagttaggtttttcaagctatgagagtgtataaaaaatatttgtgtgaaaggaaaattgtaaccaggaatgagtaattgttgggattgaatacgagattttaggaaatagttacaataggaattcttcattaaattagattgatcataactacaaaagttaacattcatacatatcgttaaggttcgatgaaccataaatagatattccgatatttaaaatatcttatatgattgtattaataaaatatctcatatattcaaaatcatatttcacttaactatttcgctgtcaaaaaatatcctaccacttttccaacatgacaaaaaaaaaacatactacttttctatcgtggcacgtttaaaaaatcatatcattccaaaaagatttactcgtcagattaaatatctaatcatcattggattcacaatttgtttatttacctaccagacactttaaaaaaaaagattaactacagaataattttgtctaaaaagaaacggataagaacacgtaagacatgtcagtcttatcttaaaatccaagtcagcatctcgtgtaataataatctcgtacctttataaaacccctcattgtcttcaacaaaaacataacacatttcaagcattggattaatcaaagacaaagaaaacgaaa

SEQ ID NO: 2192 - DNA, 3000 bp, Unknown
  misc_feature (1)..( 3000): cDNA_ID_3066428_gDNA_ID_1620500_Annot_ID_158832 3000 nt of promoter + ATG
tctccaatgccaatacctgtaccaccaccagaaccaattccttcaccaaagccgctgcctccactagagccaattccttctccaaagccgctgcctccactagagccaattccttctccaaagccgttgcctccactagagccaataccttctccaaagccactgcctccactagagccaattccaacgccatagccaacaccagacccaccacttccatagcccctacctacaccataccccataggcttacttgtgtggtcaggatcttcctcttccagttcactcgccatggtctgcattatctgatcaggcttgactttgtgctcaggatgttttgattcaccagacatggactggagtttatggtcaggcttttccttgtgctcaggatgttctcccaacatagactggagtttatggtcaggcttttccttgtgctcaggatgttctcccaacatagactggagtttatggtcaggcttttccttgtgctcaggatgttctcccaacatagactggagtttatggtcaggcttttccttgtgctcaggatgttctaatgcaccggacatggactggagtgtatggccaggcttaaccgtgtgctctggatgttctgatacaccggacatggactggagtgtatggccaggcttgaccgtgtgctcaggttggacctcatgatctggctgtagcataaccatcccaggcatcatttcatggttcagatctagctttcttggctccatcatagggaggtccttaagaatcctgagtgcaaaagtagagctgaagaagcatagtaagaagataaacccaaagcataagccttggtgtccctgagccattatttctatgtaataagttgatcctgctgtacattcctgataaaatgatccctcatgcttttataggaaggaagacttttacttaatagaaaacacatcccctaaacgcaagacgccttgctgaaaatacgcattaaaaatcgaattcacaaacatagcatgacaggcataagaaataactttttttgcgataacacaaatcgtatgttcagcaacttcaactctccaagtttcgaaaccttattacgattatttgcaaaaaagaaactacatcaacaccatcttggcagaagaagtcattataacaaaaacaaacaccaaaaaaaaaaactcaactgagagtattcaactgagcactacttggtagatattagacattatcaccatcaccttgtgattcagcagctctcaaactctcagccatagcacgagccctgttctgagtttgtctctctacagcaaccatgtataaacctaaacaattatgggttaaagaaagtgtcccatacaaacaaaaagctcatgaatttgagtaacaaaaaccatagtctctaagatgaaaatgtgggaaagatggatcaatcataccaatagcacttccgatagcacaaccccatagaatcctcattgaccacttatcgttgataatccctctcgatcccattttttttctctgcaataactctttcaaagctagctttttatccactaaaacgcaaaatttatgattccaaaacagcaaatcaaactcaatcctgaaaaaactctgctaattatcggagatttaagagataaaccttattcttattcttttgataaaccttattctacaagaggaaagaagaaataagaggagaaacaaaattcgtagcgttaattagggaactgtggatgaatgagcataaggaatgtgagctaaccagaattagtcggtgaccggaagagtgagaatcgagaaaatgacgatgagaggaagaagaagaagaaggaacgagtacgggaataaaagaacggactaatttgtaattttaaaacaatgagtgctattttggtaatacataacttataaagggttcataacaataaatgaaacacttttttttctttcccgacatgtattttttgttgattaatacaaaattatcaataacattcgcacatgttatgtggatatctaatttatttttgtaacatccgataaaaaaatgttaaatttattttgcaatttggctcttcgattttcaaatttggtttttttataaataacaagaatttgtcactgtcttccctataaaatttggaggaagcaaaggcgcttgcttttcgcagcaaagcctatagaaactttacttccttctcctctcgtctcatgcaccgaatgtatttccctgcttaaccaattctctactttgtcctcttcttctccgtttcgattttacaagattcgatcttttgcaatcgaaatacctaatattccgattctcgattccggcgtcttttgcttcgggcttttttggtaagtgtactcttacactatctccgtctctactcttttgcgtcttgcattgctgattgttggaaatggatttctttgtggtgtaatgcggtttccaaacgagttcgagttggctcttttagaaagattctttcttctttagtctgattctcaaggtttcacattcttcgttttgataatgcgtttccctaattgcgttgtgattatcgataccgagtaaaaaggtgttcttggacttttcactttgccattgatttgcttcacttgtattactttagaactctcagaaacgatcattgattggcttgtgtagagataattgagcagttccatttatctacttagatcggagatataatgcctgccaggtgtttgttatatgcaattttgggtagagcattgaaattttgaccgagagtagtatcatgattacaagccatgttctgctttagtttcgtagtcagtgatggttattaggaagatgattgaaactagctttttttgcagcttcaaatgcataacattttggttgtaatgtagggaacattttaatcattcagcattctacattttgcatagctactgttgttaaccaagccatttgttttgcactgtgaattagtgggaggaatg

SEQ ID NO: 2193 - DNA, 851 bp, Unknown
  misc_feature (1)..( 851): cDNA_ID_2151809_gDNA_ID_1620501_Annot_ID_158883 3000 nt of promoter + ATG
gatctaactaacagaacaacacatgccaatcaaattactaaaccatgagcttcataaacccacacataaagttacagcaatcgattgattgatcaagtaaccactaagagccctatcaataaatccaggagatacaaactacatggccaaaatgggaatgagtaaactgcgatggagttacctgtaacgcaaaaatgccttctttctcaacagttttaacctgagagacgatattatcatcaacccaaagaatagaaatcggaatcctctttccccatttgtcccagagcgcagtcatcccacacttaaccgcgatgatcccagtcctcttggatctactagacatctcaccttgtttcgcctcaatgattcgggtctgagccccgataatatcagatccaccaccgtccatcaacccagtatcggagctgaatcgtcggatgagaaagaagctactacaatgaggaagagattcagaggatgaaggagttatagaccgtattgatagaaactgattgattcgagaaaggaggcctctcggtacggccgccatgatttcgaatcgaagcgaccttcaatggctaaagtctaaacgaagaaggagagagatgcagaaaccagaactctcaaggcttttgcgtagggttttagatgggcgacaaaatgataaccaaagcctctatctcagaaagagagtctcaatattatttatttccctctttttataatatgtggacgataataaaaacaaaatcctacgtggcttatccattgcgacatataaaacaaaaacaaaacggtacatgaaaattttgcctcaattttcaaaatcaatctcaaattctcaaatg

SEQ ID NO: 2194 - DNA, 3000 bp, Unknown
  misc_feature (1)..( 3000): cDNA_ID_2151897_gDNA_ID_1620501_Annot_ID_158903 3000 nt of promoter + ATG
tggtggaacatccaggaatcacactaactgtttacaaatttgtagctgcgagaggaacattgaagagattcgagaagagtgaacacgacgaaaaggagaaaaaagagaaagagactgacgaagagtttgtgagggagttgatgaatgatccaagaggaaatgagtcattggcttacgaggaaagagtcgttgagagcaaagacgatatcatcgcgacacttaaatcgatgagtaaatgcaatctcttcgtcgttggaagaaatgcagctgttgcatcgttggttaagagtacagactgtccagagttaggaccagttggacgcttgttgtcgtcatcagagttttccaccaccgcgtcggtgctcgtcgttcagggatatgatccagcagcagatacacgaccgctcgttgaggaagatgcagagtacgatcagtcttccagagatatttcagacttaactgcctgaacggattttattataaaaacaaaatttctctgtttttttttttgtctcatgaaatattttgatattctttttggttgggacttggagtgtctccattgttctttttctattttccttaaattgatggttgacattagatttgtgggcatgaaaatcgacctgtaatttcttaatattttgccttgaatgatcaaaggaataatatttttaagatccaacatttctagtcatcaccatggaatgtatccttgcccatgatggtgtcacctacatacctttttagggtgtaatgtgttcattgttattcagaaaaaatgtaacaaacggaaaaatgtctaatcttaaattacctcctgaagagatatgaatgcaaaaagggaccacaaccgccaatgacaccgacaagagtcaaaagagacgtcactaataaataaactaacacattttcgaacaagaatccataacgttaacattcactcactgtctatcacacacacacatgctgtgtacttcattattactctctctcacgctctctcttctcttctcttctcttctttaaaaatctcacaccaacttcattgacaaagagaagaaaacaactctcaaaaacaaaaacatgagctacactttctttctccttttgctctctcttgtccactccactttctcttcattagctcctacggatcgagccgcgctccaatccatcagagactctttaaccgacatgcccggttcagccttcttctcctcttgggacttcacagttcctgacccttgttcctccttctctggccttacctgctcttctcgcggccgtgtcaccggcttaactcttggccctaatctctcaggctctctctccccttccatctccattctaacccacttaacccaactcattctctaccccggttcagtcaccggtcctctccctcctcggttcgattccctccctctccttcgagtcatttccttaacaagaaaccgtttaaccggtcctatacccgtatctttctcatctctctcaaatctccacactcttgaccttagctataaccaactctctggctctctccctccttttctcaccactcttcctcgactcaaagtccttgttttagcctcaaaccatttctccaacaaccttaagcctgtctctagcccattgttccatttagacctaaagatgaaccaaatctccggccaactcccacccgctttcccgactactctccggtacttatctctatccggaaactcaatgcagggcacaatcaatgccatggagccattaacagagctaatatacatcgatctaagcatgaaccaatttaccggcgcaatccctagctcactctttagtcccacaatctcaacaatgttcctacaacgaaacaacttcacatccattgccacctcaaacgccacgtcattgttacctgagggctccattgttgatctgagccataactcaatctccggagagctaactcccgcgcttgtcggagcagaggctttgttcttgaacaacaaccgtctcactggagacattccagaggaatacgtcaagagcttaatcaacggtacaacaaaacagctcttcttgcaacataactacttcacgagattcccttggaactctggtctccaactaccagactctgtttcgctctgtttgtcatataactgtatggagacagatccagtcgttggtttgtccacgtgtccgatcgaagttgcacctctgctctcaagacctgcttcacaatgttcaagattctataatcacagctccactggttaaagatcagtttttctttgttatttttctcaaagaaatttgcaaaaaatgacaaagtttttcataagcgttatcgacaaaacaaaagtatgacattttaagaaattgaaccgttatgtctcctagtgttttcttaaaaaaatcaaaagttcataaaaaagatctgtaaaactgtggtcctcacgtgtaaatgagattgtagtgtttatggaatatataatttatagattggtccttttctctatttttcttcattgacatatatgccattttgatatgaaagaaataaacaacacaccattggttttctatatctcttctccttatcttcaaattgtcattatcttttaataaaaaaaggtacaaacttttattcagtttgtggtctggagagcactcaaaatactgtttacataaaatgattgaagataattagatccaagcatgatggatatggatatgagttaatggtgttgattaagaacttataaagtctaatggtgttgatttagtaaaacattaaatgccagataattagctgttaacagacataccgacaaagaattttaagtaataaagttagcataaagctatctgatttgtcagaatgtaaaaacgagtccaagttgactccttcgagctttgattctcgttccaataatacttcctccaccatctctcctcctctcgttagatctaagaaacagagaaaacaagagagataga

SEQ ID NO: 2195 - DNA, 3000 bp, Unknown
  misc_feature (1)..( 3000): cDNA_ID_3066448_gDNA_ID_1620501_Annot_ID_158907 3000 nt of promoter + ATG
tccacaatctgtgtatgctgtagagttaacttgcataacattatgctggtcacttttgtagttgaatactgttgaagaagagagacagacttagcaaggtaaatgctgttatgctggaaataacttatcatgttttcttactattgatatggaacagaagactgctgaagaacagaggcagaattgacataaatcatcgtcttttttggtgagatagtatgtatgggattgcaacattggttctgctgtatttaggcatcgtagtacaggagttagaaaaattacctaagacatcgccgacatgaaactctcttccctgtgtccagttggtatagtttgtaaagagttcccagccattgctgtcaccaactatatgctctgttccttcagattttagcatgagagaagataaagagaaaatggcatagagtataatcaagctagagaatcggcttccctgatgaagcattgctatctcttaacttcttgttttctcaatttcttttcagaaatacagtatatttataaagcagtaagcatttgtgggtaggaaggtcatgacattgttgtgttaaccagataagtgagtcatgaaaaccatacatatgtggatcaaggagccacagattgtatgcggggtacaacaaactgtgcatcagggcgatgcactgaaaagcattaaacctaataaggcgatagaacatacacagttatgtatgcattgttcatagtttactaatacagcaaaggattaagctaataaggcaagtcgaaagtgcagcatgatggagcagcagccgatgggttaaggctgcactttgtaaacaggttaatggtgttcagtttcttcaaccacttgaatccaggcttcttctcttcggttttgttctccttcttctttttggtcttatgcttatccaggccaaagcatccgtatgagaccttatcagagacgggctctgagttcctagatgcctgaagcgagtagatgcggttctggagaatgcagaccttgtgaaagtggtcatctctcatcttaagcacacacctagcaagcccaacagcttcgttcttcatgaacaatgcctcagtggctagctctctgttctcctccaagagagaagtgagtttgtagccaagattagcgttttcctccacagccacttctttctccatctccagcaacatgacaaacttcttcaacagctctatagtcttggaggcttcatgaaactgttggtccttgtgaagtaactcgtgtttcagaatctctttgtccaagcttgctgtcacaagttgggatacaagctcatcgactttctcagaaaccgcagtaggatctttcatctgttgaaaggataaggtgctctcaacttcagaactgacctcactaacggaatcaatgtccgaaatgcagtcatcatcatcttggagaagctggttcggaagagaagtagtgggtttaagtctggtctgatgagaagaacgacccaagagagtgacgtagccgttgtacaggtccagacaaagtgagagaagcaaaggtcgtccctggtaaaaccattcagctcgttgagcaaaggtatcatcatctccttggctttcttgaaaaccagactcacgcaggatttgcatccgagcttcaaggtctgtttccaacattttttcagacaagaagtgatgagagagaaagacaaacagagcaagagagagagagaaaaagggggtccactgtttctgtagcatgctttgtgatttgaaaatttgaaaatgtgaaaaagctccaaaaagagagagagagagtgagaagaaatttgaaaatggaaaatgaaagtaccagagagagatggcaactgtggagcttccatggatgctttgttcttcatcttcttcaacctgaaagatatacttgttttagttagtgattcgtatataaaattataaagggaaaatgggaataatggcatagatgatgaagacattgatggcttttccaagaagataataaatgttaagaaagggatattttagatcatcgagattaatgaaggatcggagtggggagaagaaagatacaaacccagaaatagtgagagagagaagatagctgacacgtttgttcagttgtatcagtgcagagcatataacaggcaaaatccgccaaagttacaagcatttgattttgttccactcatattttaacacgtggctttagtacttgggtttggtagttgcggcccattgtttgttgggcttaataactcaaagcctttaggtttttgagattctgacatcaaatttagaaagcaaaaagagggagagagcatattggttggtggtaaatgacaattttatatatccagaagagttcataaagttatgtcatcgaataatgttttcataaataaataaaaatgtgcgttttagaaaataatatttatttcatcgtctttttccataaacgcggatctctttattcacactcttaattattttatcatatgagacaattgcatataaaaaaaaaaaacctgaactgtgtgtttggtgagaattccagtttattctttttcactaatgctcagaaatcatcattcttatttggaaatatgcactaaataaaatacacaatggacaaagctcttggataaagttttcaaagtaacacaagaggcagcttcttgaggttttctctcttccaacttttttgctttacttactactgaggttttctattcctttggaagcttcgttgatgggttcaacacaagatctaaaatgtaacatttcttttcttaaatttcctgcaaagttcgatgtagttcatgtttttttttttccattcttttccttataaagtgtcgtccacatttgcttgacgggatacaaaacgaaacccaagtctctgtcttcgtctccttctttcttcttctctctgtcatcattttgcttttttttcttctcctacatgccctagattttgggtttctgaaataaaaa

SEQ ID NO: 2196 - DNA, 3000 bp, Unknown
  misc_feature (1)..( 3000): cDNA_ID_3066444_gDNA_ID_1620501_Annot_ID_158908 3000 nt of promoter + ATG
gctctatcaatctccttcttgactgtatacgttttcatgagtttgatactgcaggacaacaaatgcatagcgattgattggcgtgcgactaaagtattggtgtctcttagaagtataacggatcttatattcttcattaacattctgcttcaggtgtgtctccattgctcctatctcatatctaaggaaattcattggctttaacgcttctttggtcttatgtgttgcagtttaggttggcctatgtagctcctgagtctagaatagttggtgccggccagttagttgatcatccaagaaaaattgctcgccattacttccgaggaaagtttctccttgacatgttcatagtctttcccattccacagataatgatattaaggataataccattacacttaggcacacgcagggaagaatctgagaaacagattttacgcgctacggttctttttcaatacattccaaagttatatagactcttacctcttcttgctggacaaacatctactggcttcatatttgagtcagcttgggctaattttgttattaatcttctcaccttcatgcttgctggtcacgctgttggctcttgctggtatctctctgctctgcaggtatatagtagaagatcagtgtctttaaagattctcttcatatctatcaagtgatttaaagattgtttttgttgtattgcttttttcagagagttaagaaatgcatgctgaatgcttggaatatttctgcggatgaacgtagaaatcttatcgattgtgctcgtggaagttatgcatcgaagtcacaacgagatctgtggagagataatgctagtgtcaatgcttgttttcaagaaaatggttatacctatgggatctatttgaaggcagtgaatcttaccaatgaatctagtttcttcacaagattcagttattctctgtattggggattccaagtaagttcatttcaggtttggttgatgttgcagctattagtctttgaatcactctttaactaatgttgaaatgttttcaactctgaaagcaaataagcacacttgctggaaacttatccccaagttactcagtgggtgaggttttctttacaatgggtatcattggactagggcttttgctttttgcgcggcttatcggtaacatgcacaacttccttcaatcacttgatcgaaggtaaatcacatttcatcaacaatgttctgaaaagggatggtgaatttcttggctaatgcatgttctgttttaggaggatggaaatgatgctgagaaagcgtgatgtggagcagtggatgagccatagacgtttgccagaagatataagaaagtctgtgcactgtggcatttgattttctcaggctgtgtaatgtgatattcataactaatcaactgttcaactttttcaggagggtgagagaggttgagcggtacacttgggctgcgacaagaggagttaacgaagaattgctatttgagaacatgcctgatgaccttcaaagagatataagaagacacctcttcaaatttctcaagaaggtaataagcaacagcctcatgacagcattagtcagtattcattttgtgtactcagactccacagtgttgcaaaaagctagttctgaatccaagtgttaatgagtttgcaggtgagaatattttcgttgatggatgaatcagttttagattcaatcagagagaggctgaaacagaggacttacataaggagtagcacggtgttgcatcacagaggtctagtagagaaaatggtattcatagtgagaggtgagatggagagcattggagaagacggttctgttcttcctttatcagaaggagacgtttgtggtgaagaacttctcacttggtgcctctcttctataaaccccggtactaataacatttgagtgttcataactcttaatgttttttggttagaaacttggaactttggagctgaatacgttttgaaacttgcagatgggacgaggataaagatgccaccaaagggattggttagcaacagaaatgttaggtgtgtgacaaacgtggaggcgttttcgctgagtgtagcagatcttgaagatgtaacaagcttgttttcaagattcttaagaagccatcgagtgcaaggagctataaggtacgagtctccttattggaggttacgagcagctatgcagatccaagtggcttggagataccgaaagagacaactccagagattaaacactgctcactccaattccaaccgttaaatttgatgatgatgtttggtttggtagattagtaattttattttgaagtataaagcttagtgattcactataaaagatgaatcgatgattcattcgttgtaatcaattcactcattagtgtttcttaagtatctttttgctgtttttccaatcatacggtataattttacttcaggtcactcggcttgagtaacttgggctcataatttcggcccattctaattgatcttaaattaataattaatcaagcctggataatgaatgatttttgccttttcggtacttctttactgtaagaagttaattaagacaaagaaacggaaacagccatgtagttaatgacattttgcctccaataattagggccaattaattagttacagttggtaatcaaataaaggaattttcgaattcgtgaatattcaaaaggaaataaatgttaaaaacacagaggagagagaagcctcacggacacgaaataataaacaatgtaataaaagtcagtgtttgacttttccagacatgagttttatttacaataatacacttccttgacctgggctacgaagaagaagacccctgacttggtcatcatctcctttcttatttcttcttcttcttatcaaaattactaaaactctctgcttcaacttccttctccgcctcaaattttccctttatgcctagattctagccttctagggtcttcttgaaaccgtgattttggtcaagaa

SEQ ID NO: 2197 - DNA, 3000 bp, Unknown
  misc_feature (1)..( 3000): cDNA_ID_3066459_gDNA_ID_1620501_Annot_ID_158896 3000 nt of promoter + ATG
taccagttttgtgcttcttgtgggaagaagacgaactcgagttcccattgggtcgttggagagacatcaatatctttttgtcttttgagattttgctaaagacgagaatagagaggtaagaggttgaagagaatatcaaaccaaaggaaattgcatcttttctttcttctttggggccactcaaagtctgcaactcgtttcaaacaaaaaaaaagagaaaagtattggttggcttataaaagaacacgtaggtttatgtaagaccacaaatgcaactgtttcaatccaatggtgtgtatctgtgttttcttttccactatatcccgttgaacttattaattgatttattgttctgttttgcttttaaagtctttgttcatgatttctacggaaaacaacctttagtgagtattcacagagcgtgtgggtttaggacaataattactgtctagaaccatacaaacgtacttgcagacaaagtcagaggcacaactatgtgtgtgtgtatctatttgcatggcgtaataggcatgcataaactcatcatgtggtcatatatctcgttttctattttttggtacacaaataactcttttgtataaagacagctaactaatgttttgaatttttaaatgttatctcttaaaattaaattctaccaattgtaaattcagtcaatcattccgaagcattttttcatgctttgtgattccgccatatattttcccatgttcttttttacgtttttcatcataattttaaagttttacgattttttgttgttatcaatgaaaatggaccaagtaaacttctaccgtaatggttgcatattagatagtggacttatgcgcgcgcgcggaaacaaaacttggccggttgaatcgtcgtctgcctggcatctaacagttttttcgaacattgtcataatcaatatattgagggatgttaatcatgaagtcgtatggaatggacgcgggaaatcactcataaacaatgtgaacattttataaggttataaagaagaacaagtttcatccttcttttgtatatttcgactcatacatatctttctattcaggaataagtataaaacataatataacatgtggcatatcgaccgaccaatacatctttcccaacccatgatcaaccttctgattgtgttttaatttattcgtcatgaaatggatcagaatactcatgatgagtttgtgtatcactcaagggaccccttgtcttaaaatcaactaaaatcatttgatgtaacttttatacgaagtactatccaaataattaattttcataagcagcggacattcattttgtttgtatgactatatgattttattatttgaagctgtatgcaaacgtggagatatgattgcatctttgtctatgcatgaacatgccacgttaatttaggagtacatatcatgatattgatctctcttgctataactttttggcacaatactattgcatgcctctctatattacttcaacaaaacgtttaaatttaccatggttagaacttagaagtaatcgagctgcaaaccatggtgatcatattttttctcgttcgcatgctcggtcttaatatattgagagttatggccaaaatttgaataccattttaagaaacttcagaaaatcaggagtttgattattatctttggttcttacttacttcaacgaaaactaatgacaaaactcttttaagtcgaggtatgcgagtaataactccttggacatatttttttgataaaagtttaattgattatagacttatagtagtcttaattattattataagtataaagaggagtaaacattcatcattagactactagacattataaagttatatatatcgaaattctaacaagaaggatccctagagaccagacatgcatgtccaaagacagatcgtataatagctaataggagtcttatcgatccaacatccaaggtaggctttattacaaagtaactattagagtgcacttcccatgatgattctagaatctaatattattatcaatacagccaatgagcattatgtgatgtaacaatttatgtctactttatattttgaagttatcataaatcaacgaattctattttgattttcaaaaaagagtaaaagatttgggcttctaagagagacaatccacaaagctaaagagacattaacaggaaacgtatagttaaagaaaagaacactgtctgctccacaaaaacaatatacacaaaactcttcaagtctaccttatttttattggttctgcaattttcaatggtctgttacattaatgtgtcataagagacaattgagttttcttatcaacagaagggtctaaaaaattgatcccccaagttcatagtctatagactcagtttttttctttcaaatattgatgtgtaagaaagtgaaagtgatgtgatgctctgtttctgtttacggctagacaataaagccttttttggcccttatctctcctaattaaagaatctgagcagttgagaaattaaaatcaaagccttaacagattaactccaacatcatttagacacactttccttggataccacctttttacggaaacttcgaatcttacatgtaaacaaatctcaaaaccataatttcacatttttactactaactaactccaaagatctaaacccatgaattaagtatctaatcgggtaattattacagtggttttcagaaatcaatgtgtgttcatatttagaaggttgaaagttcatagttaaatgtggggaaccttatgttcctattatttatttatattaaatttcaaagtcgattaaatcaatttttaaattcaaaatctatgcaatagaatcacctactagtccttttttgtttaactagacagagagaaatagaaatagagagagagagacatgaagagcactctcaatagagaagagaaggaagcatgaagctagctctgcagcttcaaggtctcattaatg

SEQ ID NO: 2198 - DNA, 3000 bp, Unknown
  misc_feature (1)..( 3000): cDNA_ID_2151865_gDNA_ID_1620501_Annot_ID_158893 3000 nt of promoter + ATG
gtgatagacacatagatgatgaagataagaccagaatctacattgttggagttgatctttataaagaagtttataaagagaggacaaagggagctcatttcaattggccacttctcatcagttatcttccaagcttggttcatattcaggaaaaatacccaaaagacaaaagaaaaggaaacaagaggaggttagttaaacgaattacttaagctttcttattgttttggtgatgtttctttgagagagtttagtcaataattcaaggggttgtttctatttagttgataaacagagtaactggattaagcttttctcgtccctcttattttgcgtttgaatttggatggttggtttgatgatctttacacaaatatattgttcttcttatagccttatctcttatcagatgattgatttttggagagtatacatcaggtaagcagaacctttaatcaatgcaaccatttaactacaactatacatacaagggaagcaacttcaaatctttttctaaccatcctaacttaaggactgaacatgctttgatatttgcaacgaaatggtgatcagtcatctgagaaaaactcacagtataaactctaaacctaaacctactgcaatattggataatgatcgaaccattgtggtagtgagagtaacaagggtttctcaaccatttatattcagctactgaaatatctgtcggtaacacaagaccaacgatacattgaagactaatgctactatatcaaatggaaaatagaggtgatgctttattacattgcgtttcttacagtgacctcaacatctaaataaaagcaccattctgtgaaatccaaattacaaacagaaattcttttaagtctccgatggaatacacagtgatttgggaataagtttagacaggacgcttatagagagtgtataacattgcattgaccatatatattagagaaactaaaaatcaatatatgaaccttcataaatcataccctgtttcttaaaatagcattaaaaaaaaaatgaagacagaagcagaaacaactggatcttctttggcactttttgaagtccacttcttgtagcagcaacctcaagttctgtgacacaactctttttcgactctgaagaatccacattggccagtccacctttgttttacttttactcttgtctctcttttcctccgagtaatgcttttactctcgttggctattgactctgaaatagttgtacttgctaaatctccaactaagttacacttgtgatagatccaaacatcaagcgtatgctgcgtatcatcatccacaataaccactccaccctcatcagccaagcccaaaaccaaatcaggcgtcttttgtgagaagtttgaaatctatttcttgtagcaaaaacctcacgtcttgtgactctaactcttccttgactctgaagaatccatagtgaacttccttgagtaatttcagaacattggccaatccaccattgtttttactctcgtctctcttctcctccgtgtaagaatttgactcttctgggccattgactctgaaaaagtggtactcgttaatctctactaggttactcttgtgatgcgtccaaacatcactcgtatcatccacaataaccactccacgctcctcagccaaaaccaaatcaagcgtcttcacgtaaggagactcgtctcttgttatcactctatcaccaaagtagattctcttgggatcaatcagcttcaacaaggattcggcgtatactctagtacccattgtataaacatacattgtgaacaactcgttggcttccttcaaaaactcgtgaacaaaaggccgtagctttgtcaagtaatcgctgtccaacttccacagatcttcccttgtagttgaacacgcttcttcgattagacacttctctgtttcggaaagaagtgaaaccctaatagagtggagaagcgtgtggtccaagtcgagtacaaggtttagcttcttctcgttgagacaatagaattgcgtagtaaagcgcttcgtaaacgctgctgcttcgtggcttagctgcaaaccttgaacgagataatcgaatgctctgccatggcgtttgtttaccgtcgatttacaagcgatgcagactccgtaacgaacataccagtgaccgcagctactacgagatgacgaaagtgacgaagacgattcgttgatcgccggttcgaattccatagaaatgttttcaactgcaaacatgatttctctgattgagataatccttccttcctttgatttgaaaatcacttagcactgatcagattgtttttgagaacagaaaaccacagtaatcgagcaaaacgaaaccctaatttgacaagaaactgacagtagaaaccctaaacgaaaccctaattttaagggtgtttcacattaataagattaaaaaccacaaaaaattgtaaaccgcgtgatccaaataaattaccctttttaaaatcaattaattgtggtttattccgtaactaataaattaagaacaatatttatctaaaattctacacatttgagataaaattattagatttctgatttaccaatctacacaatgatatgtcaccatctgtaagcagattatgacacgttttaacaattttacatgttaatgtaagttataataaactatcaagataatttacttattttagctaggcaaactaaacatcaaataaaaaggaaaatttacaatagtctgaattaacaaaagaagaaaaaaaaagaaagtaaaagacagatatacagtatatgtagaatttcactttctgaaatttaaagcataattatttttttgaacaaaaaagtaataattatttattgctctgtaactttctggtattagtaaaaatcttagttgtcatgttttcaaagatttttatttatgttttacgaatttacctatgaaatcaattaaaaccctaactaagattttcgttaccgtcgctttctcctaagtaag

SEQ ID NO: 2199 - DNA, 3000 bp, Unknown
  misc_feature (1)..( 3000): cDNA_ID_3066493_gDNA_ID_1620502_Annot_ID_158918 3000 nt of promoter + ATG
tgcaagacgagcgggacacgtcgggaatttaaactacccgtcgttctctgtcgtgtttcagcagtatggagagagtaaaatgtcgacacatttcattaggactgtgacaaatgtaggcgattcggattcggtttacgagattaagattaggccgcctagagggactacggtgacggttgagccggagaagctatcgttcagacgggtggggcagaaactgagttttgttgttagggttaagaccacagaggtgaagttgtcaccaggagcgacaaatgtggagactggtcatatagtttggtcagatgggaaacggaatgtgacaagtcccttggtggtcactcttcaacaacctctttgaaggggtttaggatctggtgaccgggaaaattctggtctctgtttgttgtactagtgaaaaagaaagatcataagttgttgttgttgtcgtctatgatctttgttggtgtaatataaatatgtatcttttgttttgttgttaagaaagatagagcgtctaaagaacgtcccatttttgtagaagtagctgaagaatatctttcacttgtgatatgggcttttattgaggcttattaagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaagaatcgaatatttattatttcgccccgaagattctatttctgatcatttacacccctaaaaagagtagagctttcgtgaagccaccatg

SEQ ID NO: 2200 - DNA, 3000 bp, Unknown
  misc_feature (1)..( 3000): cDNA_ID_2047653_gDNA_ID_1620502_Annot_ID_158935 3000 nt of promoter + ATG
tcctacaattcgttttatcatattaatggtgtatttggatccctggtattattaaatttagaaaatactagtttttaattatataggtaaatgaaataatttgaaattttgtttaaactgaattatgttagaatttaggtagatgaatagatcaatcgaggcttgaagccaagcgtgtgccagcaagaaggggtgacactgatagtataaatatataaaacgaaagatatgatgtatctctccggcatatataattgttttcagagatttattaattaaaattgacaactaaatttgtttataacagatattaagaacaaagtagaaaagaaaaaaaaaacgaaatacaaacaagttagcttagcttcaatgaaggacgtgtttctacaactattagtctgatgacaaaaataatctcgtcagcctaatttttgttatattttttcttttttgttttgtgtcattgttagtcattttgagttcatgtataagctttaagatgtatagggttatcatggagtaggtattaggtacattctaatgacaatagccaaagaatattgatcagttttaaaaatgaagaattcttagaagagaaagaaatagagagagtatcgaattaacacacaaatatttattcgagaaaaaaaaaggctatgaagctctcgacgacgtcgttgaatccctgaatagactacgcctaacgtgatgccgtttattttgttgccgacaaacgacgcgtcgtttgatttcaattgcctacaaaagctaggcgacctaattacgttatttggtagggccagatgaagaactatattgctcgcataataaaatgggcggtgtgtgttagtgacttagtgtgtttttgtgatgctttttttaatttcttttgtccaatattttttataatcgatggtgtatcaattgtctacccacgaaatttaaagtaacatgtcgattaatatatcgatcagcccactacaaacccttttaaatagactctgaatcctatcaattctttgtaagttagtaacgttcacagacttggtcatttgtacttgatcatacgtatttttaagccttttaagcgttttattccttcggagtcttggactctggattgtatatatttatcttatgatttagataaataaaaatactgaaagttattccagtactagtttctaggaatatcaaataacccacttgttaacattagtccaccgaaaattctcgtagaaaaacaaacagaggaaaatagtacatattttatttaaaatacagcatttgctttgctaaccttataataaatacatatatcctatttgtcttttgtcaaaacgagttctttatatactttacaaattcaaagtaccatacgatattgaactaaagatatcacaacaaatattctttgttacaattacaccattttaatactaaaaatcacaaacaaaatcaaatggtacctaatattttatttgtttgtactcatcatgaaaaagagaaacacacaagaaaaaatgctttgcttgttgaagagttattgctttcttttcggaaggcttaggagtgacgagtaagaactgagatgagacagaactgacgtacgtggatatcaagaccacaaatttgtatatttgttccaaaaaagttacaagcattgcatatttgcattgaaatgatagaactgtggcttcttcttaatctatctacaacgagagggtcgcttttaaccgaccggtcattagtagtccttatacattctagtcaaatatggttattgaaagccgtacgatgatattgtatgtaatcttatcttagaaataatgtaggtgaggcgtgagaaagcaatgaaacatttgtcgaaaatatgaataagacgaagcgcgaaagaaacgacacgtgaactccgtcacatgtgatagatatattgggccgttggggacaaatgctcactttcagaacacctacacgttatacacgtaggcatgcgaacttgttgggccattgtaacgaaggcccactttctgaacacctactacacgtgcctacgtttatctgatttttcattttgtcgtttttatttccttgcattagttctcacttctcaatgcaaaacatatcgattaatactatgttcaaaaaataaaataaaaacatatcgattaatatttaatagtgtgggaaaatatatcctcgaataaaccaaaagaaaaaaagatagattaacaaaaagttatcagtttctttttccgatattgtttggaaaaaaacaaactgattaattatctaataagtattctttataccaaacgtgaagaaagaaacttgtgtgttttgattaatgacgagattttctatagtttgttgaaaggaatccaacgttagcaaattgaatagcaaaaatacaaaatatataacatttttcaaacttctaaacgtatatggattcagttaatcttcttgaataaatgttatatacagtatacgtaaagtttaaaagtattataaaaacggaatacagtaacacctgagatttcattacgggtagaaatcaaagacaatgttccttaaaacagactcaattgaaagtaaaacggtaggtgagtaggtttaatttctgatttttgtttcttttcgaccaaatgactactgcaactttcttaaactgagttttttagatctccatataagttacaatacatattgagtattgacaaaaattattttggtttttctcagtaacaacaaataatttcaaagtaaaagcgtaagaaaaattacaagttacaaagctaaataaaaatcagaatctgcagtcgcctaataaaaaatgaaaaatgaccaaagtttctctgcaaaacaaaaactttaatctagagaagcaacttccctcctctctgcaacaaattaaattctaaaaaaaaaacagagcaatatatatgcatgcatatctatagtataagctagtctccattgaatacaaaacccagagac

SEQ ID NO: 2201 - DNA, 3000 bp, Unknown
  misc_feature (1)..( 3000): cDNA_ID_3066474_gDNA_ID_1620502_Annot_ID_158939 3000 nt of promoter + ATG
tcaatggcggtttgatcagtcttgtccatcttttttttttggtgtttaaggatagagagatctttgtctttgtcttttataatgttaagtgtttaaagtcataaacgacaaaacagtcgctcaagcattcaatataatcatgtgattatatgacgtcaccagtctcaattttaggtgactctttttctctattttaatcatttttttttccaaatttggtattacgtaccagaagtaaagagatgtgattaggccttcgtaattaatgatataggttgtctgtttattcatttatgattttcgggtatggactattttctctcaatccttgttaagaaaattcattcacatgaatggtctaatactttttgcacatgttaggaaggaccgtctgcacaagcagagactcccatccatgttgacatctttacctaagttatttcaagaacattatgtacgcttaagtctactttataatagtaaatgacataggataggacgaccatataaatatttattttttgtttttttgacaaccgtcaagacagaacgaatagaatctgaatagttgaaatgtgaatagtattgaattcgtaacactagttatcgcatcaaaatgagatttttagtatcgacctttgcatattccacgcgtcacctctccaagcagcatacgagtatcaaactatagctacctcgtgactaaaatttatgggtattgagaaaataaaacaaagtaatactgttagatatatctcaactacttttgttagcagtacaccgtatatatacatgtttttgctaaagaataacaattgacgtactaattttacctcattaatatatatggtgaaataggtgattagtatatttacctaattcaccatatatgaatatggtggcaaactgagatataagagggaaggtgattttcatgcaaattttttttttatttttttttgaatgaatgcaaaatttattcaaaaaaaaaaaacctgggctacatcaagtacttcatttctgagtttttgaaaaatctaaagacaacaaaagactttacaatttaataaaaaaataataaaaatactttatcactctcaacgaaattgttgatttaataacgtatctcttggtaaaacagcgttttatttgacgaaattgttataaatgaataaaatgataatagaaactagtgtggtacgtaaaatacctctcatttggcaaaataacggttatgtatcatgagtattgcatacgacagcgtgcttaaatagtgtgctttcaggagaaaatatataccaagttatttgctgaaattaccacgcaaatctgaggttcgaatggcaaaataaaaaaccaatgtcatttccttaatgtattaaggtcatttaaataaaattgtacacttttttcacctgtaagcgttccaaagtgtagaatggataactagaagggtcaaaggtataatattaataagcgaactcactttttgcccaagtgatttcacttcttacatttgcttgatatagttacccaaaagtgtatatatattcccttatacaattgttctattttctggattataaggggaataagaaaaaagaaaagagagagtatataataatacttttataaagtgatgttagattctaatttgtaacgaaaagttcaaagtgaaagaaaaaacgaaaaagtttttctgttttgttttatatctatagccaagaaagtttctcagatttacaagaagttaactgagaaaaacaaaaaaaaaacttatgaagcatgaaagactaattaacgaggtgattaattttgagacaaattaaacatcgaattaaaagtaacatttggagggtttatatgttatatatgtgacatgataagtccgattcatgactaatgtatatctggaatctaacatggaagaatagagaacgaagcagagccaaggtcaacttgccagacacgaatcaacagattgtgaatgagaccaaatcaatggtcataaaccggttgggtttaaaccggcaagtcatccttggctcaattccattcgttattccttcatgcaagaccctctgatacaaccaaagactcccattacaatattctttcgatcacgagctacttattttcaaatgtgttacctctttcgtgactcttgtgttgtgtggtaaagcctagtcgagatgtgtcggtatatataggcatacatatacaaatgcgacaaaataagtatattatattgtttaatttctatattccatttctatatgcatggctgggatttttgaccaaaaccctaattcaagaatagaatccaaaagatgggatcaaagaatataatctaatgggctgaccacattttccgatttaattcgcatagttaatattctttccactactttatgccgcagaaatttgtaattaagtaagacaaagaaatacagatataagatggtcgtagaaaccagtagaggaatttcatttttcgtggataagtggaatattaataagagaatggtctttactctttacagtgggaaatgggaatagtagcccattataatttcatcagattctatatatgcatgtttgtataagctaaaataaatacgtttaagcattcttcaaaaaaatttacaagttctagagactctcttaacgtcggcaatttatattctactttacatgacactttcaggaaaagaaaactatactcactagcagatcattaaattttctttttctttttttgaatgaaccttagttgtggtttttatttttgttagctagaaacttcagtgttttttttccgccaatggtagtgctttgatgatggtccggcccaattcatagaaggccttgaaaatgggccagaccaattcagagacccaacaagctcgactgtatacacaaaattcacaaaaacagcttttgagaagttttcttcttcttcaccttattttcgggtatcaaagccacaaaaccctgaga

SEQ ID NO: 2202 - DNA, 3000 bp, Unknown
  misc_feature (1)..( 3000): cDNA_ID_2047725_gDNA_ID_1620502_Annot_ID_158938 3000 nt of promoter + ATG
gagagaaattgagtagctgccgccattctcagggttttgtggctttgatacccgaaaataaggtgaagaagaagaaaacttctcaaaagctgtttttgtgaattttgtgtatacagtcgagcttgttgggtctctgaattggtctggcccattttcaaggccttctatgaattgggccggaccatcatcaaagcactaccattggcggaaaaaaaacactgaagtttctagctaacaaaaataaaaaccacaactaaggttcattcaaaaaaagaaaaagaaaatttaatgatctgctagtgagtatagttttcttttcctgaaagtgtcatgtaaagtagaatataaattgccgacgttaagagagtctctagaacttgtaaatttttttgaagaatgcttaaacgtatttattttagcttatacaaacatgcatatatagaatctgatgaaattataatgggctactattcccatttcccactgtaaagagtaaagaccattctcttattaatattccacttatccacgaaaaatgaaattcctctactggtttctacgaccatcttatatctgtatttctttgtcttacttaattacaaatttctgcggcataaagtagtggaaagaatattaactatgcgaattaaatcggaaaatgtggtcagcccattagattatattctttgatcccatcttttggattctattcttgaattagggttttggtcaaaaatcccagccatgcatatagaaatggaatatagaaattaaacaatataatatacttattttgtcgcatttgtatatgtatgcctatatataccgacacatctcgactaggctttaccacacaacacaagagtcacgaaagaggtaacacatttgaaaataagtagctcgtgatcgaaagaatattgtaatgggagtctttggttgtatcagagggtcttgcatgaaggaataacgaatggaattgagccaaggatgacttgccggtttaaacccaaccggtttatgaccattgatttggtctcattcacaatctgttgattcgtgtctggcaagttgaccttggctctgcttcgttctctattcttccatgttagattccagatatacattagtcatgaatcggacttatcatgtcacatatataacatataaaccctccaaatgttacttttaattcgatgtttaatttgtctcaaaattaatcacctcgttaattagtctttcatgcttcataagttttttttttgtttttctcagttaacttcttgtaaatctgagaaactttcttggctatagatataaaacaaaacagaaaaactttttcgttttttctttcactttgaacttttcgttacaaattagaatctaacatcactttataaaagtattattatatactctctcttttcttttttcttattccccttataatccagaaaatagaacaattgtataagggaatatatatacacttttgggtaactatatcaagcaaatgtaagaagtgaaatcacttgggcaaaaagtgagttcgcttattaatattatacctttgacccttctagttatccattctacactttggaacgcttacaggtgaaaaaagtgtacaattttatttaaatgaccttaatacattaaggaaatgacattggttttttattttgccattcgaacctcagatttgcgtggtaatttcagcaaataacttggtatatattttctcctgaaagcacactatttaagcacgctgtcgtatgcaatactcatgatacataaccgttattttgccaaatgagaggtattttacgtaccacactagtttctattatcattttattcatttataacaatttcgtcaaataaaacgctgttttaccaagagatacgttattaaatcaacaatttcgttgagagtgataaagtatttttattatttttttattaaattgtaaagtcttttgttgtctttagatttttcaaaaactcagaaatgaagtacttgatgtagcccaggttttttttttttgaataaattttgcattcattcaaaaaaaaataaaaaaaaaatttgcatgaaaatcaccttccctcttatatctcagtttgccaccatattcatatatggtgaattaggtaaatatactaatcacctatttcaccatatatattaatgaggtaaaattagtacgtcaattgttattctttagcaaaaacatgtatatatacggtgtactgctaacaaaagtagttgagatatatctaacagtattactttgttttattttctcaatacccataaattttagtcacgaggtagctatagtttgatactcgtatgctgcttggagaggtgacgcgtggaatatgcaaaggtcgatactaaaaatctcattttgatgcgataactagtgttacgaattcaatactattcacatttcaactattcagattctattcgttctgtcttgacggttgtcaaaaaaacaaaaaataaatatttatatggtcgtcctatcctatgtcatttactattataaagtagacttaagcgtacataatgttcttgaaataacttaggtaaagatgtcaacatggatgggagtctctgcttgtgcagacggtccttcctaacatgtgcaaaaagtattagaccattcatgtgaatgaattttcttaacaaggattgagagaaaatagtccatacccgaaaatcataaatgaataaacagacaacctatatcattaattacgaaggcctaatcacatctctttacttctggtacgtaataccaaatttggaaaaaaaaatgattaaaatagagaaaaagagtcacctaaaattgagactggtgacgtcatataatcacatgattatattgaatgcttgagcgactgttttgtcgtttatgactttaaacacttaacattataaaagacaaagacaaagatctctctatccttaaacaccaaaaaaaaaagatg

SEQ ID NO: 2203 - DNA, 3000 bp, Unknown
  misc_feature (1)..( 3000): cDNA_ID_2047729_gDNA_ID_1620502_Annot_ID_158942 3000 nt of promoter + ATG
tttttttaattattaaatttaagctgatgatattcagaaaatatttacttcttggaaaggacaaaaataaaactaaatttactttttttttttctttctctgccttatgtggatgataaattttcggataataacctacaaaatgtgaataaaatttatgagaattgaacaaattgattcatcttttttttttcctttccctggtacagagtttgttgtataagttatataattcggacggtacaaatgagaaaacaaacaatcaaagattacctcaaagactgatgatgagaaactacattttctcggacatcatcatctctctgtattagtattaccttgtgacaccaacggtattgattcagcatctcctggagtttctgtggtaacaactttggatgcttccttcttcagcttatggttgttataagccgctacaccggcaatagctgtgtgtgaacacagagcacactgtatgagaagcaaatttttttcttgttagccaatttgtatgtgagaagttttgtcttaccgatggcgtaaccgaaaagattgatgattgtgagtttcgtgtcggcaaagagaagagctgacaccaagacaaccacccaatccttgacaacgccagcaactcggatagtgagagcactcgtgtgagaaatcaccaagaaaaccgacaagttgagggcaaatgtacagagggaattaagggtcaacactacaaagtggaagttccatgggccattgccatctatcttcgatttctctagaaagatccacggcacaaacaagcagatagcactgcaaaggaggtacaaaaagataaaagtaacccttaggcttaaataatgagagaaatgagatggcttcctcttcttcgattttacttacctgcatgggctcacgtagtacataagagagattgggtttaacttgatgcccttcctcttgacaagaagttccatgaagattagcctcagggcttctccaacaacaccacccatttggtaaaccactccaatccagttgatgtttaattccccataagaagctactaaaacaccaaaacttatgatagacattatcaaaagcatcctgcagctcatcatttcaagtccagcagctactccaagaataaacacagcaacaggcactgcaagtatggttgaagaatactgtacattgttagtcagatataagaagtaaacataagacttatgaggaaccaagagcatgaacagtttcttacttatagccttcaacatctgcgcaaatgcaactgatatgtagaggtaggcagtgtttcccaaccagagggtcattgcaaacattgcacctattggaataactgacgtaacatatctgagtacataaagtgagttaatactgctacattgataaaattagtaaagatatttatgttatgggtattttcgactactccaaaatcaaattccttacgaagtctctttcttccttacatttctagtgtcattccttcctcgaccttcacaatcttcatggagaaataaatagagaacagagaagggaccaaaagttaggcagtctttacttgtgaacaaaaacagaaagaacattaattgcaagattaccttaagaactttggtaagaagaaagcacaagacagaggaaaagatcatatggagtaaagtcaatccaagaggataagggaaattaatttccttagatgacaaaacccactgcagcagagcaattcaaagacaaaaacgttagtcatgacgaaaagagagaaaccacaatctatgaatcgttacttgctacagattgtaaaacggtgaactctgatgcataagcaataacagagaggtcaaaagcaaacacaacacgatcaaacaaaagcaaacggatgttgaattctacacaaccgagggattctaaaatctgctagtcaacttcctagaaactagcacagtacattgcacataccagctcaattccttacgaaaactagcgatcggtttctacaaatcgaaagagcacaaaacaatacgatgcgagaacatagatccagggaaatatagattgtgagatttaaggtaaaccttattgaagaagatttgaccactagaaagagcgatatagagaagaatgtaagcataggtcacgaattcagctctcataaagcctttgctccgatccgccattgaaaccgattattatgatctcagattacggaataaaagttgtcgcttctggtttttatgtaacacttttccgagtgctttttgtttcttttccaatcgtcttctccttcactgagtatttcactttcccatcttctcaaatttcaacaacagctaaataagagcgacggtgacgactttaagtgggtcccactttttattatcctctctcattttatgggcttttctcacatttaaagcccaaatactgttgggtttataagctattgttatgtttcgtcaagcccatgaatttggttctacctcgcacacttttttttgtttcagtttcatcatccacccttggatatatgtccaatgaaaagaaatgaaaattattaagtattttttctcgagattgtgaacgataatatgaaagaaatgtaaggaacacacaagttgcttgtggattagaccacaacccatctgatatttgtccgcatctccacaaccattcttcacctccaacttctcatccatattataatccaacttgccaataattttttcaactgttacagattactacatcaacgaaatattaaacatttaaccatatataaaagttggagatatatgatataagcttttcttagcagtcccacccttcctctctcgagagagctccattccaatcaaagctgtgtaagattctgtgttctagaccaaacagagacgcgtctgtgttctggagattataaacatatgtctgataatcacaactgataactaactcggggttttttgctcttttgacagaaacacacttcagaag

SEQ ID NO: 2204 - DNA, 1956 bp, Unknown
  misc_feature (1)..( 1956): cDNA_ID_2024817_gDNA_ID_1620502_Annot_ID_158941 3000 nt of promoter + ATG
cattgacactattcagacttaagtaatggatactatctgatcgatgcttgcctcgtccatctttccaaggtcaagaccttcaaagttcttcaatgtcaggtttggaggcaaagtgaatctgtagtagaagaacacacatcgttactctataattgtttagctatatgtttgcatattcgagtctaatcaactcttatcacatttcaattgatgtggctttacctgttcttgatatcagactctctgcgacctagccttggggtgtctacagtgagagcaatggctttgaacccagctttctcggctcttctcacgagctgctcaaccaccttcctgttcttgtatacctactcagaacaatcataacgtgtgaaccatcacgtgtgaccacaggtatatcagaattgttcatcaagcaacttacatagagctggaagaatcggattcctggccctgtggaagcaacttcttcaacacttgaagtagcccatgaagatagtgtctgaaacatcatggaagaaaataactcaaaccagaaacttggttatgcatggattggtggattaagcagctataaacaccaagacggttaaaatcttcttttgaatataataacataccatgatggttccagcagcagacgcagctctagccgtagcatattcccctgcattagtttccattagagtaagcctcagtctttgtctctagtgatactaaaacaagttttaactctctagaaatgactgtttcaggaaaaaagaaaaacgtcttttaccatcagggtgagccatcttttgaaaggcagtaggagcaaccatgatcggcatcgagatcttgaaccccaagacggtagtcgccatatcaattttgttcacatcaatcaaaatccgaggccggaagctgttaaaacatcccaagttatgtacatcaaactcagttctcttgtgaaaaccaataacaaaaagtgtatcttatcttattaagaaaagaaaaactcacaggattcttgcaaaagcgtttctgttctcttgaagagtccattgatcttctgcaccagatgcatagtagtcatataccatcttaggcaacttcgcctttgcgattgcatcatactcggtaacgttagtgatctccatcttctgaagtgtgtttctgtcaaaagagcaaaaaaccccgagttagttatcagttgtgattatcagacatatgtttataatctccagaacacagacgcgtctctgtttggtctagaacacagaatcttacacagctttgattggaatggagctctctcgagagaggaagggtgggactgctaagaaaagcttatatcatatatctccaacttttatatatggttaaatgtttaatatttcgttgatgtagtaatctgtaacagttgaaaaaattattggcaagttggattataatatggatgagaagttggaggtgaagaatggttgtggagatgcggacaaatatcagatgggttgtggtctaatccacaagcaacttgtgtgttccttacatttctttcatattatcgttcacaatctcgagaaaaaatacttaataattttcatttcttttcattggacatatatccaagggtggatgatgaaactgaaacaaaaaaaagtgtgcgaggtagaaccaaattcatgggcttgacgaaacataacaatagcttataaacccaacagtatttgggctttaaatgtgagaaaagcccataaaatgagagaggataataaaaagtgggacccacttaaagtcgtcaccgtcgctcttatttagctgttgttgaaatttgagaagatgggaaagtgaaatactcagtgaaggagaagacgattggaaaagaaacaaaaagcactcggaaaagtgttacataaaaaccagaagcgacaacttttattccgtaatctgagatcataataatcggtttcaatg

SEQ ID NO: 2205 - DNA, 3000 bp, Unknown
  misc_feature (1)..( 3000): cDNA_ID_2047662_gDNA_ID_1620502_Annot_ID_158933 3000 nt of promoter + ATG
tgatatctttagttcaatatcgtatggtactttgaatttgtaaagtatataaagaactcgttttgacaaaagacaaataggatatatgtatttattataaggttagcaaagcaaatgctgtattttaaataaaatatgtactattttcctctgtttgtttttctacgagaattttcggtggactaatgttaacaagtgggttatttgatattcctagaaactagtactggaataactttcagtatttttatttatctaaatcataagataaatatatacaatccagagtccaagactccgaaggaataaaacgcttaaaaggcttaaaaatacgtatgatcaagtacaaatgaccaagtctgtgaacgttactaacttacaaagaattgataggattcagagtctatttaaaagggtttgtagtgggctgatcgatatattaatcgacatgttactttaaatttcgtgggtagacaattgatacaccatcgattataaaaaatattggacaaaagaaattaaaaaaagcatcacaaaaacacactaagtcactaacacacaccgcccattttattatgcgagcaatatagttcttcatctggccctaccaaataacgtaattaggtcgcctagcttttgtaggcaattgaaatcaaacgacgcgtcgtttgtcggcaacaaaataaacggcatcacgttaggcgtagtctattcagggattcaacgacgtcgtcgagagcttcatagcctttttttttctcgaataaatatttgtgtgttaattcgatactctctctatttctttctcttctaagaattcttcatttttaaaactgatcaatattctttggctattgtcattagaatgtacctaatacctactccatgataaccctatacatcttaaagcttatacatgaactcaaaatgactaacaatgacacaaaacaaaaaagaaaaaatataacaaaaattaggctgacgagattatttttgtcatcagactaatagttgtagaaacacgtccttcattgaagctaagctaacttgtttgtatttcgttttttttttcttttctactttgttcttaatatctgttataaacaaatttagttgtcaattttaattaataaatctctgaaaacaattatatatgccggagagatacatcatatctttcgttttatatatttatactatcagtgtcaccccttcttgctggcacacgcttggcttcaagcctcgattgatctattcatctacctaaattctaacataattcagtttaaacaaaatttcaaattatttcatttacctatataattaaaaactagtattttctaaatttaataataccagggatccaaatacaccattaatatgataaaacgaattgtaggaaaatatggatagatcatagatgtgggcaatagtgttattaaatactcatcattcatcaaaacattagttttgtttttttgttaaagaaaaaaattagtttctactattattcttaaatgcaaaataaaaaccccacatcattttattttattttgtctcgtcggtgccttagaaaactaatatccaaacacgtattttttcgcgggtcaaatatcaagaacaagttaattaattaaattgataagaaagcgaacatacacgaagaaattttcaacgaagacattactaaggagatgagaggcaaaccacgtacaatgaccgattaacacgttttaaccaaactaatcgctcacataaaactgggacaatctaaactaaatgattgattatcgatgatgtaactttttgtttgacaataatttggaagttaacgaaatgctgaagattaagatgcatcacttaactaatatcgtaaatattttttcttggtcgttgctaagttatcttttctcatacattacaaactatcaaattacttaaatttatatatccgtccctctctaatagaaattagaaaaggtcatacatatttgctacaagaatctcgtgagtttctttaataaggtttttgttaattaattatcttatatactcataattgcgacattaatgagtgttttactcttatttcacccacatgtctcttctttataagcaaaacaaactacctttttctgcacaaacaaactaacttttaatatagtaaaaaacaatttaacctttttcactctatttccttttttcattccacttagatgtgaagggaaagtaattaattcttcaaagcaatgatggaaagacccaatcctaaaccaatcttcaaagtaatctatactgtatgaaagcttcgtttctgtttttcttactatacaaatgaattaattcagtatatgaatatttcgtacataaaaaggaaattaaaatacagaaaagaaagaagaatatacaaacctttaaaagcgcgtaggccttatgaaaactacagctagttattattaaatttgtatttatttgtattttttgttttcttttaatttgtgggaataagagaaatgcataaaaaccaaaaaaagacaatgcgtcagaccataaccatgatacaccaaccaagattaattgttttatggacaaaattaaaaagaaaaattagcattttaagtgtagcattatgtcattaactaatattaaatggtaattattagtactaattaataaacaaatgtagataaaaaagtatatggaagaaataaataaaataatccaaagcaaagcaaagcaaagcgccgaagcctatttgtatggctcttggattcttacttatagcaaatcgtgcttgccagctttttactcgataaattcgtcttatggctgaaactgtataaaatctagcttatcaaaatttatcctcaaagtttattaaattaataataaaaatctctgaagaaaagtttgggtttttgccatttgggttttcttctgtctcatctggttttcgagagagatagagaaagtgagacaaggttaaggaggaagaagatg

SEQ ID NO: 2206 - DNA, 3000 bp, Unknown
  misc_feature (1)..( 3000): cDNA_ID_3066481_gDNA_ID_1620502_Annot_ID_158926 3000 nt of promoter + ATG
ggtctcttagccggtgtaaaaaatggggagctcaaggtggcaagagcaatgtcttctttgctaaaaccctggacgatcgatttatcatcaagcaagtcaccaagacagagttggaatcattcatcaaatttgcacctgcttactttaaatacttgtctgagtctatcagcacgaaaagcccaacctgcctggcaaaaatcttgggaatctatcaggtacgtaactgctaagatgagagatttcccgttcaggttagattcactcttgataaaaatatgtcttgtgttaataggtcgcaacaaagcaacttaagagcgggaaagaaacaaagatggatgttctgattatggagaatcttctgtttggaagaactgtgaaacggctttatgaccttaaaggatcttcgcgggcgcgctacaatcctgactctagtgggagcaacaaagtcttgttggatcaaaacttgattgaagcaatgccaacttctcccattttcgtcggtaacaaagcaaaacgattgttggaaagagctgtctggaacgatactgcttttcttgcagtgagttttattcttctgcaaaccatttactcttcactactctttgaaaaggtttattagcaataactatatttttcgtgtttgcagttgggtgatgtgatggattattcattgctagtaggcgtggatgaagaaaagaacgagctagttctcgggattatcgacttcttgaggcagtacacatgggacaagcatctagagtcttgggtgaaatttacaggaatcttaggaggaccaaagaatgaagcaccaacagtaatctctccaaagcaatataagagaagattcagaaaagcaatgacaacttacttcctcatggtccctgatcaatggtctccgcctaatgttgttgcaaataactccaagtctgatcaacctgaagaaacctctcaagccggtacacaagcagagtgatacaagaatcattataatgtaagtttattttttggtcttgtatagatttttggcatttgggaacacattattattcgttatttctttctttattggaaggttgggtttctgtcagatatcgattttgtttgcgtcttttagattttgggtcgttaaagtagagacttaggagattgtctgaaaaattcctcagaaagatagagagacatttctcttgtgtatagcttttgctttaatgtgacatgatttatgaaagattcttttgtttatatgttggatcctcgtacccttttttttggtgaaagattgaaatcaaaatctggacgtaagtttcttacaaaagagaaacaagaaagaagcaaatcgctgcttctttcatagccttttttctgtacattcttattcaagaggcctttttgaagagagaaccagattttgatgtttcgatgaagaaaaaagaaaggggatttagaggaagtcaaagctgctccatttgatcatcatgaactcttgttctgaagcaattatcggtctttgaccatccttgtttgaatcgctcagctcctgataacttctttgcagaagatcaagaatctccacctctctgtttttgataccaaatccatttataaaacaaactttgaaacaagatcgatctgattaagaatttaggttaggattaggaatatatcataccttgagtaagaagctaccattggactctgtgtgggacaacgaggaccttcatcgtatccttcacatataacctctccattatcatctgtgtaacagatgatcccttgtatcggatcttcaaaaacctgttccaagaaaaacaatttcaacattcatatttttaccaaatggttgtgtctgaattttcaagaaaattatgatccactctaaggagaaacaaaaagagagagatgatcttacaatgttcttggtggagtatctgatcggctgaggctgtgaaactgtggctttcttgactttaacatgaacttgactctgttgaagcatcaaagtctttgctcttactgtctttggaacaaaacatggtgttttaagaggaagataaagtttagttgaatatgccatagcttttgtgtttctttctttcttcaagaagaaactttgatctcttctttttggacaactcgtttggtttatagttctcagagaagaaaattataaattccgatgattgattgaatctgagtttaattaagatttttttttaagtcaattatatatagacgcaaggtgaagataaaataatagccaataagagtggcaatctcattaacaagtttggttgtctttttcgtggggtttggttagttcttctaatggtttcgtttttcttcttacgtttgatttttgatgaacgtcaatgtgaaatcgttgaatatatctacacatatacatgtgtatgtctagtcaggtgtatttttattacataaatttttataaaactattattgggatttcttactccgttaatgtttaaaaaatattactaagaaaactacttagattctgtaacacttatatttgagaaacaaaatgagttttataacccgattctttgacaaaataatatgagacaaaaacaaataattccccaactgaaatagtttatagacttaagacattttaccttccttctgacctaaaaaggtaaaaaagacatttgaccttccatcgaaacaattaatctgtcattacattaatttcaaaaacttgcgtgctattagttgcacttgcattcaaccaattttttcgttatgttgagataatattaatattagagtaaaagaaaaactaaacatcgagcaaattagttgttacagtgcttatctgccgtccaatgacgaattaactcctacttaattaaaccgtggcacgtgtcgatatatcaagcgtcatgataagcttttaggagcatttttaattgcaaaatgacaataattggtgttatattattgctatgatttagacaagagactaattgtaggctaaac

SEQ ID NO: 2207 - DNA, 3000 bp, Unknown
  misc_feature (1)..( 3000): cDNA_ID_2047682_gDNA_ID_1620502_Annot_ID_158927 3000 nt of promoter + ATG
cgagagattcttagctcgtgacatcactttccaaaacacggcgggtccgtcgaagcaccaagcggtggctctccgtgtgggttctgatttctccgccttctacaattgcgacatgttagcttatcaagacactctatacgtccactctaaccgtcaattcttcgtcaaatgtctcatcgccggaaccgttgacttcatcttcggaaacgccgccgtcgtgctccaagactgtgacatccacgctcgccgccctaattccggtcagaaaaacatggtcacagctcagggaagaacggatcctaaccagaacacagggatcgttatccagaaatgtaggatcggtgccacgtcggatttacagtcggtgaaaggtagttttccgacgtacttgggtcggccatggaaggaatattcacaaacggtgataatgcagtcggctatctccgacgtgatccgacccgaagggtggtccgagtggaccgggacttttgcgttgaacactctgacttacagagagtattcgaacacaggagcaggggctggaactgcaaatagagtgaagtggaggggctttaaggtaattacggctgctgctgaagctcaaaaatatacggctggtcagtttattggtggtggaggctggttatcgtcgaccggtttccccttctcgctcggtctttgagagattgttgtgtaatgtgttcctacgtattgttggctacaaaaattattgattaatattgtatgaagcaaatcgtgttgtcctctttgttttgtttgggttgtgtactttctctagatcatcgtagtattagaaacgagatgaaataatgcgggtttttgcgccttgagaatatggatttgagaaaggagggatgttgcctatttgatgatgatgcatgatggatgtcataataaaaaacaaaccaaaaacatgtattttcttgtaacttctctctctttttgttgtcaacgaaacttatgtccatatatcaaaaaaaaaaaaaagacaaactattttgatatgcatgcattgtagtccaaaacttgttaggtaatccgatctagaaagagaataagcaatgaggacagttacggtaagaaggctgaaagaaagggaatttaggataattccgacgatgctcccggtaaccgtttcggagtgcttttagaaaaataaaaaaccttgaatcatcgaccggttgatttttttctttttttcttttttaagtttgttactatggtgtaaagcaaagagaaacttggaaatatataaaccacatgaatgcctaataatgataattgcgcaattttacgatgaattcacaattcgaaagcgtacaaaaaaacttgtctttgaccttggttagatttagctggccaaagttgacttcgactatatcataagattcataacgtattaacattactcaaattaatatctcgaagactcgaactttcctttgtacttgtaacgtgtttaacgtcaaaatcactataatgagcattggcctatcggctatcgggcatgttagcgccaggttaacttagcccaagatggttcaatctgaccggagggagacattcttgacacgtttgttggttcgtctcatgggcttcttttagaccgtaatcttcagttgataaacattcttgctaacccattttaacgggtattaaatttacatatgaaaaaataaaaataaaattaaatatgacctaagttctttttgtagtttaaaaaaaaattgaggttgatcttgcatttttttgttacctggatattctttttttttcctggtattttcccctaaataaagtcattcttccattgcacaaaaaaaaaagagtcaatcttccaatgagagaaaatggatcaaaataagtaattaacctctttcaaaccaaatattcctaactatgatatttccataaacgacatttctagaactttgacaaccagacttccttagtattctgcaaggaacttatcctaaaagcccaaaactaatgcacagtaagtatatcatatcactaaaatctatcccaaattagatcactacaatatctcatcaattatatcaagaaattcgtgattctatacatccaaagtttccataacaaaaaccccataaaatagactatgaataaaaatatcttcaaataaaaatcatgataaaatgttcaatcgtaatcatgttaaaatattcaataagataaaaatttatcaatatatttttgaggacattttcccgcattcaaattcaaataattctaaacaattaattaagcacactattaatcagtaagttttttttctttctataacagtatattgctcaaactattattttaaaaagtgtaatttctaatccaatgtgcaacgttgacaatacaaaccaatgtgctctgcattgactttttctacactgcttattagcttcactggaatgatttgcccatttgcatgtgttatcaagtaagacgtgcatgttttctatactctctagtaagtacatatgtgcctagaagtgaaaatattactttaaattagacaaacatttggacttaaaacttgaaactagtattgtattattaatcacaagtagcacccaaattcatgtttttattaaaccaggtcgaatattctgcattaatcatgcaatattcaattacaatctgatgaatacagaaacggaaacttcttaatgaagattgatataaattaattagtgacagaaattacgtaagaggatgatcatgaattaactagtgacagaacatgatgtatcgtcaacactcctaattttaatcgatcatctacacacacttccttaagaagcaccagagaataaacgcgagacgttaatttaaatattcacattccactacttatataaaactatcaacacactgacatcaataaccaattcttcattcttgttctaagacacacacacacaaatataaaccctagaaaccgagttagggtttttgatg

SEQ ID NO: 2208 - DNA, 3000 bp, Unknown
  misc_feature (1)..( 3000): cDNA_ID_2047670_gDNA_ID_1620502_Annot_ID_158931 3000 nt of promoter + ATG
cattaaactttttttattgtcaaaaagtattatacatcaaataatcttatggttttctaactatgtaatcatctggttgcagagaataagtctgtacagaatccaccattggttgagacaaagaaactggatacgtcattgtcgatgaatctacgtcctccaccatctgagcgacataagtcgtttgatgacgatgattcaacaatgagaaaacctattgttgcaaagaaagctgctgttgttgttccttcaaatgtgaacacatatacggtttcagatcttcaagtagctaccaacagtttcagcgtagataatcttctcggtgaaggaacatttggaagagtatacagagctcagtttgaagatggaaaggtatttaattttatataatcctcctctacttgtaagagcacaatgtcataatattctgctactgagatattttctttgatctactaggtacttgctgtgaagaaaatcgactcatctgcgcttcccacggatactgctgatgattttaccgaaattgtatcgaaaatagcgcatttggatcacgaaaatgtcacaaagcttgatggttactgttctgaacacgggcaacacttggtggtctatgagttccatagaaacggctcattgcatgactttttacatcttgcagaagaggaaagcaaaccgttgatatggaatccccgtgtcaagatcgctcttggcactgcacgtgcattggagtaagtctttaaacatctcaatcacattattgctcaatataatagcatgcagcagagtctcatggaaagtattgttgttgttgcaggtacttgcatgaagtttgctcaccatctatagtccacaagaacattaaatcagcaaatattttacttgactcagagctgaatccacacctctcagactcaggtctcgctagcttccttcccactgcaaacgaggtatatatagtatagactaaacttctcagaattctagtatctctctctctcttttgttcctccatggaacttgttcctaagtattcatgacattgtgcagctactaaaccaaaacgatgaaggatacagcgcaccagaaacttcaatgtcaggccaatactctttgaagagcgatgtttacagttttggagtagtgatgctcgagcttttaaccggaagaaaaccattcgacaggtacttttacaatccatatccctcgccttcctaaaaaaacttaagagtgatgcaaatgtgttcagaattgaagtaagtcctggtgattgttgtgtgtgacagcacaaggtcaagatcggaacaatcattggtaagatgggcaacacctcagcttcacgacattgatgctttgggcaaaatggttgatccagctctcaaagggctatacccggttaaatccctctcccgatttgcagatgttatcgccctttgcgtccaggtaatcatctatatattataatgtgatgatctgaacaaatgaaatctgaatgtatattgttcttttaatctgttacagccggagccagagtttagaccacccatgtctgaagtggtgcaagcattggttgtattggtgcagagagctaacatgagcaagagaactgttggagtcggctccggtagctccggcgtcaatgattacatgtaaattctttacctgatgagaaccaacaaaaaaaaacataaaaatttgccctttttctcttgtctgctcggaatctggatgggacgacaacaagtgacaaccgaggacagacaaaacaaaacaaaatcctttttttctttcggtttcataaaactgatgatgagagaataacaacaacaacccttcacgcattgtacactcccatgtttctttgtaatttgttcccaatttgtagctttttttttagattccgacaacatgaacaaaaccattcccttttgtgagttccgatccaaaaacggtattattccatttgtaattttttccttgtttgaataaattttatgttaataaagtggaatatgatcgattacaatttgtgtaaatctgctgctgaattgctaaagcttaaacagcaacggtcgttctaaatttcaacaatctttggactttcaccggcaatcaaggcgacgacggaaccgtaagagcgtaaatccacgtaatattagaaacccgaccggaaacacgctagtgacacgtggatttgtcacgtggacactttttatgacacgtggtagataaatcgactatactatgcacacctcacgtttgaatcaaaaccatataatatacacgatttcttgaatgagggtagaaataattagaatgatgatcgggaagttgtggagatctgtgggaaccgtcggaaagtttgatggtcgttacgacggcgtgaggacgatggttggaaaagcctcgaaccgagctggtgttcatggttcgaaacttcccaacgctaaagcacttgacaatgtaaccaattagttgaggtttcataatctcatttttgtttgtttgtcatagtaatcatgaaattaaattattctaatgcgtaggaggaagagatcagggagaggattagtaaaggcagcgaagacaaagaacagaaaagaaaagaggttgagaaaaaagttgaaggctctcaaagaggatctaacggcgaagatgcaccatcctccgaccggtgatgacgggtcttggtttttttttatcctgcttaatctcttcaatatgcattgtgtaatagtaatctttgtttcttcgaatcttattgctgcgcttagtatttctaattttgtggtctcgaataaaagaaaaataaaatataatatatacatctaccgggacttaaaagcccaaatattaaaggcccattaagtgtggcttatccatctccctcttcttctctgtctcatctctacaatcacagtcacagatactgtacttttcgaagagacgagtttcgaattttcgccttctctcactcctgagctgaatgaatttccaatg

SEQ ID NO: 2209 - DNA, 3000 bp, Unknown
  misc_feature (1)..( 3000): cDNA_ID_3066477_gDNA_ID_1620502_Annot_ID_158929 3000 nt of promoter + ATG
tcctcgaatgcgtcgtttgtctctcggagctagccgatggagacaaagctagggttttgccgagctgtgatcactggtttcacgttgaatgtatagactcctggctgcaatcaaactccacttgtcctatatgtagaaagagagtttgtttgaagcagtcaagaacgagaccagaacttggcggccgcgacaagagttttaaccaaaaccacgaccaaacatccgaacatcatgagttttcgacagatcctccgacgaacacagacacggcgattattgaagatggtggctgcggcgaagcaaacgaaggtcaaccagaattaacggcggtggtgatagacattccggcgaaagagatataaaatcaggcccatgctaggcattatgggcccattatatgataatatactgtccatgtattaagctaccgtgacatcactaaaaagtgataaataaattatttttttggtacaaaacttatgatatacactaatatactatggtaccatagtatatctcaacttgcaagaaagatactaggaacgactgatactgtgaatgtcgcgatgaatgtttttcttttaataaatgtataaatcttgtagtagtaacttttttttagaaacaattacatttcccaacgctctctactgacacaatttaaatagataaactgtgtatgtgcagcagcacgttcaaagcgtgaagacaaacaaatctatcaaccaaacaaagtgacctttttaaagaataattggcagaggttttattacaacagacaatttttcataaaagtagtgtggaaataggtatcttcaaaaaattagttgtgagaatataaattttgttcactactaatattttaaattctaaacaatttgatacaacatacatcaaaggggttatttaattattgcaaaaaatgtcttgaaattttaagtagtctgtaattaacctaaaagtaaatgttcataccaaatatgatatttttgttatttataaacttatggtagtttttatatttattatttatttttaaaattgcctctctcttttttttggacatcagtctctcgattactgcattggatgccctgtatttgcaacttgttgatagaaaggattacgcaagttgttgctgtcaacaaaaagagattatgcaagttgttatgtttaatatacccgttacacaatttatcactttttccgtaaaataagttccccgccttaaattagctactctagataatgaaagattaatgataaagaaggaatcaaattattcacatgattgtaacatcaacttttgatatattagaaaaaaaaacacagaaaagatcgccaaaaaaagaagaaaaaaaaaatgaaagaaagcatgtgatgattacgagtttactgtatgcttttctaaacgagggaacaaacttcattcataactatttgtagcattttatcctatatggctataattcaataatgtacttgtatccgatacttggatttaggatacaatctcttttatttcattttctagatttggtcaattaaactaccgacactgaaataaacatttctttatagatgacatttaactaaactatgttggagagaatatgatctgatgaaatgggggaaaaaatgtttgatatgacatccactgagactatgtttataatcttactaaacctaccagagatcagatataaacatgtttattgaaatcagaaaaataatttttagagatgtcatcataagagagaataatttttttccaagtttaataaacaatcagatactcaaacagattaaaacagtttagtttatatcattcatatcttttaaaagagagctagagtctgcgttatagcaacaatactttgtatttaaattttattttcatcaaattgatggaataatagctttattccaaaaaaaaaatggtagatggacccgtgacaggcttgcagccatcggcctaaatactttatatttataatttcatcaataatttcggtgcccctaatatctgattgtttacataatcgctatgtgacacttttgctttgctttaattatacctgtatactataatgttctgccataacatttatagcaacgttaattaattccttttatgtatgattagacgtttcaagacccatcattaacaatttataggtagaaatagtcctttacctccatagttttagtataatggcagttttctcaactattgttgttaagatacataaatcagcattctatacttgtatgtaatcaactctgtacctaatgttttaaaagaaagatctaagtactgtgtgtaaaaagatttatacttctaagtaagatagtactaattctattattgaactctttaaagatacaaatgttatcaaatcaaaactgaaaataacaagtgtttctgataacgacggtccagttacacttacacatcaattgaatccaaagaatagttttagtaacactcgagattttcaaattggttgaatgacgaaacgaatactaaaatcagaaaagaagaatatgctttttagtaaagaaaaaggttatattattgtcggttaatgataatataatcctagtttcctaatgtgtatgaggataaacgtggacgagactggtgagttcatcactggcaaagcaacgaatatttaggtaattacatatacaaaattacaaaaatacaaaaacgacaatagactcctgtcaatttccgtataatatgaataatattctgattaaaacataaaacgaagatcttatctttacgagcgaggcagcttatataacccagtggaacgttttttgtttttctgaaaattccactcaaataatagaatcaagaaaagtaaaaccagaaaaagccattttaaataaatagtatcgtgtttgattttaatttcatcaacataattattatataaacacccactcttcacgagtacattcatcatcactcactagtgtcgaacaatg

SEQ ID NO: 2210 - DNA, 3000 bp, Unknown
  misc_feature (1)..( 3000): cDNA_ID_3066485_gDNA_ID_1620502_Annot_ID_158924 3000 nt of promoter + ATG
tttgtgtttgttgtatataaggaaaccttgcatccaaaatcaaatcatgaagttaggctaactttttagctgtcaatgattgcaatttgctcctttgtttgccttctaacataatacggttgaccaaaggcgtgtttctgattttaaaacgatactatcataatatctccaccgtatttttaaacgattgtataacataatatctccaccgtatttttttgtataatttctaggtttgtcaccttccaccgaattatttttattttgtatttccaaatgtattaaaatcttaataaattcaatttgggttgatatgttcgacttgaaatagatactaattagtagtaaaataaaggttggttgaataaagaaactgccaacggaaacggaaatgactagtggatttttttgttaaaattttaactagtaatcgagaataagtaattaggagtgaaggaatgttctttgttgataacgttcttaaataaggccctgttcgtttgatcagtttgatggatcatctggatggagatgagttttgatgtttgtttggtgccaaaaacgggagtttgaaaatttagcctaaattttcaaattcatttggctgaactaaattggatcatttggatggaaatgattcagtcaaaaataacaaatgacaaaaatatcctaattatttcaattgattatttagatgtatttttagatacaaaaacaaatagactaaatcttcttttacaattattttttaaaaaatagaaaaattaattttttctctaaaactgcaaaatcaaaattttccgctaaaaccgtaaaattacatttttccgccaaaaccacaaaaatcatatttcccgcaaaaaccgtaaaatcgtgttttcccgccaaaaccgcaaaatcacgttttcccgccaaaaacgtaaaattttattttccgccaaaactacaaaattctattttcccgtcaaaaccgtaaaatcatgttttctcccaaaaccgcaaaattacgttttcccgtcaaaacctcaaattcacatttttccgtcaaaaccgcaaaaatcacgttttcccgctaaaaacgtaaaattttgttttccgccaaaaccataaaatcgagttttcttgtcaaaaccgtaaaattacgttttcccgctaaaaccgtaaaataaatttataaatgtaaaaaattattatttaaaatttatttacttttaaatatattttagattaagaattaaaattaatatgtttacaagtaataataaaaatataattagatgaaagtatgggtattttaggtatttggattattacaaatcatttggatggagagtagagataagcaaacgaataacatctcattcggatgatccaatcaaatgaaccgactaaaaataaaataaacaagagtcggatgaatcatccagatggacatgttgaatggatcagttggatggatctgtcaaatggaaatgactattggaattttttgttaaaattttaactagtaatcgagaataagtaattaggagtgaaggaatgttctttgttgataacgttcttaaataacttgtgaaggaagaaagacacataaacgtatttggttggcttatggaaacaagtaaagaagtcacgaaagaactaatcaaagaaagcaaatgccgtgtccgtctcatattcaaaaaataaattaaaataaaagagtgcatgtgattgcaatctattcgtattatcatgtagatctacgatagtatttttgtttttccattacaaaatttgatattagcgattccatgttttgggtgttagaattaataatagtattagtatgataacatctcaataaatgtaactagactgcacatatattgatgggatcagtttaataaagtttaacatatctatatttttttcaagaatttttgtaaaatgaaatatatctttcatatttaatttttccaaattttactcgattttctttctaagaacaaaagtttatgatttgatttgtatgtatttttagaaaacgcgtttataaattcacaattatggaatctctatagtattgttgggtccatataattcattccacgggccaaaaagacataagttacgcaaggggttaggattaggtacatgaaggtgtatgttaagatccgtgagacacagataattgacgtgacgatgtcgctttctctgccacagaaaaacatgaatatcatatcagtcaatacctccaaatttttgtttttttaatttttttcaaaaaacctgaaaatcaaagggggaaaaaaatccctcaaaattcgagtattgaagaacgacgacgacgatcttctgggtgactcaaaggtttcagctcaattcagatgattttttgggttgaagatatttgaaacgattcgccttcttttggaatttggaattttaaaggatttcgattttgatgtgaattttgcacatgatcagggactgataattattgggttttgcttgattttgattgttcatgaacaaaaattctggaaaagatctagcttgttcataaacaatttttttagaaaacagaacaaagttttctccgatcgctcctaaaattgtatatatacttttctgattcgtgttaatctggtgataattgaattagatcgtcataaaacacgtcttcttgttgacactgattttagcgtttaatttttattttttttcagtgagaggttaagctcaaggtctctggattgcttttgaatttgcatgctgttggaggatgatagaccatcggtatgtgcttgagttttctcgaggaaggatgaaccgatacgagccgtcttattgattaattatatatatgtagtggagtgcctgaaggagatatatatatatatagtagcagttggatattagggttttcatttgttaggtgtgagtttcttttgttgttgttaatttggattctagacttccatgaccatcgtagcatgatggttgggaaggttttag

SEQ ID NO: 2211 - DNA, 3000 bp, Unknown
  misc_feature (1)..( 3000): cDNA_ID_3066520_gDNA_ID_1620503_Annot_ID_158957 3000 nt of promoter + ATG
atagtttctcgtttagtttagatatataaatacaaagacttgagacgacttctaatactccggcaacgatgattaataccgacgataacttattgatgatcgaagctctcttgacctccgatccgtcgccaccattacttccggcgaatctcagcctcgagactactctcccgaagcgtttacatgctgtgttgaatggaacccacgagccctggagttacgccattttctggaaaccgtcgtacgatgacttttccggtgaagcagttctcaaatggggcgacggagtttacactggtggcaacgaggaaaagacacgagggaggttgaggaggaagaagacgattctgtcgtctccggaggagaaagagcgtcggagtaatgttattcgggagcttaacttgatgatctccggcgaagcgtttccggtggttgaagacgacgtcagtgatgacgatgacgtggaagtgacggatatggagtggttcttcttggtttccatgacgtggagttttggtaacggatccgggttagcgggtaaggcgtttgctagctataacccggttttggttaccggttcggatctgatttacgggtcgggttgtgatcgggctaaacaaggaggggatgtagggttacagaccatcttgtgtattccttcacataacggagtgttggagcttgcatccacggaggagatccgaccaaattcggatctttttaataggatccggtttctttttggaggatccaaatatttttctggagccccgaattcgaactcggagcttttcccatttcagttagagagcagttgttcaagtactgtaaccggtaacccgaatcctagtccggtttatctacagaaccggtataatttgaacttctcgacgtcatcttccacattggcgagagctccatgcggcgatgtactgagttttggcgagaatgttaaacagagttttgaaaatcggaaccctaatacttattctgatcagattcaaaacgtcgtccctcacgcgacggtgatgctggagaagaagaagggaaaaaagcgcgggagaaaaccggcgcatggtagagacaagcctttgaaccacgtggaagcagagaggatgagacgtgagaagctaaaccacagattctacgcattacgagcggttgtaccaaacgtatcgaaaatggacaaaacgtcgttgctcgaagacgcggtttgttacataaacgagctgaaatcaaaagctgaaaacgttgaattggagaaacatgcgattgagattcagttcaatgaactcaaggagattgcaggacaacgaaacgcaattcctagcgtttgtaaatacgaggaaaaggcatcagagatgatgaagatcgaagtgaagattatggaaagtgatgatgcaatggttagagttgaatcaaggaaggatcatcatccaggagcgagattgatgaatgctttgatggatttggagttagaagtgaatcatgcgagcatttctgtgatgaacgatcttatgatacaacaagcgaacgtgaagatggggttgagaatctacaagcaggaagagcttagggatttgttgatgtcgaaaattagctgagagtttctgcggtgtgttttgagaaaattaatcatggggtcaaagtgtaattaagttttgttgattttctcataagttaatggccgttttattagattttggataatatacagttctaatcttgtgacccaaaattagggggacttattgcaaatggtcaaccctggaatgaacgagatgaacacaaacacaaatggtgcttgaattctttttttttttgtttcctcttgtttgttcatcttactaacatgaaaaagatgaatatttatattttgcactttcagcccaaatggtaaaaatttgggttgaatatatttttgagaaaaatccaaaaaaagattattgcacgtttaatatccaaacttttttggttggaaggaaaatatacatagtttaattaaaacatataatttaatttctacaattttactcaagatctaataacaaaagcaaaattctagttttactcttaccatctcaattaatttataattgacatggtatatttgatttgaataaaaattattttttgttgataggttgtttttattaaaattattttattttgactaccaaaataaaaattagaagaaaatctttttaaaaaaatcttcaactttccttttttaaaacacaccctttaatagataaaattagggtttttggaatgaaatgttgaagaagatcaaaaaatttagattttttctatcccaatttaagtgggtgagtaagacaatacatttcttgctatccttttgtttttaattttcaaagaagaaatttaaagcatacatgtatcttaggtttaaaactgatcttgttattatatatagtttcaaaatccaaaacacacatcacaagcgagatattcttcattaaaagaaagaacaaataaaatggagagtagaagatcttcctatgcttttgtttcggttttgatccttgtggtgctcttgttttcagggtcaaacttgttgttgcattagaggactatcatcatccacaaacacttaattgaacaactccgtaaggttccaatttgtatcattaatgtgtgatgtgtccaactcctaaactaaagtctcaataaaataatggagttatcttgcttactcgtacatgtatggaataatggtgtagtagtgactgatgagatttacaatgaatcaattctgaaaccaaaaagtgattcagcccaatgatgtgtgttttaaagcccaatgactaatgggcttatttaacccaaccaaataactaatgggctgaattcggatcatttaaacccgacccggtatcatctctatggcgctctctggttaaaacatacaaacttttagggtttcttcaatctctctctccctctttcttcctcttctctcattgaaatcgaacgagg

SEQ ID NO: 2212 - DNA, 3000 bp, Unknown
  misc_feature (1)..( 3000): cDNA_ID_3593307_gDNA_ID_1620503_Annot_ID_158962 3000 nt of promoter + ATG
ttgcatcaacaatcaagcaaaggagaaaataagttgcatcatataagagatgtgtaaaagaatattttttcgatatcacctaccttttcgactcctgaagttgtgcccgctgttccggtaccttatccacctcacccgccgtatagctatatacggagtcagacaagaaaaataaggaacatgattatcaaaaccacacaaacaattcacaaagtgatgctttttgcttatgataatcacacttctaattcgaattcgagcttaacatacatgaaaccacatataatcaatcagtcacgttacctagagggaagagcagattgaggcacgaaaggagtataagtggtttctctttcagcagcagtttgttgagctttctgaaactcttttaaaacagcttgaaagtcccttgcaagcttagcatctgcaatcttcttacttggctacacaattacacaacaatcaaacacacaacaaagagtcgcttaaaaaccaaacaagaagaaaaagattccactttacattgacaccgctttgatgatcagtttcactagcttctttaagtttagctgaagtatccttcacaagctgtccaatatgcaaccttgtcttgtgcctatcacaacaaaatccgaataataatttctaaattcagaatccacaaaaaaaaaaaagcaatcaaaattgaaatcaaaaattcaattttttttatcaaatgaaatttagatttcaatttcaacatacagcttctcccggagctccggtgtatctttgggagtaccaagtgtgttaacgagtcgctgaaacgtggagactccggtattgatctggaatattccagaagcaacggcttgtgtcgaatcttgtcgaccaccattgaatttcctcgttgatcttcctcttcctgattctaaatcttgaaaactcatcttcttcgcgaaacctctttttttcctggaaaaattggatctacaaaaagattgagaaattggttatcggagttttctctaatctctgagaaaaaaaaaacgaaggtcaaggcgtggatcgtggagacagatagacgaagattgaaaagcgttttcgaaaaaatcccaaactgattttaattgagaagaaaaagctgagataaagttgtttcctttttgatccttttatttctatatatttagtaacctctcctcgtttctgtttttcttgccaaattaaacaattggtttggtttattgagattttggtttgggtcagtttgtttttatttttgatttgattcagttttagttaataaacaataatttttagttagtttatatattaatatgattatattttttctcaatatgtgtaaatagttaaaatgtaaagttttaataaaacatttatttggtttggtttagttcagatacaatcaaatcagtttatataagattccactacggtttaaacagttcaatttggttcggtgcccttagtttaactattttaggtgaaagtttaataatgaaaagtaggtctgggcacgaagcgaatattcggaaaaattgtgatatttgttattcgattcgttttaaccgaatacttgattttatgatttgctttgattcgaaactttccggatatccggaatttcgaatatccggatttttttgtgatatttgcggatatccgctttgatacgtataaatattttaaaaaaatatataaactatataaccatatcagatattcaaagtttttatttaacatgctttcaaaataagttctaaataccaaatataacctttgttgttatcaccggtcaacaaaaatgttatcaaactaattccaaaaactaaaactcgatagtttttgatgtcattgatcaaaacataacataaaaaaaaatatcaaacaaacatcttaacataaaaacataaggtagcaacaatacacaaactatttatgatatctatatatagatataactatatattctaatatatatcaaaagatacggatcgaagcggatatttgattttttaaaaaacaatatttgctatttgattcggtttttacgaatactacattttcctatttgctttggtccaaaatcttacggaaattcggatttttcgaatcaaatcaaatcgaataccgaatcgaagcggatcgatcgaatattttgcccagccctaatggaaagtgttaatgtaattactttatcagcatttttttcgcaagatttccaatgatgaggttattaaactttactacatgtgaaaagcagaaacggttttggacacgtggacgacagatagtggttgataatgtgattatgtcacgtcttttgttttgttttaaacgtaagtactatatgattaaaatttaattagaatctttcccgacaaagaaatagctaagcacgacctttttcttccttgaagtcgccggcgagacaaaaaaaaaaaaacataatcccgacggttacacgtaccggagaattgtatttaaattgaatccgctttgtattttcctcacagccaaagatttttccttactaggattttcattttctcttctgttttcgtttcaaattcagaaaatcttccgtttcaatccggtttatatcggtttttagcaatgtcggtgagtactccttcatatccgattaatcgttctcgtctcgtatttgtagaatttcgatcaccagctgcgattagatatgttgaaattggcgtttagaatcactaattttgggttttaccttcttatggattacttgtttgataaatgtgattagtatttatctaattagttaaaactttgtgaatttatttttggacacagcttcttatatgtataacttttaagttaatcagaacttaaccaattcgttaactttaggagtaaggggtttaacacttttgtgctctctgttttcaaattcatgtcagtctgaacattgttaatgacacaactggtaactgttaatagacgtctgaacgtttttcttcattgcag

SEQ ID NO: 2213 - DNA, 3000 bp, Unknown
  misc_feature (1)..( 3000): cDNA_ID_2106377_gDNA_ID_1620503_Annot_ID_158959 3000 nt of promoter + ATG
ttgtgataaatacctttacatctcgtatgagttctattattagagtatgaatgaatcaaagcaacttgaataatgtgaaatgattactattacaacttgtgtttaaacgatacaacaacaggtttaacatttggtttgaaagttggtaatgtacggagaggcttgacttgtctcgtgttgtgttcatcttttagcaagaaagctctactgctccatggtgacttttcccggaacaaaagagctgtttattcccctaagttcaaaattaataatgtcccttaatacttgtagtcgctaggcatcaggcatgtatctctgtaccaatctgtatctgtaagagcttcaaactatctgaaaactcaagacgaatattgttgagtcgagctgcatgttacagattacaacatatctaatctagctctctctagcatagatttaaatagtaaagtcaagtcctactaattatctaaatatgtcaaatatttctcaaaaataaaccattccctaagagacctgattaataattttcaaaaaatttcagtaagaatcaacataaaattatacaataaatagtttcccttgtatagatcaaagagatgacgactcagtagttaattatcgcagtgggtatgttcactatcaattcatagtgttccgtgattggagggtttctaagtgatatagacttgattaacgcctaaatcctgaaaatatgaaatcgataattactctgattgattggtacgtttactgtttatcaccgaaaaatctctcaaactttattcttcgtctaagactttaattttgaccgccacatataattcaaataaaatggtacaattattagaacaaaagttcaaatattcaagaactttacggtaaaactacagaacatagacaagatgattaccctaagaccaatggttttaataaccactgtccgaaagacaaaacaaaatgaagacgattcttctataaaatatcaaatacaagaagaaaaaaataactcaaatataaatcaatatgaatttaaaagaatcaactcaaaacctgaatcaaagcactggaccaaatcagaaagaaagcaaaaaactacaaaacttggttttatttctgtttgcttattcaaatggaacacaaaaatcaaaattcgaagaaaacatcttatagaacacaaaccatatacataactagatatttcatatttagttgtagatgcaattgagttaccatatgcttctggtcatgcttgactccttgtacgccaccggcagccgattttaaaaccaaaatcggtatccactcgtggcatacagggagccaggcataacgacaaactattatatgtatatattgttgtataccaaacctctacgcatgaacatatctttatacgtggatcttggcttgaatcgaatcagaactttttttaactgttgggaagaggaaatgaagtagtcagagagaaatgttgaagagttttggttgaagaggaatatgtggtacaaatatataaaggggaaagagagaagagaactaattatgttcttgccaaaaaaatatattcaaaagcatgactaagttaggttttgatttttaaaatctttaatgtgaagatagatgaataaaattgttaacaaattaaaggacccatttactcactttccttaaaggtttctcctttttccacatattttatttatctattgagagttaaatcatgcaaagaattttgctttttaaagcacataatagaaaaagacaatggtgatgcatattgtattatttcttcaatattcaagttctaagatattataaacttgcttaaactccaatatatgtacattgttattgtaaggtggaaacaaaaataaggattcttcttgtcaaaggtaataaagattacatagcgtgcaaacctgctgagttacttttaattaaatagttatattggagagttttttataaagatttttggtatcatacaaaggaaaatttataaaaaagaaagagtgaatgggccattgatcaatcatcttcatcagcataaaggacctacattttcatcccaatccagaactttagcgttggacaaatcaaattgatatcccattaggtcttgctttgtttttgtttcttttttgttggtttatgtatgcgtttgtattagtatttacaagttaagataatgtgttcattgtcaaattgtaaaagggttttatacatgatatcaatgcaaatacatatatttggggtttgaaataaccaaaatcttaaatcttcataacttgggaaataatgtgaataagcatttctttacaaatgaacattgtacttgtagacacactatgaacatattcatgagcgtgaacaaaaagtgagtacatatatgttttataacgaagagaattcaaattcaaagactctctaaagcttaaaattcgattcttcttttgcaaaaatagattttgtatgcttttttcatcatagctctacatcggtcgtgggctctttcactttcacttttcattcttttataagtgaagacactttttctttagtgtcattcttagtattattttctcttttctttttattcattttccctttcgtttgtttttttctttgataatggttttaaaaatttagtccagaccaaatatggcctagaattagagaatcttgttaggatgaagttttattttcttctttggtcttacaaaaactgaaacaagataaacgacgtcgtattacacacaaacaaacgaaaactaaacgacgtcgttaaatattaaaaaaaaacggaaacgagatttactagtttggattttaatgggctcaacaggcccatactaaaccagtatgggcttctttcgtgctgcaactcatccagatgatctccggcgacgagtaccttcgccggcaataatggtctctgtgtagatagatcgtgaagaagattagagaatcgaagaactcgtatcagataagctaaaatca

SEQ ID NO: 2214 - DNA, 3000 bp, Unknown
  misc_feature (1)..( 3000): cDNA_ID_2151976_gDNA_ID_1620503_Annot_ID_158960 3000 nt of promoter + ATG
agcagctttactcactctgttaaacgcacccgtaacccacgtggcaccggttaaaacataccggtttttcattatagcagaaccagcattgctcactgtctgctcagcagcagctattgctgattttgttttctctgtgacttgaaacttctgatcaacttctttaactttttcgctcacaactgtagtcccggtgttgattttctccgtgaatccgattcttttgtcgaaagatgtaactctagctgaagctgttgatgtcaactgatgcttctcatcaagactcttcgctttagctatagcgtctttacctaaaacaaacccttttgaaatcataccacttacaacatcttcagcttttctaaataccgatacatcttctcgcgtaggagatgatgatttattgctctctttcaatgattcctaaggagacaaaatgttatgattacacacagtgattcttaaagagagttttgaggttaaagaaatggtttataaggagcttacaatggaagctaaagcatcaggaggtagttggtaatctggtgacattgtaactgtgaccgatgaatcaacaatcgtcgatccctgaaacaaaatagacattaaaacaaagcattgcaatatgactcattgaattaaggttaagaaaaagtgaatttacgtacggtgaggagaactgcggtttcagctccttgtaaatccttgaatgtgacatatgctaatttagaaccatcattctcgctgtagaaaccaactcggaaagttttaggaatcggtaagaacataattcagatgaaaatgtaagtcgaaaaaactgacctttgagtctcgaggtaagcaatatcgccggaaaaagagaagaactccttgagatctctttctgttgcttcaagagaaacgttgctaactttgacagttaccatctgcaatgaagaaaaacgttcagacgtctattaacagttaccagttgtgtcattaacaatgttcagactgacatgaatttgaaaacagagagcacaaaagtgttaaaccccttactcctaaagttaacgaattggttaagttctgattaacttaaaagttatacatataagaagctgtgtccaaaaataaattcacaaagttttaactaattagataaatactaatcacatttatcaaacaagtaatccataagaaggtaaaacccaaaattagtgattctaaacgccaatttcaacatatctaatcgcagctggtgatcgaaattctacaaatacgagacgagaacgattaatcggatatgaaggagtactcaccgacattgctaaaaaccgatataaaccggattgaaacggaagattttctgaatttgaaacgaaaacagaagagaaaatgaaaatcctagtaaggaaaaatctttggctgtgaggaaaatacaaagcggattcaatttaaatacaattctccggtacgtgtaaccgtcgggattatgtttttttttttttgtctcgccggcgacttcaaggaagaaaaaggtcgtgcttagctatttctttgtcgggaaagattctaattaaattttaatcatatagtacttacgtttaaaacaaaacaaaagacgtgacataatcacattatcaaccactatctgtcgtccacgtgtccaaaaccgtttctgcttttcacatgtagtaaagtttaataacctcatcattggaaatcttgcgaaaaaaatgctgataaagtaattacattaacactttccattagggctgggcaaaatattcgatcgatccgcttcgattcggtattcgatttgatttgattcgaaaaatccgaatttccgtaagattttggaccaaagcaaataggaaaatgtagtattcgtaaaaaccgaatcaaatagcaaatattgttttttaaaaaatcaaatatccgcttcgatccgtatcttttgatatatattagaatatatagttatatctatatatagatatcataaatagtttgtgtattgttgctaccttatgtttttatgttaagatgtttgtttgatatttttttttatgttatgttttgatcaatgacatcaaaaactatcgagttttagtttttggaattagtttgataacatttttgttgaccggtgataacaacaaaggttatatttggtatttagaacttattttgaaagcatgttaaataaaaactttgaatatctgatatggttatatagtttatatatttttttaaaatatttatacgtatcaaagcggatatccgcaaatatcacaaaaaaatccggatattcgaaattccggatatccggaaagtttcgaatcaaagcaaatcataaaatcaagtattcggttaaaacgaatcgaataacaaatatcacaatttttccgaatattcgcttcgtgcccagacctacttttcattattaaactttcacctaaaatagttaaactaagggcaccgaaccaaattgaactgtttaaaccgtagtggaatcttatataaactgatttgattgtatctgaactaaaccaaaccaaataaatgttttattaaaactttacattttaactatttacacatattgagaaaaaatataatcatattaatatataaactaactaaaaattattgtttattaactaaaactgaatcaaatcaaaaataaaaacaaactgacccaaaccaaaatctcaataaaccaaaccaattgtttaatttggcaagaaaaacagaaacgaggagaggttactaaatatatagaaataaaaggatcaaaaaggaaacaactttatctcagctttttcttctcaattaaaatcagtttgggattttttcgaaaacgcttttcaatcttcgtctatctgtctccacgatccacgccttgaccttcgttttttttttctcagagattagagaaaactccgataaccaatttctcaatctttttgtagatccaatttttccaggaaaaaaagaggtttcgcgaagaagatg

SEQ ID NO: 2215 - DNA, 3000 bp, Unknown
  misc_feature (1)..( 3000): cDNA_ID_2152054_gDNA_ID_1620504_Annot_ID_158981 3000 nt of promoter + ATG
atgatgatcatcaattgagttaaagtagttagctttgccaccaaaagaatctgatatcgtaaggcatgaaaactaaactgataatagctctgccttaggttgcatattatctaattcaaaaccaagaacaacaacattcaatcaccaactaactaaacaagtgttagataaaaatggattgcagcatgacaagtgaaaaccaaaccaattgttgcagtttcagtgaacctttccttgtaagtagttttgccacaactgagttaaagttgttagctttccactcaaagaatctatcttaaattcctaacacttggttcaaacaaccaataacacaagattgcaattatcaactaaactaaaacaagtgttaaatagaaatgaactgattctcaaaattaggaaccttttctcgtgtggaaaccagtaggtttgcagtttttgcccttgtagaagtctctaggagctcgttttggggagaggatatcaagagaagaagctctctttcttctgaatgatcttccaatccccattaacaatcctcctatcgtcgtcattctccaacaatgtattagactgatatcagtcgttgatcttaaaaaaaaaaaggacctgatagaagagtgcaaatctcagagaggtcaaattaggggtttttgttcaagtgaggttgtaggttgaagacactgtaaacgatgtcgtatagggggtaaaattcggaaaattgttgttttcaggaaactatctgactctaaacaaatgaaactgaaaatataggggtcatatttacaaattagttatcttcgatttacgcacgtattatatgtttgttgtagatgtttattttctaagtattgcataacgcataatgttttcttgtatgattgtatcaagctattctactatgtgaacatccaattatcaagtgaatatatattccaccgcataaacatgttatcaattattttgtatatcgtttcgtgaaaatatcaaaccaaatctaccatttttagaatagcacaaaaaaggattaaggataatagaagaacagagtcctaacttaaagcttagtgaggaagcttcacactcgtattatcgtcaataaaacaaagacgagatacaaatgactcttcacactactattattgtttatcttgtgatgattcctttcctatcaaaatgtctgcagcaacttcactctcttgttgacttttatcttgtgatgattccttcctttccactatatcggctgcagtttcccactcctctaggcctttatcgtctgttgcttccataagtttccacacttccattatatgtccaccttgctttgccttgagtttgagcagtgcagctacccactcctctcgacctttaccagctaaaaacgaccctaacagtctaaggcccaaaggaagaaagcctgcgagatggacagcacgaactgcgagctcttcgaaatcagaaggtggataaggctgcttgaaagcaaaatgagagaagacttgaagagcttcatcatatcttaaagatctgacttcgtacacatccatcactccggcgtcaacaagcaaattcttgttctggctaataagaatgactctgcttcctggagcaaaccagttagcatattcaatgatccacttcccttgttccatgttgttcacatcatcagcgataaggagaattttccggtgtttacgccttgcttcggtaatttcatgtccatcgtgatatgagcttattattaccgttggatcttcttctccttcaaactttagaagcttgtctttcatgttttcaacattatctaggaaaacatgtgtctgaaagtttacaaagatctctgcataaatgtaccttgcaagtgttgtcttcccaacaccagcactaccccaaatgccaattgtacgaacctctttgttaacttctaaagccaacaagtcataaaccactttcatgtgacgatccattgcaacaagggcattcgaatcgtttgatccggagtagaacacgacaagagatatgtcacgagcaatttggttgagtagatctgactgatccattcctgcaagattttgagataatggatactcagcggcaaggttggtcaatttggtaagtgcagttctccaacttggcgccttctccggatgttgtctgcatatttcttccacattaaaagataaatctgtaagaaaaatgggtatgaccatgagtgaacctttttcctgaaactcgagtatcactaagagctcttctaggaagccaacggagcaaggtttcgtcgtagaggtcataacaaccgcgactctcgactcttccaaagccttgagtgtccgttgaccaattggtccgaatctcttctccaagcatctgtaggataaaaaagttctaatgccatttcgaatcaaaatattttgaaaatatccatggctagtctggcagcagaaactcaggaagacatccacctcccttccaagcaacaaagaagcagcagaagatgaagaagcagaagacattgctttggttaaaaacactaattctgcagctggactcgaacaacgaaaagctacacatgtgaaacagctttacaacaaacacaccacttataaaaaaaacactagtagctaatgtgaaaacaaacaagacaaaaaagacaaaaactttacgtagaaatatataaataaacagagcaatgatagatttcaaagtatttaaaagttcttaatagatatctatcaaaatgacagcatacaaagtagcatttggtttattctttatatttttttgccgaacaaaatcaaagattcactgctccaagacatgatccacttgcttgatagattaatttcttatattttccttgtttatgcatcaaaccaacattaaagaaacgacatctctcttatcttttgatctttcaggattcaaatgatcatcttgaaacagagcgttgaaacagagtatctttgagcctcttctaagccaaggtctttgaca

SEQ ID NO: 2216 - DNA, 3000 bp, Unknown
  misc_feature (1)..( 3000): cDNA_ID_2152149_gDNA_ID_1620505_Annot_ID_158985 3000 nt of promoter + ATG
accagggaggagctgtggatgtaaacgatgaccttgcgagagagacggcgttctacactcaagcgcttgaagggacaagagaagcgtttggtaaactcaatgaaatgggtgtgaattttctcaggcctgcgaattactatgcggagatggtgaaatcggatgttcatatggagaaagtgaagtctcggcttttgcatgagaagaaacagattgaggagtctgaagagaggaggaaggctagggataataagagaatggctaaggaagtacagtctcagaagatgaaggaacgtgcgaaggagaagaaggataacattgagtctgtgaagaagtggaggaaacagaggcagcagagtgggtttagtgataaagctggtgagcctgaacttgatttcgaaagtggaaagagtttccagagaggaggaggtaagaaaagaccaggtgtgtctcccggagatcgatcaggaggtaaaggaaggcctacttcgaggatgggcaacaagaagagggagtttcgggattccaagtttggtcatggtggtaggaagggtttgagcaagcagaacacagcagagacgacaaacgatttcaaaggcggtttccgtggtggaaaagctagcggaaacaagaggcagaagaggtaaaaggtttgattatctaaacccacttcaaaactactataaactatttgtcttctttgttttttttaagaacatgtattttgttttggaaaccctgtggtaagggtcttagaaccaatacaattttgtactagtgattacttgaattaacaaagtcccttgtttgaagtctcatagttaacacttgaagttgaaactttatatgatagaaatacaacaaaacaaagcttagagcatacaaaaaaaaaatcctgaaaccagtagcaaccctaggaagttttattctggaactggaaccagacttggaacatatgcataaccgcaaacaaaaggcctattatcactacacaaatcacatcgtcctgcatcaatttgtttcttcactattccatctttactaatcatgcaaacgctaacgcaaacatcatcatcggtttcctcttcggtctcttgctcacaccataccatgatattatcgttcttgtcaatgaaataacttggatgagtgagatgttgatcagtatgtaatgtcgggagatcagggctagtcacgtctacgtacttggtccatgagactacctcatcgctcaatttgtttgtgatccaaacttcgatcttcattgtttctccactttgatgtaacaaagaaagcctatctcctcttaaactcgataaggctgccgtgtctaatacattacattcgaatggaagattgcaaacgattttgaatgtctctgtggagaaatcaaaactctggatgaaaatttcgggtctattattccaatgtgcaatccaatacatgtttcctttcaccgacacacctttacaaggtggatctatagaccaatccaaacgagtatcatcaacaattctccatgaatcagatttgaaatcatatatctgaatcttcggttcataagaccccgcgatttcactctcgtcttcaatctctccatcgaaaatccttagaagtttgtactcatcacgacatacattgtcatatccaaaaccatagaaatcattactcgaataaaaatccattggttcgatccatttgactcgactcaaaaacgggttccaaaccgcgagtttgtagcttcttgatcgttcgttcttgcatctacataacaataatccatcacaatggaccatagtggagatttgagctacattgtcgaactcttgcgggattggtgaagatgaacgagctcctttcactggatcgatgatctgaacaatacgatcgattcttatgaaacgttcttgttcttgaaaaagatccaagtatttgtagatgaatctcttgtccttcaagagagcaaaccattgtttacacgtcaatttgaattgcgtcaaatattcgactggaatcctacaacatatttcttctattatatcaataggaagcaacgaacgttcacatgaagccatgcaaaaacaaattgagaaaaaaaatcagaaaatttatgacaagtggtcttgcttcttatactacgtcgtgaatggatggtaataaacaattaaatgttacctctagttttttttttttgagagaatggtttttatccgtatatggcttattacaagtttcctcctttttcgagtttggtttgaggtctatattgaagatgagatactaaaaattgaggtaaattctttagtgtgaaggaaaattagtaaatacgatacgtttggaattgtttactactaaaaaaaaaattgttttagaccaagccagtccgacaaaaaggcgtgtgaatcataagaagtatcacatgatgctagacataaaagatttttcaaacatgacaaaacaaattgtgagtgtcttagtcatgccatttgaagtagaacgaaacttagtgatgagacacgtaacatcagtgagaatcaagatctaacttcggacttatcgtacgtaccacgtccacctaagtgttatccatatctactacatgtctatcttcattcaattttttttttgcattaacttgtaaacatagtgcataataattagaatcaagatttgaatccaattcgcttactaaatcctaaatgttaaaagcatacatgtttttcaaatcctacttttaggtgctaagttttttttctaaggtagttagagattgttagattttatatcattgaactgatcatcagtctctatactaacttctagatctcattgaatgtttactcaattttttttaattttttgtttggataatcgtctgctcgtggttttgatgcgtacgaacactcgtcaccatgcatgtcaagctctccttcctatataaactaaaaccacccattattgtcctcaaaaacaaacacatcaacaaaacaacaagaaaaaatg

SEQ ID NO: 2217 - DNA, 3000 bp, Unknown
  misc_feature (1)..( 3000): cDNA_ID_2152195_gDNA_ID_1620505_Annot_ID_158999 3000 nt of promoter + ATG
attcaggacaaattatagaagtggttccaaagtctttagcttcagtagacttgactccaataagccccaagaagaaaaggcaagtttgtcccgaaacttgcagaaacagatttatggtaaatcttttttctaacaatctgttggcatttgaaacatgcaggcgtaagtccgaacaatcaggagaaggcgactcgtcatgtaaacggtgcaactgcaaaaaatccaagtgtttgaagctgtaagttgaatacaccaatctttggcttgctttgaagtagttttttgttgagtctcttgtactgtgtttccctctgcagttactgtgaatgctttgctgctggattttattgcatagagccatgttcatgtataaattgcttcaacaaacctatccataaagatgttgtcctggctactcgcaaacagattgaatcccgcaatccacttgcatttgctcctaaagtcatcagaaactcagattccatcattgaagttggtgtaagtgttctcaatatttccttttacttatcatcctcaatacatttatctcattgaaaaggctataaaattctgcattggttcacaggaggatgcaagtaaaactccagcttcagcgcgacacaaacgaggctgtaactgcaagaaatcaaactgtctgaagaaatactgtgaatgctatcaggtatttccattaaactccatacacatcagtgtaagattcccttctgtggattggttctgattcattgatcgtgtagggcggagttggttgttctataaactgtagatgtgaaggatgtaaaaatgcatttggcagaaaagatggttagcttttacttctccactttatcataaacacacaagtctcttgatcttttatttgacaagagtacacaatttcttgcagggtctttgttcgaacaagatgaggagaatgaaacatctggcacacccggaacaaagaaaacacaacagaatgtcgagttgttcaaacctgcagctccaccttcaacaccaattccatttaggtaaagaaataatctcaaatacaatcaaatatgtgtccatttacacttctcctgattaactttattaacctttgttttcagacaaccactggcgcaacttccaatctcatccaacaacagactgctacctccacagtctcattttcatcatggagctattggatcatcttcctcagggatatacaacatcagaaaaccagacatgagtttgttgtctcattcaagaatcgagacaatcacagaggatattgatgatatgtctgagaatctaatccattctccaataactactctatctcccaacagcaaaagggtttcgttgtctcatcttgattcaccagagtcgactccatggagaagaaatggtggggggaggaatctgatacgttcgttcccaacgtttccttctctcactccacaccattaaaattctttgaatgtcaacttctagttggtagttttaacttacacagacaacatacgcaaacatttacaagtttagtagcagtattgcgttagtttttacaatggttgtgtaataaaaatgttaagtcatttatcaatatcttgacaacattcctcgtctaatatcacaaatgtaaccttatttattcaacaattttcatgtaaaaacaatcttcacaattaataatttattgactaactaataataatcttgttcaaagaggatgacaaaagagaaagaaaaccaaaaaacaagctggtcgactaattaagttgcactagacttggaacataagaccacacaattgggtaacaccttctgtctgattctccaagatccacttctttcatggatccatccactccaatgatgtaagctatgtagcgctgtattctgtagcctttatcaaaaacaacagcgactttcttctcctcgtcaatgaagaaactccccaaacaaaactgaaactgagggccaatgagttttcttatactcactgataagaacaccttgctgttccaagacaccgcgttgggctcaatcttagacgtgacccagatctccatcattaatgtatcccacggctgatataaaacagcaagctgctcgtctctaacattggatacactcaaagcatcttcagattcaacaaactgaaacggaagaggcaaaagtggtccaaatgtctctcttgtgaaatcaaaagagagtaagaaaaactcttcgtttgtttcacttgtttcgtaatacttctcttcagcaacccagaaggcatttcccttgagagacacgccactattaatagtccctaattgccagtctggagtgacatgaaaaaccctccatgaattagagttaaaatcgtagattatgaactcatgaaaatggggtctcaaacaagtaatacacctcaagattttgtgggatttgctgctcttgtcgtatccgagagcataagaatagctgtcgaatttgttgaactgatgtgtgggctcgattgaccgggtatgcccccaatacgggttccaaaccacgagcctagtcttggcttgggtgatgctgatgcataacaataaaccgtcgcagtgaaagacttgagatatatcatcaacttcgtcgcctaagctaataactttagcttcacgttttatacatgatgatgatgatgatgatgatgattcaacgacgttgttatcaagattgactctcatcaaataaaccctaaaattcatcatcatgaccaccataaagtaaagagtaaagcattaattgggccaaaaatgtaacgaatgggcctgagtgttataggtccaggtaagggaaagatgacgtcacttagtggatggactaaaagagtgatatgatttggacttcatagttcacactgtttcgcaccggcgcggacaaagttttttttttgttcgaaatccgacaacaaccctagattataaacaaaataaaccagtgtctgcatagaggcaatgtagatgtgatttttgctggaaa

SEQ ID NO: 2218 - DNA, 2614 bp, Unknown
  misc_feature (1)..( 2614): cDNA_ID_1030508_gDNA_ID_1620505_Annot_ID_159007 3000 nt of promoter + ATG
catacataaggggaatggaaacgaaccatctttggctaagtcatgctcattaggaatatgaccaacatgaatataaaaggagacagtttcaggagtagaataaggattgtggaaacaaaatttgtacattccactttttggagccttaaactcaaacttatctccagatgttccctttaaagtctgtacaatgttcccagctggtgacgtcacctacacaaacacaatccaatgaatcaatcaacacattaaccctaaccaaaatccaatccaatccaatcaaagatagcaaatttccacaatcccaaccaaaccctaaattgtcacatccttacaaagatcagatcaggtcaaaattaagcatgagaaacaccaatttcacgataaatcaaacattgggattatcgaaggaaacgtatcaaagttaagaacttttggggtaaaaaggtaaattgaaagatcgctaaccgtgaaatccaaaccaggatgatcggatccccagaagatatcatgatcgacgacgacgaagttaccggaaacagtgtcgccttcgtaaaggacgtactcttggacacattcttcgtcgttcaccgttacagagagagatgagatttgattgattgaattcaatagaattagacctatcaatacaaagacatggatcttcgcttgtcgtctctccatctttttttttagatcttcttcgatcaaaaaaattcagtttgttttctcgagagaattcgccgagtagaggaagaagaagaagacaaagaggattttattgcgacttagattaccaaaccggaaattaaaaccggtttatgacgacacggggagattttattggtcaacggcttttggtcattaaagagagttagagaaaaatattactaattttaatgtaagtaaaatacgatctaaattatgattaaattgataaaattttacttcaaaaagtgtttcagtgatgtttgtttttacaaaaaatttttgatttttgtatatatattggttaatgacttaatgtacgttttggaagttttttttatctacgccattgatatgtgttaaaaagaattgactgttatgtatgcataataatgtcaaggtagtttttatttatttggtcaataatgtcaaagtacttatattctaagaaatcattatttccgggaacaaaatctaaagaatcatatgttttcttctttgtgttaccatgtaaaagtgaatccttccaaatttccttaggttgagaatgacaattcttctttcatatgttatcaaagactaaaatgatcagaatgtcaatttgcagatttggtcaacactacattagaaacgaacatatatgagcgaaagacatgatttggttagggaagctagagttgatgggcctaatgagccctatacggcccgttatgagatacgtatgactgtaagagtaaatagtcttttttttcttaacagtaaataatctttatctccatttaattgtaaagttattgacattttgaaacgaccgtaaatattaccaaaaaactgacggagttaggatcggccacgtagaaagggacaaagagagaacagtcacggactcggccagactaagtatgggcctgtctgaatccaaactcagctaagttccaaaagcataaagagagatgtgtaatgaaatgaacgtattctagaaacgaaagcaatgttatgctttgtttttgagccacatgtttttgggagatggagagaatcttttttacgtttttaacctaacccacttggcacttggccaaaaaagtgagaagaaactgtggcgaatgagtaggccacgccatggactttgttccttgtccttcaaaagttaaatttatgttatgcgtggggacaatctaagcaacgtggttcctttaaatatcgcagcttcctcttttacacttttggagcctacgtgttttgttttggaccggccaaatacacgagtcagtcagtttagaaataatttggatgtccaaaaatcttggagatccaaataaaataattagcatgttttagttcataagaatatgaaatgtagataaactgtccatattaatttttccatagaattggctttttatcgaggtgatgtacttaatgactttgttgattactactcgtataacaataaagaatatgatactatgtgagacttataatgaatttggtgtgtgttaattaatccagttgaaacagtttaataacaaatcagaataaaaattgtagtaagaaaatttgaacgctgatccttcaacctagatagtgaacctttcaaatactatatgattcacgtgtaatgtttttgaccgttggttatttttgtgtgaactatattaacttatcaatatcgaaaggctaaataagtaaataactaaaagaaagttcaggaaacaactcgacctaatgacctatcatttctgatcacccgtcctataaatacatacgtaagatcattcgttactcatatcaagcttctacacacgatctagcttaaagttctgtaacctaagcgataatcacttagctactccaagtttcttcttaatttctctcacactagtagttctaagctttagaaatg

SEQ ID NO: 2219 - DNA, 3000 bp, Unknown
  misc_feature (1)..( 3000): cDNA_ID_3066549_gDNA_ID_1620505_Annot_ID_159000 3000 nt of promoter + ATG
cattgttttaagcacatatatgacaagttattatatttagatattaataatgttcagctatgtcgttaaaaagaaaattccgagtttgtcagtaagaagaatgataagtaagataaaacaatatcatgcaaaagaagcagaaaacgaaccataaacacctaataataatcattgatgttctgaaatattataggtttgaattcttgtatctattttgtaacgaattgacatgtaatttattttcttttctaagaagcacgatatgtgtataatataagaaagtttcttaagaaaccgggttgcaccgttgcatggaggcgaacaacacacacagcaaaacatgatggaccggtatatatatcattatgcgataaaagttcacttcactttgtagtaattgggaaaataagataaccatttgcttgtttgatcggctactccttcgctaatggaattattaagaattagatcaaaagctcatacacgtgaacaacacgaactatagagttcttcaacatgtctctttttataaagtggcgtgatgttaactatttattaaaaaatagtatacgtaatcattaatgaaagagatgagaaataattataacatgtagaaaaatggcattgtaagtttatagttggcatgttagtttgtgaagagatgtcggtcacatatttttgataaatttcttcacttcttttattttcttattaacttctcaattttttttctatacgtactaattttaaatttaaatagtacgtcatagttaacaaagatatttcaataaataagaaatgtaattaatatttttataaagggttgctttccataattatcagacatgtggacattataaagaaatatcgctcaaaatttctttaacgaaaaataatttatttattgtatgcatactaattatgctatttcagaacatatgacatggggtcacaagctatagaatgattgtactctttctaaacttataaaataacaaataatatttttagtataaatctttttcatggatccaatcaagacatgttctagtaaaggttatagaagactttattttacacttttaactccgataagaggataaataaacatttaagaaaattatggtatcaaataaaaaccactaaactaatcgtctttcacaacatatgtaatcttttttttagttgtgtgtgtgtaatgtgttctattctccttaagtatgagcaattaaagcaacatctatctaactactaaaagtttacacgacatgctaaacaagaaaccttcctaaaactatagcaacaacatttttcttaaatttatggagattttttttcatttttctgacctacggtcaaattgagcagaagaagacaggttaaaggacctaccttttgtaaaacccaagaaagaaaaaaacacattttgagcaaaggacagatttgtcatttttcgttcatgattcagatctaatttttcaacctacattaatgtcacctaatctttgcacaaatcactagacacacacaaactaatccgctattacaaaagccacaaaagaaaataaaaatccgattcttataaagaaaatagttttctgatatctaatgtaagattattattttcaaactacaagttaatgaaatttgaataatgataactacaagttaacaaccttgacacaatccccaaatttccgattaagattacgtaatatttttaaaaactgtttaagaaaataatcgagttttacgagggatttgcacacaacgaccgtatcattttcccttaattgcattgattacaccaatttaaaataaataaaataaaattacacgttaaaataagtttctacccctaattaacttttgttaatttagtactactactctattcaacgtttcaatttccaaaacaaatctcattattattaaggtaaaaaataaacccaaaataaaaggcaaaataacagttttttacttttttatatgaaaaccaaaaaagcaaaataaaaatttactgttgtgcgtcaaatcattctcatcttttagttttgtcgcacaaaaaagagttgcaaatctaaaagaatataattgcagacacaaagagagagaaagagagagagctgttggagtgtgaactagagaagacaatgagatgactttcattatcattttgcatccatttctcagtttcatcggtatgtttccttctctaatgatctctctcggctctcacatttttcttatgatatgatttaatcgttcttcttctatccattttggttttagtatttgttctgacacttcacttgtaagacatttggatccaatctactcaacgagtcgtttttgtgtctgtctctcattttgctttaggaaagactcaatcttttgagtttctgtagctaacccatttgctcatttctggtaaatttgatctgataaaaaactcgacatgttctgcatttttttgtccctcttgatcttgttggagttaaagtttcactctttctataagtagtgtgtttgtacatttgttccgcaatggtttgctgattagaaaatctgcctgcagtttcctcactaaaccaaaaaagtcttgatttttttccatgttgtgtaatctcttgatttacaagtatttggactaatacttctctgttaagagattctttgtctctgttctgttggaaagtaattttggtttgctttctctgtagattactttccagttagacctaaatccggatatttgtattgctctaatgattccacttaacttgagtataaaattttgctttaagcctaatcaatttaattgcttattgtgtgacattgtttcagttttgtaggtgaaaagcctgacacatagagaacaaagatgtcttcagtttgagttagtagagattgattctggcctggaatccttatcttggacttgaccacccttgggtgaagtctagaccactctttgtgcttctagcagccggtgtgatg

SEQ ID NO: 2220 - DNA, 3000 bp, Unknown
  misc_feature (1)..( 3000): cDNA_ID_2152187_gDNA_ID_1620505_Annot_ID_158997 3000 nt of promoter + ATG
tgtgaagagaaatagacagacaaataatgtatatacaataagatgaaagaaatgcatttgtcgtctcatacttgtcccaagtccgattattatggttcaaaaaaagccaaataacaagagtgcaaatttattttgaaaatccaaacaatcgtcgtttgttctgtcttttgttttttaacgtttgttctgagttgtacactttctccttgaaatattcggtgttgacatccaacaaaatgcttagattcgaatatgaattatatatggagatggagaataattataaactaaaactatcctaccaaataaacattttggatcaattagttatcccaaacattttatcccatgggatcacacattttagatttctacatcattccctaaaaaatgtttaacaaattcaaaaattagaaagcaacaatcatttaaagtgcttgtatataatttagttgattttactaaagtcgtgcaattgattctcattacaaacaagttataagctagtcttgattttgacacaaagagaaagtgattattcagaaaaaatatatattatgtgggtagatgtgactgaaggatcctacattggatgattaatttacataaaatctagatataactctatggacttaaaaataataatggattctatgtataatggatgacaaagaacaaaaacgaaggagattctatagtacaaatacaaaggccaaatgatgactttggtaagatggcttttcttgtggccatttgtagtaagcaagatgatttttaatttacttaattaaaaatgtaacagcaattattttcttaatattccgttaataaacaacctgacatgcacaaacagttcatggaacagcttttgaatatcccaatacattaacacctgatttagtacattatacactgaaaattatatttaaagactgaccaaatatataatacatagatatcaatcaaaatgttatagaagatgcttctttttcttattttttgaagaaaaaaaaatgcattgttgtatgttttttatgtcacgtgatgtgtcatgtggcacgtgacagtgaagtagcagcatgaatgaagaatggtcgacattatgattatcgcatggagccacttttgccagaagaaatgttttcagctctatccatatcaatactcgaagacatatttactctatactttaataagtttttatttgttacaatcacttgactagtagttttagttaagttaagctccaaaaacttcttgaaaagctccggtagaaggatcatgccttcggtttcttaagccgtgatttgatggctaattgtatacatatcgtcacacataattcgtattttctttagccgaaaatcccccgcaacattactagaaaataaaatgtttaagtagatataatttcatttttcatcattcaaaagagaattttcgttccatatttccctttctatatctcacgattcacgtaccgatgaaaaggaccgttgctacgaacatttggagcattcgctttatggcgtcacgggaaatacattttttggctaggagaaataaatagctaaatttattttatttcagaaggtagctaatatattaaaacaacaacatatgtcacaaaaaaatattcatgcaattttttttcacagttcaccatgggtgcgtaataactgtattcacaatccatcatcatgtacagttatctttagaggtgacattaacttttcaacaactatttaacaagtagacgtacatacgtacgtgaaaacaatttcgttgcgagttgttagttacaacatacttggacgttgagaccattcacagtaactatatttcacatttccacttttacatgtgagtgtgtaacattgaggccattcacggtgactgtatttcttcaagttaaataaagttttgtttttgagctaaaccggttaaaaaatacacataccatattcaaatctttataaacttatataatccaactatttgcaaccatgtacacactattgtaacattctttggtaatgtcgatatactttaacgattcttataatatgggagatattttatgataatgccataaaattatcataaaaggcttgaatatctctgaacgttacatttaaaaagaaatattggaattatgattatgactataacttcgaataattgaccaattaatttcaatttaagtgtcatgatgattacacataagtgctttctcgtgattagcaatattcagccagcaatatattttattaattccaaatctccatgttaaacaaaagccttgtaagttgtaatctcataacgtgtgtttctttttcattccgttctagaatcttctttaatccaacacttaatactagtacttaattatcatgtattctcacgagataattacatttatcgagcacaaaaataagtttaatttatcttaacgaatcactgttaatacggtcaaataattataggtatatcaacaatgacaagtagtagtcaacagagtcagtaaaaaccacagagaaaagataggaatttatttctcttttttgttgttcatcatctttatatatacaaaacaaaacagaaggtgcagcgaaaaggaactgttgattattgcagttacttaaattttattttgcataaccaaagcaagaaaaaaaaggagcaaagattaaggtgatgtccgttactttattaaaagcaaaatcgatacgatatttatttttgtacagagagacaacagcgagtgaattgattctcaaagagacgtgtacgtagaggtgtatatatagacaacataaaagagaaagagagagacaaagacaagtgttggggtcaccttttgtggtctctgttggatttggtttggactatcttcacgagattatcctcatcttcccgcttcttctctcctttgaatctttcttcgttgttctttcactttcttaaagaggatgtgagattgtttttggtagttagaaa

SEQ ID NO: 2221 - DNA, 3000 bp, Unknown
  misc_feature (1)..( 3000): cDNA_ID_2990229_gDNA_ID_1620505_Annot_ID_158989 3000 nt of promoter + ATG
ttgtcccttcaagcgcttgagtgtagaacgccgtctctctcgcaaggtcatcgtttacatccacagctcctccctggtcaatctcaacagtaagcttatgagtccaatcaacatcttcaggccagctaatatcttgaagcttatcaagcaacccatctctgttgtatatcgcagtcttcgtaggctcagccaatttctcggtgatctcgttctctgtatccgaatccgaaagagactccgcttcggagtcagtagcatcatcctcatcaatcatgttcatctcatcatctgatactatatcctcttccaatgacatctactcaaaattcgataacaacaaacaaaattagattcagaatcaaaaaagttcagacttttatacctttgggtaaaaaaaaaacttggcgaatcacagaaactagggtttataagtcaccaacgcaaagagagattccataactggttccgttaccttctatatgacaataaagttcgatactttatctaaggacttaagattataaccatgaacaaaattagggtttatcattctattgacacaaaccctttgagaaggaatagaagaaaacttactgttgattacggagaagattgaagaagcttgtgcttgagtagggtttttgagagagagaagagagatagtgaacccgccggcgcaaggaagaagaagaagaaacttagttttaaaggcttcgactttgtaaaacccttttctgctttatactaaaccggaaatctcacaaaaccggatcataccgggttcaaattatcgctcaattggttcccgttactatttataaaccggatctaagacatgaaaacttgtgacaaattgattcatttcattttagtaaaggtcacatgatttgagatctaacatagtataagagtatcattcaacagaaaggaaaacaaaactttgagccaaggctccaaaactctaatctctacgaaacagataaaggactgtgagaatcaatcattgttttcgattgaaccaaactctgaatcttgagttttgcttctgccatatttttcttctcaagctcatctaccaacattttgcaagtgctatctctaggaaccattccttttcgtactgcttcctcaaagaacaagcaagcttcttcaactttcccgctcatacataaccctctaatgagaagaatatatgtcgaaacatcgatactaacatcgtttttcaccatgtgatgcaataatattccaagtagcttcattttcttcttatggcaacacatcttcaacaatggagcataagtctcaacgtttggactacatgattccccctcctcatcctccatccttttaagcaaacgtagagccatctcatctcgtgagtgatgaagcgcagcggaaatcatggtattgtagactaaaacatcacgacgaactccttgattcgtcatgtcctcaaatatctcagctgcatccttaaacctaccagtcttcgacaaaatatgtatcaatgagctataaaacttagcatcaggaacacaaccatcttctttcatcttctcatacactcctaaagcttcagctacttgtttagatttacccaaagaatgcatcacaatagtataagtcacaacattaggattacacccattctctcgcatctcttccaacatttcattaaccctcctaaaatccccttccttgcaataagcttccacaaagctagtgtaagtaacaacatcaggagtgaactcagtaaccttcatcaaatccatcatcgctctagcatcatcaaatttccgagctttacaaaaaccgtgaatcaaaatgttgaatgtccgcgcatccggcttgattgtatcgaaaagcttcagaaaaacttcatgagcatgctctatactattctctttcacaagtgcatccatcaaactgttcatagcaatagtatctgttttcacaccataactcttctccatctctaaaaaagcatcaacagctttattatatttccctgacttggccaatctcctcataaccttactcatcgtatcaagcgtaacaagcttagattcttcattcttgttcatctcattgactaattcccacatcaaatcaaaattcctacatttccccaacacatcaaccattgcattataagtatgacctgaatgcacataacctgtttgtgaatttgcccaaatgaaaaacccgtaagcttgattccaaccattactaaaccttcttagaacttgcaaaaccaaactctctgtaaccaccacatcgcatttactcaactctttaacaacatcctcatgagacgtgtccttcttattcaaaaagtcgcaaactttatcaatatcttccactggtttcttcactacatttccctctgagacttgttgacgactaaacttctggctctcgacccaattcgccaaagaagggataacaaaatcttcatcatctttggaaaccgaactcgatgaagaagaaggcttgtttgatagaaagtctttaatccaagacggtagctccggtgactctgcggcaacaatcggcgactcctctgcagtgttattcgttaccagaaacctccgttggaagattctccgaggtaaagtatacgaaacaagcttactaatcctaagcttagtgagcattttgttccgtttgaatctaaacgcagacttctctcctgtttttccgatcaaagttcgaatcttttagacctaaagcttgctgctttgtgccgggtcgggtcggttcgttaattggtacaaccccggttcgatttaatttaatttagcgtttagatttttggtttaccccacatctgacaagtgacgatttttactgacacgtgtacaagtcattctcttcgtcttcttcctctaaaaaccctaattttaaggaacctcgtgtggtcatcgtcttcgtacctttctgctttctacgccgtcaaaatctaactgctcgacagtgaccatgcaaagctcaatgaca

SEQ ID NO: 2222 - DNA, 3000 bp, Unknown
  misc_feature (1)..( 3000): cDNA_ID_3066561_gDNA_ID_1620505_Annot_ID_158991 3000 nt of promoter + ATG
ggttatattttagattatatttaaaataatctttgtttttttttgtaaatcagagtgattatttctttccaattctctggatacatagatgtaatttttaaatactttttaagtaaattatccacacaaaaaaaagggaagtaaatttagtagaatccttataagatgtgggagaaagaataaaccctaatttttattttgagagaccgagtagccgatttctttttccttgggagatccgatcacaaagagaaaatatgacgatgcccgatcttccgccagatttggtcgaggaaatactttctagggttccggcgacatctgtgaaaaagttacgatctacttgcacacaatggaacgctatattcaaagatgaaagattcactgagaagcactttagtaaagcaccaaaggagtctatggttctcatgttgaaggagcatagggtttgcccggtgaaagtcaatctcaacaagtagtgatggtttgttgttatgcaccatcaaggacaaaagactcgtggtttggaatccgtgtttgggggaaaccaagtggatccaactcaaagttgattaccggagatacgtctccaagttttgtctagggtatatccaaaacaacgaatctcgccgtagctataaaatcttgcggagttggtatagttacgatgacaaatcatcaccgcgccaaagagatttggggtttgaaatatacgagtttatctctgattcgtcatggagagttcttaatgacgtcaatcacgaattcgttataggaagtagtgtctttgaagggaaatacttacttgcttgcttatgatgttgaagaaaattctagagttgtactaatgtttgattttacaacagagagattcaaacgtctacgccttccgcatttccaagatgttggtaatatggatctatcagttgttagagaagaacaactctcaatattacattggactcgtaatacatcaaagatggagatttggataactaataacattgatactgatgctacattgttgtggagactgcacttacacactcaagtcttctcacgtaattgtgttcgagtcttctcaagtctatatatcgacaaggagaagaaagttgtcttgtgttgtaatgttaatgatgatgcgaccagcaagaacatagtatacattatcggagaggacaatggatattacacagaaatccttttcctactccctataaacatacattgggttctacttgaccgtaataaaaaatggtattcatctattttcaattatgttccgcgtttggttcaaatctataatggtcatctcttatttttttcttaattaagtatctgtttttgaacaatgtagagtttttttttctaaccaaaaataaaaattaatttgattcgatgatgagtttttagtggtaaaaatgttgtttaatacacaaatttttaaaaaatggttatttaatacgtgaataatttaattatggataggttttggtaccttatttatggttcctttctacatagcgtgaaatacgtgaagttcaatcggcccaagagttgtgggctaaggcctaaaacctctgttttataaaaacaaataatggtttagggcaaacgtgagaaaaacaaaacaaaaccctaatctctctgtttacagggacgacggagtctttcttcttcgttgggagatcagatcacaaatagggaaccattgatgatgtcgaatcttcctttggatttggtagaggaaatactctctagggttccagccacatctctcaaacgattacgatcgacttgtagacaatggaacgctttattgaaagaccgaagattcacagagaagcactttcgtaaagcaccaaaggagtctctagttctcatgttgaaagaaataagcgtcaatctcaacgttactcctccatctatagagtttaaagatgcacttggcttaaaggattcccattctaattcagaacaagttgatatagtccaagttcttcactgcgatggtttgttgttatgcaccaccaaggacaatagacacgtggtttggaatccgtgtttgggggaaacccattggatccaattcaaagttgattacgggagagtctactccagctttgctctaggatatatccaaaacaacgaatcttgccgtagctacaaaatcttgtggaggtggaaaagtaacgattacaaatcatcaccgcgtcaaagagggtttgaaatatacgagtttatctctgataaatggagggttattgatgacgtcaatcacgactctttggtcaatcacaactatttaggacgttgctgtcgcgtgtctttgaagggaaatatttactggcttgttgatgatgttgaagacaattctagatctttacttatgtttgactttaaaacagagagatttaaacgtctatgccttccgcatttcgaaaatgttggtcacatggttttatcatttgttagagaagaacaactctcagtattatattggagccgtgctacaccaaagatggagatatggataaccaataacattgatactgatgctacattgttgtggagactgcacttagacactcgctttaattgtgttcgaatcttctcaagtctctatttcgaggaggagaagaaagtcgtcttgtgttgtaatgttaaattgttaatgatgataagatcagcaagaacatggtatacattatcggagaggacgatggatatatagaaatccctttcgtacaacctttaaacatacaaagagttctacttaacagtaatagaaaatggcattcaattattatcagttatgttccgagtttggttcaaatccagtaatggtcctctgttattttttttcttaagtatctgtttatgaacaatgtagagcttttttttttgtaaccaaattttttttttttttttttgaattttttgattataaagtgacgaacttttataattaagatactgaatcagtaagagccaacaatg

SEQ ID NO: 2223 - DNA, 3000 bp, Unknown
  misc_feature (1)..( 3000): cDNA_ID_2152183_gDNA_ID_1620505_Annot_ID_158996 3000 nt of promoter + ATG
cacgactttagtaaaatcaactaaattatatacaagcactttaaatgattgttgctttctaatttttgaatttgttaaacattttttagggaatgatgtagaaatctaaaatgtgtgatcccatgggataaaatgtttgggataactaattgatccaaaatgtttatttggtaggatagttttagtttataattattctccatctccatatataattcatattcgaatctaagcattttgttggatgtcaacaccgaatatttcaaggagaaagtgtacaactcagaacaaacgttaaaaaacaaaagacagaacaaacgacgattgtttggattttcaaaataaatttgcactcttgttatttggctttttttgaaccataataatcggacttgggacaagtatgagacgacaaatgcatttctttcatcttattgtatatacattatttgtctgtctatttctcttcacatttaatttgtaggcagttattttcatttctttgttatgcattgcttaaattatcattgacgatttttgttgaccttgggttttgcaactctctctctgcttttctttctgtggtaaacactaaacaattgaatggaagtcttgcatcttttgacttctgtacttgcgaagtatacttaacaaacaaagcttagttttatctttctcttttggaaaaagcatatcatctcaaatctcaataatcattacatggacctcttgattaagtgtggaaatttaaagaatgtatagttttgataatctcaataatccagagaattttatttttgcagttttgatattccactacaagtaaagcccattccatagttgggctttgaagtgaacattacatggacctctagattgttaacgtataaactccaacgttaaaaccattttagttacagacgtgtggacaaacaatatgttgctgaaatataaaccaaaacatttacacaatcttaccaaaaggcaaaagtctaaactagagtaaacaaattaggagaagttgaaagaaacaaaatcaagcttataacagtatcactaaagaaactcataaaactaatttaacatttattgatatgtaaaattctaaaatacataactttaaattggaggaactgattattattttttttgcaaaaggggaactgattattaagttggaaattcatgtacatccgatataactatattattattattagtaaaaacatcatcgtgattacgaataaaaaatttcaaaaggacacccattgcgtatttttgttgttttaatttgaaatctgatctgtaaagctaaagcataataataataatataagtatggaagaggcgacaaagttgtaaatttgcaaatagatacacaaagatgtcaaaccttatctctttcgtttcacgacaaaacacaaccagcgaatattattagaaggtacctaaccttgtacgtatcgtactctttcacttcttcttcttctttttacttatttatacttctttatgtaaattagcatacaagatgcaaatatgaacctgcctaagttattctttgttttgataaaatagtctttaatctaacaaaattcagaaatgatctatttcaaaaacattaaatagtattaaaaaagaaaattaatcttacaaaatttagaaatgcttaaaaatctgagtttctttaaaaaccacatcatatcttaggactgtaaggacaaatatatcaaatgcaacattatatcagtggggaataatggacacagccacccaaacatgcgaaaggacacccgttaacgactaaatgcaaaagaaaattatttattgtagtgcaaatttttggttcaaacatttctaaaaacaaagatttgtcattcttgcaccctatataaaatatcattttgaacaaggaaagaacaaatttcttaacatcaagatctttggtaatatattttaccatcccactaacagacttatttggactaaaaataaaccaatacaaatttcaacggcttaaacaaattgtcattataacaaaagaataaatctattggtacattgattctgtatatttttgcctaaataggtcaaattttttctctgagtagagaaacaaatagcaaatacgtctccttaaaaccagccttactcaaattaagccattctttttttcttcttccgccattcactctcagcctctccttcttcgtttcctaaactcatttttcttcgctctctttagattctttttttctcatatctctccttgatcctctgttttttattctgaggttgtttttcggagaaggaatcacctaaaccctttcaaatctcttcttctaccaaatatatttttttggatgaaaaaaacttctaccaaattctcagattttatttccttgagggttttgtgttttttttgcatggtctagttgatttctgaaatttaagtatatcttgtttacgataatatagaaaaaaattattggtgtttttgtgtgtttataatttatcttgggtcaatgataatagtggacgacgagtcggtgtcttagggtttactttttgtaaagaaaattttcttgttgaattattggctttttgtgaattcgattttctcttatttatataaaacattattgaatttcaacgctattttgaaaattttatttttaatattcatgttgtattagaatctggaatgtcagaagaacgtgtgcaggaacaagaacttggggttggtgtaatagtttaaataaattcttacaaagaataaaaaaaaaatcaggttctctgcaccaaatttttaaaatcattatttaacatattttgctaaattctctaaaaacaaatttgataatgatgaaaattttgattagttctgtgttgtgtttggtgattgcttgaattaagtctgattgaattttagggttatttgagttttgtgtgtctttgagattattgttttacaagaaaaaaaagaaaaaaagagagatg

SEQ ID NO: 2224 - DNA, 3000 bp, Unknown
  misc_feature (1)..( 3000): cDNA_ID_2152168_gDNA_ID_1620505_Annot_ID_158992 3000 nt of promoter + ATG
atcggcccaatgggcttcggcctaaaacctcttgtttatcaaaataaatattgatttaggggctaacgtgaaaagaaaaaaacaaaacaaaaccctaatctctctgtttacagggacgagaccgagtctttcttttcgttgggagatcagatcacaaatagagaaccattcatgatgtcggatcttcctttagatttggtagagaaaatactctctagggttcccgccacatctctcaaacgactacgatcgacttgtagacgatggaacgctttattgaaagaccgaagattcaccgagaaacactttcataaagcaccaaaggagtctagagttctcatgttgaaagagtatagggtttttccaataagcgtcaatctcaaagttactcctccatctgtagactttaaaggtgcacttggttattcccattctaattcagaacaagtcgtgataaccgaagtttttcactgcgatggtttgttgttatgcaccaccaatgacgatagactcgtggtttggaatccgtgtttgggggaaaccaaatggatccaactcaaagttgattaccggagatacgtctccatatttgctctagggtatatccaaaacaacgaatcctgccgtagctataaaatcttgtggacttggtatagttacgattacaattcatcaccgccacaaagaggtttggggtttgaaatatacgagtttagctctgattcatcatggagggttcttgatgacgtcaatcacgactccgtcgtcaatcacaactccataataagaagtggcgtgtctttgaagggaaatacttatatgcttgcttatgatattgaagaaaattctaaatttttactaatgtttgattttacaacagagcgattgaaacgtctatgccttccgcatttccaagatgttggtgaaatggatctatctgttagagaagaacaactctcagtattgaattggagccgtattacatcaaagatggagatatggataaccaataactttgatactgaagctacattgttgtggaaaagagtgcacttagacagtcaatgtaattgtgttcgaatcttctcaagtctatatttcgacgaggagaagaaagtcgtcttgtattgtaatgttaaagatggtgagaccagcaagaaagtggtatacattatcggagaggacgatggacattacatagaaatccctttcgtaaaatctataaaaatagaaaggcttcaacttatccatactacaagatggtactcattgattttcaattatgttccgagtttgtttcaaatccagtaaggtagattcgtaaaagaaacgaaagaaactagtccttttttttctttcttagtttttgtttttgaagacaatgtcgtttgaataatttaatgaatggttttttttttttttttggatatgtttatgattcgattttttgtttggattgttgaacatctgacctcttcatgcttctttgaggccagcgccttattaagctattatctcttgtctctctgttttaacagaaacacaaagagaacatcaatctctctttagtctcttgttcttgttttagttcttagattgaacacaacgttttgtaactaagagagaagagagaagtcttttaattgtctacattttgtttattggatcaagagatggttcttacaacacaacacatacttatactacttgattccactcaattacttgcactctagacttagcaactactagtactagctagacatcactttagacgtcaacaacaactcctagcaactttgcttagctagacattaaaccaacaagacactctttcttacttgcatagttaaactaaggactcattgcttcttaaccatatgccgatcgtcttgaggaaggaagactatgatattccagcatggttcttgttcacttccaagggtccccttgcgactgtgtaattaagatacaatataaactttaaccaaattagggttattttgtcctctgttttctaccttgtgaacggaagtaactagctttctctctatgatggtctgaacatgaatggatttttgagtaattttggtggttttttttatgcattagtgcagaaggcaaagaaagaaacctcaaagattttgtgttggcggactactctaaaacaccatcagaaccattgctaaagttctctcaggcgaatctcccgcagcatcaaaattcaagcaattgttgtttgcgataatttttggtcgtacgtaacatgttttatatatcttattatataaagtataattttcaatctgagtatcttaataagattttgacacgtgtaaaatatttcaacgaattagattttaacattatgttaacatatatatctaaacttccaaacttaagtagtttaaaaggttaattatatagtttctatactataatttttattttattttattacaaatcataaaataaaactagctatctaacaagtttattattcatgagtttaaattatatatgaattttattttaattattattagttaaaattacaataatactaaatcaatattatataaacaaatatatctaattaataaaattgaatatattgaaaatatattttgatatgatttaaaagatattaattataaatcttccaatttaatataaaatttaaaataaatatcctattatattattgagagacatatacatagatcagtcatataggactggttatattttagattatatttaaaataatctttgtttttttttgtaaatcagagtgattatttctttccaattctctggatacatagatgtaatttttaaatactttttaagtaaattatccacacaaaaaaaagggaagtaaatttagtagaatccttataagatgtgggagaaagaataaaccctaatttttattttgagagaccgagtagccgatttctttttccttgggagatccgatcacaaagagaaaatatg

SEQ ID NO: 2225 - DNA, 3000 bp, Unknown
  misc_feature (1)..( 3000): cDNA_ID_3066565_gDNA_ID_1620505_Annot_ID_158988 3000 nt of promoter + ATG
gaaagtgagactgagtatgaaggagaaagggttacgtaaaccgccagggactagttcaatacagattcgaggtaaaacccatgagttcacatcaggggacgagtcacaccctgaaatgccaaacatagaagcaatgctagatgaagttagtcaaagagcgagtcacttaggccatgtacctgatcttagtaatgttcttatggatgttgatgagaaagagaagatctttatgcttagcagacacagcgagaaacttgcaatggcctatggactcattagctcaaacaaaggcacaacaatccgaatagtcaagaacctaagagtatgctctgattgtcattcatttgcaaaatttgcatccaaagtatacaacagagaaatcattctaagagacaataaccggtttcattacatccgtcaagggaagtgttcttgcggtgacttctggtgatagcagaaacagaactaaaagaataataggaagattatgttgagactgcagcttcctcggtggatgatcaaaaggacgatctgacgagatcctagagtttgacggatgacgatctcgaagttctcaaaggttgtttagatctaggctttggtttcaactacgacgagatccctgcgctctgcaagactttacctgctttagagctttgctattcaatgagccaaaaaaatttagacgataagcatacaccatcactccaattgccaattggaagatctctagtcccgtcgtgtgtaaatatctcatattttccgtcgattgattaggtgatctaagtttgatctactctgatttcaattatgtaattggtttgttgctgagtgctagtgttaaacaagaatttcagtgattggaatggactgtgatatatgaagtctaaatgttatcagtttgttgttgttacaggtgataatccggatgatgtgaaagctagactcaaatgctgggcacaagccgttgcctgtactgtccaattgtgcagctgaatgaatcattgtcacgtctgactcaggaatactagtgtatgaacaatctctctcgggcattgttagcggaggaggagatttcagaaaggcattggaaggtctgaatttaactgaacatcaacaatgattctcacttaatttccatgtatgtgtagtagtagtatctagtctaatgatttttatgaacggaattaaaaggtatcagtgaataaaaacatcaatttttttccgcatttacatgatggtctcagcatctacagcttaacatctgacatcttaatagctggagtcttctccttatgagagcattcctcttatttaactggtcatggttctgcggaggtaacttatctaactgtgtctattaactgagtgtgatgcaatatgattatactctgtgccatataccattttgtgaatgattgtgtgttaagctacagtgtaaagcttgcttattacatgtgagagatgaaagcttattgcagagttaagcaatgtcgattttcaatagtttgacaaacagagatgtctcagcttggacagcggctataggagcaatggctatggcaggaaacgctgagcgagcaaacgctaagggtttaatacagattcgaggtaagacccatgagttcacttcaggagatgagtctcaccctgaaatgccaaaaattggagcaatgctcaccatagagcaagcaacttaggtcatgttcctgatcttggtaatgttttgaacttctgatggatgtagatgagaagatctttatgcttagcagccacagcgagaaacttgcaatggtctttgggctcattagctcaaacaaaggcacaaatttgcatccgaagtatacaacagagaaatcgttctaagagacaacaaccggtttcatttcattcgtcaaggaaagtgttcttgcagtgacttctggtgattacagaaaacacaagtaaaagatggaaaggaagattcacattttattgaataagaccctgcaattatacatataagcttcaatgcttgaacaaggtttctaaaagcaaaagtagatacaaaaaaggatggttcatcacaattcaagaacttgttcatttctcaggaaagattgggtcaatgaaagagtgatacataggatcagatctccaaagaagagccatgtgaagatgagaaggagtgagtcgatgaatctcttcaacaagccagatagtagcttcagctttagtaggatgaatgatagaatccaacctctgttcttcagaatcagtaccgaatcgtgattgatcccatcgttgtaagagaacattcgtgaggtaatgtagaggctgaccataaagctgtttcattgaaatgcttaatccaacccagcttgtgaacggaatcaacgagccacgattcgtcgggattggtacttgcttcatgtagtcttgatacatctctgctcttctcagcaacgaacctgactcaaaaaatttcagagcatttttgtaaaaatcaaaacttttgaatcaaaatggtgagaaaggaaagaaacaagggaccattgaaatcgtgtaccttcatcagcgacgtctctgtgagaagtatcgagcggtgaaaagccatcgctgatctcagcatcgacgtcagatgaaccggaatcacctgatggtcgtagttccattgtcattgagctttgcatggtcactgtcgagcagttagattttgacggcgtagaaagcagaaaggtacgaagacgatgaccacacgaggttccttaaaattagggtttttagaggaagaagacgaagagaatgacttgtacacgtgtcagtaaaaatcgtcacttgtcagatgtggggtaaaccaaaaatctaaacgctaaattaaattaaatcgaaccggggttgtaccaattaacgaaccgacccgacccggcacaaagcagcaagctttaggtctaaaagattcgaactttgatcggaaaaacaggagagaagtctgcgtttagattcaaacggaacaaaatg

SEQ ID NO: 2226 - DNA, 3000 bp, Unknown
  misc_feature (1)..( 3000): cDNA_ID_2152681_gDNA_ID_1620506_Annot_ID_159025 3000 nt of promoter + ATG
attttaaaacaaatttttttgttaaaacaaatattattcttactaaacgttttttgtttaaataaataaatcatgtatttgaacttatttacaatgtaatgacactgacattaattatttaggaatgaaaatattaaatcttctaaatccttgcttttagaattattatgtcattacttaaaaggctcaaaatataaaaaaattaaatattattatttatatatctagactttataaaacattattaatatttaaacttataaaaagtttaatatatcataattttttaatattattatataatatatagagttttaaaaaatcttaattctttccgtcatattttgtgactcgaaattttaaaaataaacatatattaatcaattggcaaaaaatgtgtgagttatacgtcccacatgaactaaaatatttagacaatgattcataaatatatcataaataagattaacattaataaaataatgatttttttacaggatgggtttggcgggacgcgatttagcaggacgttacttaataacaaatataaagtataaaataaaaatattttatagcaaaattttatatatactaattttaaaatataaattgtctccacggtgtaccacgggttaaaatctagttatttagtaattatgcatctcgtataaaccagctacaaaaatatcagtggaaggatctttatcagcaagcatattagaaaacattaaaaaatgaatagtaaactatgagtggggaagcaaaagaagagcgacggcttgctattggagacaaagttcataccacacgaactagacgatgcatagtatagatataggttaggcatatgtccatgcatatgttacgtgtagattgaaagggcatcgagatcaacggtggagatggaagcaagtaaaaatagccacgtgtggaaaaagcaaaagaagagaagaagaagatataagcgacgaaaggagagaggatatgtttcctttgtgatgggaacatcacaactctgtctctattggtacttctagttcactacttgtctatgttttttctttcagtacttagtttcccccacgatttacacaactttcttctgctcgtatttacagattttgaagattatttatacatctttatatagaactacacatgaaatcgtatgaaagcatgcatgaatcatgattcatgtgtgtgaaaattgacggtatgaagatgtgtataaattttatacatctgcgaaaatcatatcttgtggccaaatatcgaccaattggaacggcttgcaaattctatgaaaacgatcgatatgaaaatctgatttacatatataatagtattttcaattaaaaatcattttcctcaatttctatatatgtgtatttagcatatatatatatatatatatatcaaataaaccaaataacttcaataataatttaaatatatgaaaattaaaaaaattcactactcatatgatataattcatcactatagaacttataaaataagatcctggtaaaaaaagcatcaatcttgtatttcagtagtttataatgttaaaatatatgtaatcaaacttctcatatttttattaaaaccacacatgggctatctagctaattcacacacacatatatatatatattgttttcgattgtcatgatgatcatttatccacgtaagcagagacaagatgtaaaatgtcactagtttatagggagtggagtgggaataagtaggaaaagggaaaaaattaaaggaaaggtatacataattttcaagtcgattttgggttgataattacagtgagagggagacaacacattgcgctatacctaattctaactagtttcatttctagactgatggaccaatcatatcactttctactaatatcgttagtttgagcttcataaatatcttttatcacattttattttagaaaggttgttgttagttctatgcatctttttaaaccacacgaagtttcaaaaatattcataataatatttacgcctttataactaacatattcaatttcttacattttatcatggacaaaaaaagagagtagttcctcaggagaaatacaaattcgatatctaaaatcaagtgttagtaatctattggttaatattttttcaacacaaagattatttcatggtaaatgcattttttaagataacaattgtatgttcgaacactagtttagattctctatatgattttccgatactcaaagaaactatacactcactttcttaacaaatttattaggccaaatatatactgtttcaccggagatgcattcatatttactatggattagataacaattgtatgttccgaacactattttagtttaatttagattgcctatatgcatgatttttttataaccaaagaaaatatacactcactttcttaacaaagattaaataaagagataatcataaatggaactttgtactaacagaatcttgagaagaaatttgatttgagttttgttcttttttttttgttgttttaaatttccacatgcctatactttcgtttgtttatgtgacgcttttgtacgacaaaatcaggtttggattcgtacttcttttaggtcaatacattcttttgtttaattctgaccaaaaataaagaaatatgttgtttaataaaaatgtaggatattgagagtcgtactataataaaaaaataaaaaaatctcgaactttgatagtataagagatatacgattaaatcttgaacttaatatcctatatttttctcaaactatacttagtttgtatttatacttgtatatattagagtccacacaaagaaaaatggataacaaataatgacatcaatattttgggaacccccaccatgccaaacccaactccatgttacaaaacaaaacaaataaaatttctttataaaatggcatcttctcttcatattttttaaatctctcatctcaataaacaaacactaaca

SEQ ID NO: 2227 - DNA, 170 bp, Unknown
  misc_feature (1)..( 170): cDNA_ID_3066577_gDNA_ID_1620506_Annot_ID_159026 3000 nt of promoter + ATG
tccttcacattgcatgtatgttcaatggtgagaacattgatcttgtgaagcaaatgcttgtcaatagtgacttagatgtgagtcttgggctccaactcttgcttgataaatctctcattcaaataaatgatgatagagaaatagtcatgcatagtttgttactaaaaatg

SEQ ID NO: 2228 - DNA, 3000 bp, Unknown
  misc_feature (1)..( 3000): cDNA_ID_2152700_gDNA_ID_1620507_Annot_ID_159032 3000 nt of promoter + ATG
tggtgttagttgcaggtgaagaaacagagactttagccaaagaaaccctaggaacagggaaagagaaagagatccttggaggagcaggatctggagtacaagatgctgataacttgagcttccgatctgatggttgttcatcagaaaactcgtactggtcagaaggaggagtgtaggagctgcttggtacatcatcagattgtgagcctttgtaagaaagaggcggtgatggcttgtgagtggtaatggagggtgttgtagctcttggggatatataaggagattgcaaagcggaaacaaaagcagaagatggtggggacacaagagaaggtgaatagaaaggagagtttttgatacttggagatgaatctgaagcattattatttgcttgaagaagatcttctttacctttcttacttgaagagcttgctggtgatgaagttcttatggttaaaccaactaaacttgcttcttcttctattcccttcattactccttttacttctttcaccaaacacaaattaaactcaaatgaaagctctcacctctcagcttcaaaaggttatgtctttatctctctaacttggtaatgaatctcataatggtgtttctctgacagatgatattgaagtgagtgggactgagaggagatgagtcagaacatgaatgcaacagttgatgcagttcaatgagattgaggtaaaatctgagaaactgcatgtgatgtatctaactcttccattttgtggggtccctcttctacaacactgttgaaacccaatttgtgttttcttcttttctttatttaatttctcctcctcctcttacttcagatttgaccaacaacaccaagccagtttcagagagtctctgcaacaatggagaggtcacgggtcagaagaaaaatcattgctttacattgagtttgtggtctaatgttcatcatcattaacaagattgaatctttttactctctagctaggaccaacaatgaaaaagcaacatattagtcaaatctttaaagatgatttcttaaagacttacccttttgtttgatctttttcagacacaaggcaaaaaaagacgtgtcacttcccctgcatatcttttcattaccaagcctgtctctctcgtctatctttctctctgtgtttctttttgaggaagagcagaagattgtgataatgaagagggagaagaatctggagttgtgagttggatctgaaagtgcttatggacattaatttgtttttaaaatagtgattaaagaaatggttaagagagaagcagcctggagatggttaatgtctaaacatgtaccaatgtcattttataatgatcacccacttaatcaaaaaccattttataattaacttaaatttataatcttggattctcctttatgtcatttgtttttagctctcctctctctcttctctcaacctcctctgcattttctggaaatttttaatgagtttttttttcttctttagtttaccaagaagactccagtttttatttaagatcgagttattagagaagtataaatataacatgggttacattggatttaagagagttaaatagacaagagtcagatttaagacattgaactttgagcttaaaagaggttgtaggattgaagaaagggaaccattttcaattttcttagtactttggttgtttgtcatttactgtttgtattttgtggtctatagaaaactccaaacattgtactatattgagtattgaatcatataatactatcattgctgcaattaataggagaaaaatgtcaagagaatattttacgtaaaacatattttgggttctaagtaagtgaaattccttccactatgtgattatgaactaaatttctaacaatagtactaacataacataagtagtaacctagtagtatttgacaatttttcttatcaataacattttagtatattgtaatttgtaagataaactcctcataatcgagtaattatcttttttttttaattcaaggtggtgcatgtatgtatgtgtacactgacacaacatttgaaatctgatttcacagtgggaattggtccaagaccagtccacttgtgactttttatttatttaccccacacattttcacatttatctacaatcataagggactttaaaaacatacacattacacacacacacacacaaaaacaaaaaatttaccatcaaaatcttggagtgtgtgacgtatgaacaaaacaagattgatactgtatgtagaaaagtctcgttatcaaacgatgtggaagcgtttatcaaacgctcaaggataagtctcgttgtttccatacctaaaaacggcaaccactgtatatagaaaagatgtaaacgtcaaaactgaagaagttagaaagacgagggtaaattagtaaaatagtcgagatcatattaaagtcctaacggtatatcacacaccgttgaattccagatccgaccagataagatcacgtcgaatcgaacggtcataaaatatccgagtagttgctgaagtatccagcggtttcgccacgtgtcccgaccatgtcgctcacacgttcgtatttctctattacaaaaaaaaggaaacgaatcaaaatgttttttgatcgtaaccgggaaaaaaaaaacgatttttcgcaacgaaactttccacaatcaacggatatagagagagatctctgcgaatcgtttaaatcgtcttctaatttcgtttcggtctcttcgtaaaggattcacctttgagtggttttgcgttccattttattaggtacgtcaagctcgaaactttcgattcattggctttcgtaaatgtgattaatctgggaattgagttgaatttagagaaccctattgcttcatttttgttttcgtattttggttttattgaatttgcctctggttcttactggaatggtggttgtttagtcttgagattgatcccatgtgaaaagttagtatttttgtggcgtcgtcatg

SEQ ID NO: 2229 - DNA, 3000 bp, Unknown
  misc_feature (1)..( 3000): cDNA_ID_2152718_gDNA_ID_1620507_Annot_ID_159036 3000 nt of promoter + ATG
tatttaagagcacaagagatgttatgacttaaatatattaacttggtgcacattttcttgccattaagttatcatctaagaaataaaattagttaaatctcctaacattgtcactaaacttaaatctaatttttaatttgttgataagttgtccaagagaagtagtaatttgttttcatgtacgagttccacataatcatatgtaacttgactaacttccatagtccaaactccaaactaatcaatcagattcgaattcaagtgccactgatcaatatccaaataaactcttcttaattcaggttctcattagaatttgtatcccgacaatatgtaacactcattgatttttacactcccaaacaactcaagactcaagagtgtgatcaaatgttgattagtgcttaagcatgagatgtttggaagaatatgaatcaaatggtgagatgtgaccgagaagtcttcctcacataaatctgtcttctctcgcttataacgatgtttgcgtgattcaaattgataaaagtatagcattgatattacacgaagctgtcgaggcatatattatgctaattacgaatcgaagatcggttttaaatgcctttgatccctcatatacataaatatatagatataagtacaaagtcgtatacggtatggatgaaataattaaaagattgtgcacatgcatacatacattgcatgcatgacactatctatacgatttggtttgggttaatctctttcgtccacgtcgaatcgacgtactaactattttgtatacaccacttttgcatattcttacttccctttttttagtatatttttgtgttcatgctttttcccatgcttgcttatttaatttttcgaatttatagtttctatcataaatcctctgaagaggcgaagataacataaactatgtaaattttttaattctatatccaaaagtttattcgagttttcaaaactacatatagtaaatagaattatactagaacaaaaataagagaacaattaccacaaaaaataagagaataaaggttaaatatttattaatttgatattattgtattgaatgtggataggaacatatgtagatgcgcgtgtaagtaaaggtaaaatatctaagcgcgtgtgagtttgtacgaaattcgtaaataagatttcacgaacgtacaaatgatttgcctttggttaaaaaggttaaaatagtaaattaataatccaatacagagagtggaggaacaacggccccaagatttttttttaagattgatgtgattgcgacgtgtcgcttgcttgtctgctatgtgggccccacatccattgctacttggtaattcatttttgagcttaattttttagttttgttaggacaactttaatagatcttgaaatggatagctattaaaaattggattgtaaaatgaatttaacaaaggtatgatgattttatattcaaattccttatattattatgaaacctatgtaattacatttttatattttgaaattagattatttttcgtataaatgtttttgtatatatatattccataacattttaaaaaattatttttacagtttacaaatcatcagttatataatgagttatttggatgtttaaccattaaccattagtttcttttaaggattttagtttcagtgtttttgattgcatgtatcttaactattttgtttttctaatgacaatatgtgattaagaaacaacaagtcctttttgcatagaaagccaacaacaaaagtaaaacatttatcggaataagagaatgttagcaaacaattcataatttagctagctatatcaaaatctatacaaaagaaaatgatcaaaaaaaaaaaaagatggtggagtgtgataataattgaagttagtgtggacactttcaatatatatttcttcgtcttgcactcatttgtttttctttattttattcacatttagtgataatacgtatgtggacttatatggaacaccaaaattattttattctatagtgcttcgttcttcttctctctctcaatctctttcttctcttcaatgctctcttctctctctaagaaaccacttttttcttcttttgccaagaaaatctaaaggtttgtgtataccttcgtttcatcaaatccatcaacacttagtttcgtttcttgttcttgtccttgttttaaagtttgtagatttagttactcttctttttccttctctttgatctcttatttgatcttaagatccaaatcttgaaatctacgagattggtatgtgtgcatatgtatagatttacgagtaaaaatatcactgtttcctcaaactcttttttttcttcttcccgatcttggcttttcatgttttggtttcttgatttctagattttcagatttctttctttgtgttgttataaatctcatctcttgttgatttctcacttcttaaatccatatggtgtctttttttggctgatcaagaatcttcaagttttttcttcttacaaatgttttatgatcttgaagtttaagaacaccatctgttttgtttatattacttagttgagttctattattgtatttggtagcttcttcatccatttacggatatgtcttaatccactttttcttatgatcactcaacataaaataaactctctcgaatcagattggtaactgaaaccttttttttttttttttttgcgtgcgaataattgttcctcttaagtgagatttcacttcatcaaaatcaaataaataatctttatccactaatcctagttacttttgtgtgacttcttcttccacatgaaataatgttcttctactaagaagatcatcaaatctgagtaacatgtacttgtgtttgtctttgcagaaggagtaaagagaagagtcagatttggataggtgatgataaagaagatctggtgttatgcagaagtatttgggaaacgaagaggcaaatagtaacagtggaagaatcaaatg

SEQ ID NO: 2230 - DNA, 3000 bp, Unknown
  misc_feature (1)..( 3000): cDNA_ID_2152817_gDNA_ID_1620508_Annot_ID_159043 3000 nt of promoter + ATG
gaagaagaagaaaggaaaaggagtacaagagcctccagaaaagaggaccaaagtttcaaaagaaggacggagcattcgttgtggacgttgtagtaccgaaggtcataatacaagaagttgtcctagtgtgggagtcgttaacaaaaggtggccaaagaagacacctgatggagttagtcagtctatgagtattggtaccaatgaaggaacaagccaacgaccaagccaaccatcacagaattctcattttgactaaggtaatataggtttttttcaagataattgtgcttgtcggttgctctagttaatcatgttttttttgggattttggcagaatttaagtggaatgaagaaaagtaatgagacgtaagaatgtaggcttttgtttaagtctgaagagattgaaagtttttgttataatctcaagtgaactcttaagttgtgtccggattaaatgataattgttcgaaacttggtattgctatttaaggtttcttttggtctgttttaacaatttcgatctcattccaatttcaagtgatgaaaatactaccagacaatctcataaatattacaagttcaagacaagacaatacaatctcttaacataaatattactagatactcgtagcttaatatatagaatttagtgggttttgttaccaagccttagatgcttatggaacattgtcatcgtgaaagaaaaagaaagaaaaaagaagaaggtgatttaagacgacaaaaacgacgtcgttttacaaaaatttgtttgtctcttctttcatctaaacgacgtcgtgtcatacgtggcatccatgtgagcaaccgttaacggtttcgtaacaccgtcacggcttaggcatgtattgacatgaatggtgtgagtttgagatttgaatttgaaaatttggtttgttaatgtatggatttgcacaacagtaaacgttgggtatgaattgaacatactactttagctcgggtatgaaatgaccgtttttccaattatgctaacaacttttgtttgtctccccgaaaaatttcaatgctatagtcaaaattggttaacgtgattggacgaagagtcaaatttctgaggaaatatgggagttattgttttgagttttggtgtaaaactctgatttgttgtttagtagaacgattctaaagactaaacagtcatctcttggagtaggggtataactttccaaaatgtaatttttaccgtgaaaaattcaagtagaagaagaaatagaagaaataggcaacaaggccaagatgatgatctctttgacccacttatctatgattttccggattgatctttcgatgagttgctttgagaatttcagcatgattgtttgttccgaatatataaaatttatgttatcttgaatatgatcgtttagacttacatatcttctctttattcactagcagaaaattacctttaatgaagtattcataagatctttttgtttgattttcagcatttaggaacaacaatatattgtaaaaaatttatacgtttgtcgaaaaatcgtcgaaaatattccgaatttcgacaaaaaatttccaatgattttttattgtttcttgacgaaattccatcaacatttcgacaaaatatttttgacgatcaatttcgtctggaatttccaacgcttcggttggtcaaaatatactatgctttcttgtagtgatgaaactagaagactgtattcatttgaacagcttggcagctgatactcgtttggtttttcttgttggtcccaacttggcaaatcggtactattttcttcgccatttggtaagattcgtcggaaaaacttccggactttgggttctgatgaatttcaacaatgttttctgttaacaatttttttactattttttgacaaaaagtttccaacgaattttcaccgtttgggtaaaataaccaaaacccgaaaaaccatactggaccgaatcgaaataaatggtttggttgagttatgatttagcataaaactcatttggttttaatttttataagtttttggtttatatttggtttggttaaaaccgtaaaaccgagtgttttttatttgtttttgactaaaaataaaaataattatatatatatattgtccaatctatattgtgtttaataatagtattaataattgtttctttattggacttataattattgatcttttttgtaatttaaaaaccaaaaattaatattattaatttttttctatatctgaattttaatttttaaattatatttaacttattggtggatatattattttattatattttacttttatttatgtataaaacttataaatatatttgtaaaaacatggaataaccgaaaaacccgaaactaagattcatataatttcaatttttataaaaccgaaaaatcagtaaaaactataaaacggaaccgtaatcaaaccaaattacaaaagtttttatatggtttaagtttttttaaaattgaaaaaccgtaaaactaaaaaggcgaatcgagatcaaactgaaattcacagtacgtccaccctagttttttcaacgaatttccgacatatttcgtccagaatttccaacgcttttgtttatggtaatatgctataatttcttgtagtatagaaactagaggagtgtatttatttgaacagcttgacagctgatactcgtttaatttcccttggtcccaactcgacaaattcgtactattcacattttttttttgtttattcaccaatccataagtgtactatgtaataacacaaataataataaaaaaattgtcgacacaaaataaaacagagaaaaacagtaaaaacactaacaaaacgcaaaatctcagtttcccacttgaaagagaggaaacaacaaaacaattcgataaattgaaaaatcaaaattgaagataaacgcaaaaaccaattcttcgtcttcttcacaaaaaagatagcaacaatcgaagaagaagagcttgaaatg

SEQ ID NO: 2231 - DNA, 3000 bp, Unknown
  misc_feature (1)..( 3000): cDNA_ID_2152848_gDNA_ID_1620508_Annot_ID_159049 3000 nt of promoter + ATG
ctatgaataagatcattttggtgaagtaaaactaatcgtcgacagactcgaatctgcttatgaaatgaattaaactctgacaaaaagaaagaacaatcttatttctctattcgcaaccgcacaaatgttggcgctgctgtggaaataattacaaaggatcatcaccacctgattcttcattgattgctcaagtttttgatgacatatgaaagtatgtctctgtggttgaagtaagcgagttccacctatgcacgtttacccttactttacaatgaaatctatttttcttcaccaaacaacattttgaacaatgggagtggacaatatacctcagtgtcaaagcggactatgcaggtggaaaatttcccagtgtctgtattggtagtaacatcttccccaggtcttatctctgaaatatcgattgggagatggatagtgtaaagctccttacctatcaatccaagggtgtctgcatcctcactagacttaaaacataatgggatgatttccattcccaccaaattactccggtgaatcctttctaaactatttgagatcactctgctttaacgccctgtaaaaacaacaaaattttgcctcaaagaatttaggacacaaacttcagagagagaaagagatatagagggaggttcaaacctgtaacatgggtctcttggcagctaaatcacgggagctaccactaccatactcagctccaaccagaataattgtggcctaacaagctgctttgtatctctgaaaaaaaacagacattatcattatacaatcagtattaaacccacaagatttccttgggaaaattaagccaagaaacacaaaccatggcagcatcgaagaaaaagattttcacccaataggaatgtgaactgtcttagggcaaacttatccatttaatagcttgttaacaagtctgatattcacaaatgttcccaaagccataatttcattgttaccgcatagacttccatatgagttgaaatatttgcggttaatctccggtgattctaaatcgtgtttcccttggtgatggaattagaaccgtcaaatggtcatctgaccatgggctaagcccagtccacaacattatggacagtccatggtcgacccgtaacgaaaacgggttaaatggtctaaagaccaattatgtccgcggatttaatgggctagcccacacggtctatggttggtccatcaattttctcaacacatcaattttcttctcttctctatctcggcgacgaagctctctctctctcgcttcgacctctctctcaactcctactcccgttagttctactagaatatgaatccgttgattagaataagttctctctaaaatatgcgttcatatgatagtctcattgattttattctctaagtccttatgcaatttcatcgctttgttattttctgttccttaattgtgattctgcatatgctttctttgatttcagcttgtgggtttgtccaaatttcacttgtttgctattctttgttattctctctctcccttcctttgatgccaaccatgtgtttgatgaaatgcctcacagaatatgtagagtttggttttggtagagcttgtaattacttgtgtagagcttggtgtttatgtatggagctaagtgtatgaacgtttagtgtgtgtttgctaatgtttatgaacgtttagagcttgtaattaagtaatcgtttctcaccacaatccatcacttgtttgacaaaacgttgttttgcaggaaacggattagaggtagcaagttcatgactcattggtttattatttttttgcagagagtggccatacatggaatcatcggctttacaagattggcgatcaaacattggcaaataatattcagacatttgttaattcccaaatctaagcttaactcttttgatgaacttattttcagacattggcaaataacattaagttatgggctgaccattggacatggtccttaatggttttggacaaattttcagaccattgtccaataaagatcatccattaaaactaatggtccaattggacatgaccattgggctttggacagcccaattgacacttctagatggaatcataagtagctcgaaacatgtcgggtaacacactagagtgaacaacctgtaacatattcctatagaaagttcaattaatgtgtacctggagagaaatacattcgatgattctaagttgcaagtacctgagcaatttcctctatggtaggctagatatccctgaggaagacatccttatctttcttgttctccccaatatactctgtctcaaagtcaatgctaacctgtgaaatagaacacatacatatattggacttgtacaatcgaataggaaatatattggacttttaaattttttccaaattgtgtactgttccaaaaaggacataggtgttggtgtcggatcccgcaccagtagtccaggaccaaccaaaaattgccacataagcatgagagaagcccataagggatacggcccatgagaacctcgaattgagagggaagacatggacgaggtggccgttctgcgggatggtgacaaggtcgaaattaaggacagttcggcttaaggttctcgggccgggtatcaaagcccacgaagtccaaagtcaattcaaattcaaacgtttgaacattaaactcgaagactgaaacagatgcagttaagggagaaatattatgtataattgagaattaaatgttatgtactagtataagtaagacgttgtgagccatgtaggacacatgcaatttttctagcaaagatactatagccatttttataccaattcgtagctttatacatttgatttttgtcctcaagaataatccatctcactaaataaataaatacttgagtgtgtgaatccgacattcatattttggcgccgtttgtggggatggaggattcttgagtcatcagattttttcaccacattttcgagacaagcagca

SEQ ID NO: 2232 - DNA, 3000 bp, Unknown
  misc_feature (1)..( 3000): cDNA_ID_3066605_gDNA_ID_1620508_Annot_ID_159045 3000 nt of promoter + ATG
aaaaaaaaacctaaattttataaaccataaatttgaatgaaaattacctcattttccttcctcacaatagagattatgagctggaactcctattccactaatataagctcttcacgatagatgcttatggaacattgtcgtcgtgaaagaaaaagaaagaaaaaagaagaaggtgatttaagacgacaaaaacgacgtcgttttacaaaaatttgtttgtctcttctttcatctaaaacgacgtcgtgtcatacgtggcatccacgtgagcaaccgttaacggtttcgtaacaccgtcacggcttaggcatgtattgacatgaatggtgtgagtttgggatttgaatttgaaaatttggtttgttaatgtatggatttgcacaacaacaaacgttgggtatgaattgaacatactactttagctggggtatgaaatgaccgtttttcctagcataattagtcctaaagatgaagataagataaaattgttagtattaatgaatagtcataactgataaataattgtatgcgataacaatttgctaacaattaattgtagttgaacacaagtaaactgacataagtataaattcgtttttttgttttaacattttacttgcaaaaaaaattatttatggtaacaatttgaactatgatacgtccttagctgccagtcggttgagcaattttttttttttttttaatatcaggaggttctgaggcgaaacctgtaatttccctaaacccaaaactaaagtatgtaatattaatttcatctcaggcgtcgcagtcggttaaacaattgatacgtcagtatttgattttgaggtggcagctttcatgcatctaagagcaacctcatcaatggtttctaaacttaagtttcttattttaaagagataaattttattataaaaaaatgtgtgagtttcttgattaacaagaaaccatctccaaaataccttatataaaaaaattttaagagaatttctaaaatatttaagaaacacacataattaaataatattatttttgttgtttcaatgttaagaaacttatatttagaaaccaccaatgaaattcctataaagatgcaatccctaaaatcttgatagatgtaatgttactcgatagttcccgtcatgtcaaaaatattggtggttcgtaactaaaaccacctgacatatatcttatcgtttgacttatcataggcatgaaaacattagaaaaaactcttggaaattataagttctcttatccattattgtctatgccacacatattaaatactcttaagagtttttgatgtgcggatcatttgattgattgaccaagaaacttaacacaacaagtttaaagagttcccgacctctatccggtacgtcgcatgagggtctctccccacaaaattcactatcaagcatggcccatgcttgcatgagggcttgaacatgcgacatagaaactagactgatcgcgtgactagcccccttatggtatgtaaaccatcactaaagtagtgtggtaggtaaatttcgatatatttttccttagttcatgcatctaaaacatttgaaacaattatttttacatcgtgaaatcaaaacgtagttattgtagaaatcggtacacattaattttaagtaagagaaaaagtcgaccaaattagcaaattctattaattattatcgttcaaaaccgcttcaaattcaaaaagttccatatgatgttacgtcattgtgtgggacaatgcaaatgtcaacaactcagagtgaacaagtcgccttcttcgccaacgcgctcacataatttgtgtaatattttatcttagtgtttctagaagcttgactcgctcgcatattgcaattctaccaaatcatatttttattttaatgaaatttctatgattttgacaactaattcttgattttgaccttactatatttcttgtagaattagatagggtgcaattctcatagaatgtttctttaaatttatttctaactaatattaaaaaaaactataatatattcggatttagtcttaagaagatttaccgttacttctaatgatatatttgaatatttgatggcaaatcgaattcaaataaccaacaagttgttggtccaataataaattttttagataaaggtattgagttttagacacgttgggagagatttcttcgtcaaataaaatgaatttattctagtgtgggtctcgcatgtaggaaatgtaggtcttttaattttgaatttccaaatattcaaaaaaaaaaaaaaaaaaatcgaattcaaataactgaaaattagtgtaaattatataatagactatctattagtttctttgaaaaacatatagtatagtaatagacattttgataaatcttcatcttttacatttctaagtatccaaatgcttttccaaaccatatgttttcgggcttttttttttttatcaattcggtaagaaacacattgacggcattaattaacataaaactaataaactacatgttttctatgtttttttgctaatttttcctaaagctaatccattagaaaattttactattctaactatcattgtatgaaaaaggtattatctaattgtattcacaattctataggaaaaaaggttaacatgtcattttcttctcctttttagccgtccactcacgactaagaacttattcgtctaaacatgaattacatgacaatgtcaaagcgtggttaaaacttcagaaagaagtataaacctacctcaagaagtcgtcgtcctctttctctaattaaactattatttcccataatagaaaacactaattttttgcctttttggtaaggaaagtaacatagttgttagtaaatatgaattaggaaataatatacaaagtcttggtcctcttctcatcgactttaaaatctctttctcccattacaaaccaaaaccattagaagatttcgaaaaagaaaaaaaaacacctccacaaacaaaaca

SEQ ID NO: 2233 - DNA, 3000 bp, Unknown
  misc_feature (1)..( 3000): cDNA_ID_2152837_gDNA_ID_1620508_Annot_ID_159046 3000 nt of promoter + ATG
gtacgtaagatcttttaatgttcctctcatgatcttggggggtggaggttatactcttccaaatgttgctcgttgctggtgctatgaggtttctcctttgtaacttggactttgtgtttttcatattcatgcaattctttgttctgaaaaagtgctttttaattgttgcagacggcgattgcggttggagaacaacttgacaatgatctcccaggcaatgattacatgaagtattttcgtccagattacaagcttcatatattgccaaccaacaggcagaatttaaacacacgattagatattataacaatgaggtaaccttttaaaaaggctgatcagtttggtgccaatatagttgagatgtttacaacttttgctttctaaacctctttgtaaatccattatagggaaactttactagcgcaactttctctagtaatgcacgcacctagtgtaccgtttcaagacactccatcaagcagtcaagccactgaagcggtaaaatctttattcattcgttcattactactttatctttctcattactggatatgttttaatttgtccaatgaggttattaagattcgcatgacatatctttaggcggaagtggacatggagaagagaaatgatccacgcatttgagtgcaatccaagttatgaaccagactctaacaacgattagcattttcttggataaggcaaatggtaaagtagtgtcataggagaaggattcttcatattcaaatttcacctttttctgagtttgttcttagagcatgtacagaaaagaacgattgatgtataaaatcaacattgtagagatactacaataacattcaaatattatagaaagcaacagatttttgttgacaaaagtctccacaaattacatataaggcacattctgcaacaattcaatgtaagaaagagagaacaaatgcatggtaagttacaactaatgatatctatatctatatgcagcctgttcaactaggaaaaatcaacaattacacacatggaatttttcattgtgataagaaatcagattctttagtcccttagtcaataaaataatcacgaaccagcaaagtatatgactcaacaacaagagtcctgatattgcatatcccaagaccataaactcatcacataatatatgctaattattaccgaaaaatgagcttcttaatgcctaaaattctgatttgaacttggctcgtacgctcataatttaaagctcagccaagaacatcatgatagccaacagagatgcatacactttcttgaattaaaatcccagatcacaatgaagtaaagttatctaagtaaaatttaattattttcaaaaaaaaacaatattcatggcttttgttcatcattcctttcttgaatcaaaaggttatatatttgatgagagtaaagaacagaataatgatacaatatacattctcttatatagagatgagatttcctaatcaaagataaaacctaaatgtaaatcatatatatttgataaatgtaaatattactaaaactaagatatgataatattttagatccttctgcaatcttcatgatttccatattcttgggcgatcatctcaaccatcaatgattgatttccagtttccccaataaaagtagctttaattcaaatcataataggataatcagttcttaaatactttggaaaaatatatggataaaatcagaaaaataaacctctttcaaataggaataagaaaaaaaataggaattaatcattttgattttctagttgatgtattgatcatatagttgagtattcttataatgtaaattagccgatcaagatttaaatatactttttaaacgtttctttttaagctgattaggttttagaaattctaggggaattagtttcatgagtttttataattttgttttgcaaatattgttcaaaaatcaaaaatcattaaaaatctgaaaacatatttatggcctaaaggctaaaagttggatataatttatttattttcggttggatatattttgcttagttttatcccgtgtgtattttttccttatttatatatagtaaacgagaacgtagacagaacagagttgggatggagacaaagaagagaagaagaagaagaaggagatgattttcttaacagatgatctatgggcaattatacttgcgagattaccactaacaatcatcaccacttcaaaactagtttgcaagcaatgaaatcgctcatagaatctccctttttccgcaaacttttcaacacccaccatcaaaactctcattcttcatggtcaatcctctgtagagtcctacctgaagaagtcgtggctcactacgaaagcgagacttggggtctttcacgatctctaggttcttacatttcttctttcataacccacaaattcaatactcaattcccatacgttacactcgtcgtggcttacactcatgttggattgattttgatcagttcttgcaacaaattactaacttactatgtggctaatccgatctcaagacaatgtgtcgataatatatcactaaaattttcttcaaaagtttctctaaactgtattacaatgttttcacaaactttcatcgatacctaaatagtttatatctttattttcataaaaatttgtgattaaaaataaaattcgttagaaattagaaattttattaatctttgtaataagaaagtaaacttataacaattttaaagtatctttttaatattttccattttaattttagttaaatacatatttttcttcctatatgattgattgcatcttaaatcgcatatcttaaagtggcagaagagtaaataaagtggtcatcaaagggcaaaatagtaaaaacaccacctcgactctttttttcttctgtcttggacataaagcttgattcaattccattccttattgttatatacacatctctgattcaactccaccgaattcagaagatcgaagaagatg

SEQ ID NO: 2234 - DNA, 3000 bp, Unknown
  misc_feature (1)..( 3000): cDNA_ID_3066632_gDNA_ID_1620509_Annot_ID_159058 3000 nt of promoter + ATG
tatacaagaaatgagatcttcctcgagaacaaatgactgttgaagtcagcccgcatggagcgtgttatggaagttattgtcactgggagctaaactttcttcatcatggcggggtaaatggtggatgacttgttcaaaaagaaacataagagaatgcttggggatccgcacaatatcgtattatgtttttaagaagaaagataattttgtttgtttgagctaagtgggattaatcgagagaatcactgtttttctattagctaggttggctggttatagaagacaagttatcatcgagcttacacttcagcttaatcactgcatgtacatggagcaacgaaagtatgattaaagagttttataatcttaaagtaccacaagtggtccaacctcgaagaaatatgaataacacatgaagtatgaaagaacatataagcaaagtgaaaaggtaaatttgggattttgcgattaaaatacttgaactggccaagtaagctaaaggctaactaaacaacaaggcaaacgaaccaactaaacaataaaaaaatgataaagataagcacaaaagattaatcaagatatatataacggagcatgggtaaggcaattgataaggattgattactagctagtcaatcccaaatgcttgaaccacacaattatcaaactcattcttaagattttataggatcataacatgaatcataatatttatatctgtactttgagtaattcatttgcatgcatagatattgggccttaatgggctataacatatatcaaacaagttggcccaaatgcaaattggctcacttaaaaagaagaattacgagctctatggtcagagtattaacaaaacccattctttaacatgttttttcttctttgtgtggcttttgttatttggttacgtcttgcatgagctccagttttcaagtatttgtgtatctccagttactaataattgcagggtgtttactggttgattattggtttttcagtattcatgtattttcgggatagatagctaatcatatattatatactccgatcaaattatgaatatcgaatttgtttataatattatcgataggattaaaatattaataaaggtaaaacagttttatgaatgtatatttttgttgcttagttactaattcgtttgtgtctctttttcctcatgcatggaagtttttggattagatatggaatatgaaatttttattgatggtggctcaaaattagcacttcaccaaagaactacgatttttcgcagttcctatttttccggtttatcatgctgttttttttatatatatccgtcgttttataacttttgttttccttattttatttatattatatcttatcggttgatccgatcagcttacaaagtagattacttttgatccaaatagaattgagcaaccacattgtttgatctgagtttggaatgtcttccgactaccaaataaattaattaggtcaaagtacaacttacagatttccaaaagtaattatgtttttgtttacaaagagaatcgaattcggatatgaaagtttcacctttcaccaaattttcctctaccaatagaccataaaagctttggccaaattattttgtaaccgagttcgaaaccttggattaatcaatgcccaaatatttgggttgtataccgttcttttaatattaatgcacctgttaaaatatataaaaaaattactatttttatctattaagagaatatatgacgattgtcaactcttataaaattttggtagagaatattttgaggattgtcacaacttttaatactttagttgatacataatttagatttttaataaggttatcaacgtcatcaaaaaacaaaagaccaagctcccgtaaaatcgttattctatatcaatctcaaacataaagaccaaacaaaagaccaacctctacactattaatcaatttgttagttattctatatctatctcaaaacaaaatatacaatccataaaatcatacactacaaagttaagtctttttgtttgtatttttttttcatttactaatagcaagttatcatttgtagatagagagtattgaattgtattgttaatttgttattgttgtattattgaatgaacgtcttttttcttctaagcaagttatcatttgtgaatagggagtattaaaccgtattgttattgttgtattattgaataaaagggtacagcttatatataagcatttcatattattgaatgaaagggtacaatttatatataagcatttcatattttgtccacataattggggtttagtggtggttgagaattagagaaatattgaaagaaactaaccctggtttaataaactttgaaacaaaaaaatacatgtacgagaagtttggatttgggccaaagatccaaacagtttacacggtaatcagtaacatgcgatctgactactttctaacgttactcagaaagtattccaaatttgggaaagacattatagtggtcttttaggcagaagtctactagacttttttcgcttatttaataaactctagactctccatatatagtcttcactaataaaactcttgcaaatatttaaagttttggacacgaataacgaatttaatatatatattttaatcaagttcaggaacgatatatatatttataaaccctgatatattttatatatttggttctccgattgtaatcagtatgttgaaagaacacaaagttctcaattcaaatgagtcttaagtcgacaatttttttgattgaaaataattttttatgtaagatgtgattctttggctttgcttatactccaacgagaagtaagagcatacaaaaagtaatgatcgaaagcgaatgaaagacaaacgaagcaacacctctttactcattctttatattaatacctctcaggcttcttcacctgttaacactttttcttcacttgcctacagcacctgagctctcttaaaa

SEQ ID NO: 2235 - DNA, 3000 bp, Unknown
  misc_feature (1)..( 3000): cDNA_ID_2152915_gDNA_ID_1620509_Annot_ID_159068 3000 nt of promoter + ATG
aaaaggcggtcgcttacctacatttactgcaaaacaatctaaaatgttgaagggatcatatgatttcattggcagaaattattactcatcttcttacgctaaggatgttccttgctcaagcgaaaacgttacattattctctgatccttgtgctagcgtcacaggtgaaagagaaggagtgcctatcggtccaaaggcagcatcagattggcttttgatatatccaaaaggaattcgtgatctccttctctatgcaaaatacaagttcaaggatcctgtcatgtacataaccgaaaatggtagagatgaagctagtaccggtaaaatcgaccttaaagatagtgagaggatcgattactacgctcaacatttgaagatggttcaagacgctatatcaattggagccaatgttaagggattctttgcatggtctttgctagataactttgaatgggcaacgggctacgcagtccgatttggactagtttacgtagatttcaacggtggacgtaagagatatcccaaaaaatcggcaaaatggtttaaaaagttattaaatgaaaagaaaaagaattgatgagacacgcatcattacattgcaacaaacatatgatgtccactaatggttttgtatgaacgttaagcgtgactaacttttttataacacatccaatagagtaaaaatatatccgttaaattagaataatgacatttcttatgctactttcaaagagatgcatgaaatgttttatcgattgttaatttttttttccaaagtaatgtaggtgttagtttcttaaaccaaacctgaaaaattgaatttaaaatacttcaaattatctaaaatttcccacaaaattccatactatcaaagaatacaaattagcttaactcatttacgaattacgatcgtaacattacttagtgaaattctagtagtaaattactttactagcttagtgaaaattctatatccaataccaactcgctattcaaattcaatataaatattgtatcatgttaattgctaataaaatgtcatatattataagatttctatattattgagaaatatacacatttctaaaaactaaatcaaattcaaggaacagtttgtgcatcgaagtactaaaccaagatgcgatttcttatcaacatctatgtactagaatctagtctactaaagaaaaaattcatacaattaaattgtctaaaccaaatgggtaagaactcattattaactgggactgtaatgaagcaaaactttttaataacgaaattaaagatggccaagctcgatccattaactgtgtaacttccaaagtaaagattgttattgacacaaacactaactgacttatggataccccaccataatcaacctccttccattgatgttgccccatttttaacatctcatagaaaaatcgtcatgttcttcttcttggcaaacaattcatattttatagcttaaagagtaatcaaatcctaagaaaaaaatagaaagattatttgatttaatttctttgcaggggctatgtttcactaacctttaataaaaatgaccaaaaataatgaaccaagataaacgaatgtaggtgagaatttaatcaaacgattatagtaaattagattagttctccatatttaaactgttgacttccaaagaatatacaagctttactctgcactcacaattggttacaatgttttacagattatgaaagtaatattatttaactattacatatttatgtggtagttggtagaatataaaattaagccatatggtagtaaaaaaattagataaaaaaattaaattatagataatatgaattttacttttgtgcaaaaaataaacaaaaagtattcttcaataaaacaaacataaaataaaataaagtagtgatgctcattattcctctattttcttggaatgggcaagcaaagatcttctacttggcaaggagagagatgtattcccccaaataccaatgaactccaaatccacacatctctagatgcatgtattaagagaatggaatcaaaatccttgggttatgccaataatatgttgaacaatctacacttgagttgatgcaatggatatgaatagtcctgatctccgtagacaagcacaatgttgcatcgtggttgttgattgttattcattccgaagcaaaacatatgattaatattgatacaatggtttacaaaattatgaccaaaatatttttatgtaccgactccttcttacctagaaaaaaagaatgataccaatataaattgaacaaaaagtatatgaataaatccaataaaaaaaatacagaataaaccaattgggacatgaagagtataaactctactcgcataagcattaatattgtatcatgatcgagtttaaatattaaatattatgtatatgatcaaaaattaaatattatgtattatagcaataaaagattaattacacagtttatgaatcgagtttgacttagtgaaaagtttagctttattactatcccagttaataattcgtaccaattcgatttaggcaatttaattgtatgaattctatagagaccatattttattgttacttttacacaaattaagatttaaactttttttttttttatatatctttcatcgaatggaagtctctcttccgtaggtaatgtggacattggggtttatttttctggcaatacaaaacacacaacactaaagcccacagtgtttgaagcaggcccaataagaagctctcttcaaatttttagactcttgcgtgtccgctagtatcacgactggatatgtgataacacacgtagacgaacctgaagcaatcactcaaactcaagacttctctttaatcctcctcccaaaaatctcagagaatcctccttcaattccaattcaaagctccttccttttttcacatctctcttcttcaaattcaatcatcataaaaatcgaatctttattcttcagagagcttca

SEQ ID NO: 2236 - DNA, 3000 bp, Unknown
  misc_feature (1)..( 3000): cDNA_ID_2152928_gDNA_ID_1620509_Annot_ID_159072 3000 nt of promoter + ATG
gttatcaatcatgttccaatagagacaagggggtgtctcaatgggaggaagcaaaggttccatgtctttctaagaccttctcattacacaaacgattaggaaagatcaaaacacatttcagtggaagaagaatgataatagagaatctttttaaccaaccaatctatttcattacgagcaatcatatcttctttgtactaaaggagcctcaacatatctatctatgcttaggatactgtggaacaaaatcaaaatccttaaaagcttcaattttgtataacaatggattttgatgggtccaactaaagctttagagttctacttttcacaggtctgcaactaactacaacctctgaatttgctaaagtttctgaaaaaccaaaaactttaaggaaacacattggtcagctattcacttatggcgtctcttaaggtttagcaactaggctattccaaaacattataattaaaggtttggattctccttaagggtttacttactacaaaatcaaacaataacaagcttcagtttttaataacaatggcttttcaaggttccaaaattccaattaaatctccaaattctgcaatcacagggtccacaactaacaacaacatctcaattccgcaaaatcttcagaaaaatcaaaatcttaagccaaaaataaagctccatactcaaacaaatcacataccacaaaaaccgaaagataatcaatcgtaatcgcaaacaataagaaagatgtaaaacctagttgtagtaaagctcaagacccatgccgtcatggatctcatagtccttgagagtgatgtgatccttgtagatgttgtaccacttctgaattctgatcttctcggctcgtgttccggtttgtgccgcgacaagcttcttcagatcaccgatcgtgtcatcatcgttacacttcaccctaacttttttccctaaacgatcgttgagaaccacctcgatcatcttcttcgctcgaaaactacaattgcgaaccctagcccccaattttctattcctccggaaaagtaaagtacgggaagattctacgcgttaaggctcgttgtgacttttatttataaacttttttttggtcgtacttatgtcggtttgagaattggtaatagatttatttaatttctagaaccttatctatattttaatagattttacctttttttttgtcggctaatagattttactttaattttgtgaattatcaattttggcttcctattttctccatatatagactttgtattaaaattatttttttgtttatatttgaaagtttgtgcaaaaaaaaaaaagtttatatttgaaaccttattattaaaaccttgtgattgtgatttttttaatttttttatcatcttgaattctctcagcaaacttaaaaataacaacaattttatcctatcaaagaaagagccgacctctcaaaataagatacatcttaattgtgattattgatgctagcaaactcaaaaataacaacaattttatcctatcaagaaaagagccgacctctcaaaagtaacaaaagcaaaaaccaaaaatttacatagtgtctgattggtaaccaaaagctgtacaagttttttagctgttagctttatttgaatagtgcaaagctgttagaaagagttgtacaaaaaagctgagagtaaactttttataacacttttaataaagtttttgttattggtaactgtgaaagttgtacaaaattatataaagctgtattgtgttaccattcaaactcataatctgatatgtaaaattacaataaatatgccaccaatttacgtctaaataaaattctacaaaacgctatcaaatcactaccaaatatgcaaatcaaagacaaggagcgaagcttaactactcgaaaaaaatctgtctcacgaacaagaacaccatcaaatcgaaccaactatcattcaccgccatatcaactccggataggaaaacatgtaaactttaacatcgacttgagacaaatcaaaacaactagaacaatctagaggaaaattgaagttgaaccaagaaaaaaagtgctaacataaagatgaaagcttgacggatactaacgagagatcacctcgaaaaatatggtctattttttcaagaaagatggtgttgttgtatgaaaatacgggagctatttgacttcttgtgtatatccacttactttgaaccgtatcacaggtttaaaagtaataattcgtaagtttgaaaaaaaaaatctcatttagctaacattaaagaaaatttaaacgttgatttaaaacgctttaacatgtttccataaattggattaacaaaaattgcaacgttttcaaaacagatcgacgacgttttaaaaaaaaacaagattttatttaaacctttcaatttttgtataaattaagtataacatcaatataaattataggattaacttttcatcgttaattttttttttaaaaacataaatatcataatgtcattaaaaagtaaaaatatctaaaaattcattggtttaaaattataaaaaaatatttcatatataaaatgaaaattattaaataattaaacaagaattatttttaaatatatgtaataactctataaaatcaagaaaaaagaaaagaaaacaaaaaaactataaaatcaattttctcggaacaaaagatgtagttacataggatcagaacaagggaaagatattgatcaacccgtgtagaatatacaatatggttaactcttacaatcacttaatcggttttaccattacaaattttaaacacataaattattatcctctgagaagttggcgtgtgtgctcaaaaaggaaataaacaaaaattgcagaaattactgaactagagatagaatgaaacaataacaacaaccacaaacgaaacagctaaagaaaacgataattaaaaaaaaaaaaaaaaagcttacgaacgccattggagaagagcacgaaaaagaagaagaagact

SEQ ID NO: 2237 - DNA, 3000 bp, Unknown
  misc_feature (1)..( 3000): cDNA_ID_2152890_gDNA_ID_1620509_Annot_ID_159061 3000 nt of promoter + ATG
tcttcttgctttatttcaaaacctatattatagtaataatcaagagatcaatatatatataaactcataagaaaaaagtggttgattcataataagatagtaccagaagtgttatctaattccgagcaataaacgaaaggcatgacaaagaggaggatgagtacaaatgcggcaaaacatttcttggtgatagccatgtctaatatagtctcttaaattttcttacgactgattctagcacttacgatgattatatatataataacacaaacatacattcaaaggttctttttggtgaaagaggaaaaggaaaagaatccaaaaaaaaattctcttgagttagtcaaaagaaaaaataaagagataagtattcttacctaattatgtttgaaacattaataagataacatacattgttttacaaatatttaaatacgaaaattcttttcaattcaattaaaaaaaaaaaagatctcaggttccatggttggaacttgaagttaaattgaattttttgttaaagataagatgtaataatttgatctaaacagaattagtttatattatatcattctttaatatgattaaagggtctatacttagtttattaaacaaatatacataattttttaagaaatatatatttttatactaaaataatatatatatatattgtgaattttaacgccttctatagttaaaaatattcaagtaacaactttatgtctgatatatattcaataatttcagattacaataagtcttcgcaattcttcgacaaaaatattaaaaactagatattaacctgcgatacaccgtatgacgatattttataactaaaaaggtgaaattgtaagttgatttgtttagtactgtttattttgtttagtgtttaataatgtataattgtattttgattgttaatgttagaatttcacatgtcgtataacatcgtgaaattaaagtttaaatattgatattatttgaaaagtcataagagttttaatattatgattgtttttatttattttgttttgtcaaatctattgatggttttaggtttttgtctcatggaagatgcaaatagacatttatgttatcaaattagacctaactaagcctaattaagtcaatgttaagtaacaaagaaagatcatacggttagtcacgattcatcatccatcatcctccaaacaccaccccacttttcaggtgacattgttcttaaatcttaacctatctttctttcagattcatctctatatttatttttccaccaaaaacagtgtgacttaagtcttgggggttaataaatccgttactactaatactattctctattttcttgacttgagacatttttccaatttttacatcaatatgttctaacaaaagaaatagttttttattttattttatcgaataaatattttattgagtaaaaacaagtagagaactatgactttgttatatgatgatattgaccgatgtgttgagaattgcttttttaaggaacacttacatgtttgcaaagaacggacaatcttgaatactacatctgaatgacttaatcatcccctgaagtttaaacccatagaaatttatgttattagattatctttttggattattattattattatatttattttgtatagctattgagttagctcatttaactcacgatcaagatgatatgagtccaaatttatatataaaaaatcatattataaataagatgagttgagttgagcgaactatcttattttgacatctatagggtttgggtatgtaacccatataataaatgggttgggtcaaacccacccgttaaaatcttgaacagggtttgagttattatccactttacactcctaaatagactcaaggcattgcattatacaaacgattagacctaggtacaaagatgtaatattaccaaactatatactactatgaatatattaattatatatgagtctatatattccccaataaatttcagtgttctttctctacttgagtttggttctaacacccaatgagttttagaattcgattcttaaagttaatgcaatgcattgctaatctctgggaaacattactagtagataagtgatactaaacatggaaataatcaagaggcacacatgaactcttctttcttctttaactttattcttctcacttctttcttcttactccactttactcttctttctcagacgcttcaactcaaaaagagaaaccagcatagttgtaatcttgaggatcagctatttttctgaaggatatttggcctaatttcgaaactcaaggtatcttctttttctttttctaagtctcaattcagcaaaatgtaacatacacaaatatcactagtttacatattttattattattattattattttcactagtttacatatatatatatatatatatcagggtcgaagtaccaaatcaaagttcttgctgttgtttacgtatacgagagtgaattttgtttaatggatatctcaaatatttcgtgctttatttgtaaatcttcattgttctttctctacttgtttttttgggtttatataaccatttagctgatttttaaatgacttagaacttggatcttacagttagttttcagttgtgaaaccaagtttgtttatttcagctgtatctttgtttctctgtcagctttgtaaagtaactaagttaggtccactcgaattctcgtataatatttaatatcgcctttcgttttcaggattttgacttggcaaatagaaaattgttatagttttttgtttttctctaattaaaaaaaaaaagaaagttcttgtttcttttgttttggttaagagattagtgttgtctactgtttggattattctttctctgttactgttacgtgtttcattttaagatagagagtctctttatcattcatagagtgtacttttttccctgattgtttcaggtacttaggaaacgctgtagaag

SEQ ID NO: 2238 - DNA, 3000 bp, Unknown
  misc_feature (1)..( 3000): cDNA_ID_3066681_gDNA_ID_1620510_Annot_ID_159081 3000 nt of promoter + ATG
atcataaataatactctcaacttgttaaagggaattacacagaacatgatacccaaattgatgcctaaaataacctatacccaaagtatttgaatatggcaaagatcatgaccaaatcatcaaataagagtttgttttaataatggttggttaaatcctcccaaaagatttactataaaacgtcgtatcagtgacaagaaaagatgttatattcagaaaatgaatctcattcctttaaatgcatatgcacaaatgagaaaagctgataaaaaggttcgatttgatcacgttttgtttcccatttccactttttgctaaccaaaagtataagccgtcaccaatattgaacataaaaatttcggagaaaatgacacaacttgacttttagtaatttctcatccttttacttctagaatcatatcttctgaacacttggaagttgggacattagtcaagaccaccagattctgcaaatagtttgatatatctctaacatcccttacaaaagtaatacttcaatagcggggaacacaagctgatctcaaaactccacaggtatgtagcgaaaaacggaaggcaagcgatgataacaatgctaatgttctattcataggtttgtcgcagcaacacaaatttcataaagatagcaaagattaagagttacaaacaacctgattgaggcaaaaggtgtccaaataatcatattacctcgtttaagcccacacgattataatttggatctctagttcatgaatctgcaacagcaatagcagtaggggtaacttgtttaaccctcctttgatgaacatcccagttataaacacgtgcaatagttacctgtcgatcaccaaaaagtcctagtcagagactactctttactcaatctttgtatgtatctacaatacaggttgcctaaattgcaattttgggtttttgataattaacagttatgttaaagtaagatcaggcccctacttatatgtaacttctcacgaattaggggctaactcaaatgaaatgagataaatttacaagtatctctgtacctgagtaactgtgacttgatccctcaagaactgtaaatcagctacaagaacctccaggctggctttagcattttccagattgtttttcagaagagctgaagcctgttggaacaacaaagattataagaacttattctatggtcccggagatttaaaatagcgaatagaatatgtttttagggtaatggacctcttcacaggaatattccagcatgacattagctcccaaccacaaacacactgagtctgtgtcttcaatgcaggcccgtgaatatattccttcagacacctcaaaatcagctaagagcgcctgcattgtaagaagaattccatgtgagaaaataatgatgaagaacacaagaatcaacagtaagtctaaaaaccaaagacactttcatataggaaagacaaaacatcgtgcccactacaatctctgtgtcagcgattcactgattcttccagtgaagcaagaactcaacatgttctgctgtcaccatcaaacaccacttaacactaatttaaggggccataggaataaataagaactctgattagtgatttcgacattgtcttttcaaccaatcaatctcgatcttcaaaaacagactttcaaatgcaagtaggcttatgagattctaaggaaatgttgcaagtaagactgactcgcgcagaagagaaaagaaaatatcttcacatgaacacaaaagcttgcattcaaagattggtaagaaatcaaagcacaacaaagttcaacattatggaataaaaactctggattctggattcaaaagtttaaataacaatgtttctacatttatatatactcacaatccatctcaaaaacagtagcaagacactgatcataacatcaaagctaaacaaaatgaaaatgaacaacgacgaacctcaccagtacccttctttgcttccaaagtagcaacaacctctaaacacttttcaatatctgggattttagcctacacatttaccaacactagtgagatatcatcaagtagagataacttaaaagcatcatacataaactagaaacaagtgaacctgaagatccctttgttgagcaagaagcttcatctcaacaactttatattgctgaagcctaaaaccatagaaagagaaaccataaaggattaatcacaagtaatgattttggattcaattgattataaatccgtaggagatctgggatttgagcttaagaagaacacactcagataaatgagtagactttcagagtgaaaatgagaactagaaagaggagaaacctttcttggtgaaaggcgagagcagagttaggatcgagaccagactgagagagataagtctccacatcttggatgaatttggcggcagggatccctcttctctcagtcaaatcactaccgcttccactcggagaagacgacgacatcttcgaatcggaatctcagttcccgatttggggatttagggttttaaaagcttcgacttggttttgtatgtttttcgaatctgacgactccgacacggcgtccgtagtcggaattagagtagtgtaacgccgtcgttttttaagaaggggataaaaaggcctcgcaggcccattactattgaagacggacgcggttttgtaaattaattaggccggttccgtattcacgatgaatttttttgaaaattgtaccattggtttagcacttatttggttctaattcaattcagtaggggaacaacttactattgggcctatggagctatgttaagcccatcgttttgatcctaaccggtttataattttttagaatatagaaatgaatctaagatactcaatgtttgacccccaaaaaaaaaaaaagatactcagcttctcccgtctcgctagatcttccaaaatccgacaacagatatatagatcaacctaatttgaggtagaagaatacagagagcagcgaaaatg

SEQ ID NO: 2239 - DNA, 3000 bp, Unknown
  misc_feature (1)..( 3000): cDNA_ID_3066670_gDNA_ID_1620510_Annot_ID_159091 3000 nt of promoter + ATG
tccaattcattagaggaacattttggaattagcattacagtgctcaaatattctttgtagaaaattgatcttagctaggttctttgagcataagtaattaccaacattttgaaggtagtgttcatttatccaatctagcacgacaaacggacaaacatataatccgctcttacttgtcacgtatcctccttatgatttcccataatctgttaggtaaaaatgatctctcgttttctttgaacggaaaaaaataatgagaatttgactgtttcaaagtcaaacatgtttgcatttgcatgcaagtactaataaaacaaattactgatctgaagtatcgaagaaatttcagtttttcacaatttgtttttacaaaatacacaaaaatgccaatagaaatgttttatttcgtttgtttttagcgtattttttaacaaaagtttttcttataacatggtatgattgtgagttcaattcatttgaaaaatatacataccaaatatagaaaagtaaacgcaaatgtgaacagaaagaactatgaattctagctggttaatgtctagtagctttgatttgagattggataatgacgtggttgtataacgtgagtcacgtgacctatatattcatgtgtggatgcgcctgcaaagagagtgaagcacgatgagtctctttctttatttatttatgattcttactcgatagagttattcatcaatattaactagtagaaactaaagagagagcgatgtgttccttttatgtttttttttggaatttgaataacattttgggacactaacaatatgtataggatttctgattccaagctactagctagagtgcaagggagtttattttcgacacctctcggtccaatgtcactcttcgatatatatcacaatcacgctcgtctctcggatcacttctagaaccatttcactcaaaatttggatgttcttttatgttccaaattgaaacccatccatttttttttactaaacttccggattagcaactatatttgttttcttcttttttcctctagttgatttccatgtgatttcttatatagttttatattttcattatatttatttctgagtttgtagattaggtacctcgtgatttataaattaaaaaatttatgaatattttctttaccaaatggaaggtggtctagctagtacccttaactgacaacaaaaaaaaaagaaagaaaaagctaatacccttaactgagtatgtaaaatcatacagtaattagttcaactccatttaaaaaggatgatttaagcactaaactaatatactatcaagtatcaacatatatatgattttggccttcgagaaacacattttatttaaagaatgtatacattcttggtgatgatcatgatcatgtgattgacaaaaaaaaaagcatgatcatgtgcctgttagagaagttttatcaagagaatttgttatgactacgtgttggatgtgtataaagccccccaaattaaaatttatgtttcaattcttaataaaattttgttagctatcgtattaatttttgattataaacttactatatacaattaaagatcttttctttatttaaacgttatgcgatgaaagatttataataatgacttttcaatattttaaatttattaattattagaatttatttgtgtctttactcaaatggttaagtacatttggaagagacgacaaaaaaggttagcattgcacatttgaaaatgatggaaagacgaactactacagcgggcggtgtgtcgagagatgaagaaggcaattggtatcaagggtttcctctaaactttgggatttgtttagctgccttagccgagttatggaacgtgtattatagtctttatatagcttgagagagatgagttacacggttgaatctggaagtggactccgtggtggttgtcggtttcctgaagacatggattagtgaaccttatccgctatcattccttgaaagtttgtagtatgacttcctatcacatgtatataaagagactaattgtataacagatagatgttcaagacactgcacgggttaagaatgttaggatattgttcttgtaagttttcttaataattgaggggatattcgtctccctttgtcctgccaaaaaaaaagtccatttaattttatatttttcatcgaagttcgactctactaaattgggaacattactgtacatagtataaaaattataacagttatggattgagacttgtcgatacgaatatgtcaaatgaaaaaaagaatctaatgtactttctaaaatcgttttgacccgaaaaaaaagaagtaattcgattaaatgttattgtttacattaaaaccctataaagtcttatctcagttcgataattcttgttcaaggggatctctcagatcgaaggttcgatactcaaagatttcgctttttcttttctttttgtttcactttcttcttcccagcccttcttcgccgacgttttcttttgcccggaggagccgactattactcaagattttgattctgactttcaggttctttctttctttctttcttctgcagttccgtttctatcagctcaagatttatcgattaagatttctcaaagtattgatttttttttagtgattagacaaattttcatcagtaactcatgaactttgttatgattagcggcttgggtttgttttgttgaattgtcaatgaagaaaaaccctaattttgcattgtcacaggaagtaaaaatatggactttgatgatgatgacaaaccaaaagaggttaccaaaacccgtagattcgctcctggccgtgccggaaagtctaaacccaaacctaaaccggaacccactgctgataaaccggtacagccgccgccgcagtcacaaactgagtccgtgagcaagactgagcatgacgttgatgctaaattcgttggcactaaggttgaaactgaggtttgtaatggctctgtgaag

SEQ ID NO: 2240 - DNA, 3000 bp, Unknown
  misc_feature (1)..( 3000): cDNA_ID_2047775_gDNA_ID_1620510_Annot_ID_159096 3000 nt of promoter + ATG
tagcatctcacgaatactatggagtcatatggctatattatccctatttggtgctggaattgcatggggcaatatttttccatacaaggaagacatgagcttcgaatatgcctgttcaagatacttcgagttcgttgaaacgttcttgttagttggcatattgagtcattgcatcacctcttcaaaatcaccaaaaccagcttttaaggcaaaccaatttatcgtcaatattttccaatttatggttagcgtaaccatgttttttattacttatatggatcagaggtgggatatcttttggatatacatctgtataatcttcgttgtgatctcatttgttcagttgagttatcctgtggatggctttgagatcctatatattatgatggtagccttttcaggatttgcttcgggaatcgctggactatattttgaaattgagtcagtaggacactcttggcattgggcttatttcatcactgctttcgttttagtaatggttgcgaatatatatcgggagacgatattaatcccattgaggaggattaatttatggttaaaaatgaaagatcaccttaaagtttaactattcccaaaagatgtagttttcttttttaccttgctttatttctaaggaatattgacatgttacaaaagtttttttaatgaaatttattaatacatgactacaaacaaaagataacttaccaaaaaaacattgaatttaaaatttaaaaccaaaattttatcagttttaaaaactaaaatataatttcgggtgaatgaaataattgactaaaaaatggaacgctataagaagaggttatgttgacaataagaagatgttcatgtttcaagtaaagacttacttatgatttacaaaataatttttatgaatttttaaatatcatgtgttatatgaaacaatagtgagaaagttcatatttcttgaaggatagttctcttttcatctaaagtgtgcacatgaacatgttaaccatccaatagaacatcaccatttcatcaacccaagattcttattgttgtgtatacacttttatgaagaacaataaaattaaaaccattacttagatatagactattactaggagaacaagtatttgctccaaaaaaaaattagagaaccaaaattatgtttgaaccaaaaaacatctactaatttatagagatattaatttatctatatagagagattttactaatttgtaatacaaaatttatctcaaatatagttttttctttataatcaatattttctaaaatcaattacaatttacaagtagaaaagcaactattcagtttaaaaacaaacacgaaatttttttgcagaagatttcatcatataatctaattacattgattaaaaagtaaagaaacaataaatttatataaaatgtggcttttaaaatgttaatatttcaggtggcatatggcaaatgcctttttgataaggctataggcatggtgtatggtggtcatcatcatcatcagctcataaaaaaatatgtttcttaaataaaagtttcaagacaaaacagggagagtaacagtccgatgtgatgttatctatctgcacaatgttagaaagctatcatcgctcagttttatgcttgacattccaaagtaacatagttgtagtttagtatatatgctaataaaaaatctcatggatgaattattggagtacttccatgcgacccatggttggatgtgtatgaaattataatttttatataattaaacctgtaaaaaatgtgttaaaagttaggagaagtttgtcttagacggtaaaattgtatatagtttttataatcaaatcaagtttgatctttttaagacaaagtaaatactgtaaacggaagatatcaaagctctttatctattccacaaaactatctatttttcttgattaatttgtaagatcaacatatgtataacagattatggtaatttaaaaacttcacttaccataaaattaacatatatattgaggatttagtttaattccaatatgagaattgagaacatatatttaatgaatatgattcatcttgtagttaattcacttaattattagtcttttgaattagaaaggaaattataaacggtagtatgcataagctttgttaagaaaaactaaatttgttaagatattgaatattatcttttttcctatattttgatggtactgtacttgtttactttcaaatggacatttagctaactttattttagaactatataaaatgttaaatcagttatttaaaatgtagccaagttagatatcattaggagataattgattcaatttatactcctttaatcagaaaataatttattaataacaggatctaaaatatttattttaagtgaaggaaaaaacaaaataagacaatatgtcacatatcacaaatatatatatatattggaatatcctatataagttaattttcgactttaaaacgaaagtaacatatatattgctaacttaaacatctttaaaaatacttttttcaatttaaatcacattaatcagaaaataattttttataataatttattaaaaagtatattaaaaatatggcacatgtcagcaaaaaaaaaattgcaaattttatatatgtctagaatatctttaaaatgttttatatgaaatttgaaattttatttagtgattataaaaaactggtcacctatttagaattgttagcttaaataattcataatcatatataaatatttttaacaatatagtctgcatacgtaatagaagtcaaatatatacagcataccttaccggccggtatgatttcaagattttcaaaattaagacggaactgtaattttattaccggccggataaaataaaaccgaaatttcttgtcttgtccgggaggactgtttctctcttgacttaaaagacttgggatcaaacaaacttgagagatcattttggaatttcaataatctgagaaaatg

SEQ ID NO: 2241 - DNA, 2600 bp, Unknown
  misc_feature (1)..( 2600): cDNA_ID_3066643_gDNA_ID_1620510_Annot_ID_159105 3000 nt of promoter + ATG
cttcgcctacttgctgagatgtttgtttgatccaatgtgggtaattgtcggaatgcaagcatctggcacgatgcttagactcatcaaatagttaggacaagatagaaacgtctattgggacttcccattcactcacgagttgttgatgctaatggattatgggcttatggccctcaaaaatagaaattctattatgcgccaagaacagatctgcttcttggcctatatatctacctaacaaaagttcaagtcacggttgttcttgggaactagactagtatacttggactgttgatggtcaagaaaactccttcttcgcttccagctttacgtgggaactgggaagcattgtggtcacgggaagcggccaaatattggtttgatcactgatgagtcttgctttcaagatgtagatttgtcaaatgaatagactaccgactatagtttggcttgcttcatggggtatgcagattgcaactcactgttgtcttttctctacttatgatgaaaaccaaaaccacttccttgtgaattgtgattactacaagttgattagacgatccatgcagacccgactcagcctcacaaccaatatgttctatatttgagactctcttattgtctgaacaaatctaggtacacatattcaccgcccatcctgcaaaagctagtggctcaagccactgtatatcacatatggaaggaaatgagcaatataattcattagcaacaagcaactcctgctacaataatcttaattaaagaccattgatatgtaggcatattccataatacaattatcgccaaaaaaggacatggaagaaattcattaacctaatgtgaataactagggttgcttcttcgtcaaaagatccatgtgaccattgtatttttttttccatgtttggcaaaacacaaatatagaaggttgacattatgtaaaaccaaaacacttcattttctaatgatatttacattcatatcatattatataagtaaacgttgaatttgtccctcagtatttgaatgcacctagctaggttggctaaatgaatttgaattttatggtcaaaccaatgaacatagggggaactggagaagtataagacgtatatgaacatacagtatagtatttgcaacttgtttgaaactggaaaaaagtataattaagttattacgacaacttataaacataattaagaaacagaattacacgcatgaaaagtcgtaaaatgtcaaccttcaaagctatagtgctgaattaagtgctaactaagtatactaatcaaccctaaaaattaattaagtcctaccacgatcctataattaatgttcaatttgcggcatttggaactttattcattaggataacgcgttgcatgacataaagagtcaaatgagatattttattactcatagtttagttattttcagtgtatagattcgattaatatcttaattaagagagtaaattgacaaaatcataaaaatacagtcttcatccttggattttggcagtacttgtactggatctttaacggagaaatatttaacgataaatatttcttagaatttaagaagtgaaacggataatttggtttatttaagaataatgaattgtgcaacgatgggtgtatttaggaataatgaatgtgtgcaacgattggtgtatttaggaataatgatgctggtcatgtctagggatttggggtctaactaaagcgaatgtaaatatgagaaattttacatctaaacaatataatatgtattgtaaatttgtaataaaatattttgtaaaataacaaacatgatgtttttttatcaatgaaattgaatttcgaaaacaaattgcacttgatttttttaccaatacataaaatctaatttaaaaattcggtggctccaaaatttgcataatattatgaatcctaagactgttttttcgatcagtagacatggtctagtgactagaatggatgttaaacaaccgcactcggactaatctatgttcatatctatgcaaaatgtggtttcatttccgccttggaaaatgaataattttgacataaacggtgtcagtttaaaacacaagcacgagaactagttcgattattaaattgaggaaactgttttgttccggtattttgttcatatttcctgaaaccaatccatatttataagatatctctttttatcaacaatatacttatgcggatttaaacacggatagtaatattatgatgatgttctcctctcataaagatagttgataattacaaatatattaggagatgctctatgttttaaagtttttaagttattgggaaaaattaacaattctaatattgcggccgtttatgcctttgtcccacatgttacaaataaatcttaaaaaagaattatcatctattttgttcatctataaaaccatcaacttctccatcttttcctgtggatacaaacaacatcatccattatctctctaaacataactccaaaaagtgactcttttcatttcagaactcactcaaagacaagtacaaagctaagtcttgatttttttctttgaatatctctttgtgggtcactcttcatcaatg

SEQ ID NO: 2242 - DNA, 3000 bp, Unknown
  misc_feature (1)..( 3000): cDNA_ID_3066654_gDNA_ID_1620510_Annot_ID_159099 3000 nt of promoter + ATG
ttgaatattgtaatatgatttgatgaaatatagagacaataaaaaaaaaagttttagagtatagaattcattcgaataatattaatttttttttttttttgtcatctgaaaattaattaggactcaaacgagccaatcctgaagaatattgtttacaaatgtaatatgaagcggttgggtacaaacttttcgtgccaaaaaatccgctttaacattagtactacgagagattaaagatagagaaaagtttgtgaactcatccttgtcgctctgtaactcctccaaatacgatgagaaagccgaccattcggttggggaagacaccatctccaccagatctgaacagtctgtaaaaaaatctacatcttggttgtcggcaccaatcatacacttcatcgcccagaggagagcttccacctcggcatgtaaaggagatagacttcttctgagattggcagctcccaaagttgatgtctctccagttgatgatgtacagtaccatcctaagcctgaaaacttgtcggtatctttccaagatccatctacaaaacaacgatatccagaataattgttgtctaaagaaaaatgccgcactcgattacgatcttccaaattgaaagaaccaaattttttgttgtgaagctcaagttgagcagacttccacaagtctgactcttactctttttccgccaaatgtaagatctctagaggatctttatccacattatcaaagattttttcattccgtgctttccaaatataccaaattatccatggaaatgaagatgaatcaaattccaaaggtatgcgccaaaataaatgatccaaatttgcatatatagatgcataaggaaattttcctgggaccgtaggtatctgtgaaagtgcctaaatctgacgagcatgattgcataagaaaagcgtgtggttaatggtttcttctagagcaccacatctgctacatcctatctcacagtttattccgcgttttcgtagattgtccattactggtacacatcccgctaaaatttgctacaagaagtgacgtaacttgggcggacattgtactttccatgagaatgcttttaagactttgatgtctgggccaaaaaaagaaaagttagcatccaaagtttttaacctcgccgtatgatatccaaatttaactgtatattttccagattttgtgaaatgtcaacctaggatatcttccttagttgacgcacccaagtgcaaagcacttattaacgagacatcttccggatcaaaaagctcttgtaaaagatcaatattccagaaatttgtccgtgagtctataagatttttcaccttcaaagaaggatcaaaagcgtaaccattttttaatgctggtctcgggaattgaattggaatccacggatcctcccaaactgagatggattctccagaaccgactcttttaataagtcatttattaaccagagatctagctgagcaaatactcctccaaccatatgatggagagtatgattttatattatccaaagggttggatttcagaaaataacgtcatttaaaaaccctcgcaaagagtgaatctggaaccgtgattaaacgccataattgtttagttagaagagccgaattaaaatcgtcaacattatgaaaacccaaaccctcttccgatttactataacacaccttatcccatgccattcaatgcatacctctagattcaccatttgaactccaccagaattttgcgatcgcactcgtgagcttcgatgtgattgttttcggtagtctataacaagacataacataagttggtaatgccgtagctaccgatttaatcatcacctcttttcctcctttcgataaaaacttagctgaccatccatttatcctattttgtaatctatctctaacaaaagagaagatttttgttttagatccacctagactttctggtaaaccaagataggagcccataccaccaagattagtgattcccaatgttgcttttatttctgccttaagtgaatcatcgaccttatgaccaaactgtatcgaagactttgtaaaatttatttgttgtcctgaaaccgtttcataatgctttaaaatttccaaaattactccacactgctttttgctagctttgcaaaagaataaactatcatctacaaataacagatgagttaccaagaggcttgccgtaactactttcataccagtaatcaatttttgttgttaagaataatattaacttatttaaccttttttgtctttgttttttttttaatttctattaaatgtatgttctaaaaatataggtgattttgaacaaaaactgaatttcaccagctcatcttaaaacagtgacaccgccggtcgaaaccaccgtttttctgatcgtttcttttccaaatcattcggcaaaaattgaaagcgaacctttttcttttcttccttcctttcacctctttaatcataatcaaatcagtcaccaaaagccacagataaatcccaaattggtttcatcgattataagcaggaaaaaaattgatcctttagggcacactagtttcgtcatcttcttcttgtgggccttcttcttcttcttcttctacgacctttaaattgacttttctttactctaatggaatctccttttcctccctctacgccactcgtttcgaatcagagtttcaggtactcttctgggcaattccccaattttgctcttataatctcaattcgattcttggttagtttttgcttaatttccacaatcagacgaaattcaaaagctttacttatgggtttgatctcaattactacaaaagcttgtttgatttcgtcgttttgctcaaagatttgaactttctgtgttgcatcttcgatatgatcacttctagttacttatttggattagttcttcttctccagtgtcagggaatgttagagaaagtttaagcttgagtggtagaagttgaattgtgtttgaatttgataatg

SEQ ID NO: 2243 - DNA, 3000 bp, Unknown
  misc_feature (1)..( 3000): cDNA_ID_3066662_gDNA_ID_1620510_Annot_ID_159094 3000 nt of promoter + ATG
gtaggttttatctagaagaactctcacaactgaatcatctttgcaagatggtcttcgaaccctgacaagggaacgacgacgtagcttaatgtttgaatctctatctaagcttgaattacgagacagaaatgagcaggaagaactagagagaaatctgcattccgcagataatgcctcagtttctttacccggaaggcaaagtggggacagggaatggcgtattatgagatcagaatttggttcagacgaaaactcatctgtcagctcttcctcttgcccagttcgcaaatgcgttgatgaccatgtgaccaacatttatgactcgtttctacctatccttactcagttcgttgaggacggcttacctgtagcaagaacaaatgaggtacttaagatgatcaagcaagtcctagtggatctgaagaatgcgccttacaaaacaaggaaggctcgattgactttagattcagataactcaagttcattcccggagcagtttcttcccgcactaggcgatttgcttctcgctctttctttaaagagcgagagagacacaaacggtaaaagtgtcacaatatccgtagacgggaaactcactaaaactgctatagcattgccagttgcattggacgcgttaagggaacttgttgctgacctcagcaaataccaaaacttaaacaaagattcactgtcttttccacttgttaaacagaacagggtatgctctggttctgtcctcgcaagtggtgaagagcttccttctggcattgtaagtagtatcctattacaagtctcatcttaccatttaatcaaacttgttttggttattcctaaatatcatgcctcactcactgcctcaggcaaccgcagcttttgatggaatccaagagtccaaatgggaagaaccaaatggtgcaaaaggtatgaaatatagcctgatccaaaactatgatatttgttacatgttataatgcgaatctctcctcgcacaggctgttggatcgtgtacaaaacactctacaaccagatgcaccaactcatagcatacgaactcatgtctgctaatgatgccccagagagagaccccaaagattggtaatgtctgattcctattattcaagtctagacatacacaatcaatgctttaacactgtttgttgcctccaccaggattcttgaaggaagtaacgatggtggttcgacatggtgtgtcctagacaagcaaactagtcaggtattcgaggaacggttccaacgcaaatcctacaaaataactacacctggattccaagcaaatcttttcaggtatgttaaataacttttccctgatagaacacaaatgtgttttgaattgagtttgataagagtcttatcataagacagtcccatttgcttttcttgtttttcttatgggtcataatcatatctaatgtgtatgttgcaggttccggtttttaagtgtacgagacgtgaattcgacctcgagactacaactagggagcatcgatctgtacagaagtcaccagtgatttaatgatgcattcatgcacatcaaatgtataaatattccaaaaacatcaatttgttttgtcttcactttctgcacattgatgtattccgtattcgtgagggaattggcctttgctattgctatgaaacacctctgtcttagacagaggcttacagactcatggtcacagttgttatcaacgaataataagcctccacgtgtaacttaacctaaaggtccctagttcagtaaacatggaaagtgaacaagcgagcgacaacatcggcgccgcaaaaaaagtggaatgattactcttcctctgcgagacgacgatgaggaaaacgacacatacgaagctaaaatgctcctcataggcgagaatggtctcgacggtgagagtttacctcctactcctctgcgtgacggtgcactggagctccagaagtataacatcagctccatcgagtcaacagtcgtgattcgtgagctgacgtcacaaggtctctcctttcagctctggccagcggcttctactttcgtcacgttgcttgataactaccgacgtgaccctagcaagagtccactcaccgccacactcttgtcgctgaaaaaaccatcgccgttgaacatactcgagctcggatctggaaccggcctcgtcgggatcgctgcggcaatcactctctctgctaacgtcacggtgacggatctcccacacgtcttagataatctcaacttcaacgccgaagcaaacgctgaaattgttgagagattcggcgggaaagtcaacgtggcaccactacgatggggagaagctgatgacgtggaggttctaggtcagaacgttgacttgattctggcttcggacgtggtgtatcatgaccatctctacgagcctctcctcaaaacgctgcgtttgatgcagctagaggggaagaggttaattttcctgatggcgcatctaaggagatggaagaaagaatctgtcttcttcaaaaaagctcgaaagctcttcgatgttgacgttatccactctgatgttcctcaagaaagttctagaatcggtgttgtggtttaccgtttcaccacgaaacagccaaatcagaatggtcggattgtttcgtgttagcaatcgcgttgtcaggattcatttcctaaataaagtttgcaaaaatgtttgtcatgtctattcaattcaggtgttattaaatgatgaaccaatccatgcaaattaaatataagcattgaagactataaggccttacaaactatttggactcttttataaatgatcaaaaactataggtgataaagcaaataagtttttaaaaggggttgcgaccataaatagcttggggcctatttttgtgaatcgtacaattactaggactattttgtaaatacttaaaaactattggaacaaaagtatcagagtagaacttgtgacacacagtcacacagactttgactgaccagtgaagactacaatg

SEQ ID NO: 2244 - DNA, 3000 bp, Unknown
  misc_feature (1)..( 3000): cDNA_ID_2047812_gDNA_ID_1620510_Annot_ID_159086 3000 nt of promoter + ATG
ttacggatttgcccttacctcaagctgagtcatcagaagtcgtgaacacaacaccgacttctccaaactcaacctcagtctcatcttcctccaacgaagctgcaaatgataacaacagtggtaaagaagttactgttaaagatcaagaagaaggagatcaacaacaagagcaaaagggtactaagccacagtaagttattcattaaccctctattttaatattatttggtgttggatttttattaattattgtgagttttctttttaaaggttgaaggcaaagaagaagaatcaaaagaaagctagagaagctaggtttgcgtttctgacgaagagcgatattgataatcttgacgacggttataggtggagaaaatacggccaaaaagctgtcaaaaacagtccttatcccaggtataaatacatataactctgtatatacatatatattgcagccctagctagatccatttagaccatcagaccatgctcactatatatgcatgtgtttacatatactttatatgtaaagatatttatatgcatatctactttatatgcacatgtaagtatatttcgctagatcgggtttatccaatttatggatcatccacttctacatattgtacatatgcatgttcattcagatattgatatacataacacaccatatctgtagtcatatataatttttttatatatttaggtgtgtgtagagtagccctagattcagtgttctctatatatgcagagtctaatatgcatataacatgaccctattcaatcatatatatgtacactatatgttaatatagacgactgtatatacctaatacgcgtttttgtagggtcaaaaaaacgtttgaatttttgttttcgagaatatcttttctttggttccattccatgaggtttctatgttttgtgttattcttcccttgatttatgttgcttgtgtcggaagatttctgtttcatcttgttccaaacttcatctcagatctcgagatcttctgtatctctgtatatcttccatgtttcaaactaaaatagattagaaatttgttgaaaatgtattagtacttaatttatttatttttcctgaaaatacagaagctattaccgttgcaccacagtgggttgcggagtgaagaagagagtggagagatcctccgatgatccttcgatcgtcatgacaacctacgaaggtcagcatacccatcctttccccatgacgccacgtggacacatcggaatgctcacgtcaccaatcctagaccacggtgcaaccaccgcgtcatcatcatcattctccatccctcagccacgttacttgctgactcaacatcaccagccctacaacatgtacaacaacaactctctaagtatgatcaatagaagatcatccgatggcactttcgtaaatccaggtccatcatcatcattccccggctttggttatgatatgtctcaagcttctacttcaacttcttcttccattagagatcatggattgcttcaagatattcttccttcgcagatcagatccgatactattaacactcaaaccaatgaagagaataagaaatgaagaagttttttttcccggggcaattgtttttttctttaggccggatccggtaggtaggtttcatgaggagtttttggtcggtttaggtaaaccgatgttgatggctttctaatgtttttttcttcattacatttagcatcggttttgtttcatcaccacgaaataagcaatcgacgctaagttggaacagaggtttatgtagcatatgtgatataggtataacttcattttttgtttgagtattaataaagatgtatcgttaactttttatgacttcggagagagaagagtttaatctagttatatagtatgtatttagttgtattatagtgtttctagaccatctaatttgtaatcatgctatcactagcccggctcagaatcttacatttattttattttcatatatccatcctaatcgatgtagatttacataacatacagtatacacaaagatacttcgaggtttgttgctattcaatcatctatatgcttaccattgctcacaacaaatatattattctacaatcatgtatattccttatagttacatatattaacttgatcagtttttgtattatagtcatcaagatgcaatgccatcacacaaaacaaaatcttatatgacctaatgtgatccttggctagattagatataagatatttgaaagtaaattaatactttattggacgttcatatatattctcaattttcataactacagtaatttcacatcatactattcataagtaaacatatataccataacgacatctacatataacttttaaaatgataacaaaaagcctaaataagaaaaaaaaatatttcatatctatgaatcagtcatataggtgctaaaaatgttagctttatattctcatctttatataaagattcataaagagagaacttttagtcttaaactcaaagtctcctttatagttttcttcactgcgacttttatgttagtcttcaatcatcacaaataaaattcaaaaagactttcaggattaatgagcacactgtttatatctacatgcgtacttgacccacccattacttagttgtagtcttgtagatatggtcatatggaccatatttaatttttgacattatcaacatatcctttctttagttctccttttttcaagtattttaattacaagataaaaataaaatgaattggactgttatggtatgtaactatgtataattatacttcgttaaacttcattttaatgtaactcatcctttgacattagttaacacacacacacaaacacactaaagatatatcataaagttgatgtatggaggtatatatgcgtgcatatatgctttaggtctttttcaggaagccgatagctacgcaagtcatgtatggctgatattaaatataaaagtaa

SEQ ID NO: 2245 - DNA, 3000 bp, Unknown
  misc_feature (1)..( 3000): cDNA_ID_1442233_gDNA_ID_1620510_Annot_ID_159082 3000 nt of promoter + ATG
ctaggttcttaagccctttcaccttcccccacatagttgttaaccttttgtactcttccaacatctccatcacttctcttacaatcctccctgaccctcttgctatccgcattatccttgactcgttaaacacctttggatttgagctgtccagttctgcacaaccaccaatcagttattgctcaaaactactattacttttacagagaaactttctccaaagaagatattgctctcaccttcattagtcatagagtccatcattgtcatgtatcgctttatcttcgcctggctttctttctcatgtccctctggcatcatttcagcacgcattccaggtagcatggagaaaacctacaaaccaacaccgtattttcatatttttgtcttatcagcatcacgttgtgctctttagcttactaatatttgaccagagattctgacctccttaagtgggcccatgttcagcatgttctggaactggtcgtacataattctcaatgtaaatttaccatgagagagcatttccagaagttcaggctgttgatctttaggtaccacctcttgtagtttattcacgaatccagacatatcaccatttcctattgtacatatacattatcaagattctgagtcaactcctcacaatcagtcaatgccatgatatttacctaagagacggctgacaaacggtttagcatcaaaaacttcaaactcatccatatgctctcctgttccaatgaatatgacaggactttttgtagctgcaacactaacaagatggaaaatagatgagatccacttgcccaattggaaaagcttgcatgattttcatatcaccatttcgagtacatgacaactcagcagctacaagatacttacgcgctaagagtcccaccacccttggcatgaccatccatcttagtaataattacagctcccacagcaacagtttgtttaaatgctcgagcttgttcaaacgcagtttgaccaatactgctatccataacaaatataacaagatctggtttctgtaaagtgaaaaggcagcaattagcgcctccaacataattaaggaacaagaacagaagactttaagataagagagtaaaaccgttgcttcagaaatttgacgcatttcttcaaagagagaagcttgttgtttatggcgaccactggtgtcaacaataataagatcacaattttctttcttgaacctatcaactccctcaacagcaattttcacaggatcggatcctgtgtaactgcaaagaatcacaaatcagtattagcacattctgctatcacagtatgccctggctaatggtttcaatccataagagttttttattttatatatatttcgtcatgttattgacattgaagtaaaaccaaattgacaaattgcaaaatagaaacagaagataacacaagacctcaaaatatccatttatgtatactgtacaaatctatgaaaaagacgtgagatcccttgttacagtggcactgtaaaatgaataccgaaaaaagagcgcaaagaaaaaactggcaaaagggatttaaaggtaactggagagggatatattcagtaaccgtagtggcgtagtcctcgagtgtaaaccaaacaatttcataaatggtgtaccatggctctaccgtcaaaaataaaattacatcacttttgtacgtgagctaatatatttggaaatgcaagcaccaaaggtcttccaagcacgcaggaagaaagctaataactaagatataagattttttaacactgcaaaaagggttgatgtcagtaccttccataataggggatcttagatttggtggcattctgtttcagctgatcaaaagcacctgccctgaaagtatccgcacacactagagctggtttgtacccttttcttctgatgataataagcatacttggtacaagttgtggtttttccagcacctaacacacagtcaaaaagttttggacgattttaacaatgaatttacaactacacaaaagcatagcatcttacagagagatcagatacctcaccttgtaatccgacgaacataactacactaggtttggcctttttgggagcaaatgcagactttcctggatccaacatcttacagagttcactgaagatcgcctgaaagagaatcataagaacttaatcacaaaaaaaaaaaaacgtaaacctatttaatcgaaattagacatgcagaatctgcggtaaagcctaagacctgctcaatgatacgacgcttgttatggccggctgctagatcctcaaggttgacgattttcttaatattggtctgcatctccttcacaagggggaaagaaacatcggactggagcagagcacgagtgatctcgttcaagcaatcattcagagccttttcatcgattattgtcacattgttcatcttctgtatggcgctcataatccgacctccaagctccgccaacaccattttcgctgctctctgtattcttctacctcaaattaggttgatctatatatctgttgtcggattttggaagatctagcgagacgggagaagctgagtatctttttttttttttgggggtcaaacattgagtatcttagattcatttctatattctaaaaaattataaaccggttaggatcaaaacgatgggcttaacatagctccataggcccaatagtaagttgttcccctactgaattgaattagaaccaaataagtgctaaaccaatggtacaattttcaaaaaaattcatcgtgaatacggaaccggcctaattaatttacaaaaccgcgtccgtcttcaatagtaatgggcctgcgaggcctttttatccccttcttaaaaaacgacggcgttacactactctaattccgactacggacgccgtgtcggagtcgtcagattcgaaaaacatacaaaaccaagtcgaagcttttaaaaccctaaatccccaaatcgggaactgagattccgattcgaag

SEQ ID NO: 2246 - DNA, 3000 bp, Unknown
  misc_feature (1)..( 3000): cDNA_ID_2047816_gDNA_ID_1620510_Annot_ID_159085 3000 nt of promoter + ATG
acggtacatttaaccacaacgacaagaagttattaatctgactttgcttgttacgtaattgtgcatttcattttcatattgttttgatttattttgctttgctgattaaaataaaaaaaattatgacaacattttaaaatcatcattgattttgtttcactgcatttattatataccatttcacatacatatgaccatttgttcaactataagtatagggatggacattcagttatttgggtttccggtttcggttttttggtttatagaaaatagatccaattcggcttaatattataattcggttagtgcatatggaaacaaagttatattttggttatgtttttgacaaacaaatcataaatagcttactataactgattgtagttatagattgtagtcttgtagattattaataatataagctctttaatgaattttggctagtttggttgttttatatagttcgagcttggttcgattcaaaattgggttattcggtatagaatattttttcttccatttaaatcaaacataatttggatcgggttagagtagacttttggttcggattcgagaagtttggttcggcttgaaaatttgacctagctctaactataactatttgaatcgttttaaccaattcctaatttgccatagtatgtcgagtttttggtttgtaattttttttaaaaatgattccaaaaaaaaaatgaatagtcggattaatattataaattaacaaaataaatagaaatgatggtggaggcgtggaacaataaatagttaacgagatttgatgaccgatgacttgtcggagaagaagcaaactctctgctgacgtatgctttgtgtcagcttattttcgaagcttctttcttacgcgttattccttatttttaattgttttttcatttactttcctaaatttactgtttctcaatctattcaatttattagcttaaatttccactaattttgtctctttctgttggttttatctttccctcagagcacattttccatcttatactctctatctacatgaaagtatgtgctcacgctgtttccataaaggaatattaattttgtacagtataaaatccgttaaaagtttcacactaatgaatactactatcttctctcacattggaaaatgcgctaaaatataaaaggagttaataactgcgtgtttatcactagtgagtttgtaatagttattgtggtgattaatctaattatagttggtccttgatttaatcttaattaagaaaagagaaattaagtattgcaagtgtaatatgaaaagaatcggcgacaagacgttcaagtcaaaatagaattaggctaaataagtataaaattttacgtcaggagaggatcacgaaaaaaaatctttccccttaaaaaaacaattacaattgtattggaaaagacaagttgtcgttaaaagttaaaaatcaaacaaagccgcgaggagtttaaaattgaaaacgaaaaataaaacaaaaaagagtactgtaataatcagatgcgtcagacccacaccttttggtttcgtacgtgtcttcccttacgcgcctatcctcgtatcccttggtctcttaccgttttaaccggttatttctttgtactaatacgcgtaaaaaacaagagtcttgctaaaagatcatttgagttcatcaaattctgttacgttatttgaattgatacgaaaactatttaagaaattatgttctaaaattctaaataacctgtttatactatactttccataacatacaaaaatttgctcaaatactaagaaattctctcttagtaactatgtccagccatacttaggctatgaatgataaccaaaactgcatctaaaaccgtaccgcaacagtgctgtaacagtatcaaaatctctacatatacatatgtatttatgtattttcattactatttgaaccgcaccgcacttctcccgtaccgcaaaacgcagtcaccattcggagccttaatatttaatcggctttcatgctcaaacgttatgacgtaaaattttaaaaattcacaaaatgagactgtttattagtctcctcaactatactttagtttggcctgatgtctacaaattgtaatctagttaatagtaagattttgtttgtttaaattttttttatttttttttgcatatatggttgtgagttaaatgcccatatgatatctatcaaaagtatcttttctaatttcgccccctttacaattatgaaatatacaaaacgtatatatttttctgattatgatgaaatagttgaactattcgaaagctcataaacggtaacccatccatatatagcttatatcacacactaatcattggaaatagttaattttgctcacgttcatagtaaaaatgaaatgtaacaaaaaaaaaatgaaatgtaacgaacccgaattatatttggacaagaaaaagtcaagttagtattcaagaattagagaccaaattgtaacaaatgccgtttggagacacgacacaatgtgggaataaagaagaaaaaaaactgcaatgaagtgaagggacaaaaattaaatgctcggcagaggacggcaccgtcttgatccattcacaaccgtacgccacacacccctcaccggcgtttaccggtgaccagtgttttctttctttctattatattttaattccatttttattttatattcttttgcccgcgtaaatgagacgaaataataaataattattataaaaaaaaacaaatgggaaacctcctaaatccaagctgttttccagaagaacccaaaactccacaaaagttatattcacacctctctcttatctcaaaaatcttataaaccattacaaaataaaaaacatataatcacccagaaagctaaagaaaagttttccttttttcccctcacgaaatctcagagaagatgatatatatctataaaagtatcatctcatagattccatcttttctctattac

SEQ ID NO: 2247 - DNA, 3000 bp, Unknown
  misc_feature (1)..( 3000): cDNA_ID_3066688_gDNA_ID_1620511_Annot_ID_159114 3000 nt of promoter + ATG
tcaacagaaaaaaacataaataaaagggtattttatcaactttgacaaaaaaataagtaatttatctaatctagggtgaatataaaagtgaaaacgtaaaatactgtacgaccttgtactatccaaattaatttctactaactactatgtagtttatatgtactatttcacataacttgaaattatgtttgaataattggtaacatatttgatataactataattgatctgaggctgctatgtaaataagatatccccaatactttgcacgacgtttgattagaaagacactgaaaaagaattagtatatacttaattttatgggttttgtttgctagagacgttgaaagttaaactataatttctttagaattttcaaatccggattatttgttgtggccattcaaattcgaatttttagttgttatgtttcaaaaacgaaaataataacttgttttactttttaaaaaacaataaataataaaatccctaatttgtatatagatagacaaaaagtattaactgctacttctggaacaaaagtaaaaatgtaagggtcacgagtgagtgttttcgttgggcctcacgtgtctgtaaaacttgttttggttgctcagaccacttgtgaaccgtacagttataaacttataatcattccaccaatcccatttcagattcctattttacgttatatattcacaagtcttcttttttttctcccgtagctttatgttttggcttttgtttgcatcaaccttaccttgtgcaatttgttcttttgtctttaattaggtaaaacgagaactttggttataactatccatcagtttaccgttaacggtcaaaactttgtcaatgacagaatggtatatagtcattcgttgtcaacgaatatatgagaagttgttagaaggaattgaaatctttctatttacataaactttcgtatccagtataactcgaacgagaaaagtaattacaagcaggtttatacttataataataataataattcgttctagtgttttcattacagaagcaatatttggttgtattagaccacaagtatctatacccgaaacaaaagaaaacgagcgtcgttatgttgatgggtcaattatttaataattgatgaatatctctaacaataagctgatctgttagaaacttataataaagaagaccaataaatcaaataacaattaggaaaataaataaagaagtatgggcaacatgactagatgcttattattggccaatttggtaaagagtcgatcgatgctcgagacccgtgacaaccttctctgtctgtctcacagctttattaggtcttacgtttcatttttgaatttctttataactaaatctgtaaatgtttctatatagatattctaattgataaactaaatatacttctctctgtttatttatgggttatttatttgctcatagtgtcattgcctcgtctgaccacgaccttgttcgcgtggttttttcccatgcctatacattgatctaaccatatgtgcataaaattacttacaaaatatatgtatgctaataaagaggactgaaatcaagaatagtcttcaaaatttgcataaaacgtgtatttttgccatatcaaacgtttataattctcattcatgactaaaaatacagttggagggatccaatgtctaagtccataataaatctttcaactatactaaacggacatgaagtggttcatgtgtaaatactcttacatgccaccaaacttaattttaaaattccaccaactaaatatttttgtctagattataagaaacttttgattacaaaagtgtactccccaaggccccaaatgttttgtatgaaaaaattgttgtataatctgatcaataatatatctgcaaacatattaatataaaattgttaaaatgtttgaacaaggaattagtaaattagtataaaatgtcagaacttacaaaattgaagtagtttgttagctgtataatggcatgcaaagagtgagttatggtttaattaaatgtaatagtaagtccattaaaacaaaagagctaagattataacattttttaactagcgttagggattatgcggatgtagtggcggcggtggggcacgagtccaagcatggacatgactggaggctacggtaggtggtttcaacgatatataattaacaacaaatgagtctttaacgttgaaaaaaaattaacgacaaatgagtctttaacgttgaaaaagtttaacaggttgattgatgtgttgattagttaatattactgatatatttatgttatttgtagcacattaaaattgaggaaacacattaaaaccttcatgataaatagtcacaacagttatatgtattttctttataaataaaaaaaaatatttatttcactcacatttatcttaaaattagccattgttttttctctgtaatagatctatcgaacatagttgctaccgaatttttcattttatcgaagaccattttaaaaatattataatgaacgattctttgcataaccagcatatttatatataagttacgataaaattataattagacgttgtgcgcttcaaataatcatcatcactggtgttgcttgagtctttatattgacaaatgtgatcgtactgagaaaacgtaaaaataatgttgaagaaaggaaaaacaaactgacgcttttgaaaaagggaaaacaaactattaattttttaaatgttttcaacaaaaaaagttttttctttttcttttgagatatctcattttcgtaacctgtccagctagatcgttttatctctatcttattttatgttcataacaagagtctcttatcctttgtcatcaattttcgccgaaaagatctctataaataccatcattcactttctatcacatgaaaactaaaaaacacaaacatcacatgtatacacacatatagttacaaacacacatacacaaaacacagatatataaaaatg

SEQ ID NO: 2248 - DNA, 3000 bp, Unknown
  misc_feature (1)..( 3000): cDNA_ID_2025511_gDNA_ID_1620511_Annot_ID_159122 3000 nt of promoter + ATG
tacgcgtttagaatactccatgttgaaaaagatagaaaaatcttataattatcacattttcattaatctatgggcttgaatggtttaccgtataccagttcacgtggtcacgtttttaaaacgtgattccgctatttttacctttcaaaattttatcaagttttaacgttttcatgtttaaaaaaatgattccattatatagcactagcgtattaaaaattataactaagaaacgtgattaatctacaataactagttttttttagcaatttataatcattctacataaactttctttagttcatttcattcagctaaccattatttagttattctattgttcagctatccatctcacataccaatcaaacccatcaaaacgagaaaactctaaactaaggggtaaagacttgactggtacattagttgaataactgaacaatacaatagcggaatcaccaggacgacaaaattcaaaacggaataaacttaacacgccaaaaagctacttaataaatgactttgtctaaactagttagttatacatttaacacatgcgaaatagattggaaaatagcttattaattttcacggtttatcactccgtggttattattgtgaatggtatacactcggcaaaatcacgttttgaaacacatgaacatgcaaataagacacataccattcaagccctatattattttgaattattcataaaattgaaaaatttgacacaaaaaattgttatcgtgttaccaaagcaatttttatcggtaatactcaattatgaccagaacatatactacttccccactttttgcttcaattttgattacttcatcagttctgccatttacatgcaaggtaccaaaaaaactttttttttttctttcgggttaaccaccgaaaatcatataacgttaaatgaaaatgttgaaaacaataagatatgcaattgtatcagaattcagaaagtaatgagaagaaacaattcgatataaaaagattacaaaaactataaaatgaccaaagtaaaacacacactaatacacaaatctcatgtcttaaaggacgccattggttgtagagaaccacaactcaatttccacggtgtacgtctacaatctccaaccgctattcccgcgtttgcgttctgatcgtcgacacaatcgccaccaccactctgcgtcagcgttaaactcgtcgtagcaatcatattctctaaatcgctaacgtaactcgagagccaaatcttctccgatctaagacccgcgttctccgtttcgaccgagtcaagcctctgttttacagctcgacatctctcactgttctctttgattcgtcgttcaagactggagatctcatgaatcgtgtcttccattaacttctgtttcttcaaacgcgacctccttgcagattcgcggtttgataacttgcgttttcttttcttctcatctatgtcggaacctgaacttgtcttctctgcgtttgccatgtttttttgttcaagagataacgtaaaaccaatgaagaatcacaactgatatagaatgataaacaaggaattggttgagatttatcatttcataactctgtccattgtcttttcataactcaagaactcaagaatttcaagacaagaaaaaagaatttcaagaatctgtgattttgcgaggatcaagagaaattaaacaagaagatctttatttatgattacgtttgattttaagagaagagaagagattagttagaagagaaatagaacaaggaagaagataaggataagatcgaaaataaggaaagtgggagaagttgttcgttttaggttgctcttatttatagatttaacattataaaaaaaaatctcgaatttttacattagaaaagattatccaaattgtataagaaaggaagattcatcgaatgacgaatcggaaaagaaagagaattttagtcaaacatttttattttttacttttttggtttattgtttttattttattttatttttattaggacataacagctaaataggtgttggtgttgttccttaataggtgaccagtaattactatttttgctttttagcatttaaattgttgttttgttgtgcatttagttgtcacactcgtaggataattcaagaaatatcctacgaaaactagattctataaccttctaattatgtatatatacttgtccaaatttaattcatcgttttgtaagtccctttttctgcaactccagtaaaaatagagtatgattgtctaaaatcagtaaactggatcagttaatgtcagtgggtaatgcattagctgacataaacacgttccgatcattatttcttcttagttcggttttaactactaagcatttcaaaaagttacacaaccattttaaattttaaattgctaatgggacaaaaatacctcatttagaaagaatcatacgtacgtaaactatatcgtcaatgaaacacgaagttcttttggaattggacaggttaaacgtggagcaatgaccgactatttttagtgtttttaattttggggatttagagattacgcttaacatggttgacaattttattattaaagaaaattatccatgttgaaagcaaaattccatttgatattacttttgtgtgggtcttatctgaaatgattttagtaaactaaaagaaagagactgtatatattgataagccagccctgctttcttttcaaatgaaaatacaaaacaatagaagatgggcgataatttattaattaatataatacttgaaaatacacgatccttatctgctcaccgataaactatatatcattatttatttatcagataaataaaatacttcaatataattatttttcataaaaaaaaagtagatgcacttcattggttggctagttttagaaatttgtttaggttctacggaccttttgttcgggtctgagtcaatcttgatatttgaggttttgaacaaactagaaaaaaatg

SEQ ID NO: 2249 - DNA, 2528 bp, Unknown
  misc_feature (1)..( 2528): cDNA_ID_2047850_gDNA_ID_1620511_Annot_ID_159125 3000 nt of promoter + ATG
catcgctacgtaagaatacaccaaaaggagattggataaaatcccccctaggtgtatcagcaccacttgttgctgcatcctccctccggtcagcgaaagcagcatcaaagaaaccctgatcagattgatgactgtccccacttccaccctcaaggtttgcagcgttattatcacctgctcgcattttcgacttgaccttgttgcccaccttagatgcctgaaatgttgactacactagtcatacgacagtttacgaaaagatcagaatatgcaacctaattagactaaccaaatctgatatctttgaagctatagcaacttgtataggctgctgagaatcaaggccaagttttgatacaaccgcctctttcgagtcaagaccaagcttagatgcaacactactagtcacccgactaaagctcgtttcaccttcttgccccctccttgtcttagccggagagcctctcgggtcttgaaagagtgccgaatcatttgtgatacatatgatcccaataagacaaccatcatcatcataagaaggagacatcgtagtcacaactgaaaacctctctccagctttgttctttacaggaaactcaccagtccaactctctccactactgcaacgccgagtgatattctgtgcaaccgaagcatcctgaacatctacaagaatatcaatcggatccttccccagtgcttctgaagctgagaatccataaagcttctccgccattgagttcctggaattttgaatctgaatatcagttgggacatatcagctactacaaagacatacacattacaacgaaactataggaatcaaaatccacaatcccagaaatgttctaactagtactcaccaaaagataatttggccatttagatcgaagacatgaacagcttgagccatagactgcaaaatattcaaatactgtttatcggtgaacttgcctgccgattgcccctcgcctccgccgccggcaactttcgcatggctctccttacgcaacggagaagcgtgacgaaacgaagccgcaccggtttttctccacatcggagttccgtcgttactgtttctcctcacaggacgttgcggcgatgctgaatgcgaacgctgcttcatctccgccgatactttaagtctcgacatctctcgttttagatgctcttggctttcttctaactctcgtatcttctttagaagctcctccgctggtggagtcgtcttctccattgccagaaaaacgcagtcaaatcaaatcaacggagatcaaatctgagtttgaatcggagaagctgaatcaaggtgaaaatggtggagaagcttgagagatggattaaggaagaagaaacagaatctggagagagtcaacaaagaaggaaaactaatttgcttatctttctttgttttgattcctttttttctggttttaggtttctcagtttgtccttacttttttctttaatttttcaatttctgttttttgcttcttatagagtttttctttttcttcttcctaattcatgaataacgattaaagttgtttattatagtggggagattatgtaactaaataatctagattttttctaatttcaaacaaaagtgttttggattagtggtgtgataaatggtttgtttcaaattacttaagtttggctgcttgtttggtataagcaattttttattttttggtttttttcctctgaaagaccattaaaaaagaaaaagtgaagactttataaataaatttttaaaaaacagataagatggaaatataaattgctttattttagtcatttaggcagcctatattttgacccaaaataatgccttaatttttagataattcagtataataaattattaaaatatttataaagaagataaattgtaaaaaatggtgataaacaaacacaaaaatttcaacaaactatttattaaaaaaaatgtattttatactactaggagactaacaaaattctctaatcgaattaaaaataactccaaacacatattacgctcaataaattagaaatctcatatgtgatttagtgtagtgatatactttaaggagctatccttaaatacaagaccccacgcaattaattttgcatgcaacccatttccattaattactcaagaaaaaaaaagttatctttttttggcaagctctcaaatttaaagtctcccattggttggacttctttgtttgtttctattatgaccgtacaaaactacagtacaaaatcatcatcgatgtgaaactttttttgtcgttcatgttatttatttatttattttcttgttttttttttttatcgtctgaaaatttattatagagatttcgataaattacaaagccggcgattaacaactaaccctagaaatataagccgacgattaaaagataatctcggaaacaaagcctaaaggaaagggaagcaaacaaggcaaaacaaaccttacatacaaagaaaaaattttaaaactgaaacaaagaagcaaccaaaacaacccaatg

SEQ ID NO: 2250 - DNA, 3000 bp, Unknown
  misc_feature (1)..( 3000): cDNA_ID_2990508_gDNA_ID_1620511_Annot_ID_159124 3000 nt of promoter + ATG
agttatgaaatgataaatctcaaccaattccttgtttatcattctatatcagttgtgattcttcattggttttacgttatctcttgaacaaaaaaacatggcaaacgcagagaagacaagttcaggttccgacatagatgagaagaaaagaaaacgcaagttatcaaaccgcgaatctgcaaggaggtcgcgtttgaagaaacagaagttaatggaagacacgattcatgagatctccagtcttgaacgacgaatcaaagagaacagtgagagatgtcgagctgtaaaacagaggcttgactcggtcgaaacggagaacgcgggtcttagatcggagaagatttggctctcgagttacgttagcgatttagagaatatgattgctacgacgagtttaacgctgacgcagagtggtggtggcgattgtgtcgacgatcagaacgcaaacgcgggaatagcggttggagattgtagacgtacaccgtggaaattgagttgtggttctctacaaccaatggcgtcctttaagacatgagatttgtgtattagtgtgtgttttactttggtcattttatagtttttgtaatctttttatatcgaattgtttcttctcattactttctgaattctgatacaattgcatatcttattgttttcaacattttcatttaacgttatatgattttcggtggttaacccgaaagaaaaaaaaaaagtttttttggtaccttgcatgtaaatggcagaactgatgaagtaatcaaaattgaagcaaaaagtggggaagtagtatatgttctggtcataattgagtattaccgataaaaattgctttggtaacacgataacaattttttgtgtcaaatttttcaattttatgaataattcaaaataatatagggcttgaatggtatgtgtcttatttgcatgttcatgtgtttcaaaacgtgattttgccgagtgtataccattcacaataataaccacggagtgataaaccgtgaaaattaataagctattttccaatctatttcgcatgtgttaaatgtataactaactagtttagacaaagtcatttattaagtagctttttggcgtgttaagtttattccgttttgaattttgtcgtcctggtgattccgctattgtattgttcagttattcaactaatgtaccagtcaagtctttaccccttagtttagagttttctcgttttgatgggtttgattggtatgtgagatggatagctgaacaatagaataactaaataatggttagctgaatgaaatgaactaaagaaagtttatgtagaatgattataaattgctaaaaaaaactagttattgtagattaatcacgtttcttagttataatttttaatacgctagtgctatataatggaatcatttttttaaacatgaaaacgttaaaacttgataaaattttgaaaggtaaaaatagcggaatcacgttttaaaaacgtgaccacgtgaactggtatacggtaaaccattcaagcccatagattaatgaaaatgtgataattataagatttttctatctttttcaacatggagtattctaaacgcgtaggagtttaattgattttaagtgatttatttgtctataaatgttatatatatattcgatgtatagaacaatagatgaactatcataaaccataaaattcaatgatttcaaatatgatcgaggtgattttttagctctagtgatatgtctatcaatttcaagaaaaatcgcctccttaaactgaaacaattcgtagagcatatccgttctttgtaggagtatgaaatatgcaaccacaagtccacagcaatggtcaggaatgaaatatgcgaccacaagtccacagcaatggtcaggaaacctcacaacggcataagtttatcttcccgataattcttttcgctcagaaaatagaccatatgacaagtcacaaaacaaaaagtccgtaagacatagtcttagtatgataacgttctagatcaagcaagagaaagtgacataagtatgcatatattcgtgtagagctcatctatatatgcacaataaatctttatcactttacttcaatatatacgaacataagttttattgcacaattgattaaccactttcacttccataagaaagtataagccaaaaaaagagtcctcctctctttctatcattctctccaagtattcattagtcatgtttctttacatttatttatgtttgtgattaggaagaaattataacacgttctaacttttaaaatacttcaaaaacacattaaacaatgttttgatgaatgcgtgattcacaatcttcaaaaaatattgctgaatcttgaagacaaaacagcctattcattaacaccaccagcaaggacgacatgttaacgaccaaaattgcaataaaataaaacaaaagatgttacaaaaacaaatttgtaataaaaaaaaactgttaggtgtttctctttgtcaatgtaagatagagaaatcaattttgggtagaaagaagttgtgaactaactacctaccaataagccacatgactgtgagaagcttttgtttccctcccatttctctatattaatggtgcttcctctctaaaccattcctctctctttctctctaccaccatttattctctccttaatcactgactcgactcgggtcgtgaccaggtctgttctcttctaacaattcgtaactttttttcttagatctgtcttgattccgattcgtgtttttgataccaaagtttcgatatttacgaggagggttgcgtaaaaatcggaactttttttctttctcaatcccagattcgttaatggagtaatgagatctgtttgttagtgattatcgaattagtgtaatgttgcctaatttcgaattcgacattgagataggaacaatttatagcttgtggatctgatcattgtctctcttttgtttgttgtgattctcagttttttctatctgagct

SEQ ID NO: 2251 - DNA, 3000 bp, Unknown
  misc_feature (1)..( 3000): cDNA_ID_2047860_gDNA_ID_1620511_Annot_ID_159121 3000 nt of promoter + ATG
catttataatcttttaatgggttcaatatagataattgctgatccgacaattagtatattctcgtagttatcacgattcatgatgatgatgatgatgatgattacatcatccaatttgttagacaatttctatggatgacatctgataaacagagtgagaagtttgcttaacgcggaacatatatacactcaagtatttaaagaagatcacgcgcggcgattgattaagcgagaacgacgctacagtaaaccaaaaccaaatctagatctgtgcctctccggtcacggtgcttctcaccggtggccggagagggcttctccctcttctcctttcctctctcttatctcctctgcctctcctttgaagctccggtggtgttcaaatctggcttgctcttcgtctcttgttggtggtatgcggcgagtggtcacgcacggagcaaaggacgtgcggcgtgtctctctccgtttaaggcagtggctttgatgagacgactgtagcggttgtgcggctcctatcgacgggaccatcttccagatctgataaattggtggtgcatcgccatgtttcttcagacatcgtcgttcttctttgatttgggcacaacggtgagttttcggtgtggcagatcttctcttctcgggtctctctacctgttttttctccagctctggtgatggtgtgattgatccgacgggcttctcttgtggaggcaatccaaggagtcgtttggctcttgtggattgttcgtggtggttagtggcgttgtgggttttgtttggtggtcgacgtctctcctccattggtgggcagttgagggtggtagcctcttcggccatgggtatggattctctgtgtccattgggtttcgtcccttttgcttcatctctggtttgctttcaggtggagttttgttgttcatggtgttgtcggtgttggttcatttggtgaaggtgagcctttgggtgttatggctatgttcaccgagggttgaatagaggcggcggataggtctaagtggcatcactaactcaacgagttagtgtagaagtccgcggttgtctttacgtttttgcgttagttctttgagaatctgtaggcacctatctcgaggtttgtggacggatctcagatagttgagctcgtggcaacaacgatgaggattccaatacttcggtattgtggcaatcacgcaaatttccaagtttcgcggacttgaaatcggtgtttcccttcgcaacttagtcataattactcagctgcaatccgaagttttttgagtagtaatgttgtttttaattttctgtagtgtgctttaatccgttcttgtattttctgtaacttctgtcaaaaatcttaaaatggtataaaatttaactttttaccaaaaaaaaaaaaagtttgcttaacgcttacatatgacgtatctacgtggatgatttatgattacaagcttttgtagttacattttctttaattgttatttatcatatttttgttaattaataatgttggatcttttttttccaaactaataaaacttagcaatatgtagtatatatgccatatagaaatacatactccaaattattttcttttctggtgttaattttttttttttcgaaaaaaagagaaaagagttaagtctgtgttaattctttctctactaactttaaaagagagagatcatgttacaaagaatagagaacattgcgtaaatctctccatctcaaactcttcttagtttattattacaaagccactctacataattgggatgcaaacgacaacgttcatgtctatagatggatagaagataacatcatcgctcatatttagttaggcaaagtattttattatatagttgaaagagtctatttagagtccgacacgtgacaaattttctaaaatatgtaataaagttgcaacgcgtaacaacaaatcgattaaattttgacttatttaaaatattttatatgttattggagtgtacaagttttataatttttttttcttatattttatcttgttattttaataacattacaagctatgagattaaaaatgcagaaatcaatttacattttgttacttttcaaagtactaattaaacagagtaaaatattgataaaaatttgaaagttccataatcttttattttgcaggataccagtcaaaaatggtaagaatttatcatttcactacatagaataccaattcaaatatatagctcaaattcccccccccccccaaaaaaatatagctcaacataaagttcactacataaatccttattttctcaatatatcattttatataatttttgttcattactttacatggtataaattttatcgatttatattcaattaggtaatataatcttttatttttaataatatcatatttaaagcatgatgatacgcgatataattttttggataaaagtaaagacgcgatatgattattatgtgttcaacataatgtacataagataaaatttatttaaatctattaattttttttataaaatcaatttgaatgtgtatgtgacattgggacatcatctagtttattttgaaatatatgtaattaggtagtatgaaactcttttagacaataaaaggtagtatgaaactctttctgactttggtttttaaacaacccatatatgtctcttgtaaatttactttcaaggttggtttgaactcttatttcagtgcaactggttggtttttggttggttagattttgtttattaaatgtcggcccattagttagatggcaaaaaccatgggcttagtagaattctaatctataagtccaagcctctttttgataaaagaataaatagaaaaaaaatgtggctgctgggattcgagcccaggtctccacggccacaacgtggaattcttaccactaaactacagccactttgttggtttgaagcatcaagaaacaaatacaaaacaaaaactatctgatgataatgggccatg

SEQ ID NO: 2252 - DNA, 3000 bp, Unknown
  misc_feature (1)..( 3000): cDNA_ID_2047871_gDNA_ID_1620511_Annot_ID_159117 3000 nt of promoter + ATG
ctttcttctatgaaattgattacgacattactgtgccacgtcagcctcgcaatccaggtcaattcgtgtcaatccacacaaacaaataatttcttacaaaaatagtaatgaaaaggacgtaatcatgcatatctaatttatctacatcttatggtgattaatgatcgtatgtgtttctctgtttttttaattagactgaagaaatagaaagaaaaatatttgaaaaagtatactaacaagtccaattgtgttgaatagatctgaacaaccgataaagatgtagtcaaatataaaatcattacaaattttatatgaagagatcgcatctaatcatcctcgaaaccgacaattcaatcggttattaattataacaaaaataattacttcgaatctcaatccgaataattgatgcatcttatatattgatattgtggtggataaaataaacaaacaatcgcattaatgatgaacggctatacctctagacaaacttatacaagttggaagaaattgaagataattttggatcaaaaaaagtttgtggttttgcttggaggcattgccaactaacaatatctgtctccatgtatctctctattcatatcctcatatgcaattatgcatgtacatgtacgtatacattcatagatatgcagcatatgctctatattgtatagatctttagcccataagtttcctccacatgagactaaacgttgattttgataataaaagcgtaattcatctttcagaaaattattgaagcaataatactaattgaatttttgaaaatctagttagctatcaccacttatagagttatagtatatacttcaatattgtaattattatgacataaaattgtgttcattaaattggcaacgtaacgtgactttgatggaagaatgcgtcttcttgtttccaaccttccaatgatattagacagctctatctctatcttaacgactcattttctttctttggattgtatcaccctctatccacacaactcatctcatctaatcattttttatatatctgcatgaatcaaaatttcgaaaaacaatttcataacatttgcaaaaaaggaataataaaagaaatcacgtacatgtgttagtttatgtaacaaatatacaactttggtctccataaacaggaccattaattacaattgtttaacaaatcaagggaaaaaaaaactgtactgcgatcccttctaaatttactttcaaatgtgtaaaaatttatcacattgatgatcatcaaaatgcaatacttactataccaaacaagttaaatagtatgaatcttctgcttaacccgcttgtcttttaatcaggcatatctataaagtaatgtctttttctcactttaaattctatattagcaagctggaagttataatttaatacaattgtgtaagacaaaaaaatgatcaacagaagagataaggcaaaggatgggcccgaaacaagcctaatttgataacaaatctaaatttgatccatttcataagacttctaaacttttagccatctgggtaacatcatcagttgcagtgtcatactatcactcaaatccgatccgaagttatattcttctacacgatatgtcacaagtttgaaattaatgctccatatgatatttcaggactattataagttatcaagaacaattaagagaaagcgaaaagtagttagttaaccaataaaaaaataaaattaaagtagattgtaaaagtttaaaaaaaaaagagaggatcaaaacatgacgaggttattcaatcaagagcattcgagtaaaatattctagcaataatttgaaatcacattattattattgttatttttaaatccttagtcatattatttatgtgcctttttgccaattaagaaaataggtaaaaattgtcaaaaaaaatttttattgatatacggttaaaaacaggttaaaattccaaaaaaaaaaaacacaccacaaaactaattgaaatgagaaaacaactacaactaagaaagcaaaaactatagaagcaagtttaccacaatttcagcatactttcgaacggtatacaaacttcaaaagtgtgcagattgttgttggttctcctttgaagatttttatcaatcttcaaaagagagaaagaaaagcttggtgtttctagagatctcttcaagttcttgtgagaaaaggctcgaaaaattgtgacaaatgcatccaacaatttggttttagtccatgtaattattctcatattctccaaaggaaacagtcagtgcacacttgtgcacttccccttctctttgcaaacaacacaagaactggccaacagaagtgtaggctaacattctcctacacataaacaatacgggcaaaagcccaaacaaaaagaaagcccaataacttaaatgaaaagcccaatatgtaaacttggaatttttttgacatcagacttcatcaagtgacgaaaaaaacaaaattctaatttataaattttaaaccatttctgtagcaattaaataattaacgaaggttcacccaaacaaatcatattttaactaatttataataaggttttcttgaattaatattccttagttgcgccgacaaatacacgaaatgaaaatataagtttgttataaatttgacggattttaaattaattcgatgcataaaattttcctttttttttgcttaattttgtttttgttttcttctccagtcaaagaaaagctctttgcgcaacaaaataacagaaaacacagagacaagtgagagaaactactagagagaagaatgtcaagctttcttggttctacgttaatggaggtttcgagtttctgttgatttcttttcaacctcaagtaaacttcaaatctcctccgtctacttctgtatctcttcttcttcctccaaaaaccctgaatttcgctccctctgaccaccgtactgactttaccggctccattcggtgatctacggaggtgatagctagct

SEQ ID NO: 2253 - DNA, 3000 bp, Unknown
  misc_feature (1)..( 3000): cDNA_ID_2991329_gDNA_ID_1620511_Annot_ID_159119 3000 nt of promoter + ATG
ctattaatcatatagcaagaggtctggaggtttggttgattatgaggatgacgaagatgagctagagaagagtaaaagacagaagctcagttcaacaagtgaaggaaataagaacaccccagaacaaggtggtgaagctaaggaacctggagaactctaaggagctaatgacgatagcaatagtttagatgaagaaattgacagcaagcagatgtaaagagatgttgagattaacattcttgacaatagataggatttttgaagaatagaagaaactgtgtatagagggttaaaatgatgcttttgaagacaactcgatgatccgtgtaaatgactatgcaattgcattttgtaaatgaatcttgtgtgaaaatgaaattacaatttcttaaagagagacttggaggatttcatcatacacccgaggatttaagataatttcaggcaggtgtttctgtgtatatatatcagatttttttgaaacaggtaatgggttgtttttgtttgtagatgtcttgataatttccgtttctcttgatgtccacatttaccatttacctctaattgatatcatcaactcaagcgtttttacaaacaccaaaaagcgcctatttgcatcatacagtataattaaataattcaaagttcaaacgatgaaatttcacacatattcatattatttaattcaatttgatatatcttcatagagaaacaatttgtaattttaggaaaaaaaggaaataaaaaaggagtgaaggacttgagagaaaataagaaaagagtttgtgaataatcttttgtctttctctttcgtcttcctcgctctaacgccgccttctcacactctcaaattggctcatccattccaagcacgctccttcgatcttcctcttggtacgctcgtttctaattgtaagttttcttcaactcctattccaacgtttgtgtagatcttgtattcgagcaattagatcgataaaccctagtttctccgtggatattctagcaacttcccctagatttctccgtatataatcgtaaggatttagaaatcgaattatattgtgatgtttagttaacgaaaacccagtttattgaatcgtctccatcaagtagaatccctaatcttagatcccctgcttagggtttcgaaatttgtctattttgttcagctttatactgattctatttgtccaattttgaagatttgattctaagtctctagtatattctttgttatgcaatgcagaaacatgtctaattcaaaggacgagaaatcacaagatgcagctgatagaatcaaggctgcaacactcactgctgctaaaggtctaagccgtacacaagcggagagagcagcggctgcagcagcgagaaacgttaacgcttatggccagaaagaagaaggtccgagtagatggcaggagaaaagagaattaaagaggcagatgtatttgatgagtactgagaaagctgtcaggcttggtgaaaggaaagataaaacaatgtcagcttcagccgtgggaagcagtgcttcggcggcttcacagtgtcagaaatgtttccaagctgggcattggacttatgagtgtaagaatgaaagggtttatatctcgaggccttcgagaactcagcagcttaagaatcctaaactgagaacgaagccttctgttgatgatcttgatggtagtgatgatgatgatgaagaagaaaggcctgatgcaactaatgggaaagcagaagttgagaagcgatctaagaagagtaagcgaaagcataggtcaaagtctgattctgaaagtgatagtgaagcctctgtgtttgaaacagatagtgatggctcatctggagagagtagttcagaatacagttcatcgtcggactcagaggacgaaaggaggaggagaagaaaggccaagaagagcaagaagaagcaaaagcagaggaaagaaaggcgaagaaggtacagctcttcttcatcggagtcatctgagtcagaatcagcttcggactcagattctgatgaagatagaagcagaagaaagaagaagagcaagaggcacagcaacaagcgtcgttgaattggttttaggaaatcgataagtggatgaaaattttcatgccttagaatcattttaagcttcttaaaggaaactcactgctatgttacttctttttcttcaagttcgattttttctttttgtcagccatttatggctttatgttgtaacaaactgataaatctttagaatctcctcaagttttcatagctcaatagctccttggagaatgttgtaaacctaaacgaaatacctttgtgttgttatgatagagagattttagtgactgttggttatagcatgcatatattcgaaggatggaggaggttttttggcattcaatggaaattatctatgtactagatactctgtaacaaaaaaataataaccacatcaatccaatactaattggaaagtaatcagttcaaacaaaattaaaatcatcccctgaaacatacaaatatgtgtaataaagtcaagggcttcttttgtaaatatccgtaatttatcttccagaaatagttgcattaattatctctgtgactctgtccccagtctccttcctcacagactgatccctctctctcccaaagttgcattaagttttaaactagtacaaagtctaagcttggagcttccactttgtgttctccttgaaaagtttttaccttttttcaatctctgttgttgatacacctgtaaagctcatattgcacacaaagtgttcgataaaatgcctagccgaaacaaaaattgcatataactggtttgtttctcactctctatccctcaacttcttgaattttttttcgtaggaattctctagaggtgttatttaggaacataacggtttaatcgtctccatttcgttggtactttaatcataacagttttggttttgtgatcttcatttatagcttctgagaaaacaagtgaaagt

SEQ ID NO: 2254 - DNA, 3000 bp, Unknown
  misc_feature (1)..( 3000): cDNA_ID_2991329_gDNA_ID_1620511_Annot_ID_159118 3000 nt of promoter + ATG
aaataaggtctgatggttatagttgcacgtaacaattagcagaagaaaaataataaaaaatgtttctcacagagtaagtttttcttgccttgtattgatagttcttcgatacatatctgctagaatggttggtataagatccgtaattcttctttttattgaactacaatacatcttgatttctattaagagttctttgataaatttttcaatttcgcagcaaaggatcatttgggatattttctgtgagaagcatctacctgaattagttgatttcataatggcctcatgtcctgaaagacctggcgatacatctgaaggtgcattcgtaagagttggcagccatcgtggaacaaagccgggaatcctattgcgcatttgtgaattgctgtgctcttgcgttcagctggatccatccaggacaaagtaacctttatgatgattatcacattatttctgttttagtgtatcactacagtagccatctaatattcttgtgcatttacttctcttgtctgctacgtgcagttttctccataacagtgtgatagaaaaggttttgcttctcactcgaagaaaggaaaaaaccctagtggctgcagctgttcgatttgtccgcactctcctctctgtccatgtaagtaaagtagtcttcgatcagcattttttcttataggctcatctgtgcattctctcttgagaatgaattagacaattgattctataatggctagaaaatgttctcggatgacaataagtctttaggtaagttatgcaatttctaaaatattgttctatttcagaatgataatgtccagagttacattgttgagaacaacacgctgaaaccgattatcgaagtttttgttgctaatcgtcatcgggacaacctgatgactgctgctgtgttggagcttcttgagcacatacgcaaggttcctattatttcatccttttcttcactgtttctttggggtgttcctctgtacataatacatattactgttttgtgtgcaggaatatgcagtgttggtcaaatacgtaggtgatacattttgggaccagctagctccatttgagaacctgcgttccatcaaggatttgaaaacgaaatatgagaaggtatcattcttcgatctaacttctactttgaaaagttttcctaaactattctttgtttaacaatgtgtcaatgttgtcttagggaccaaagagcaccactgatgatgaatctgatatgagacaagatgggcgtgctctggatgaaaaaaagccagcttctgcttccagtacacagatggaagaagctgatccccataattccaatgccacagctgcaagttctgcttctagcacacagatggaagatgctgagccctataatcctgatgtcacagctgcaagttctacttgtagcacacagatggaagtagctgagccctataatcctggtgtcaccgctgcaagttctacttctagcacacagatggaagaagctgatccctataatcctgatgtcacagctgcaagttctacttctatcacaccgatggaagtagctgagccctataatcctgatgtcacagctgcaagttctacttctatcacaccgatggaagtagctgagccctataatcctggtgtcacagctgcaagttctgtttctccgaggtatttgtttctggtttctctcgatagaaattcattagaagcaacaaatatagttaatagatttgctttctgttttctattaatcatatagcaagaggtctggaggtttggttgattatgaggatgacgaagatgagctagagaagagtaaaagacagaagctcagttcaacaagtgaaggaaataagaacaccccagaacaaggtggtgaagctaaggaacctggagaactctaaggagctaatgacgatagcaatagtttagatgaagaaattgacagcaagcagatgtaaagagatgttgagattaacattcttgacaatagataggatttttgaagaatagaagaaactgtgtatagagggttaaaatgatgcttttgaagacaactcgatgatccgtgtaaatgactatgcaattgcattttgtaaatgaatcttgtgtgaaaatgaaattacaatttcttaaagagagacttggaggatttcatcatacacccgaggatttaagataatttcaggcaggtgtttctgtgtatatatatcagatttttttgaaacaggtaatgggttgtttttgtttgtagatgtcttgataatttccgtttctcttgatgtccacatttaccatttacctctaattgatatcatcaactcaagcgtttttacaaacaccaaaaagcgcctatttgcatcatacagtataattaaataattcaaagttcaaacgatgaaatttcacacatattcatattatttaattcaatttgatatatcttcatagagaaacaatttgtaattttaggaaaaaaaggaaataaaaaaggagtgaaggacttgagagaaaataagaaaagagtttgtgaataatcttttgtctttctctttcgtcttcctcgctctaacgccgccttctcacactctcaaattggctcatccattccaagcacgctccttcgatcttcctcttggtacgctcgtttctaattgtaagttttcttcaactcctattccaacgtttgtgtagatcttgtattcgagcaattagatcgataaaccctagtttctccgtggatattctagcaacttcccctagatttctccgtatataatcgtaaggatttagaaatcgaattatattgtgatgtttagttaacgaaaacccagtttattgaatcgtctccatcaagtagaatccctaatcttagatcccctgcttagggtttcgaaatttgtctattttgttcagctttatactgattctatttgtccaattttgaagatttgattctaagtctctagtatattctttgttatgcaatgcagaaac

SEQ ID NO: 2255 - DNA, 1845 bp, Unknown
  misc_feature (1)..( 1845): cDNA_ID_2153039_gDNA_ID_1620512_Annot_ID_159132 3000 nt of promoter + ATG
gatcaaaagaaaaaataataagccagaaatgtggttaaaaatgagtttcacaggaaaaatatgattaaaatggtataattttgctacatgcttatgataatgaaatatacaagtagacagaacttaagttgtacgtaaaaatatttgaccgaaaaagtaaagttgtagattttcgtcaagtctataacaaggatatagaattagagacaaaaaggaataaaatccattacagttgaatcatatgcatttccattttctaaattggaaactacattttattaaaatcttgactggtaaaaatattgactaaatttttagaatatacattttaaaaatgggaaaaatcttttataaccaaaacgtaaaataatttttgatatcaataagataggtaatattggtttaatcaatttatcatatatatatgagctggatatgaaatttaaattttaaacggacaaatctagtatatttgaacataataataaaagtaattttaagtatggtaaattttatcaaattatatatagataatttactttttaatcaataaataaattgctaatcctgataaaaaaatgtaaatttttataaaaataacatagttcgtacttcctctttttatcgaataacactgttatttcttcttttaacaataacaataaaatgccataaatcagactcaaaatgataaacaagtttagaataactaactatggtgtaattgtggaagataaacaaactgaacataaaatagtattggtggtagattaaacaataggcccaatggaagtttttcattaataatccaacaagtcgccagtttttttgcacttttaccttcaattttttttattaaaaagggcagggtttttcgatattgtaggattaatgtgtattgttttaaacatagagggtaaaatagcaaaatccagtaaacaaaaataagaaaacgcaaacgtcgggtgttttgaaacgagccaaacacagctttaacttgtgggctatatatatagctttgcacacataagaacaaaacataatgtggcttggcttatctcctcagcacaagtgtttcctctttactcttcaaatccttcttcattctcccattcacaattccttcatttttcatttttaacttatcctccatttttttttctgaaaacacacaaaaaaatatattcggttttagaattccaagaaatccgggaatgagcatatctctctagctagactcattccagcaaactctgaatcaatttcccattttcagatccaaatccattgtgttaaaaagaggtaaaatcactctacatttctcttattgttttttttaacaaatttgttcattggtctttgtgcttattagattgtcgaagaagataaaatagatttcgaaataaattcacaaccagaattttgaggtttattagaaagtagaagaagaaaggtcactgtagattgagtctaccattgttcatttgttctcatcttgacatcttcaatgtagcatctagagactccaaattaaataaataaaatattcaatattttggttttatgaaaaggtagaagaagaaaggtcactaataaattcgagtctactattgtactatctttttttttttttttcattgtactcatctttaatggtagacacgtattctgagagtagaatttaaatatctataatgaaaaaaattctttcttttcgtaatttattgagaatctaatccgatgtatttggtcaatgcaacttatttatctacattgcagggattaacaaaattgaatagttcttaacaaacaattagaagaaaaaaaaagaggagaaacaaaatg

SEQ ID NO: 2256 - DNA, 3000 bp, Unknown
  misc_feature (1)..( 3000): cDNA_ID_2153058_gDNA_ID_1620512_Annot_ID_159139 3000 nt of promoter + ATG
aaatgatttgttttgtgaatagttgattccagctaatgtggtgaaagacaatcatcttacgtttggtgattgtatcaactacattgatgaagaagggaacttagtaggacaaagagggaataagcagatgataggatttgcttcaaaggatgcatggcgacataatttgcagaaggattagacataataacatgaagatactgtcaagtatgagctccttcatgaacttaagtacgttcataattccacttgatccacaactttgggctattggtataaaaagctaactttatctagattacatgctacatctcaattcaagatgtccatttattaaagcaaaggcatgactttatcttcgactagaaactggtgatggaccatcctcaacctccactagcatcatctccacctactcctaaccactaacccaattatccttttcaccttttcctctcaacactatcctatttttaggtgatttagggaaaagagaaatactacactttgatgtaattttttttttaattgaattgagctttgaatactatggttaatatggatgaaagaaaacacacgttcctactaatttctttttctaaatgatgacgttttctcaagttacttatcgtagtctaatcggttattgacaaaaatgatctagacgtttgaaaatcattggccaacctcttcactagatagaatttttatttctaaccattacctacctgatacacacaccaagttctgaatctagagatgatcttgtctcatttgtttatagactaaagagtatataaaagctggattcatgtgggtcatccatcattaatcgtgttcttcaattcaccaacttcgtaggttccgcatcttttgtactttctttctatttttaatcttgcaatatcaaaaataaatatatacaccttttaaaaaaattctgaatatgcatatggtaatggtatcatcagaaaacattgaatattgaatcgtctatctaccaatctcttcaagttgtgaattttatttatcaaaaaaaaaaaaaaaatcaactgaaacgtcaatgttatgttttgcttcaatctaaagaaagttgtaccaaaaataaagtacttttttaccaagaaatttcggattgtagccaaaatatgtcttgttttattttttttgttcaccaaaaatatgttaaactagttttttgactttttcccccatgcgttgttgttgttattcggacgaccaatatttaatacagtattcaagtgtagctaagctactgattccagataaagtaaaaaaatgtctttgataccaacttcactttgaccaattatcgaactctttaatttcataatatatagctttgacaaatatcccatcagaattcataaatcgccacatgaatcttataattgtcaactatgtgcagtccaatattaatatcatggaaaactagattactagcatttaatttcttaattgtatttaggttatagacttaacatggtttttcttctagagcattttcactacatttttttctttctatgttattattttatgttttacttattgttacatccatttacaacgatgttggataaaatatttttaactgttcagtccgtaaatgactagctaaatttttacggatatatttttacataaaaaaagaaattatttttacgatttaccaatttaactcttctttctctctaagttttcatttattaaaaatgatagtttttttaagaaagttatttgtatttatttatttaaaattggatgcaaaaaattacaaaacttggaagaaatattgttaacccatctttatcagtatagaatttctgattactccctgcgttgaaaataagaagatccatagaacgtggtaatgtttttttttttttttttctggcaagaaatggtaatgttaatcaattagactcatgactaaagctggaaaatttgactaaaatggtattatcttgcattattacctaaaagctcttcttgcattactctttcatgcaaaattgcctccaaaagtcatacttcgaaatcatggctttgtaactcacccttgccaccatctatctaaacttattattgtttaaaacaaaattgattttcaaagaaaaaaaaaatataaactcccaccggtcaataacttttaattttcacttcaattattcataaaataaatatatacaccttgattctttcttaataactggagttattttgaatttaaattacttttgaaatacaaaagaaagtaagataattttgccatttaaaatgtctacaacaattatgttaacacttaacatacatttttagaaccaaatggtaatggtccactagttaaaagatttcttatgaatgtctttttatgcagagttcgaattttctcacaacgattttaaccattttcgtcactcgcaaaatttttagtggataacaaaaaaaaaaaaaagttgaaatttaatggaaatttaggagatttgtccaatttttaattttcccgattaatttaaaaaatctactttacgccttttattgacaaagatgcatattaactatatatatatatatatatatatatatatatatatatatatattataaactaaattttgtagaacccatcagaagaaatttgtacttttaactttaaaatcaattaaaaaatttcaattcaaataaaaaaaaatccaaaattgtttataaattcaagaaatataacacacaagttgacataaacagtggagagatttgtgaaatgtgaactcttttgacgtctttctcatatttcgtctcgggacaattcacacgcactgaatcatctctctcacgaggactattcagccatttgcaaacgcacacacaaacgcacacgcgtttatttttttttcgccaaatcaaatctgaagagttcctgtatcttttaaccgctcttcttcttcttcagagagcttcgttgattgaacggaaaaa

SEQ ID NO: 2257 - DNA, 3000 bp, Unknown
  misc_feature (1)..( 3000): cDNA_ID_3066718_gDNA_ID_1620512_Annot_ID_159142 3000 nt of promoter + ATG
aattttatgtcttaagggcgcttgcggacaaggttgcagcttctggattctatgttgtggttcctgattactttggtggagatccttataatccctctaaccaggacagacccatccctgtctggatcaaagaccatggctgtgttcgttcctcctcctctcctccttataataactgtcctatacattctcaacttctatttgaagttttgttaacaagtttgactcaatgtatgtgttattgttctgttattttgatagattccatctgaatcagttcatatcctcttttgtttttcaggataagggctttgaaaacacgaaaccagtacttgaaaccataaagaacaaaggcataactgccattggagccgcagggatgtgttggggtggtgagtttttgttagaaatctatgcctaagagatgtgacgctctctttttgtctaatggatagtacttttctctcttgtgttattcatcttcagcaaaagtagtggtggaactgtctaaagaagagcttattcaagcagctgtgttgcttcatccttcttttgtcaatgttgatgatatcaaaggttagtgactttgctacttccatcttgattcctcacatagaaccaaggaacattagttgtcatgccttgcctaatgcgttgtaacatttagagtcacctataggattgcgtaactgatctcgccatgattagatactatcattattactgtaaagaatactaattcacatttgcaaacataaaaaacactgtgattggtccggtttctttactttcaccggtctttgatgatccttatcaatttcacgggtttattgcaggtgggaaggctccaattgctatattaggagctgaaattgatcaaatgtccccaccagcactcttgaagcaatttgaggagattctatcttccaaacccgaggtaagctgctttatcaccgcaactcaacagtgtaatttaatcacctttatctaactttaaaacggatcctgtaggtgaatagttacgtgaagatacacccgaaagtgtcacacggatggacagttagatacaacatcgatgaaccagaggcggttaaagcagcagaagaagctcacaaggagatgcttgattggtttgtgacctacatcaaatgatttgagaaagaaagaaaggtattgtctattacttcatatatgcaaagaataaaaattaaagagagacaaagcaaaactcttggttggtgtttcaatttctactttctatagtcttttgaagcattctctgagattctgtgataccttttgttaatcattgttttatgatttttatatgttgacgatacgttacccttctcatcatcttcttgtggtaagcaaaaaaagttaccaaaacaaactttgattgaaatcaatgtcttcttcgactaaagaagtaaaaaagatattgtacatatatacagaaataatcaattcttcttcttcttgatgaatttgatagtcaaaacgcaaaattattgattgttgagacttgagaccttgagtaatttttttttttttgggtcaaatgagagtaatttataagagtcaaaatcattacatgaaaatgatttaagagagtttgtccacacacaaaaacctaaaaaaaagaaaactagtaattgacaaaattatacgataaatttattgtataagaaattgatccatatattatttatattgttgcttaaaaatcgtgcaaaaatgtggacagaaaaaaaaaacttgccaaaacaagaagatattgctcaagaaagtcactaggttctttagagaaatcaaataaaatctcaattcataatcaatgtagatttctcataattaaatttgtattacaaacttacaattatcaaaaacaaaatctgtaattacacaaaaaaaaaaaaggaaaatagaaacaaaaaaaaatccgcagaatatctccaaaaatcaattctactaacacaaaaacaataatactaataaatctatttttctattttcaaggaaaaggaaacaaacctttatagctcctctctatcgtctcgtctctataaataaacgagaagctcacaaattccacaaaaatccactctaactatgaaacaattagggttttgaaatttacctaaatctctccgtaatcatcgatcaaaacgatgctcgagtgtcaatcaatgatggagaaattatcaccgttcgtagacgtcgcctctctggaaatcgagtctctgcgaagaatcaaacgcccgaaacgcttctctgaagaagaatcagaagaaaccgagaatacgacgaattcatcaaacgcggtattcggattccctaacttaccagaagaaccgaatcgcgatatggatcaaagcgttttgtgcagaatctgcgttcgattaccagatgggagaagaatacagagaagtttcttaaagagtgaatctgttcagcttctttggtcgttttgttattcgcagattggtgatgaatcttctgagagaaagcggcgttttaaattgattcaagggtttcctggggattataagaatctttattttggatctaatactacttttgaacaatctgggcttgctaattccttggtttctgttacttggctctgaagaatcttctttcgatctgtaattagaaaaataatttctttcttctaccaagtttatgtttactcaatttctcgaatttgtacttggaaattgcaaatttcatttggttttcttgaatcgttgttagatatttccgatcaaatcgtttttagataacactgtttcaaagtcaatgtcgtcatcatcatacaagaagaacgtatagtttttggtttatctttttgttgcttcttaagtcactctttctcgcatagtttttgaggtgacgaagttacgtatacggtgacgtagcaaaccaagcccataagcccaaattctaaacaagcctaagacaagtgagcaaggagtgggtaaaccaaaccataccaaa

SEQ ID NO: 2258 - DNA, 3000 bp, Unknown
  misc_feature (1)..( 3000): cDNA_ID_2153103_gDNA_ID_1620512_Annot_ID_159157 3000 nt of promoter + ATG
gcaatattaattaaaaatgatgaacccaggttctttttccttaaaaaatgtaaaaacaagttgaaattgcaagttccttttaccatcaggttttttaggctcggatccaaaagatctgttatttgctcgttgtatatctgcaataaaagatgggaaagggaaccatgtatatcaagctttgataaatgaaaacatcataagcacaaaaactaaagttgaatccactcattaaacctcgagaaacgaacagcggcactggtactttagctgcctttcagcatgctttgcttgctcctgcaaacaaaaaaaatcaacttttgaatgttctgcctctctcacataatgaaacagactgaaaggaaacaacacgaagcatcacctcactgagacgggcgaagagcaattcaaagacacgtggagtcaaacctctttggtcaccactaaggtgctcttccaacaatccatttgcaggaccccacatggtatacgttttcccactgccagtctggtgaaaacaaatgttagaattacaatcatcttgagaaattgaaattcaatcccgtagaaacagattgagaaatgatgactacctgtccataggcaaaaacagaactgttaaatccagcaagacagttctcaacaagaggggctccaacaagctgaaagatctcatcctgcaaagaatacaaaaaagataaagacttgttagcctatataaatcataagataacattgtatagtgaaaccccaatcatgaaaactaaatgcctgcctgtgttgactccgggtcagcaatcgaatcgaatgtgaaagtctgttcattaatagtgagggcgtcgttggagatcttttttactatcatctcctcttcctcacctttgcttggaggcttcattcttactataacctacatatgcccaaagacttagagattagcttaaactttactcagaaaacataatatagtttctcttcaatttagtaactataaacttctaaaaatacaagcaatcatcttcattttgttaatttatagaaatctggaacttaattagaccaattaatccaagacattaggatttttccttcgaacattctccaatttctgagcaagaaaaacaaaaaataaaaagctcagactaccttgacaccagagtctgaaaccccaatcgctactccattatccgccgtagcttccgcaatcagcttccgtttaagaggattagacgacggaggacgcggaggcaatggacttttcaatttcgccggagaagatctatgatcaggaatcaacgagttcagatccggaggtggagcattctctttagaagatttaatcttcctttgtgacttcgatttcgtcaagctagggtttggcgattgtgactctccgatatcacgcaagatagcgttccttggcatcatgaaatgcttcatctctctgcgctaaccaattcgaagattccctaaagaagaattaaatctgcttctgcaacagtcagtgtttcgggcaaagtaacgaagaagaagggaagagagagagagagtttgagagtttgagagagagccgttaatggcgagaattttgaatttctagatcgagaacgcattcacatgtttattcatctattctccgttgatcgtgagatgatagatctaacggataagatcaaattagggcccatgattttgttcgaccgtttgagttatttattcttaggatatttttatcccacgtggcacgtgaggttttagattgtgttgggttgggcttataaacgaagcccaatgaaggtaaactccaaatttaaacagtcgattcaaatcatggttattgtgttgtattacaataataaccataattttgtagactacaaaaatatatcactttaattcataattgtattgaaatcatggttattatgttgaaatcatgcgaggctcgctcatgattcaaataatccttgacttagcgggtgacgtattcggttgctgtgtactcaaaagagtcatatcaatagctgaagatcgcttcaaaggttacttccttgacctaatcgcaaagaacgctctcttattaggaagttcattgatccaacatgtgcttaagctcgattttacacgaaaaatcacacatgaccacacttgcacgagataatggctaagtttgatgacattctctcgcgttccaacatagtagagctccataggattgcctccaagttggcatcagattctgatctttttatcgactttaccaaaaccatgcgaggctcactcatgcatgattcaaataatcctaggaaaatcagaagaagtcgacacaacattcttggaagcaattaagcaaaggctcaccgatattagaaccgataaattcggttatctcatcgtgttatatttcatacaagttttcaagaaaagaagaccttattctcaagtgaagtatgaaatccaaaaactaaatctctctccctttcaaaggaaacactgggaagtgggaaacacattggtccaacgagcgtattacggacaccatcgcatgtatgcttcaatggcattgcatcgagctttcgtatcataaacatgggagaaacgttgtggagaagcttctcggtgacggtaagtcggtggtggctttggggatcttctcgaaggagattgtgaagtgtgatgaagataagttggtgaaactggctaaagatgatcatgggagcaaagttttgaaaaattattttagaaaaaaaaaactcaagtttgagcttaggaatacaaatcagtaattagacttaccatttcaatttctacgatctcagttcgatcctaactaaaatgaaatgagtatagacacacaaaaatagaaatatttgatactcagtcaacgttagagttcctaaaaaataacgccaaagaattttgagatttttcaatttcttcattaaggaaaaaaaaaaaaaaaactcaaattctctgatctgatctaaaagcttccaacgaatg

SEQ ID NO: 2259 - DNA, 3000 bp, Unknown
  misc_feature (1)..( 3000): cDNA_ID_2153107_gDNA_ID_1620512_Annot_ID_159158 3000 nt of promoter + ATG
ttagtaaatcccattgcatatcaaggccacacttcagagacaacaataaaagatgcattcattttatagacaaaaaagtactacacaaaagatttagaatccaggcgttgcaactaatgcaaattgaactgcacaaccaaacttgaagaactaattcagagccttgcgcaccaacgatttataattacgtcgcagtaatacctgatcaagtgcagaagcaaaaaggtctagaacatgaccctgagtgactagttgctttgcgatgctatcataaaacttgacagccttcttatagtacggagcggcatctttatctaaatctttgtgagaacgcacaggatccgacaaatcctttgagacaatctgtacaaaagagattacaaatatgcttcatacacatggtgtgatcaaagctcacaatgccaacaatcatcaacatatacttaccgttccagggccttccgtacatggacctccgatcaaagctacaattctagccccagttccaggcaagcaagctccaagcaatcctgcagctacactcaatgccacgcctgtacatcgttgggaccgatgacctggcttaacaggccactgatcactttgtagctcatccaaaagctacataccaaacatcattcacacaaagatagaagaatcagatgaaaattttccgacttgacaatcaaaagcaaagtcactcaccgagttgagtgtgaattcgcactcggaagcaggcaacaagaatctattcaaaccagaactcgggaagccattttgaggtcctttagaacctcctctcctagaagaaccaccaagccccaactgatccaaaatctgatctttcgaaatctctttatctcctttaaaaacaaaaactttagacatctcagagaatcccaattcatgtacatgagcctgagtaccaaacgacacaaatccaaccaaagcattctccggaagcaacccaatcgcttgtttaagcgccgatttagcaaaatccaattcttcttcaatcatacaagtatcaagaacaaacacaaacaccggcggatccaccagaccttccccgttggctacaggcggaggaagagtgtattcaacagtagtgtactgaggataaagctcaccaggaagattagtctcagagatcacatgataatgaggcgggaaatgattacgctgataacaaaacggacagatccaaagctttgcggtgaaatcgacttgtgcgtaagcgtttaacgcagcggaacaagtccggcatcggagcggtgcgtaaggaagagtagggatatcggcatgtcgccggatcggagaaatgcaagcggcgagtgggatcacgcatttgctagcttcagctttggaatgaggccagacgttccatgtcatacgaactccatcgattccttctagatctgtattcgcagtctccgccattcgttggaagcttttagatcagatcagagaatttgagttttttttttttttttccttaatgaagaaattgaaaaatctcaaaattctttggcgttattttttaggaactctaacgttgactgagtatcaaatatttctatttttgtgtgtctatactcatttcattttagttaggatcgaactgagatcgtagaaattgaaatggtaagtctaattactgatttgtattcctaagctcaaacttgagttttttttttctaaaataatttttcaaaactttgctcccatgatcatctttagccagtttcaccaacttatcttcatcacacttcacaatctccttcgagaagatccccaaagccaccaccgacttaccgtcaccgagaagcttctccacaacgtttctcccatgtttatgatacgaaagctcgatgcaatgccattgaagcatacatgcgatggtgtccgtaatacgctcgttggaccaatgtgtttcccacttcccagtgtttcctttgaaagggagagagatttagtttttggatttcatacttcacttgagaataaggtcttcttttcttgaaaacttgtatgaaatataacacgatgagataaccgaatttatcggttctaatatcggtgagcctttgcttaattgcttccaagaatgttgtgtcgacttcttctgattttcctaggattatttgaatcatgcatgagtgagcctcgcatggttttggtaaagtcgataaaaagatcagaatctgatgccaacttggaggcaatcctatggagctctactatgttggaacgcgagagaatgtcatcaaacttagccattatctcgtgcaagtgtggtcatgtgtgatttttcgtgtaaaatcgagcttaagcacatgttggatcaatgaacttcctaataagagagcgttctttgcgattaggtcaaggaagtaacctttgaagcgatcttcagctattgatatgactcttttgagtacacagcaaccgaatacgtcacccgctaagtcaaggattatttgaatcatgagcgagcctcgcatgatttcaacataataaccatgatttcaatacaattatgaattaaagtgatatatttttgtagtctacaaaattatggttattattgtaatacaacacaataaccatgatttgaatcgactgtttaaatttggagtttaccttcattgggcttcgtttataagcccaacccaacacaatctaaaacctcacgtgccacgtgggataaaaatatcctaagaataaataactcaaacggtcgaacaaaatcatgggccctaatttgatcttatccgttagatctatcatctcacgatcaacggagaatagatgaataaacatgtgaatgcgttctcgatctagaaattcaaaattctcgccattaacggctctctctcaaactctcaaactctctctctctcttcccttcttcttcgttactttgcccgaaacactgactgttgcagaagcagatttaattcttctttagggaatcttcgaattggttagcgcagagag

SEQ ID NO: 2260 - DNA, 3000 bp, Unknown
  misc_feature (1)..( 3000): cDNA_ID_4359736_gDNA_ID_1620512_Annot_ID_159154 3000 nt of promoter + ATG
tggtcaacatattagcagtacaaaaaattttgatctgaccagagtcgcaagatattttagataataattgaagttcgagactaaaccgagttggactgtcccaattaacacccctagataatgaacacatctcaactaattgtcgggtctttggatcatgcgtttgtttaatcactttcacaagtaaagatgtgtaggacatagaaagaacttaaactaaacagttgtgtatctgttccttctacttcatttggttgatgtttcataatgcgacgcataaactaatataataatatatggatatgtaatcctcatgcagctgttacgcattggtgccggtagtggtcgggctattgagtaccattattttttaatattatgacagttttagcatttgagttgtactaatagtcttatataggtttaaaaaaaaaaagagtatattgtttttctaatctttgataatatttacttatacacaataaagttaatgccttgtaatccaataattgtagtcattcaataaagttataagtgcatccgtatactctatcaatcaatcacaagtcacacacgtacgtgtcacgtttaaaagtgtcaaacccaaattatagatacacaaaatactacatacataataataaatttcgtagacttttagggcaagtttagactttagcgggtaatagactatgagatcttaaggatattatgtcgttgaaatttgcaaagaaataataacacatttgtataattcaagtttaagagatttttacaaggccaactccaatgattacacagtacactattctccaatctttaaaaaatggcgaagattggtaaaaaaaactgagtaaacaaaaaaagtaagatcaaaactaacaagattaaaaaacgattaaaaaaagattaagagttatgagtaatcatcggaagaaagaagcatagtgatgcaaattctgatgatatgaagctttgctctttgttgcctcactgtcctcttcatcttctccaacctctctttcatcttttccatcaactgactcatcaattttccagatatgttggataccaacatggcaacacatcattatacacacgcatacctttatatacatgcaaacacttacacgtacgaacaaaggaagaagcgacaatcccacacctatacacttgagttcaacctccaacactacatatacaaagtgtccaccatgaaactctgtcggaatcctacgtgataaagatacttatgtgtgtgcttatgggttatatatgatttacaccatacagttttgtgtttgtgggtggatgtacaattatacatagaaaaagctagctaggtagttactaatcttatttatatatataaaagatgacgaaatgttttgcaatctttgacatcatcacttctttaaatgatatatcaataaataatcatactgtatattcttttatttttcttgttaataaggaagttctaggtcttgatcccactttttttttttgttaataagaaagttctaggtcttgatcccacttttttttttttttgttaatgagaaagttctaggtgtattttatcccaaaatctcattcgatttgggaccaacttttgctaatatcattagagcgaaaccattactttcaagtgagactcgaacttgggacaactttcctcctaaggcagttcttgaatccaagttaactatccctatttattttatttaataataaatgtgggatatgaaaataatatggattggcgcatggatggagagggtccacttgtaggttggagagtgaagcaagttcacgtgctgatcatcgtcatgcaactctttgaatatttgcataaatacacgttcttaaactcatcctccatgttctctcactctacttttgtcctcctccactaacttgtcatttcttaactttttcaattttggtttgattatctcaattaattaacattatctattgtaaatgtcttatcatctttttttcttcatgtaatgctatataatcagtattgtctacaatctacgttacaccttccatttttgtatgctattcacgttaatttgtaaactgaattagtatatcgattgagatacatataggtaaaatatggccaaggaaaataagaaatcatttaaccaaaaataatacaattatacgaataataaattaaataaatcataacaatgataacaaagagacaaaaaacaaaaactaaatagtgatagcaaaggacaactaccttttctgtttatgacttatcttcaacaattagcttcaatattggttttattagccctacaagctgtccgtttcatatcaaacatataatcttcttgtcttccaaaatctgcttttaaacagcactgcctctctaattaattaatctagcttcaccacaaatttcttttagttctggtaaagttttcatcaatataattattctatgtatatcacataatttatatttgattaattaaaagcatgtatttgcgtttaaattggggatattgtaatggactacaagtatgtgctaatttttaacattaaaacctaagaaaaaagaagatatactaattgatatgtatgagatcatataataatatatgatgggtcgtatcttgagaccaactagtaaatcaggaccattttagaattagaattatcttgctccgccattatatgcgaataatcacagtcgaaccatatgcattatatcctcagctaaaatttagtactaaaaggttcatgatttgcgaagctttgttcacttggagagctggagtatattatcataattctctttaacttagcttattggtgtttattacagtcgcattatctctaaccacatatgataatagagaacaacataacttctagtagtaattaagcactttttatcaaattaaaagttaacactacaaataaaataaaccattgaaaataaaatagagctaaagtgtcaacagttaatca

SEQ ID NO: 2261 - DNA, 3000 bp, Unknown
  misc_feature (1)..( 3000): cDNA_ID_3066720_gDNA_ID_1620512_Annot_ID_159140 3000 nt of promoter + ATG
gttgaacagacatgtttgatttatctatctttcttcgatgtacaggaacacactgttgaatatcttacaagattactatccccacccgttccagcagattattccagggctgaaaatcatttgattggttatgcctgcatgttgaatgttgttattgttgggataggatctgttgacagcattcaaattttctctttacatggcatggtatgtaaattgtacttccaagtttactagacttaatagtgaatttgctgaaagatgtaatgtacgattttgatggctactttttaggttccgcaacttgcttgctcactaatgccaatttgtgaagagtttggatcttacaccccgagtgtatcatggactcttccttctggagaagcaatatcagcatattctgttttctcaaatgcattcactcttcttttaaagctatggagattcaatcatcctcctattgagcatggtgtgggagatgttcccacagttggctcccaactcactcctgaacatcttctttcagtgcgtaattcttatcttgtttcgtcggagatccttgatagagaccgaaacagaaagagactttcagaagttgcaagggcagcatcttgccagcccgtgtttgtggactcgttccccaagctgaaagtctggtataggcagcaccaaagatgcatagcagccacattatctggacttacacatggatctcccgttcatcagacagttgaagcacttctcaacatgacgttcggaaaggtcagaggcagtcagactttaaatccagtaaattcgggcacaagcagttcatcaggagctgcaagtgaagatagcaatattagacctgagtttcctgcttgggatatcctcaaagccgttccatatgttgtcgatgctgctttaaccgcttgtactcatggaaggctttcgcctcgtcagttagctacaggtttgttttgttttgctggatcagattcctaattgtgttgtcatgtgcgataacatccgtctatatgacctttggcaactctgaatgccaatgagagatgtttgactgtgttgatcagttgttatatcagatgcatttcttacagtaaagtgaatttatttacagaataacaagtgtttttctttcagggctgaaagacttagcagattttctcccggcatcattagcaacgatagtaagctatttctcagctgaggtgagtagaggtgtttggaagccagtattcatgaacggcgtggattggccaagtccagctacaaatctatccactgttgaggaatatataacgaaaattcttgcaacaacaggcgtcgatatccctagccttgctccaggtaaaactattcaacgtgtttaaaatgccagtctgtttgtttggcttaccatctctgtagtctgtaccatcctctctttataataagctttttacctgtcctgatttgatgtgttaaagttaaagttgtcttttgaacttatggttgacttcttgctgtggtattgcaggagggagttctccggcaacgcttcctttacctctagccgcatttgttagtctaaccattacttacaaaattgacaaagcctcagagcggtttctcaacctggctggcccagctctggagtgcttggctgcaggctgcccttggccttgcatgcccattgtagcttcattatggacccaaaaggcgaaacgttggtttgacttccttgttttctctgcctctcgcaccgtcttccttcacaaccaagacgctgtgattcagctcctcagaaactgcttcagtgccactctgggtttgaatgctgcccccatgtcaaatgatggtggcgttggagctcttcttggccatggattcggctctcatttctatggagggatctctcctgtagcaccagggattctttatctccgtatgtatcgtgctctcagagatactgtctccgtatcggaagagattctctctctgctgatacattcggtggaggatatagcccagaacaggctctcaaaggagaagctggaaaagctgaagacagtgaagaacggatcaagatacggccaaagttctctagcaacagcaatgactcaagtgaagcttgctgcttcgctgagtgcctcgttggtatggctaaccggtggcttaggtgtggtccacgttctcatcaaagaaacgatcccatcttggtttctatcaactgacaaatcagaccgagaacaaggaccatcggatctagttgcagagctaagaggtcatgcccttgcctactttgtggtcctatgtggagcacttacttggggcgtggattcaagatcatctgcatccaaacgccgccgccaagcaatcttgggaagccacttggagttcatcgcgagtgccttagatgggaaaatatcagtgggatgtgaaacagcaacttggcgaacatatatttccggtttggtgagtctaatggtgagctgtttgccgctctgggtgacagagatcgatacagaagtgttaaagagtctaagcaatggactaagaaaatggggaaaagacgagctagcgattgtattactctccttgggaggtctcaaaacaatggattacgcagctgatttcatcattcatttgcgttcatagcttcttaaaaagttttgatcttctccagatttcagatagttgtttgatagatgtttttcttctagtgtttgcttccttgttgtgacttgtgttctctagctccagtgttgtgtgatgaaatcaatcacgcatatgtatagagagaaacagaaaaaaaaaaaaaaaaaaaaaaaaaaaaaatcttgtatagaaaatattagtgtactattctagaccgttagatggattagtgttctatttggaaccgttagatgactctccgttgattagttggtcacaagtcacaacaacatgttaaaagaaaacgaatgattgagtttggtttctttgtatcatctctctgtttttccgaagaactaacac

SEQ ID NO: 2262 - DNA, 3000 bp, Unknown
  misc_feature (1)..( 3000): cDNA_ID_2105183_gDNA_ID_1620512_Annot_ID_159137 3000 nt of promoter + ATG
tatgtttgtatctgattcgtgaaatcgaggactctgatgccataagattgaagaagtttccatctcacaaacatgcctcgtttatttcattgatctgattctgtttttttggaagagagtttgtttacaatttttatctgattctacagctcatctccagtactaggatccaattctagtcagattcatggttactcatcttcttgtttttttctgaaccatggttacttatcaactagaaccaacaaagacagataattatctgaaatatcaatacaagaatccatatttagaaaaaaaaattatttttaatcatcaaattaataattaaacagaagctggtgaaactaacaactatctgttaaacattagttgagaattgctaattttgtcaaggttttatgatttactaagaggtcgatttttcaaaaaacaaaaaaaatcgtaatgcagatgaattttaaagtagagctaattcattagtcatagagaaaaatcaatttagaaagatttatatagctgaatttggggatgtctttatttcaatatcaacaacataaataggcttaaggtccaaaggaacattaagatatttctagaacgtcttaagtttaactcaaactgatgtttctcagactgaaacgaaacagagaacactagccacaaacatgacaaagcaacataaattaaagaagatactactagttacatttattatttaaagagtactagacatgattttgggtctccgctggttatgtgcaaaccaaagcttagaccgtttcaagttctcacttgagatagtcgatgagccaagcgagcatgtccttgtgagcttccattgcagcttcaacttctgatggatcattttcattgtatctaacagtccaaccgtgtttgcatcttgggaatatcttcacaaaactcttcacctgaaacatatcactttgctcacaattatctacttgaagaagatatctacttccaaaaacacatcaactactagttgtgtttttgtaagtaatgaaaatattaccttgcataaagacatagagctaagcaaagtacctgaggtttagaagctaaaatatcttcgaactgcctcacaagttctggaggagacacttgatcgatttcagctcctaatacagcaattggaaggttgacctctgcttcaatcatatagtgagagtcataatcacaacaaatgagagagaactatcaagtaaggagtggccatatcaaagatctaaatacccttgatatcatccaccgtaacgcgagcaggatgtaacaaaacagtagcgtcaacaagcttttccttagctagttccaccgcaacttttgctaaagaataagaaacaaaaagtcttgtgttaactaatatacatggttgacttattatacagatcatggaaaacattttcataaaactgtggtgatgatgggaacaagaaaaccgaactcaccaccccaacagaaccctgctgctcctatactagttatgcctttgttcttcaaggcctccactattggctttgactcctcaaaccctttctcctacaaaatccatagtctggtttcagatacattgacacagaacagtacaaaaacactgacttaatcttagctttgcaatcaacaataagtagtgatagcattttggcactaataataagggattattgggatacttggactatttcatgctgggaaacaaagactcatttatgtttttgagaaaaattgaggattgaacatttaataaggaaaagaaactaactagttcatgatctttcatccaaataggaaacggacgatcctggttctcgggattataaggatctccatggaagaaatcaggaaccaccgcgtagaatccagcttctgcaaccttgtcagcaagtttcctatcaagggaagaacaatatccatgacaagttacagcaagaatgaaacatctttcgagtgactataaaaggtgatataaactataactcattataacaaagaatctgaagtaaaagactgtctaacaatcaacaaaagacaagctgattcagtagggattctctgttacagcacctcaggtttggagtttcatatcctgcagaagaaaacgttttagattctcaaatcaaaccaacaaattcagaaagaacatcaaacgtaattgggacaggtaaaaaggtttttttaccgaaaacatgagggacaagaagaacagcaagctttgaatgagtggaaccacagacgtaggtgtcaaggttaccgagtttctcgacatgacccgacccgctagttggatccagatcaggcgggttctcggtgcactgatgacctgacattcttgttttcgccgaaccaaaaaacaagacgactcctctctcgcgctttgggacctctgttttaaaaagtaaagccaccaaaccacctttgacctttcacaccagttatctacactacgtgtgcgtatctactcttccacctaaaaaaactcacgtgcgttaaataaaaactaacttttgcaatgttaatttttcttagaataaatttgctaaatggggtaataccttaccttgaatgattgaatgattctatgcacttatgcagagtaaaaaacaaaacccaacaatcaaagattattctaattcaattatcaattttatcataacaaacaaaaactcttttgacaaattatttatgtggcttcctctaattatctttaacttttttttgtttaattcacaatttatgtggtcagatattttttcttccttccacaaggtgttgccttgaaaatcacgtcggaagatcacgaggaatcgttttgcgtgcgccacccaaacagacaaaacaaaaacacttcttttgttggttccttgtcggtttccaagggtttttgtttagggttttcattttctttttccttatctatctaatcctctgtttctctccacatcaaaaaaaacctcaaaattaagagacgaattcgagata

SEQ ID NO: 2263 - DNA, 3000 bp, Unknown
  misc_feature (1)..( 3000): cDNA_ID_2153043_gDNA_ID_1620512_Annot_ID_159133 3000 nt of promoter + ATG
cttgagtttttcgtcttttcgagtttgtttaattaatgaaactttctgcagattctcattgctaacagagatacaaaatcaaatcttagtaagaaaaggtaaaagctttgaatttttctgcattaaggattggcatgcaagctttgtctcctaagcttttcaattctcgcaggggatggtggacaccgatgtttttaactgcgggtttagcatctgcaaagtattttctaaagcatgtctctaggcagaacactctaacacaagctcgtagaaacatttctcgtcactatgaccttgtatgtagcttgaggccctgagcctccatctctcttatatctctgtttcctttttgtttgagttcataatcaaattctctgtttggttaattcacagagcaacgagcttttcggtttcttcttggatgataccatgacttactcctctgcagtattcaaggtgaccatgaaatgtttttagggaatttttttttttttttttggtttctctgacttgactatgattctgacttcaaccattcacaatgatcatagtcggatgatgaggatctgagaactgcacagatgagaaaaatctcgcttctgattgataaggtaaagcattttcttgatttagaacaacaacttgtggttttttatctcttcttgaataaccgaagagggacatttcaggcgagaatagagaaggaccacgaggttttagagataggatgtggatggggaactttggccatagaagttgtgagaagaactggatgcaaatacaccgggattacgctatctattgaacagcttaaatatgctgaagaaaaagtgaaagaagctggacttcaggtttacataatccatttcttgatctgctttcttatctccaaggctatgtatgactaactatataacttctgaatgataggactggattacttttgagctccgcgattatcgccaactatctgatgctcagaaatatgacagaattatatcttggtaaagaaaactctcattttccctctgttaatatggctctgtagttaatctatcttataagatgacatttttgaacattttagcgagatgctagaagcggtcggacatgagttcatggagatgtttttcagtcgatgtgaagccgcacttgcagaaaatggcctaatagtcttgcaggtaatatatagctcttccttatttctcttccgagacattatcaaaacatttcataatcatttgagcctttttatgatgttttgactgtaacagttcatatcgatacccgaagagcgttacaatgagtacagactaagttcagatttcattaaagaatacatattccctggtggatgccttccttctttagccagagtcactacagccatgtcctcttcttctaggctatggtaaaaatgtttgtgtataaccttttccgcaatctctttgttaaatcaatctaacacttaagttaatacagcatcgaacatgttgagaacattgggattcattactaccaaacattgagattgtggaggaagaacttcttggcgagacagaagtaagataaaaaaaatatttaaagcatttcctctgtttttgttctgtttactcatattttcaacataactattattggtgcagacaaatcatggctcttggatttgatgacaaattcgtaaggacgtgggaatattattttgattattgcgcagctggattcaagactcttactcttggaaactaccaggtaataacattgacatagaccattaaaaataacgcatgattctttagtttcatgcaatcaaatgtgaggttttgacaactttgagtacaatacattgcagttggtgttctcgcgtccagggaacgtagctgcatttgcggattcatacagaggattcccttctgcttattgtgtcacctgagaggcatccacaacgtttgattgcttatatttttcgatctatacaatgtttgattgacctgaaatactagtattgattattgatttgtttggtgtgccaatttgtgaaagtttgttgaataaaagagagatttactttggaaaaaaataagcagtactcgtggagctttatgaccaattcatacactccatgcacaatcttgtatgcgaaacctttttgatattctatctgccaaaggattcactgtcaagtatttatctactccaatctttacaatagtagcattagttaactataaaattgccaaaagctatagctcacctaaagtatacagataatatatttgtgacttgatatttgttgacagcagtgatcaacaacaaaccatatatatagtagtaattaataatgaggagaagctcctctattaatttttgatgttctttaaaatactccttgatgaccaaaaaagagaatcaagggtattttatgattttcaaaagatttgtttttgcaaaaaattattgaccggagtaattattctgaaacaaaaaaaaatatatattttttctgccaaaagaaaaatattttaaaatattttttttgagattttctaattaaaaattcttcatagtagagaacatataataaaataaagttttgtttaaaaaaaaatagattttaagaatatagactcaaataaatgcgtcaataaatgtcaagaagtggcaaaaatgtaggtaacttacaaattttaaatcactaacagaaatctcaaaaaaataaaaacaataaacaaacaaaatccgttctaaaactttcttcttcttctctctttcccttcgtatcttcttcttcttcttcaacctctcgatctcactgatttttctcttcaacaactcgatcttcccttcctatttttcaattggggtcttgcaaacgaatatctgctttgaaattgaacgaaattatttagttttggtggtttttcttcgacttcaccaatctgttgaactcaaggagaatatatgagataacatcagtcttcatttctgtgagtttctata

SEQ ID NO: 2264 - DNA, 3000 bp, Unknown
  misc_feature (1)..( 3000): cDNA_ID_4359864_gDNA_ID_1620512_Annot_ID_159135 3000 nt of promoter + ATG
gaacccgcctgatctggatccaactagcgggtcgggtcatgtcgagaaactcggtaaccttgacacctacgtctgtggttccactcattcaaagcttgctgttcttcttgtccctcatgttttcggtaaaaaaacctttttacctgtcccaattacgtttgatgttctttctgaatttgttggtttgatttgagaatctaaaacgttttcttctgcaggatatgaaactccaaacctgaggtgctgtaacagagaatccctactgaatcagcttgtcttttgttgattgttagacagtcttttacttcagattctttgttataatgagttatagtttatatcaccttttatagtcactcgaaagatgtttcattcttgctgtaacttgtcatggatattgttcttcccttgataggaaacttgctgacaaggttgcagaagctggattctacgcggtggttcctgatttcttccatggagatccttataatcccgagaaccaggatcgtccgtttcctatttggatgaaagatcatgaactagttagtttcttttccttattaaatgttcaatcctcaatttttctcaaaaacataaatgagtctttgtttcccagcatgaaatagtccaagtatcccaataatcccttattattagtgccaaaatgctatcactacttattgttgattgcaaagctaagattaagtcagtgtttttgtactgttctgtgtcaatgtatctgaaaccagactatggattttgtaggagaaagggtttgaggagtcaaagccaatagtggaggccttgaagaacaaaggcataactagtataggagcagcagggttctgttggggtggtgagttcggttttcttgttcccatcatcaccacagttttatgaaaatgttttccatgatctgtataataagtcaaccatgtatattagttaacacaagactttttgtttcttattctttagcaaaagttgcggtggaactagctaaggaaaagcttgttgacgctactgttttgttacatcctgctcgcgttacggtggatgatatcaagggtatttagatctttgatatggccactccttacttgatagttctctctcatttgttgtgattatgactctcactatatgattgaagcagaggtcaaccttccaattgctgtattaggagctgaaatcgatcaagtgtctcctccagaacttgtgaggcagttcgaagatattttagcttctaaacctcaggtactttgcttagctctatgtctttatgcaaggtaatattttcattacttacaaaaacacaactagtagttgatgtgtttttggaagtagatatcttcttcaagtagataattgtgagcaaagtgatatgtttcaggtgaagagttttgtgaagatattcccaagatgcaaacacggttggactgttagatacaatgaaaatgatccatcagaagttgaagctgcaatggaagctcacaaggacatgctcgcttggctcatcgactatctcaagtgagaacttgaaacggtctaagctttggtttgcacataaccagcggagacccaaaatcatgtctagtactctttaaataataaatgtaactagtagtatcttctttaatttatgttgctttgtcatgtttgtggctagtgttctctgtttcgtttcagtctgagaaacatcagtttgagttaaacttaagacgttctagaaatatcttaatgttcctttggaccttaagcctatttatgttgttgatattgaaataaagacatccccaaattcagctatataaatctttctaaattgatttttctctatgactaatgaattagctctactttaaaattcatctgcattacgattttttttgttttttgaaaaatcgacctcttagtaaatcataaaaccttgacaaaattagcaattctcaactaatgtttaacagatagttgttagtttcaccagcttctgtttaattattaatttgatgattaaaaataatttttttttctaaatatggattcttgtattgatatttcagataattatctgtctttgttggttctagttgataagtaaccatggttcagaaaaaaacaagaagatgagtaaccatgaatctgactagaattggatcctagtactggagatgagctgtagaatcagataaaaattgtaaacaaactctcttccaaaaaaacagaatcagatcaatgaaataaacgaggcatgtttgtgagatggaaacttcttcaatcttatggcatcagagtcctcgatttcacgaatcagatacaaacataaatatttgctcagagggtaccatatctgaactctgagtttgagtatggaaaacgttcttaaatctaaaagttctcctatagatttggtaactaggtgacgacgtctttacgatactctctctaaatgtgactatacaactaatgaaaacttgtaaaaaaaaaaaaaaactcaaatacaaattttcattagttttacttttgtattttaataccaatcctatgcatgtcttgaaacaggtgaattgttgtaatatagaaatatttcttaattgatgaagttttgttattcacaattttaacgataagttaagtccaatgttcaaagtttcctgaggtggtaatcgggtggtcatgactcatgagctgcctgattatagtacattgcaaatttaattggttgactttttaagtcatcattttgttttaagattattgattctgatccaaaaataattagtctgaggatgtaataaattgaatcttttttggcataattaaaaaatgtatttatattgcattataatgtggcagtaaatggcagagaggcctcttgtgttggtatttaatatcctgtttctgcgtacatctcttatttaattcctcaccttgccaaatcacaattctcctcttcaagtcttaaccaaacccaaagtccttcaacaagaaaatccaatg

SEQ ID NO: 2265 - DNA, 3000 bp, Unknown
  misc_feature (1)..( 3000): cDNA_ID_3066726_gDNA_ID_1620512_Annot_ID_159134 3000 nt of promoter + ATG
caaaaccaattggtaattaatgaattatccaatgtcttttatatactactcaaatcttctctcatctttatgatgtgtgatcattctccacaagattaagtttgatcatacagttcatttaggcttttccatgtcctaaaggaggttatggccgttatgaatttacttaacacaaatctaataagttttccattatttagccatgaggcgatgctaggatgattagtaagcctattacataatcttattttcagatagagtttaacataattaggtgattgacttgaatagaatctacgaatgccatcaattgatttacttgacactgtttccatagaagtttaacataaaacagtgtcatgaaacttaagtagttgttatttggtgggctaaggaatagaatctaggattgtgcttaattaaacctcgttatgtcacatggttcgatctcatctattgttttgctatgttgaactttcgtgatacaaatctttctaattttgaactgaacttcaattcctaattaaactcgtttttttgtgtttcatttattcgttaatgttagtcgtcttttgtgtttcatttattcggtcatgttagtctttccctaatatagtgtaaattcctagtttaacaatagtttcactatagcacaatggttaaattcatcttgattgataactttcctaaatttgaaatccacaaaccaaattcattgcctatcaaaagaattcgtctctcatattcgatctgtggcataagaaaacttttttaaaaagaaatatgtaattatttgtgtaaaaatatatacagtgtaaattcattgcttatcaaaaacatccgttgtagtacaagggtttaattcatcttgattgctgtttctctagtttaatcgattgatcgctttctaggtttgaatcctggcagcggaaacttttttaatttatctgttgttatttgtgtaaatatatatacagtgtaaattcattgcttatcaaaagatccgctgtaacacaaggatttaatttatctcgattgttgtttctccggtttaattgattgatggctttccggatttgaaaagtttccgggatcgaatttcggcactagaaaactttttttagtttttttttgtaattatgggtttcaatagatagatatacaatatatagtttaaattcataatttataattctccccttacaaaagattaaaatttggattacatttgagaataaaggggagaagcaacatagcatgtagcggaatggatcaagctaaaagacgtttaagggagaacacaagtttatgagactcctagatctcacatcgttcaccctgacccacatcgaccttgtgatggtcccatgcaagaaaatggcaaatcacacgtcgattcttacatcgggcagaggtagatcaaagcgggaaagttgaagaatcatgcaagtatcagattggcctccacatcgacataggcaatgtcatcccacaaattttgaagtgccagcatggtttaaacttgtttttgaggatttttaatataagtttgagttttctctaatttgtatagagactcaagagccttgttctacatttcgttaatgaagatgtcatattttcatcaaactagtgaagattttctcatcttgatacatctcttctcttaaattatgtttatgcctccatttacctttgcttttttgcttctttagttcagtcttgttatcaaagttttgaagattaaactagctaggattaataatgaatacatcaatgatgttgattatgggagaatcttgctagattctttagtcaaaagaattggagttcttagactctcataggaagggaagatcttccccaccattccttacacgcaacgtgagttatctagaatttagcttctacctgctcttgagtcttagcaagtcaaagattagtagcagcagtgcagcacactattaacaattacatcaaccatcagcgtcagaagacaatttaaccagactaatattctctaaaatgttagccgtttattttgaattttttgatggccggaaactaactctttactacttgatggtagtagggttggcttacttggtgggagctacaatggttccgcagccggccccaactcttgaactctaggagttttttttgttcttccattatattgttttctttcttttttttcgaaaaaaactcttccattataatgtcggttttttttttatttggataatggcacaaccatatcattactgtaaaccaatccggtaaaaaaaaaatagaatttaaacaattataaataaaatttggtaatggtaggatcagccattatggtcatctttggacgtgggatcagccattgtaatgtctatagggcggcctaaagaaaaatcctcccaaaacctctaaataatattgagccggcagaaggaccaccacacttgcacacatcataatcagaagctaagtcctaaatatgtatatatatccacttgattcctaatatacatttttttttttgttaaaatacctaatatacataagaataagatgtatatacttacaagattttataaaaagaaactaaagatgatatatatatcaaatatatgtacataacacttgattcctaatccaagcactaattctggctttgtctacttggtgagtcatgattcatgagtgttaatattaaattcataaatgtgtctctgtgtcttaatattttagttctgtgtttaatattttcataaactatttttgcgtacctttcttattttatacttacttttctttttttccctcgtgtttgtgcatggagagtcgaaattggttggcttctcctctgacagagacaggccctttgaacatatccaattaaaaagctctccacttactccttatatagttcttcacctttacaaataaaaatttgtctagcttctcctactcttcgccagatccaaattccttgaagatacaatg

SEQ ID NO: 2266 - DNA, 3000 bp, Unknown
  misc_feature (1)..( 3000): cDNA_ID_2153020_gDNA_ID_1620513_Annot_ID_159190 3000 nt of promoter + ATG
atctaacatgaacttatcattcattatatttatcttatattactccaaataaccattagttatagccatattttcttaaccattcaagaacaataaagattcccgggattcttacatctctgagctctttatcgacgacaagtttaccgtcctttgtcatgaacttgcctcggctcatttccgaatcgacgatccccggtgctacaatggtaaccccaatatctgatccaaactcagttcttagtgtttcataaaaggcgatcacagcagctttactcgcctgaattcatcggcatgaaatgaaggtacaaaaatgaatgcttgagatcagatggttagtaaattaggagagggaaatggatacaaaatataatgttacacagtaaaagcttagtctaggtgaagcaatgtatccacatccagaagcaatcaccacaatccttcctctaaacttctttaggtatggagaagcaaaaaatgtgcaatacacagatccccaaaagttgatgtcctatgcaaagaaaaacaaaacttatcacaaacggttagtacaaaactatttttttagagagatctttggtcggagtaacttgaccatagccggcgaagccttagagacatcttcgatgtctgcaaaaaaatagagtggagcaactcctgcatttgtcactagatgatccactgcccaaattagaaacataaacaaaataagaaaaattaaaatcagcaatactattttagtttactcatattatcctccataatttttgaattgtcctacctaattatgttgcgattgatttagacgccaatttctatatttgtgtttacaaatgaaaaaaaaaaaaaaaatacctactagagcctaggtcatagtttcaattgcaaaaaagcaaaaaaaaaatacattatctgataaattgtcatgcaaacaaactacatttagaacgtaatttagtaattatacttattgacttacatcgtccaaaatgaagaaccgtggctcggataaaacgctcgcagtcttggagtttggaaacatcggctactaagggcaagacttcaggggagccatagagctcagcgagagccgctacatggaagagaggttctcctcttatgtcaacaagtgctaaatacgctcccctcttcccgtactcatacgctaaagcctatacacacactatcacacccacttttacataaccctaatcatcatttttgtttgtttgtttgttgacttacctcgccgatgccagaagctgctccggtgatgacaacaacttttccggcgacattttccgagaacagattccggcagatggagacggcggatttgagcctctggtaagttgggtagaagacaagaagtgcatacaaggttaagagaggaaacaagaagttgatgatcttgttgattgaatccatgcatcaaggactatacttcacaatggtttttcagttttccttgttctctccgctttcggagttttttgttttgctttattctggtggaagcttctcatgataatgtatgtggcaatcctacaagctgatatgcccacacgtgtttgcacaatctacaaacctcaattatatagtgtttttgttatggacgatatatacttgggttcaccatagtattaaacccttttattcacccgtctctttttctatctaatcaaaataaaccaatatgctatgtcatatagtcatatactcatattatatgtttaaaaataaatcaaaactaaaaaaaaaaaaaagcaaaataaattatgaaaataaaatatgtatttttaattaaagaaaattaaatattactttatgtttataaataagaatttaagttagtatttacaatcatttaattatatttaattataaatctaatcacattaataaaataaaatgaaattccttcaaatagtacaattttaagtttttaagacaaaaatagcattcatatttttttttgacataaataacattcagataactattttattttattattaaaattaacaattaaaaaaatacacatattcattaccaaaaattcctgacaattttttccgccaaaataagttttcgtcaaaaaatttcccgtaaaaaatatatgcccctattttctcgcaaaagaaaatccaggaagaattttacaaaatttaggaaggaatgtaagcaattacgaaggatttcatgaaattcaaaaatttctttttgttgtgtataactcttcataaattttatgatatctttcctgaattttatagattctttccgaaatttcgtaaaatcattcaaataataattttctaaaatttagaaaggattttacgaaattcaggaaagatttcacgaattgttttttgtgaaatcctttctgagttttgcaattatcttcttaaaaaccacatttcttcaaatcaaactatttacatttctaagagtgctcatgaattttctcacaactttttttttgtttttttgatgactttgtttttcttaagttcctagtccctccctactatgacttcctattttttttaagagtcacaatcgttattttaaagccaaaatcttttataatcactacttcaaatttcttgagtcatttacagccaataatcattcagtacttcaaatttcttggtaataggttcacaaggcggtttgagtctgactatcaatttccgccggaaccaaaaaacagagacaaaggaaaggttggaaaaagggacaaaaacggcagcgtttccatatcggtaaataacttcgaattaccctttttaacctttttttgcagttctcgagatctttctatcactgtaattgctttttagttttttcccaacttttcgaaaaaattagaaacaaaacaaaaaatcgattcttcgtcttcttcttccttcttcatcaatcatcattctctctctcttcttctcaattcaaaactttcgctctgtttccttttggtctctgcttcttttagtttta

SEQ ID NO: 2267 - DNA, 3000 bp, Unknown
  misc_feature (1)..( 3000): cDNA_ID_3066853_gDNA_ID_1620514_Annot_ID_159200 3000 nt of promoter + ATG
cattagtctcggtttcaatttccccaattcagtcacttttatggttgcagatggtggaaggacctagatcttgcatctaagttaccttacattagggatagacttgtagagagccatctcgggggtttggggccgtacttcgagccacactattctcttgggaggatcatagtggctaaaatcatcatgaccatggttgttgtggatgacacttatgatgcacatgcaactgtacccgaagttgcggttcttaccgaatgtttgcagaggtgcttgctatatttatgtgtttattcataaatatatgcctctttcttcttctttatttatttattcaatcgtgtaaaaatcttggcatgaccaggttgaatattggtgccgatgataaacttccggactatttacgaacagtcctcgaaagtgtgtttgaagttatgggagagattgaacaagaaatgagaccgaaaggacgatcatacggcgtgaaacaagtgttggaaagggtaatgtagccaaataagctgaatatgaagccaattaatgtatatgtatagttagtggaatctaattagttcttggattctaaaacacagttcaagaacgtagcaaaggcggacaaacagttaacagagtgggcacgaacgggcgacgtaccatcctttgatgagtacatgaaagttgggttggtgacagctgggatggatggttatgcaggatattgctttataggaatggaagatgtcagtgaaaaggaagcttttgagtggctcagttccaatcccctaatcatccaagcgctaaatgtaatgttccgtttagcaaatgacgtaggaacctacgaggtacacggcacattaaatatagggatgtctttggttttcttgtgatttttgtttttttagttctcatgaataaatgatatttgtagaccgagataaacagaggagaggtggctaatgggctcaactgttacatgaaacaatatggagtcaccaaagaagaagcatcccaagagttgcgtaaaatatacagcaacaacaaaaaagtggttatggaggagttcatgaactcacatgaccatgtgccacgccaggttctgctgcgatgcctcaactttgcacgcctcttcgatgtgatgtacacggagggtgatggatacagtgaacccaaaggcaaaatcgaacactttatgacctccttgtacgtccacccaatacccctttcataatgacgtgcaacacacaccaattctaagaagaaatttatgactctgttacctgcctcaagactgaatatctaaaatattcttaatttttaatttaatataaagtcattttgttgcatggttaactcgtaaaacttctaaccatgttgaatttgttcattcttaagctagctcacgttaagagtgtgcctctctatcttaagaccaatctccgtatctacacaggcctataccagatcagttgacccgatgtggttcttgttacaggacatgatcgtaaagacggttatgtcgtaactttgagggaatactcaatttaatgcacttaagacattgaacaggtcaggtgaccggttaactgaaaaacatgatagcttgtattctccataaatcaacttaaatgattgtatgactttgtccctcccatttttcccggttcacatatgggtccaacaataaccgaagataagattagtatattgttaagctctgtatagtaacgttaaaagcagttaaattaatggactagacgtattgagtatgagctgagatgcatcacatatagaagcagagatagagacgaacttgaagagtgtagctttagggattgtttttgtttttaacctctatttccaagttactaggaagcagaacgtaactatttaagatatggagaatccctgattaaagatgttgttaagaaattcaagtgaactgaaaaaacgctgacactaaaaagtcaatgggaacatctccttaaatagagatgaaagagatctctgcagcttcacatattcgtattgaagataagagactcaggatccacttttagcgcaaagcagataatcacaaagcatcacctttcttggagtaatacaaacgtgatcacaaagcatcactggattatatgtattatatatgtaaagctgcagagatcgaagtatgtgtccaaatcatcactaaagacagatgggcgatcgacgatatgataagggactacaactgtggtttgaatccaacaattaacctctcttgatttgtagattttcagctgttttcaatccaaagctgcacttgttgtaataatgatatttttcatttgaatataatttaacattacattaaaaaaaaaagactataccggcttagtgattttggttatatgaatatttaaaatatctgtggagatttagacggatttaaaatgatttgagataattttgcagaattactattagaaatcttagtatgtgattagtataaatttcaggacatttgatcataacatttttatatatgatcgatccattaataatagtctaataacttcaacaaatactatatccaataaggcatgatttcaatacatttcagaaaacaaaatcatcccaaaatcattaactcaattcgaatttgaattttgatggcgtcatggtgttctcgacatcgtgtttgtatattaacttccggatcttgcattataatttagttgaaaattaggacttaggagggaacacatttttcgaaaatacgaacgtgataaagtatcccacttttcccggattttcttgtatacataaatttccttaatattattactttttactttttacacaaaaatgtttagcttcctttgttaacttaacgggaataagagcagcagccggcagatatgaagtagtttttgaaatagaaacctaacctaataacagagtacttcaagtaaaacagaatagctatctctctctccctctcgacgactgtgataaaacatg

SEQ ID NO: 2268 - DNA, 1129 bp, Unknown
  misc_feature (1)..( 1129): cDNA_ID_2153283_gDNA_ID_1620514_Annot_ID_159229 3000 nt of promoter + ATG
cacaacggcttctttcgtagttagcttcagtttctcctccaacttccacaaggcttccattttttgctaaatttggggtcttttttagtagtctatcttgagagctaagtatataggtgaaattggtgagcttcatgtgaattccaccgttatagatttattcatcattatggtatttataacctatagtttctatatacccatcaataaaatctttcatctcaccttgttgattcattgtgttgggtatagatataagtggggtattaaatatatccgttgtagtcttcgtaacgcaaactatataaatttattgtgcatacgaaaaaaaattaaatgtaacatttgttattagtcgtatgattgtaacgttttgtatgattgtaaggttttggaaagttgtgtaaccttccgtattgtttttaagttgagagttaatcaggaaggtagtcaaaattttggttcaagattagcaaagaaatgaatgatcaaattgtaatcaggtaggtagtcaaattttgattaatttttttttaagatttgaggttacttgcatgatttgtagtatggaatctatatagcttgtagggacagaaggttttgatgagatcacgagccatacaatgtctattcatgttcttgttgggtggacctagtggaccttgtggtaccacaaattaaagatgaaggatcaaattgaaacatccaaaacattttggtgcaaattgaaactcaggtagtatcatggagatataatgtgtaaatacaaattactaaaaggagtaatttaaaatattactattagtaaacgaaacctccgctttatctacttttccggcgaattggaagggttttgatctccttgagcaaatcggagattctttctacagttgtgcgaacgttcttataataagtttttagttgatcgatctccgatttagtgaactaggcgtcatcttaagaaccctaatttgttttctccggttgtgaaaacttctgttgttcgtcgtcgaaggtcagttcgtgattctgagtttgtacaccttttcgtttcctctgttggcactcgaattttccaggaagtgaaactagaatttgattctgcgtagtattgaacattaagataatg

SEQ ID NO: 2269 - DNA, 3000 bp, Unknown
  misc_feature (1)..( 3000): cDNA_ID_3066787_gDNA_ID_1620514_Annot_ID_159226 3000 nt of promoter + ATG
ttattttagttgatgtaataggtgacacaaacttattagcgtaataattttgatagtgatgtgttttaaatattgaactataaattaggttcgttgattttagaaggccaccaaacaaaacaagaaaaagttctgcttggcagagatatttcggctcttataatttacaccactttagaataaatccaaaatcaaagaaaagttatgtttcatgtggtcgattttgtcatctctactgtcttgattgttttaaacggtaaaaatagtaagtgaaaacaaatagaaaaaccgtaatttatgatcattctagtggatttctgttggtttagtttttttttttttttgggtgtgtttgttgttagtatatattatcagttagatttacagttaagtgatgttttttattggtttgcactttgcagctagtaaccaaaaaatatatatactataaactaattttcaattattgaagttgcttaatccgaactagaagaactccaaaaaggtatataatctgaatctgatcaaggtcaacaaaccggagagtcatattttatgttcaaaatttttgtgatacttgttgatacttcagcggtgacatattatattgagcaactcccaaacgtatgggaacattttgtgatacccgagttatataaaccaaaaatgtaagactaaatcagccattttttgtgcagtgacgtcgagacaccgaggttcacgttttggtaatacaacctattaacaaatacaaaatataaaagagacaattggagaagtttattatttaaaaagggtcaccggaacgaagaaagcgtgatggaaaatgaaagttcaactttagcttaaatgttaaattattatcacttatttgacaccttgccttacatttttattaatatatacaatttgtgtggcttacgagttgagattctttttcatctataatatgtaaataagtctttttcatgcttttagctaatggaccgactttatatctcacccatatgtttacaaaaatctaaacttgaagaattaaattattcatccaataaacttatatcaaagtctttaatattaaacttataataaaccatgagttaacgtaattacgtcaacaatataggctaaaaatgtgaatggcgaagttaaaatatagtacattttagtccaaccctaacagaaaacttagtctcttcgttttttttattatcaaattaattaattactcaaatacagtataaacaatcgatcatttgcataaatttgaccttgacatcgataataattaattttcacaagtaatattatacttattttgttatttatttatgttacacttgaaagagagcccaacgaagacttgcaagtaagttacaattttatttaccttgagcttaacgttgtagcggcaacaacagtaactaaggaaggtcgcagatcacttgcggatgtcattatcctattttgacacttaatcactactatacattatacaagaaaaaaaaactaaaaactcttttatcatactattaaatttgcgacatgtgtatatacatatataacacatgtgaaattaatgttaacgatgattaggtaagttttactgctatgtaaacttgtcggatttattatgttatcttatctttatcaaatttattgaaccattaataatgacagagatcaatttaatatgttatcttatctttatcaaatttattgaattaccatttataatgacagagatcaagctaataacgacttaactgctctgagatctacacttttggtaaagttagatagaaaatcaaaattaccaataaatattacataatgtatttttaagaaaatagtggttgaatttttatgagtgaaataatttgagggtgacacctaaaaatattgaaattgcaacatagaaatattttaaatagtaaaaccggtccatcggtagttgcctcacaacgggtcaatttcaaaaagatcaccgacagtggacctaacaaaactatcaaccctcagagttttattaaattacgaaattgccatatcattcctcgtgacctgtaccccgtacccaataagtaccacgaaaattgctaaatttaggaaaatcacttcttcttctttttttttttgaagaaacaacaaaattagaatacacggaaattaaaaagaaatcacattgcttataaaaacatttctcatcttcagatttttattttcctatccgtcttttctccgatcgctggatcttgaagatctctagattttctcatctctctctgttcacggactctgtgtagatagagttcgtctgtttttcggagttcttgtgagaatctagggtttttttcttaaatctcgatcgggttttggtttctgtgatttttttttaaaatttgtgattcgaagaattgccattttctttgattagtcatattttttaattgcgatctctacatagagatcatcgaggggtttttaaattgaattttttgaaattgacgaagacgatagagttgttgagcggtattgatcttttggtgtgaagacgatagagtttaaatttgatttgaagaggatgcaaaaaactcaggagaagaaggttggttgcttcttattcatcggaggaccttatgattcctttgttcttgacatacgatttttgataatttatttgctaatgctatgtttcagaacatgaaagagatggagtttttcactgagtatggtgatgctaatcgttatcggattcttgaagttattgggaaaggaagctatggagttgtatgtgcagctattgatacacaaacaggagagaaagttgctattaagaagattaatgatgtttttgagcatgtctctgatgctcttcgtattctccgtgaggttaagcttctacggcttcttaggcaccctgatatagttgaaatcaaaagtatcatgcttccgccttctaagagggagtttaaagatatatatgttgtttttgagctc

SEQ ID NO: 2270 - DNA, 3000 bp, Unknown
  misc_feature (1)..( 3000): cDNA_ID_2153268_gDNA_ID_1620514_Annot_ID_159224 3000 nt of promoter + ATG
tggtgaagcaccaagcgacgatttgctgggaatacttcttgaatcgaatttgaggcaaacggaaggaaacggaatgagtaccgaggatctgatggaggagtgcaagttgttctatttcgccgggcaagagacaacatcagtacttctggtttggacaatggtgctgttaagccaacaccaagattggcaggctcgtgcacgagaagaagtgaagcaagtgtttggcgataaagaacctgatgcagaaggactcaaccagctcaaagttgtaagtaaaaccaaatcataaagctcttgctgacttttgctgtgttttgatggctgattcgatcccacgcagatgacgatgatattatatgaggtccttaggctatatcctccagtaacccagctgactcgagccattcacaaagagctgaagctaggcgatctgaccctaccaggcggtgttcagatcagtctacctattctgctagtccaacacgacatcgagctgtggggaaacgacgcagcagagttcaatcctgacagatttaaagatggtctttcaaaggcaacaaagagccaagtctccttctttccctttgcgtggggaccgaggatatgcataggccagaactttgccctgttagaggcaaaaatggcaatggcattgattctgcggaggttctcgtttgagatttctccttcctatgttcacgcaccatacacagtcatcaccattcacccacagttcggtgctcagcttatcatgcacaagctctaatcagacaacacatttgtgttgttgtcaaatatacaataaacttgttatacagagatgaatcgagatagatcataatacaaaactcaaatctttccttttatgttcaaatcagcactcgtgtcacacagattataacccttgaagcagtgattcccaaggaacaaatctctgttgtgaaactaaaacccaagataaaaggatcgaaatttacgactcgcccagtatttgttcttcataagccataaccaaacatgcaatgccaatcagacgagtcgattaccttttgaaattgtgctcaacagtgctcgcctaaaatcttagaatctcttgaaattttgaaacagagcaccaatagaaaaatcgataacaacattggagattccccaaaatcatcgcttcagaacgccctacggtttgactcgctaaacccccaccctccggaaccctaatttcagagaacaaatcgagagatcaacggcgagattcgcgacaaggttctgacagcgtttaagttcggactgaacgacaacgctgttaagtgttcgactgttggtttttactttttactctttccgtttatctaaacgacgtcgggtggtcctgcgcttgaggtgaaaattcaatttattggctttgggcttgaggtgaattcaattttattggtttgtgaaaacatgtttagatatgaccatgttttcaaaaaccaaaaaaactagacaaaaacatctcccagactattgcaatttttgacataaaactagtcttttctcaagttttatttggaaaaaaaaaaaactactttaatccatcggatctaaagtttctgattccaaatccggatagtttttctggttgggccttttgtaactggagagctacatgtaaagtttaatagccttcccatttgagagaattatagtattaaaattattatgtttttgttaaaaaaactactttcatattttcctctaaatataatgcacggtatataccctgacgtggatttcggcttttatttagtttcggctcgtgcggtgcaaggaaattcttctagtcatcatcagccaccaaaactggcttctcaattagggctcttggtcaatccttaaaagttctattgattttcatcgactacacttttttggcgaatttatgtgattgaagtggaatctaagattgaggttctttgtggtcttcggttctcgatacatcatcataaggtattgaaagttaattttcttattcttgttaggatttctaactaagataggtcaaaatataacctagatctctcgtatctctatctatatatacgtcacaaggtattgagaattcactcatagcttctgaatttcgcggtgtcgtgtttctgtctcatcatcggggttttgataaagatgtctcagtccaaagtagctatgaaaaaagattcgatgaggaagaataagaaattggttataaatattgctctagataaagaagttcttgcttcgagagtggaagctgatcatgatcttggttctgtaagagatgagaaagagaggcttgaatcatcagagagacgaagagaggtttgttccaaagctgaagatattgttgataaggccattgataatcattctagggttagaggagatgggattatgcgggaagctgatgtcgggacagggttatcgggcgcgttaaaccgtcttagagagcaaggaactttcaaggaggaaggcaaggttgttggtgttaaggacaataatcatgaagatgacagattcaaagatagatttaaggatatacagattcagagggtgaacaagtggggaaggataatgactgagaaagaagcgtatcggtcactgtgtcatggattccatgggaagggacctgggaagaagaagcaagagaaacagaggaagaagcatgaagataagtcaaaacagatggaatcttcagagagatctgtggaaagaataagagaaattcatgccatatccaagactccttacattgttctctagtcataaacttctctttgattacgataatctcaaagacatttaattaagaacttcataaatttggtattttgctttgatattcttaagagttcttggatgtttttacatcacataaaacattgcttttcacctatatatgttaccatttattttggtataatctaacgtttttgcattcttctttggaattatattttggttttattagggaaacgattttca

SEQ ID NO: 2271 - DNA, 3000 bp, Unknown
  misc_feature (1)..( 3000): cDNA_ID_3066793_gDNA_ID_1620514_Annot_ID_159222 3000 nt of promoter + ATG
tttatgttcctagaacttttagcaaattatctacctctatctttctctcttctttaagagaaaaaaaaatggagatatcagtttcttcggtaacattttcactagctgtagttgttgtgtcttggtgggtatggagaacgttaaagtgggtttggttcacaccaaagatgcttgagcgttccctgagaagacaaggtctttccggaacttcttacacgcctctaatcggcgattttaaaaagatgatcagcatgttcattgaggcaacatccaaacccatcaaaccaacagatgatatcacccctcgtgtcatgcctcatcccttgcaaatgctcaagactcatggtatccttccatagttcgcttcttgattcttctctgtttagaacttataacaaaactgttgcaaagtatctgatctatatataaacttttgtatctttattatgctcttggaacaggaaggactaacttaacatggtttggaccaataccaacaatcaccataatggatcctgagcaaatcaaggaagtgttcaacaaagtctatgacttccagaaggcgcatacgtttcctttaagcaaaatactaggcacgggactcgttagttatgatggcgataaatgggcgcaacaccgaagaatcatcaatccggctttccaccttgagaagatcaaggtttaaggctttatttctcagtcacatatcaagttgtattttttcatttggctcttctgacccaacttttgcgtggatctgcttctatctattatatatagaatatggtacatgtgttccacgaaagctgcagcgagcttgttggtgagtgggacaagttagtctcggataaagggtcctcatgtgaggtggacgtgtggcctgggcttacgagtatgactgcagatgtgatctcccgtactgcttttggtagcagctacagagaaggacacaggatatttgaactccaggcagaactagcacagctagtcatgcaagcttttcagaaattttttattcccggatatatgtaatgaaaaaactctacttgtctagctttaatatagtgcttttaaatctggattcttgatctttaacttttagtgctgcaatctattagagatatgacctgtgttgtcataatcatgtgcttattgtttgtgtagttatctcccaacaaagggtaatagaaggatgaaaacagcagccagagaaatccaagatatactgagagggatcattaacaaaagggaaagggcaagagaatctggagaagcaccaagcgaggatttgctaggtatacttcttgaatcaaacttggggcaaacggaagggaatggaatgagtaccgaggatatgatggaagaatgcaagttgttctatttggccgggcaagagacaacatcagtacttctggtttggacaatggttctgttgagccaacaccaagattggcaggctcgtgcacgagaggaagtgaagcaagtttttggcgataaacaacctgatacagaaggccttaaccaactcaaagttgtaagtataaaccaaattttttataaaacaaactttttcaaatgacttcactacttttgttgcattttgatgatttaagctgatccctcacagatgacgatgatattatatgaggtccttaggctttatcctcctgtagtccagctgacccgagccattcacaaagagatgaagctcggagatctgactttaccaggcggtgttcagatcagtctacctgttctgcttgtccatcgcgacacggagctgtggggaaacgatgcaggggagttcaagcctgagagattcaaagacggcctctcaaaagcaacaaagaaccaagtctccttctttccctttgcgtggggaccaaggatctgcattggccagaattttacattgcttgaggcaaagatggcaatgagtttgattctacagagattctccttcgagctttctccttcctatgttcacgcgccttacacaatcatcaccctttacccacagttcggagctcatcttatgctgcacaagctctaatcacataaccccttgttttgttatcaaataaactcattatctttttatgtatccaagtcagaactcgtgtcatagtttaataaaacccttcaagatgtgtcaaaccctggattgcaatataatcatcgactgttgcttgacacttcttttcaaacatcactaacaagagacaaactatgtctttattaactctgattcttcctccctaataattatgtgttgcaccaaaagatattagaccgaactcgtgtctctcaaactattatgaaaacttcccacattaacattaccaaaacacttggaattcatatctttatttgaaaagcaagacccgagatacagaaatgatcgaaatgaataatacagtctcacaacagaagaaactaaataaaacacttccagagatacagaacaaaaacaaagggaacagagagatatgtaacttttttttttattgaagtaaaatattataacaacccgttgaagaaatacagaacaaaaacaaagggaacagagagatttaaagtttactttttattttatgtcgacaaaacaaaatacttcaagttcaatgtttaggtaccaaaaaacccattgattggatggtggtggtaaatgacaaagacacgtcacaaagttgaagacgttcgtcccttgcccgccagtcaagttatgacttatgagagtcacataaccaatattaatatatctcctattttgtctacttttttttacagaagtccaaatttggttcttgcgccttcgtggcacgcaaaatatcgattacttcaaaagaattatatcaacacaaacactataaagtatataagacatcatcggtgatgtcatcaccacatccatatcttttccaaagttttcaaccttttattccccgaaattttttagcaaattctctacctctatctctctcttctctgggaggaaaa

SEQ ID NO: 2272 - DNA, 3000 bp, Unknown
  misc_feature (1)..( 3000): cDNA_ID_3066797_gDNA_ID_1620514_Annot_ID_159221 3000 nt of promoter + ATG
gagagttattttccctcctggtgtattcatcaacaagttgtacgctcgatctttccatataaaatatataatcaccttctccaccattgtatcctacaaaatcaatacaaaaacctctatcagatatactagttatactacaattctgggtaacacaagtataactagttatactacacatatctgtataatacagttataactaataatagtacatgtaaatgggtaatactactgtacctaagaaatactacatgtaaatggttaatactagtgcaactaagtcatactacatacatctggataaaactagagctacgggtaatactacatatatatttttcaattgaatcatgtgcaattctactcagttctaccagttgtatttcccgacaataactcaaatcgcatggtttcgggttcaaaactacaattcactctgattcagttgttgtaatccatttcttacccattttacagatctattcaacccaggcagtatgcataaacttccaatgtgcatacccaaacacaatttgcttaatctcaaatctaattgacaacaatctcctagttttctaggttcaaaacttcaatattaagctctatgcagctcgagtaagataccttttctttctatctcgacgcaactcgtcggagggagaggatacgacaacaatggcgactgaaatcaaatttcgatgatgagagcgatgagagctcgagcgagaagaagctgagaggagagagagaggagaggcaagagagagtcgagagagagtcgagagattttttttttcctgttttattttttttttcttttcaaaaactaaataatttaaaaatgaataaaataaagaaggagagggtaaattcgtcaactcacaattcattaatagagtgggggatatgaagacaaaaataggatacaagaggttagtgtttggcaaaaaaggagttataagattatttctcttataatttagactgaacgacgccgttcgaatagtttttttaatcattgtttttttccgttccaaactatgtcgtttgatcaaactcaatttgtgctaccaattattaatttgtgtcatacttatgctaagaccatgctaatcttcttcttttttcttttttgaagctaatgtactcggaggaacaatcgatatatccacttcaaaactgaagctatttctaggtgatttaagatttttaacatcgttaatgagtatttcatgggaagttcactataaattataaagtaaccctataattatggttattggtgagttaattatattcagtagcactttaaaaagaaatgtacgttcagtccagaacaattacagcttacgatcgaaatctgaaatcaaatcactctaactttaaaaaaaaaaaaaaaccttaaatgtgtaggtttttcttttggaatgaaaaagaataatccttgcgtaataagatagcaattgattgaaaaacaaaatagctcatgtcggcctatacactataatattctagacacgtccctttctgttggttgttaactaaaatagctcatggcggctattacaaaatgcaccacttgagatgactatgaaggtacaacaaaataaatatttgtcatatgtgagagcaaactaattggaaaaacaggatgagattgagatcataacaaatgagcaatactaaaatacactaaaccaggtttagtaaaccttatgtccttatcagagttttacgccattttatatagtttgtgtttttgagggagttgtatattatttctgacgttggagggatttagtagttttacttttcttttctttttttttgtcgttttacttttttttttgatatttctttatttcacgtttctatttaacttagagttttttttatatatttatgtttttagtttcttctctacatatataaaaattcttaagttatttgtaagatacgttttattatctaattaataaaagtaaagagttttttttctctaattggtagaatttcaagaatttcaatcctttcaagttcgacagtttgacataatacttgttattcctatcatagacataatgcttgttattcctagatattctaaatgtgtcaatttctcaaaacattgtaattctcaaatttaaatatgaaagtttttagttatttttcttttttgaaaaaaaactcttacggtgatcatcgacaattttgttacgatgatcgtaaaacaatattgttacgatgatcgacagtttttattcattatgatatattttagatattaataagaagcatatcctaagatctaagttaagaaaaatttagatattttatgtgattatttatcagttttaaatgaatatgttaaatttactttaatcagtgtttgtttagctaatgtgctgagaccggagagtgctaagatacaaggtctaaaagtaaaaaaataaaatatatagatattaatttatttttaataatagatattttaggtttttgtatatataacagcatttggtctataaaatatatgagcagggcctgactttaatgcaaaaacaacagtagcctatgtacatgtacaaaaaagtcgttttagtcaaatgtgaaaatcaaatgattttgtaattatttttgttttaaagaaatgtcaaaaagttgaagacgttcatgtcagagcatctttactggtgatatatccaatatggatgtctaaaacattttttatagttaacttattatatatttttttgtttggtcaacattatattatattttaatacgagtaactaagaaacaggatggagttaggcgagatgtcaaattttgtttattacggcttcgtggcaagggactgtgaaccacgacatcaggggtgatgtaatcaactaatcaccgcatccatatcttctccaaaagtttcaactttatgttcctagaacttttagcaaattatctacctctatctttctctcttctttaagagaaaaaaaa

SEQ ID NO: 2273 - DNA, 3000 bp, Unknown
  misc_feature (1)..( 3000): cDNA_ID_3066812_gDNA_ID_1620514_Annot_ID_159216 3000 nt of promoter + ATG
cctcttttcgtcgcttttcacacaaagtccaaatatgcttctgcgctttggtggcatgtgactgtgagggtccaagtaaagcaaaagatcaattaagcacaacaaaataattgtccaaaccaccaaaatataaaatataaaataatttgtgaccatcatcaccacatccatatcttctccgatattctaaaccctgagaatggtcacaaattctctaactctctctctctctctctagtagaaaacatggagatatcagttgcatcggtaacagtttctgtagctgtagttgttgtgtcgtggtgggtatggagaactttacagtgggtttggtttaaaccaaagatgcttgagagttacctgagaagacaaggtcttgctggaactccttacacgcctcttgtcggtgatttgaagaagaattttagcatgcgggctgaggcaagatccaaacccatcaacctaacggatgatatcacaccacgtatcgtaccttatccgttgcaaatgctcaagactcatggtatgcttccttgttggcatcttgattcctctttgtttagaactattgtagagtatctagaaaaggtttcaactttcgtatctctatgtggttgaaacagggaggactttctttacatggtttggagccataccaacaatcaccataatggatcctgagcaaatcacagaagtgctcaacaaagtttatgatttccagaaggcacatacgtttcctctgggcagattaatagccactggagtccttagttatgatggtgataaatgggcgaaacaccgaagaatcatcaacccggctttccaccttgagaagatcaaggtttaaaggctttatcttccatagtccccaatcagattagattgctttatgtatgtatgttcatttggctctgaaccaaattgtgccttctgcttctatgtatagaatatggtacctgcgttccaccagagctgcagcgagattgtttgcaaatgggacaagttagtgtcggataaagagtcatcatgtgaggtagatgtttggcctgggcttgtgagtatgactgcagatgtgatctcccgtactgcttttggcagcagctgcgtagaagggcagaggatatttgagctccaagcagaactagcacagctcatcattcaaacggttaggaaagctttcatccctggatataggtaatgaaaaactcaacttatctgatttaatataggtccttctgagcttgactcttgatcttaaaatgtcgcaatctattccttaaagatatgaaccgtgttaacattatctttctgccaatctttttctgtagttatctcccaacaaaaggtaacagaaggatgaaagcaaaagcaagagaaatccaagttatactgagagggatcgttaacaaaaggttaagggccagagaagctggtgaagcaccaaacgacgatttactgggaatacttcttgaatcgaatttggggcaaacgaaaggaaacggaatgagtaccgaggatctgatggaggagtgcaagttgttctatttcgtcgggcaagagacaacatcagtacttctggtttggacaatggttctgttaagtcaacaccaagattggcaggctcgtgcacgagaagaagtgaagcaagtgtttggcgataaagaacctgatgcagaaggactcaaccagctcaaagttgtaagtaaaagcaaatcataaacctcttggtgacttttgttgtgttttgatgatttttgatgaatgatttgatcccacgcagatgacgatgatattatatgaggtccttaggctatatcctccaatacctcagctgagcagagccattcacaaagagatggagcttggagatctgacactaccaggcggcgttctgatcaatctacctatccttctagtccaacgcgacacggagctgtggggaaacgatgcaggagagttcaagccagatagattcaaagacggtctctcaaaggcaacaaagaaccaagcctccttctttccttttgcgtggggatcgaggatctgcattggccagaattttgcattgcttgaggcaaagatggcaatggcattgatactccagagattctcctttgagctttctccttcctatgttcacgcaccttacacagtcttcaccattcacccacagttcggtgctcctcttatcatgcacaagctctaatcgttcgtagcaacccattttgttgttatcaaatatactttccattcacagatgaaacaattccatatcagtctacctataatgctagtccaacgcgacaccatgatgtgggaattcaagcctgagagattcaaagacggtctttcaaaggcaacaaagagccacgtctccttctttccatttgcatggggaccgaagatatgcatcggccagaattttgccatgttggaggcaaagatggcaatggcgttgattctacagagattctccttcgagctttctccttcctatgttcatgcgcctcaaatagtcgtcaccattcacccacagttcggtgcacatcttatcctgcgcaagctgtaattctagaatcccatgtgctcttgtcagataaacagaggaaaataaaccagatcatagtataaaactcaaatctttttattaattgaattcagaactttgtgctcacatatgtcttgacaaaccaaaatatttccaagaaaaagagtgaaacgcatggaccaatatatgtcttcctattttcgtcgcttttcacacgaagtccaaatttgcttcttgcgccttggtggcacgactgtgagggtccaagtaaagcaaaaattaattagtcattacaaaataattgcccaaaatatcaaaatataaagtatttaagacatcaggggtgatgtcatcaccacatccatatcttctccgaaattctaaacatttatacatcctgagaatggtcacaaattctctacctctctctctctctctctctggtagagaaa

SEQ ID NO: 2274 - DNA, 3000 bp, Unknown
  misc_feature (1)..( 3000): cDNA_ID_2153231_gDNA_ID_1620514_Annot_ID_159208 3000 nt of promoter + ATG
aagagcaaaacagagagaaaagagctaaacggtggcgctcatgagaaaactataaaagaggtttctctaaaggacaaaccctaggggccgtctctgtgggcttttctttttcctacttgggcctttaattattcttctcattacattggcgttacaaaaatatttgcagcgggtaaatcgggtaaattaaatttacttttttactgtcgccggtcaaatgagctcaagtgtttttatgagtcagtggttcaggtcaaacacatttactaaatgagcttataatcagattcatttgaattcgtatcatctaaacaaatgcaaattttttatataaaaaaaattctttgaaaatgcaaacactagtatgttttcagaagaagaacttttcaaagaaacatatacagtactgttttgtaatctagagacaatacacattatgtaaacaaacattatggatcgatcttcttctgaaacaaaatctcaacggattcagattgttgacatcttcaccttcatgaccacacccctgatcctcttacggttccaaagatgacgataatggtagcaaaaacagcctgcgaaaaggaagggttagtcagaattgatttatatttgtgataaagaaaagagaaatggttcttgttgagtgagagagatatatagagtagtggacttaccccaactgcgcaagctatatatcctggtctctcacgcgggttcctagagaataatagaaggaagaaaccgatgtaccagggcaaagcgaagaagaaaccaaggatgaatcttcaagacacatcaaaccaaaaaaaactctcaaaaattatcaagaatgtaatgagaagagaagttaggtaaaaataaatgataaagatcacttacaatacccagccaatgccgataccgcaacaacgaccgtgttctgttggtcttactccattaacaacataacctgcgaccaaagactatagttgatgaaaactagagataaccaaaacgagctttagaacagccaagtggtgtgtgtacgttgcaataatgatacaatccttttgagaaactacagtttagctagaaattttggcagatgagataagagattctgatgtttgtttccaaatgaatccacaatgttcaaaatactaagcaaaaaaatcatttgtcaaattgtaagacgtaaacgccaaaagagaaccttctatttgcattatctatttcaaaaacctgatttttttttttataaaaaagattcatttcttcatgtcattattctcaagtgaatctagcatcttgatttatatcatagaagaggcaatatacaatttctctctaattactggatcactcgaattttcaaataatcaaattttaatccaatgcgaatcttagcatcttagatgaggtaaaaagttgatcaaaaaggatcttcgatataatggatcaagaataaaatgaagcttctataccaaacaaaacacaaaacaaaacaaaacgacagctttgatgatgttgtccatataatgagagatgaggaaagaaagaaaccttgggcgtagggctgagcaggctgaggataaccggtggcgggaggctgctgctgcggtggatagttagagacgccttgaaacggaggaggaggctgttgttgatgttgatgatctgtcaccacagatctgtttttatcgtcgccaccgctcgtcatctctcaacagatcaaactaaacaaaaaaacagatgtttctctgttttctttgatctggagacggtggtgaaccaagatttcggttttgctggatgcttcttattaaagtttcgtatttctaggggaagtgcatgtgccacgtggctttttatgtggtggttagtcagctttcctcaaccagattttcctataataatctttgatatttgcgtaatcccaggggaaacattcgcttctctttttttttcctaaatataaaaacaaacaccgacggaaatgaaattttttgttcaatttctttcttgtatctatattctctaactatatatcgtttaatcatattggctttaatgtttatgtcacagtcgcaatggctttctcaattgacactgcaccttccactattattcaccttataaattatactctttttagttcaatttttcacttttaaaaaagacaattttcttctctattaaaacaagtgacatgcacctctaatttgcatattttcatttttattttgggttcaaataagagatgcataatatttgattatgcaagttcaaaaaaatatttgattatataataaaagagataaagagagagatgaatatagaaaaatatcccacttgttcttctacataacaatagattagaataacatttaatattaaattatttgttgaccatttagtggaattatttcattatttttaatataaaatgtagaatagatagctattgttatctaataaaagtagatattctatggagatgagattatatgaaacaagtcaaattgtaagccgtccatcagatcaatgcttttaaaaatgaacggataggatcgtctaattcacgattaattgaacaatgacattggagtgggacctttatccttgtctcctcacacgtgtctgacacgtttgcactctttcaggcggttgacgcgtttcgcttttcaaaaaacgacagcgtttttctttggcttcgcggaagaaaacagagtaaatttagatcgaaatgttttttttttctttggttctgtctctgtgtctttttctctgaactaactaatcaaaatccacgagaacaaacaaaaactgaaatcatcttattacttgtttctttgtcctttcctaaccaacacacatgaagtgcgactcgtttcggatggttttgtttcatgagattgttgtttgatcctttggatttaagaaaaaaaagcaagaatctttggactagtttgttgttcacttctgggttttgtaaccaaaggaagtataataataatg

SEQ ID NO: 2275 - DNA, 3000 bp, Unknown
  misc_feature (1)..( 3000): cDNA_ID_2153235_gDNA_ID_1620514_Annot_ID_159209 3000 nt of promoter + ATG
caaagaaggtactcatatggactgattggatgaaggtttaagaagtttgaggaaccaataaaaagaagtacaagatagaagtcatggattgtgagcatctcctgcaatagttacctcctgactctgggctaacaaatttctccatatcaactaccagcatatttggctgcaaaattagacacaagcttcatgtagctagagtaattgtaatgcagtgtttgcttaactacagaggggattaatccagagcatccgaagagaaaggcgacaaacaacaagaatcttacctcaacaagagtctgctcaaatgcaacagacaaaagtttgtcctgattgagaaagaaagatattggttggagtgttagaagaggaaaaactcaaaaaatccagagaaagctcatcaggcgtcagtacttactagccatcctgcaatccctggaagcacagcaacatcaagtccatgagtggtaattggtttaacagtcatttggaaataaggtggctctgcaaaacacactcgtaaacgcccgagaaaaggccatcgacgaaggaacttcactccaatcaacaccttcaatagttaaagataccgatatgaagtaagatacttcattgaaggaagcgtgtaagtgaagctgcagaaaagaaaatgcactacctttccttcaacatgcattcctgtcaaatgcaactttgtccacattccaaacccaagtctttttcttaacttcacagcgagtattgcgctcatatcatctgctgtgaggaaattcattccaagttccagtacctgtacacactccaatataagttatactttctctatagaacttagagcttatagaactgaaattgtgcaactataccaagtgatcatcacccgtagattgccgtagaaccctaatatctgtcaacaaaggagggtttcttcccaaataaaggtgttgtatcacaacttttttctgcacaaattatcattccatcaatactaagtcggtttttcgactgtaaactgagctacagttagtggcctagctagtactactacaaagggctaactagacacaaaacgaaactggaaagactcaaaatttgaaagagttaccgcagtccaaggtctatacttgtccaagaaccaaggtatgatcggacgaagaatcttctgagaagcaatctgttccatacaaataggccatatcctctccacggcatgattcaaccaccgcaccgattcagaatcagatagaacctacaaagttgtatttaaaaaataaaaataaaaaaagattaccatttcatgcaaacaaaggtaaagtcagtatcttccaatacaagattgagaagaaccctagaacttgaacaaatgtatacacaaagcaacttaaagtcttaaacaacaaagtagaaaattacacgtctctggttagcttgcttcctctcttcaaactgcaatttcttcctcaatctcatcacatagcgttcatgaacctaaaagaaacccaccaaaacaatatttttcaccaaatccaataaaaattgaagctttaacatctaaaagaaacatttctccagagaaggaacaacacaccaggtaaagataaacgagagagaggacatagaaaaccgcgtgtgatcgattcaagtaagatagaacccaaagtaacagtaacacaatcaccacatgatggattaccgaacactccattattattatacttcctttggttacaaaacccagaagtgaacaacaaactagtccaaagattcttgcttttttttcttaaatccaaaggatcaaacaacaatctcatgaaacaaaaccatccgaaacgagtcgcacttcatgtgtgttggttaggaaaggacaaagaaacaagtaataagatgatttcagtttttgtttgttctcgtggattttgattagttagttcagagaaaaagacacagagacagaaccaaagaaaaaaaaaacatttcgatctaaatttactctgttttcttccgcgaagccaaagaaaaacgctgtcgttttttgaaaagcgaaacgcgtcaaccgcctgaaagagtgcaaacgtgtcagacacgtgtgaggagacaaggataaaggtcccactccaatgtcattgttcaattaatcgtgaattagacgatcctatccgttcatttttaaaagcattgatctgatggacggcttacaatttgacttgtttcatataatctcatctccatagaatatctacttttattagataacaatagctatctattctacattttatattaaaaataatgaaataattccactaaatggtcaacaaataatttaatattaaatgttattctaatctattgttatgtagaagaacaagtgggatatttttctatattcatctctctctttatctcttttattatataatcaaatatttttttgaacttgcataatcaaatattatgcatctcttatttgaacccaaaataaaaatgaaaatatgcaaattagaggtgcatgtcacttgttttaatagagaagaaaattgtcttttttaaaagtgaaaaattgaactaaaaagagtataatttataaggtgaataatagtggaaggtgcagtgtcaattgagaaagccattgcgactgtgacataaacattaaagccaatatgattaaacgatatatagttagagaatatagatacaagaaagaaattgaacaaaaaatttcatttccgtcggtgtttgtttttatatttaggaaaaaaaaagagaagcgaatgtttcccctgggattacgcaaatatcaaagattattataggaaaatctggttgaggaaagctgactaaccaccacataaaaagccacgtggcacatgcacttcccctagaaatacgaaactttaataagaagcatccagcaaaaccgaaatcttggttcaccaccgtctccagatcaaagaaaacagagaaacatctgtttttttgtttagtttgatctgttgagag

SEQ ID NO: 2276 - DNA, 3000 bp, Unknown
  misc_feature (1)..( 3000): cDNA_ID_3066828_gDNA_ID_1620514_Annot_ID_159211 3000 nt of promoter + ATG
cttacaatttgacaaatgatttttttgcttagtattttgaacattgtggattcatttggaaacaaacatcagaatctcttatctcatctgccaaaatttctagctaaactgtagtttctcaaaaggattgtatcattattgcaacgtacacacaccacttggctgttctaaagctcgttttggttatctctagttttcatcaactatagtctttggtcgcaggttatgttgttaatggagtaagaccaacagaacacggtcgttgttgcggtatcggcattggctgggtattgtaagtgatctttatcatttatttttacctaacttctcttctcattacattcttgataatttttgagagttttttttggtttgatgtgtcttgaagattcatccttggtttcttcttcgctttgccctggtacatcggtttcttccttctattattctctaggaacccgcgtgagagaccaggatatatagcttgcgcagttggggtaagtccactactctatatatctctctcactcaacaagaaccatttctcttttctttatcacaaatataaatcaattctgactaacccttccttttcgcaggctgtttttgctaccattatcgtcatctttggaaccgtaagaggatcaggggtgtggtcatgaaggtgaagatgtcaacaatctgaatccgttgagattttgtttcagaagaagatcgatccataatgtttgtttacataatgtgtattgtctctagattacaaaacagtactgtatatgtttctttgaaaagttcttcttctgaaaacatactagtgtttgcattttcaaagaattttttttatataaaaaatttgcatttgtttagatgatacgaattcaaatgaatctgattataagctcatttagtaaatgtgtttgacctgaaccactgactcataaaaacacttgagctcatttgaccggcgacagtaaaaaagtaaatttaatttacccgatttacccgctgcaaatatttttgtaacgccaatgtaatgagaagaataattaaaggcccaagtaggaaaaagaaaagcccacagagacggcccctagggtttgtcctttagagaaacctcttttatagttttctcatgagcgccaccgtttagctcttttctctctgttttgctcttggctgattcgttggagcttgatctctccgtggaaatgggtggtttccgggtaagttacttctttagtctgtgtataggatacgtgattctgggtatttggacttctgaagatttgatttggagaatcatcaactgtgctcggtcggggatagtgtattataaggataaataggttctgattcgcttagaaagtatgaaactttttctatgtgcatccgttaaattaatatgaatttgaagtgtttatttccggatttggtttgttctgtatgaatctctaggatgattgttttagtgcttaatgtcttctaaaatgatcattgtgaatcattttaagcttcattagctatccttaggcccagagatcggtgttgtcttgtgactcactgagagagttgatatgatgtaaggattagggtctggtgctgtttaaggttttaccaaagctgatatttttgttggtttgtgattaattgattcaatgtacattgcagtttcaccagtatcaggtggttgggagagccctcccgacagagaacgatgagcaccctaagatctacaggatgaagctttggggtagaaatgaagtatgcgccaagtccaagttctggtgagccattcgatttgataccagtttgttaatgtaaactccattttgtcttgtttatttcctgatctaaaatggatttgctcgttgtatctaggtacttcatgaggaaactgaagaaggtgaagaaaagcaacggacagatgcttgccatcaatgaggtatggattgcattttacttagatatcttagatatgctgaaagatggctacttgtatctgatcttgttgttctactttattatagattttcgagaagaacccaacgaccatcaagaactacgggatctggttgcgttatcagagccgaactgggtaccacaacatgtacaaggagtaccgtgacacaacactcaatggtggagtggagcagatgtacactgagatggcttctcgtcatagagtgaggttcccttgcattcagatcatcaagactgcgactgtccctgcaaagctttgcaagagagagatcaccaagcagttccataactcgaagatcaagttccctcttgttttcaggaaggtcagaccaccaagcaggaagcttaagactacatacaaggcatcaaaacctaaccttttcatgtagaagcaaccgacatgattctcatcagaataggcttcttgttcctagtctgaacaaaacactggagttatcttcttttgaacatttttcaactttttttttgttctagatatgatacaatattaaggtgactcatctccaattttcgtcagtttccaaagttttgctgctttagtgtaatgttgcagaaagttcaaaactgtactatctcccactatcataaaccaatctgctttgtatgccaacgaccactaaactagcaacacttcattctcattcttgtatgaaactattctcgcaattccataaatgtcttcatctgcagtctggtttatgctacatgtccccggagctctcggcgtctgacacacacttcacccaaaaaggattgagagcagttcaattcatcatgctcagtggatcacttttcatgatttatcgattaaaaaaattgcaagtagacgagaacagatggaaaactcttacacgcaagtacacagaaaaagccccttttccggcaaaggatttggagtgtaacttgtataatcaaaactccagtgacagccaaaaagtctcaatctttataaagacccacaaaaacttgcggactccagagtgagtgtgagaatcggag

SEQ ID NO: 2277 - DNA, 3000 bp, Unknown
  misc_feature (1)..( 3000): cDNA_ID_2153256_gDNA_ID_1620514_Annot_ID_159215 3000 nt of promoter + ATG
aaccaggtctgcttcttgcctttcgggtggggaccgaggatttgcatcggtcagaacttcgctctgttggaagcaaagatggctctggctttgattcttcagagattctccttcgagctttcaccttcctatgttcattcaccttacagagtcttcactatacatccacagtgtggggctcatcttatcctgcacaagctttgatactatactccacgtgatgttatcaaaacttatacatatgagaaacaaaatttcatagaggaatttattcaagataatagtcatattaaccatgttttgaattgagaatgcttccctaataacaactaatccatctatttttgagtattattttataccaaatagaaatgccttagtggaagagatgatatttaaataagaatctacaaatttggggaaaaaatctataaagtttaaaatctctcaacttttgaaatacacagttgtaactccccaataaaagcaaaattgatcaattagtgactcaagtaaagcaaaatatcaatgagtcaaaataaaacaattttgtccaaaacacaaactatacagtattttaaaacatgaggggtggtaatatccatatccataccttcttcgaaactatctctcttctctgggagagaaaaatggagatatcagttgcatgcgtaacagtttctgtagttgtagttgttgtgtcatggtgggtatggagaactttacagtgggtttggtttaaaccaaagatgcttgaaagttacttgagaagacaaggtcttgccggaactccttacacacctcttatcggtgatttgaagaggaacgtcaacatgttgacggaggcaacatccaaacccatcaaactaaccgaagatatcacacctcgtgtcctgcctcatcccttccaaatgctcaagactcacggtatgtgtcctggttggccttttgcttcctctctgttttaaactgttgatcaagagaaaaagagtttcaaattttgtatatctatgtggtttgaaacaggaaggactttctttacatggcttggacccaaaccaaccatcaccataatggatccagagctaatcaaagaagtgttcaacaaagtttatgattatccgaaggcgcaaacgtttcttttgggcagactaatagccactggaatcattaattacgatggtgataaatgggcgaaacaccgaagaatcatcaaccctgcttttcatatagagaagatcaaggtttaaggctttatttttcagtcatgaatcaagttgtatgctcattttattctgaactaatttgtgcattctaacttctatgtatagaatatggtacctgcgttccaccagagctgcagcgatgttgttggcgaatggagcaagttagtgtcggataaagggtcgtcgtcctgtgaggtagacgtttggccttggcttgtgagtatgactggagatgtgatctctcgtactgcttttggcagcagctacaaagaagggcagaggatctttgagctacaagcagaactagtacatctcatcttacaagctttttggaaagtttacatccctggatatcggtaataaaagatctcaacctgcctggttttagaacttcactagtgctgcaaactattacagattgtgaaccatgatgtgtcatatactcatattctctctgtcttctgtttgtgtagttatctccctacgaagagtaatagaaggatgaaagcagcagctagagaaatccaagttatactgaaagggatcgttaacaaaaggttaagggcgagagaagctgggaaagcagcaccaaacgacgatttgttgggaatacttcttgaatcaaatttggggcaagccaaaggaaatggaatgagtactgaggatgtgatggaggagtgcaagttgttctatttcgccgggcaagagacaacttcggtacttctggtctgggcaatggtgctgttaagccaccaccaagattggcaggctcgtgcacgagaggaagtgaagcaagtttttggcgataaagaacctgatacagaatgtcttagccagctcaaagttgtaagtataaaccaaatcataaaccttcaggtgactttagtacttttattgtgtttagatggttttgctgaatgtttccaacagatgacaatgatattatatgaggttctcaggctatatcctcctgtaactcacctgacccgagcgattgacaaagagatgaagctaggtgacttgacactaccagccggtgttcatatcagtctacctataatgctagtccaacgcgaccccatgctgtggggtactgatgcagcagaatttaagcctgagagattcaaagacggtctttcaaaggcaacaaagagccaagtctccttctttccatttgcatggggaccgaggatatgcatcggccagaattttgccatgttagaggcaaagatggcaatggcgttgattctacagacattcaccttcgagctttctccttcctatgttcatgcgcctcaaacagtcgttaccattcacccgcagttcggtgcacatcttattctgcgcaagctataattctataaccacatgtgctgttgtcaaataaacataggaaaataatccagatcataatataaaactcaaatctttttcttatttgaagtcagaactttgtcctcacatatgtcttgagaaaccaaaatatttccaataaaaagagtgaaacgcatggaccaatagatttcttcctcttttcgtcgcttttcacacaaagtccaaatatgcttctgcgctttggtggcatgtgactgtgagggtccaagtaaagcaaaagatcaattaagcacaacaaaataattgtccaaaccaccaaaatataaaatataaaataatttgtgaccatcatcaccacatccatatcttctccgatattctaaaccctgagaatggtcacaaattctctaactctctctctctctctctagtagaaaac

SEQ ID NO: 2278 - DNA, 3000 bp, Unknown
  misc_feature (1)..( 3000): cDNA_ID_3066824_gDNA_ID_1620514_Annot_ID_159212 3000 nt of promoter + ATG
gtctgaacaaaacactggagttatcttcttttgaacatttttcaactttttttttgttctagatatgatacaatattaaggtgactcatctccaattttcgtcagtttccaaagttttgctgctttagtgtaatgttgcagaaagttcaaaactgtactatctcccactatcataaaccaatctgctttgtatgccaacgaccactaaactagcaacacttcattctcattcttgtatgaaactattctcgcaattccataaatgtcttcatctgcagtctggtttatgctacatgtccccggagctctcggcgtctgacacacacttcacccaaaaaggattgagagcagttcaattcatcatgctcagtggatcacttttcatgatttatcgattaaaaaaattgcaagtagacgagaacagatggaaaactcttacacgcaagtacacagaaaaagccccttttccggcaaaggatttggagtgtaacttgtataatcaaaactccagtgacagccaaaaagtctcaatctttataaagacccacaaaaacttgcggactccagagtgagtgtgagaatcggagatgtctttttcagtagtagcagctttaccggtgcttgtagcagtagtggtactgtggacatggcggatcgtgaagtgggtctggataaaaccaaagatgcttgagagttctttgaaaagacagggtcttaccggaactccttacactcctctcgtcggagatataaagaggaatgttgatatgatgatggaagcgagatctaaacccatcaatgtaacggatgatatcaccccacgtctccttcctcttgccttaaagatgctcaattctcacggtatagtgtcttttctttctttgtttcagcagagttgggaagtgaattgtgtagaatttagtttgacttgagatctctgttaggttgaattgttggtgcttgattgagttatgttggtggaacaggaaagactttcttcatatggattggaccacttccaacgattgtgataacgaatcctgagcagatcaaggaagtctttaataaagtcaacgactttgagaaagcttctacattccctttgatcagattgttagcaggtgggcttgcaagttacaagggagataaatgggcgagtcacaggaggatcatcaacccggcttttcacctcgaaaaaatcaaggttttggtttttttctgttgtttgaattacgttagactgtgcatatgtgtgtgtgatcgtttagtaaccttttgtttggtttacagaacatgatccctgcgttctaccattgttgcagcgaggttgtctgtcaatgggagaagctatttacagataaagaatcgcctcttgaagtcgatgtttggccttggcttgtgaatatgactgcggatgtcatctcacatactgcttttggaagtagctataaagaagggcagagaatatttcaactacaaggggaattggctgagcttatcgcacaagcttttaagaaatcttacatccctggatcgaggtaaaaccacgatctccattgtctctttgttctgttgcaaactaaagattttgagaatttgttgtttggtgtaggttttacccaacaaagagcaatagaaggatgaaagcaatagatagagaagtagacgtaatattgagaggtattgtgagcaaacgggagaaagcgagagaagctggagaaccagcaaacgatgatttgttggggatattgcttgaatccaattcagaggaatctcaaggaaatggaatgagcgtagaagatgtgatgaaagagtgcaagttgttttatttcgcgggacaagagacaacttcagtacttttggtgtggactatggttttattaagccatcaccaagactggcaagctcgcgcacgagaggaagtgatgcaagtactcggtgaaaataataaacctgatatggagtcccttaacaaccttaaagtcgtaagtgaagaaaacacaactttcaccattctcgtccatctaacaactgcgtttatagttaacaaagtcagttaaatttcaactgaaaggttgtctttgaatgttttttcaacagatgactatgatcttcaatgaggttttgaggctataccctccggtggctcagcttaaacgagttgtcaacaaagaaatgaagctcggagagttgacccttccagctggaattcaaatttacttaccaactattcttgtccagcgtgacaccgagctttggggcgatgatgcagcggattttaaacccgagcggttcagagacgggctctcaaaggcaacaaagaaccaggtctctttcttcccctttggatggggacctaggatttgcatcggtcagaattttgctatgttggaggcaaagatggcaatggctttgattctacaaaagttctccttcgagctctctccttcttatgttcacgcgcctcaaacagtcatgaccactcgtccccaattcggagctcatctaattctgcacaagctctgattttgtatatccatggatatgtcatcaaaagtctcatattatgtaacaaaaagatgtcatagaaagccctgtagccatatgttgtgaaattgtcaatatctttgtctgaaactagtcgctattctataaggtaaaagtcttcttcagtcaagtctaaggtcgttttctatcctggctgcattattaatcttgaaaagtctattccaagaagccaatttcaactctaccatctttagcatgtgttttagataagccaatcgttttttatgtcataggccagtggagaaagatttagcaaaaacataagtattttatggatttagataatctagaacattcgttgaattttcctctgcctcacactttaaaataacatcaaatctctatctatttatacaaacccttttcatctggcatcttcagttcagtaaaatagaagaaagcatctaacgaattttacaagtaagtgcgttt

SEQ ID NO: 2279 - DNA, 3000 bp, Unknown
  misc_feature (1)..( 3000): cDNA_ID_3066837_gDNA_ID_1620514_Annot_ID_159206 3000 nt of promoter + ATG
gatttcgttgcaaaatgatgatgagatgatgaattggtgtacggaactttcttacatggatggtgtggtagatagtggtgttcttgagattgaaggtggtgattattattctcatattaactatgcactcacatttgaggaaccaactctttctctatggcaagagaataatgatgtagttatgtattgattgatttcgtgaagtcataatataacaaaggctgtttcgtaatccgttaacccccaaaaaaagaaggaataagaggctgtttcattaatctttaacaaattaaaaggaaagaagaaagggaggctgttttaatcagttatctaatcttttaaattttatgtatgtattcgtaaatgttatgtatgttgacgttacatgtttttatatatatatatatatattatgattgttgagaaagcaataccaatatacatagaattattttaaaagattctcgtgattatcaagactagcatgcatcaagatgtaactgtagcggccggatgcaaacatatgaaagttcaaatgttttttgttttttgtttttaatgattaatgtttttacaaagtatattttaaccataatataacttgatgtaaaaaaacatgatcgtgctaattacggtaacttttaggaagtttttttttctccctttctatccaatgaatacccgttgacgatagccagaactacaaatttgtacattttgttgaatagaaatagtcgaatatttaaatggtataaaattaaaagaaatttgaaacgacattagccattgaattcccaccaaaatatttattggattttgttattcatgaatcatgattacataatggatgcatattcgcataattaatttatgataaaaaggggtagactctagaggcatgtccactgtcatatcaaatgatagtaacataacttacataagtgatcaaatgggctggtttatttgagactcttggtgtggaatgaatgaatttggttatagaatcttgaacgtaatcataatttctgagtgaaaatcatgtttattttcatagcaaaaaaaaaaaatcatgtttattgactttagaaatatacataacaacttcttttttttttttttggtaatgagagctttttttttgtcggcaacatgaaatacgggagtttggattcagatcgtgacacataaacaatatccgtacatagtgctgattggaggtgaaagtttttttttaataaaattttaaaccataagatattaaaaatttattggataaagatgatttgaaaactaaaaagggttaaagcatagtatattgatttgcttataaactgcataacataacataaggcccactttaaccaaaacataaggcccataagatatgggcttttgattaaacatagtggtggatatactcaaaagtccatttctatatatcaggcacagacatcagctcatcacactaaatagtgatacacacttttggttagtagttcgtaactagcatcaattaagcttcactacaggcctatcacctttttttttttcgggaggcctatcacctatgcattcattatacaccggttaatgtatagaaattaaattattgtttccagtacatcaattatccataaatctagtggctatttttagaatataggttgttgaataaataacgtaggagtaattttaagacaaacaataaaaatacaaaaagaaaacttgagtttggtggtgttttttaaaaaaagaattggttttgatttgtacaccaagttatttttgtatagtcctttagtatattcttagtgactaagaaatagatacaaatgcacatcaagtatatgctttatattccaattcattagaaaaagatttggctgctttacagtgaataaactttttcaatgttttttcttttcccatgcacgttgatggtgtagattaacaaacacttttttttttcccatcaacaaaactagtaaaactacatgtgccaaaatgcctgtttctgcttatcttattaactttcactttaattaagtatgtaatttgtttgtttcggagaaaaaagcttacttaattaaaaagctaagctttccaactttaatctttctgacatttaagaccaattatgcaaactaattaacacttccctctattgattgatttaatataataaataataaatctcaactttcttctatatgaatatgacaatgatttcaaggatttaatcacatcatgtactaataaaaatttggacctactacttacaagttacaattaggaatccaaattacatttcttccaaaatcgaggtttattattattttattttgtttgtatgtgaattaattaacccaattagactaataaaaaaagccggtcaatatttatatttcttccaaatatactatatcacctatttataaattactaaaagagctctatgacgtaactttaaatagcaaaaggctacagtaaagtgaaaataaattgtttcacatatccaacgatgaaaaaaaatgacaaaaaaataatcatggtttttttaaaacaaaaattcgccgcaaattctattactgtaaatcaagaattttatcatctatctaactcctaaatttttttaaaaagaatattttctaaaagttttctctagttattaaaatacatattgttattgttactgagaaataaataaatccatataataaattaacctatagttttccctctcaaaaaagaacggccaactaaataaaagaaagcaaaaagccaaaaagaggaaatcgcacccattcatcattctctcttcaaaaaattccgccatggaaactaacctcactaagcaatttcctctttatataactccttccttctccactcctctcttccctccttccgatgcttccctccaaaaccccaccgacgacctaatccctagaacacgaatcagcttaattcgtctgattctgattgattttctcccaaaac

SEQ ID NO: 2280 - DNA, 3000 bp, Unknown
  misc_feature (1)..( 3000): cDNA_ID_3066841_gDNA_ID_1620514_Annot_ID_159203 3000 nt of promoter + ATG
aagcttgtttcagagatgggtttggtttgttttctgataattgagacaagttgaggttttagttaattgaagcacttttgctgtcatgtttaaagcctgtgggaagatttttgggttcgtttcttccatttcctctagagtctgagcatgaccaaatatttgaagcttatgaaccttttttagaagaaagatgtggtttccttggcaaatataaccaaatggattttctaggaaaaggagtcctctctaaatttgtggagttgttcttagtgttagctaaataaggacaatatcaactgtaccgttatagtatctgtgtttgtcagcagtggagagcatgaggaggcgcttcgttggtttaataagatgtatgctttaggaaaaaagtttcatccaaagctctgtgctctcagtagtgtgtgtttgtcacaacatctgctttggctgcattgatctaacttctatgaactgcagaattgtgaagatgagcatggcgtgtaacttgttagttcaaaattcacttacatattctcctagaacaaatcgattatgaactgtaagtacttaattaattctctgtatttcacttactctgatcaagtggcataaacgttaagacaatcattatgttctaggatcggacttcacaaattggggtacttgattttctctacttgtgatgtcaatctttttattagaatttcctcctatcactacttaaacgaaatctgatttgcattcaattattctaatcattattttaaacttcttactttgttaaagtatgtacatagattgtttactttttcatcccataattgaaaaatattcatactatattgtttgcagaaattacaattcaaaataacagtgaagctgaagatgttgaccctcattgcttccaactacaagaaacctattaagaagaaagaaaaacctattaagagctccacatttataaagttctattagagacggtggataggccatggctactactgttcatctcagctcattctccctcttcatccaatccagaggaagaagagacaactccatatcttccgtcaagagtctcaaaaaacgcacaggtttgtctccctcttctgccctcacctcacaaggtggcagagacatgattccaccagagggaaaatgcaatgatcacaactctgcttttgatttcaagttgtatatgatccgcaaagccgaatctgtaaatgcggctctcgacgtttctgtaccgctccgagaacccctcactgtccaggaagccgtgcggtactcattgctagcgggcggaaaacgtgtgaggcctctgctctgcattgccgtctgcgagcttgtgggaggcgacgaggctactgccatgtcagctgcttgcgcggttgagatgatccacacaagctctcttattcatgacgatcttccgtgcatggacaatgccgacctccgcagaggcaagcccaccaaccacaaggtatgttgttaaatcatataaaggctcaaagaaatgctcactagatttgaatcgttcattgattttagtaaatattcactcgtgttggaccaatttttgctcaaacaaggtatatggagaagacatggcggttttggcaggtgatgcactccttgcattggcgtttgagcacatgacggttgtgtcgagtgggttggtcgctcccgagaggatgattcgcgcggtggttgagctggccagggccatagggactacagggctagttgctggacaaatgatagacctagccagcgaaagactgaatccagacaaggttggattggagcatctagagttcatccatctccacaaaacggcggcattgttggaggcagcggcggttttaggggttataatgggaggtggaacagaggaagagatcgaaaagcttagaaagtatgctaggtgtattggactactgtttcaggtggttgatgacattctcgacgtaacaaaatctactgaggaattgggaaagactgcaggaaaagacgtaatggctggaaagctgacgtatccaaggctgataggtttggagagatcaaaggaagttgcagagaaactgaggagagaagcagaggaacaacttctagggtttgatccaagtaaggcggcgcctctggtggctcttgctagctacatcgcttgcagacacaactgaatggactgatcatatcctcaatgcatcaatctcctaacaagtccttttacttagatctatggtcttgtttcttataaatcatctatgccgtgtgatcatctctctcatttgttttcaagttgtattatgtttttgaatcttaataatgtaatgttcgaaaaatatcaataagatttgctcataggaactaaatcgtagcgtaaggattcagatgatcagaactaaaacgtgagcgcaagtttagcttatgggttttcttcacccaaaacagagtataaagatctgaatttttgttattgaagcagcagcaagaacgaattccagacaaaaaccacagttgacccgatgtggttcttgttgaatgcagaccatgatattcacaaacactgctgtatcgtaacttggaacgaacttaatgccagtcagagatagagattgaacattgattgcttggattctcaattaattcaatcatattaaatgattgtctaacattctcaacataattcagtcatattaaatgatttgtctaatgaatgcttttaatgttcactaatgtgcccaacccaaacattacagaatttaataatagcttggattttcccactaaatcaaactaaatcttcgtctgacattttccctcgcaatatgtgtccaaccataaaaaaaaaaaaaaaaaaccactaattacgattcgtagttactttattttgttttattcaaatcagccatttgaaagtttgaagcatcagcgcaaacattaagaacagagtttctctaaatagtttttcgtctttatcctttttacagtaacaacatg

SEQ ID NO: 2281 - DNA, 3000 bp, Unknown
  misc_feature (1)..( 3000): cDNA_ID_2994894_gDNA_ID_1620515_Annot_ID_159238 3000 nt of promoter + ATG
gtgaaggcgcatacctgaagaaatgcgtttactgcaaggtaaagttggtcatgactctctctgaatgacattgggactgtctcaatcagctcaatgaaccttgtagttttcatctcttgatcatacggtaaacgagagagaaaaatatcccacagttttccaactctcacgttgcttgaggaggaagtaagatggcgttccgattctgttgatacatatactgaaaacaggctttccattgtaagcaactcctgactgaaagcaacttgcctgttcccggctttcgggtatataaagttttcgggttgggcagtgtgaagaagagatacaatctgatcttgcagctttaacacagtgtcatgcttcaaattgtgtgcaagacacgcaaaataaaacccaactggaacaaacctatatgccttgtctcttgtaagaagcagatctagagctctttgcagaatatcagtattagtttgaccttcaggtattacagatttactggcgtaaagggcgaccaatggacttacatatctttctttcataccttgtcttctaagcgacccaataatctttttgaagaattcgaatggaagatccgtgaggtctttgatccaagtatcttggtttattattctctctatgtttgtatattcccatggttgattcaccataccttcaagcatgatgactggcttttctcttcgtctttcgggatcgagaatctccatacaagccgtgaaagccagagactcaatgcaccggctcacgatgagtagatcttcagaccaaggcactagatcctgacatttcttcagaacaactaacgtgtcatcccagttttgcaagacaacttggtttagataaaggtcaaatctctcgcagaggttacccgtcgaatgttgctctgtcatttcaagaaattgagctgcacatcgtagtccagcgatgttgaaaggatgtattaaagttggacagccataaatgaaaagcataatcttctcaaaggtctctgctccaccaggaaactcttgtggtatctcgatctccgatagctgatcctctctttccttaaaatatccgctctttgcacacaagagactctacaaaagataaacaaaaaaagtaaggcattatattaacaaaaaccactaagctacatgtattggttgaaaacagaatttcttgagagagagatttgattatcattattaccttgtgaaggttaaaactcttgttgcaaactcgaacatgtactgacgcgggtagaccggtctctttactcctgtgacacacacacacacagttacattacataagtctacaacatgaataattcagatttgttatatgacatcacgaagatagtcttgagattcataccaagaaagaactttgattttcaaaagggtactgatatttggagaagaaatcgggctggaggcgacggacgaacaatccttgaggctgaaagtttccattattgagtatataaattgtgaaaactaagtagataaagtatatcaaaaccaatatggtatgatgaaactggagacatttggtcgttcatttattcttcttcactattatatttttgaagaagaaagttgcgtgttttggggattgaagaggaagaaaaagggttctaggatccacgaaacaagaggacgctaaggaagatttgagaaaaagaaagtttcttttggttttcgtttttatcaaacattaaactataatatggctacttgcatgcaggcacacacacatatatgcgtagtagatgttgggtcaaagtcagatgcgcacgagtgttgagctcaaaaagaagatctcaaaattcaaggcaagaagttgaagacgacgttcctcgagtgttgagaagagttgaaaaatcttgtattataacattttttcttcgcttttttcaacaacatttttgttttttactccaacactttctttctttttcatgcattaactgtaacaagactctaaatagttctaaccagacattttggtgacgcttatttatgatgttacgatctggtcttcgagttatgtaatatacgttaattaatagtgatttgagtatttctacgaatataaatatatatttttgcaaccatcgtacattacgagaaaatcaagagaggaaatcgaagtactgtattgcttacttaggaagaattcgctcatagaaaacagggaaaaggaggctaaagtaggaaattattagagaattacttatattgacacacatgtaacatagatttaaatggatttactagactaacatagatttgtcgacaaaaaaaaaaaaggctaacatagattttttggtaaaaatgacagcaatatttttagtattctatgctatctttaagttatttaaagtgtactctattaaaccacatagataaagaaatgccaacaaaaacaatatgaaacattacaaattctagaaaacgccctaaacggttagctttaaatttgaactctaaaggacataaagaatcaatacgtaaataaataaaacacgtaaacgactaaattcggttaattcccttaaaaaaaattgatcactctttattctttttttttttgacaaaaaaaaaatcactcttaattcttaaaacttggtttatgctattcatcagcacaaagttcctgcaattcataccaaaaccagcgaagtactatttctaatttcttgggatcaggcccaacaacatggaaattgcctaacagcccaaataatcagaagcccaaaagtaaaaacaaaaacaaagcgagcctatatttacactcagcgaccaatgtacatccgccacgttatatcgataatttttcatctaaattacaaaaataccacttcgttttcctcctccttcacttcctttggcggctctttttttgtcctctcttcctcttttcgtcggagctcgcgaagctctctctcctcagaaatcaaaaaccctaaaaaccctttttgtagcgatgatg

SEQ ID NO: 2282 - DNA, 3000 bp, Unknown
  misc_feature (1)..( 3000): cDNA_ID_2153146_gDNA_ID_1620515_Annot_ID_159242 3000 nt of promoter + ATG
aggaagtaaatgttgaaacaaaatcagtcagacaagtaaaaagtatacaagtccctaaataattttgcagatgcattttcctctacgatccatgctcgagtttattccatgcaacaaattgatgtatttttttctcaataaattaattttattacacttatcttgacttttaaaataactatctataagtgattgttcatattttgtctgagctttgttcacatattctcggtgtcaggaaccatcattcatctttgtattgacacagagaaaccaaaagttttcacattcccgcttgggttttgaactcggggaacacctttcattttattttttcttaaatcataaatggctcactcattgaatcttacttttaccctttattttagtagatttaatatgaactttttacactgtatgcaatatagatgatgatgattgatgacaactaagggtatctccatcagtgagataccttcttggtttctcaaaaaagaaaaatattagtattttaatatatattagttatataattaaatttttacaataaaataatatttgaccaatagatgatatacaagtgttcttatgggtttctcagagtttctcacttgagagactaattctactctctctcatactttttgattatattttatttttatattgaacagtttctcaatgaaaaaccattgatggagatggtgtaagatatgcattacttaaaaaaaaaggttgatgatgatatctcagaaatattctgcatttctatcaccaaagaagatctgtagttggagatgatgagagtttagccatgatgagaaaaatgggaaaagaattagcattagattttctatatatatagtttacaagtcccatgtacatacatacacacatttacatacatggtacatgggacgtcactcattgtatgaagttttaaaaaacgacaaatagacagatttagagaatcatttatatatgtttttaaaacacattacccctctacatttttatttttgttaaacgtgagatatctccaccatattataatggaaagggttgtcaaaaagaataatgatacaaaaaagaacggcaaaggggggttgggttgtggggtcatagtgacacaacattcacttacaaaagagagtaaattttatttttattattttaactgctttgcaagatttagttaacacctttttagtttggaatctggattttcttattaacttttttttaattatatgtaaaattctgaaccaaaactcgtacatctcaacgtatcaaattagtatgacttatgacacaatcttttggatggatcctaggctcaatcactatatcataagcttttggttatcaaaagtattttagcttcagatttattattgtactataagaactatcacaagttatttgaagttcaagatacaatccatggcagtttaaatttgaccatttgttttatagattttttgcttttttttcctttgaaacgatccaaatgtttccaaaactatggataaaataggtatgttcgatgattaaaatggtatagtaaaattagaaagaaaacaaaaactgacattttatcataagaaataagtttctgttttcgttattttctacaaaatcaaattacttcgtaatttccacagtcgtgtggcatgaaatcacatcatttgaattcagcattgtagtcttcgttctctacccggtcaacattctttgactttgattttctttggtgttccttcttgtcttcctatatctactaaaagccaattagttttcttttccgtgtatttatatataattttctaaatgcattatattaaaactgaattatttgattagaagtttacgacaaaaaagaacatttactcaaataattggtggctttgtgttgttaatatttatgcaaattttgtttttggtgacaaaaaaaagctaattaaattactctgtactataaacttaagttatggtaaaccagtggctctggtttgattatgtttagggtaaaaaaatcaattattctcgtatgttttaggaattaatttgcacttacaatttgacaattttatagacgattttagtgattaaaaaaacctgaatttatatgcatttcgggaatgtttcggttttgacctagaattttccgattaacaaaaaaaaatctttttaatactttaatcttaaactaagattagagatagtgaaagttgaaaactagattgagacaaataatgaatcggggacatgtatctaatataattggaggctcaataaatcatcaaatgatgtggtggtgggagcgacatgtttgagtggtataatcgtaaatcacacgccggtttaagattctgtttcttttttttttttctctgtgataagagtgagacttctgttttgtctttcgagccattcccatgtgccttgtctccgacaactttctctcttcccttctctcttcctctggttcacatggaacttcaataacattcactactttaaggtttctcatctccgaaaaagtcaggtgggtactactaaatttggattttcgttcacttagaacagttctgtttgatctttgattcctcaagttataacttttgtttttcttttatatcttatgacatgataatattaggtcttaaatcatcctcttcttttgatcctgttggaaaattctttgatttggtggttatgttgcttagataacctaaaaaggtatgaatttgtagctttgttggattcttaatctctgtttttatcaatagatttgattaatatatgtctaattatgtggttatttgcattagaattgtgttatgtatagacgaatataacttgaggttatgttgatctaagttacaaaaataattcagggtaatttagagcttctctaggatggtttaagatgagtctttaagtctgatttttttatacttgcagttattgtgcagatcattgaagtgactagaaatg

SEQ ID NO: 2283 - DNA, 3000 bp, Unknown
  misc_feature (1)..( 3000): cDNA_ID_3066879_gDNA_ID_1620515_Annot_ID_159243 3000 nt of promoter + ATG
actacgagcgcctctacgtcggcgcgtggcttggagacgcgccaccttcgtcgcttatatttcttcggaagcccgttaacgttgtctgaaccggaaccggaaccggaaccggaaccggaaccgtaaccggaacggccctctttttgtttctcgacgatcaataaattattagtaatcttgtattctttttaaaattaattttttattccgacttttatggttacgaaatttcgatttcttcatttcattacaaggtttcattaataaacgtgatttttttcccactcctgtttctttttcttccctagtagatactgccaacgcgtagctgttttgtctcttctacttttttttttctttttttttataatcttggccttcactaattttcattgattatgccatatgtgtttttttttgtccttttggtttagtgtgaaaatatattaaagagcaagttattgactcttggggaggtgacactttttaaaatgtaaaattaaatgatgttctaataagaaaaaaatgtaatatgatgggtttttttttttaatcttatggcattagccaaagtgaattttatggtggaattacattatagactttacaagatttgtgaaatgtaaattttattttaaattttagtggcattgtaattaattggtaaattttcacccaaaaacaattttatgaactagcaacaatgataagtggattcaaaaacacaattctgtaattttgatgggaatttgttttttatagtaaaacataattttttattttagcggaaaacacagctttacagttttaaaaaaaaattaaataaaaaaattgaatttaagtagaataattttagttttaatgtgtttagtattttgccataaattttcaagaattatcaaataattattgattacactattttgttaaaaacaatgttatataggtctaaatgggttaagaaaacttaaatgaattttaaatgggaagggtaaatgtggtgtaaacttaattggttaaatgagtttaaataaatgtggtgagttttaaatgacatgggtataaatgggggtgaattagcccatattaacatctctagtaaccaacattacctcattgactaattatcgagttatatctactgtaagtcttttttccgcaccgagataatgccaattgcttggatcaccgtcaagagatggaaaactatcccgaggaaagtgaccacccaaaaatgtcgagaaaagaagagaagatctcaaaatcaacggagagaaaaaggtcatcttaggaaaaatttgttgtctcacaaaaaacagcaacgtcaacggaaaatggaagccacctaaatgatctcgcctacgaaccaattcaccaaaggaacaacgtcggtgaaaaaaaatatattttattaatagttctcggatcgttacattatatacttgcaataatttcctaaaaaaacttatttatctaaactaacacctgtttgattttttattttttatttgtattggttacgatggattaaaaaataatgtcatctctatgttttaaaatatcgttcagttcaattttttttaaaaatatatatttttttaattgtattgatttctactaggtactgtttctcttcgaaagcaagaaaaataaaacaaaaatcaatgaaatagatagctgatggtgtgaatgaacttgttacttgtctttttcttttagttcccatgtacattggactccatagagaagaatatatcatatccatattaaaatctcatgtagctttcgtctatatcatgatagattgagagaaccaatcatatatagtcttgagaagttctgacttttgatccatttgatgttccaataaaccttaccatctcctcttcaaacactaaagtgttttaataaattactaaaattgagggattgtaaatagattacaaaaattgctacctaacctaaatcaatctaaaaggaaaaggaaaattaaattaaatctcttaatttcgaacaggctaacttagtattggtttagataaattattgctaattttacatgaaaggaatgcgtcttaaattaagcagtctactatcatgaaaaccgtggttgaagacttgaagtagtctctacctgaatgtgaagtctggtattttgttcgtgtcattgtgcacatagtcgcatgtgtcaaaatttttgaagggtatggcaacagtagaaaaacttgtcgataccttcttagtaaaggtctcatatgggttatatagacaaaagatgatactttgatatgttgataactcttggtcacttgtgactaaatcttcaagatcaaggtattgacctaaattaccaaagctggaataaataaccaatgaaccataagtttctcctctatgaaagatttttaaagagagaaaagaggaaaagcttcggcgtcaagttttttgttttttttcctcctctctagtcaacaattcttatctctttttttcttttcttacaataaaacaatacttgtcctcacattttgtcttgtctcactctctctcccattgatcttcttcctcggctacatctcccgacgcctctctctcgttccggtgagtcctcctctctctgctccgatctgtatttcttctctttcagtttcatgctctctgaggtaaaattaatgatctttcttaatcaagttataaaacttcaaaactagttctaaagatcgatgcttgagaaatcaattttacttacgatttgtatttcatatatatatatatagcatcatctaactatcaacttaatcaattccttaagattcttctttgactaatttaccgagagtttgataaataattagggttttcaatttctgggttaaagtcaacttcagagcttgtttctgggtttaagtcaaattcaaagcttggattcatgttgtgatggtgatattatgatttatgagggttttctctgaatttcagattttggtttaatatttgatg

SEQ ID NO: 2284 - DNA, 3000 bp, Unknown
  misc_feature (1)..( 3000): cDNA_ID_2153197_gDNA_ID_1620515_Annot_ID_159257 3000 nt of promoter + ATG
ctaaataaagaaaatatttattggatgttacacatattttgaactgcataaagccatttttatcgattttgccactattaattaagatgtcaaatatagattccttctttatcggtgttccatcaaataatctctcagtttttctttctctctctctttctcttgccaaaactcaaaaaaccaattccccattgaatcaaacgaactcaaacttttgtcagtttattactaaacatataggaaaagttgaactatcttgcctaatccattttttacaatagaggaagatcaacattttggcaaaattcttatgcaaaaaaataagaacaaagtgtttgtcattcttttagttgattagtttttttttaactttgaacccattgaggtttgtaataaagatgttgtcatttcgaatgccgtctatcggaagccaacctacggcatttgctgcaaaaataacggacaatccaaagaccgtggcacaactcaagtcggctgcatcgccttcacctcatagtaccgtgacgtgcggttaccaagctcatgtggcagggttctttcgaaacgtcaccgttttatggtccaagaatctcatgaatcattccctcaccgtaatggtgtcgagtttagacaatgacatgaattattgttgtaagattgatctcgtgaagccatggcagttttggagcaaaagagggtcaaagtcattcgacgtagagggaaactttgtggaggtcttttgggatcttcgatcagcaaaattggctggaaacggtagccccgaacccgtgtcagactattacgtggcagtagtttctgatgaagaggttgttttattgttgggagatttaaagcaaaaggcttataagcggaccaagtcaagaccggcattggtggaagggttcatatactttaaaaaagaaagcatatttgggaagaaaacgttttcgactcgggcaaggtttgacgaacaaagaaaggaacatgaagtggtggtggagagctctaatggagcagcggagccagagatgtggataagcgttgatgggatcgtggttgtgaacgtgaagaatctacaatggaaatttaggggaaaccaaatggtgatggtggatagaacaccggtaatggtctactatgatgttcatgattggttgtttgcaagttcggagactgcagcgagttcagggttgtttttgtttaagcctgttccggttggagcgatggtagatgagagctttagcgatgcggaggaaggagatagcggaggagggagtagtcctttgagtcgttataattcagcatcaagtggttttggaccattgcatgacttttgtttgtttctttatgcttggaaacttgaatgaagactattaatatcatagtgtgtgtgtttttatttaaatctcttttggtgattaagttggaatagaattagaaattaacaatttagtctaccttagtttggtcccaaataccaactaaacgattgctcaagagttaggacaatcagatatttgcaaacaaaaagtttgtattagtttaaccatactttttgttaatcgaataaccataagaaaatttggtaagtttcttatggatatgagttagttttctttagctaggccattatatatataagtctatttatttacaaattcaattaaaaacaattagcttatttagttatcaattaaagctgttttttattttaaaaaattagcctattaaggttttgactttttaaaaaaaatacatgaagcaaaaaaagaatgaaaagtctttaaaaaatgaaatacttgacactagcattgtgactatctagtgtacatagtttcaaattaaaagttttcaactcaaattaatgtactaatattttgtcaaattgaataatataagtaagagtggacaccgacctgcgcgtgtcagtgttacagatacacaaatatctttttttgtgtagacgtttccaatttgccagatattatatttgatctttctctttcttttcacctacaaaaataatatctccttttttaggcaagatattttgttcattcatgtgcgtctctcaaattaagatattttggttttttgtaaagtcaaagcaaagactattgttgtgattgggcttttaagccttaaagcatctaaaagaagacgcttttgagaatccagaatcggaaaagttccacttgtgccttgtagatcgcgagtacggctctttgtctacacgcgagcgcgtgacttcatactcataaaaatatctttagggtccttagaaaatgggttcttttgaactttttacccaatgtttctagaattatcagcttatgtcacatgcctctgcctacatgtccctttgcagacacaacccacccattgtctatccatctgtttctccttttacccttcttcacacgcagctaaagaagaaatttgtggaatcatcgcttattcgtttcaaaagtcattcatttttggtgtctctgcttcagaagatacttgacgatctctcctacgtgagctctttaaaacccttgtcttgttattttagtgagggttgctttgattctcaatcctttttgactgatcttgaaatggatcttctttcacttctctcggatttgtaataagaaatctataattttttagctcacttctctgattggtacatgttgatctgaaatttgaagtctttctgcgatgttaattggtttctctgatgtctcttttgattggtctttgatttagaacagtctcatccataggaagttacaatctttgaggaagagatgtttaaaaagattggacttttatctaattctggacttgctttcgataccaagtttcaagcttttgttagttgtttaatgtattgtggtaagtttttttccttctaagattatgatataagggactaaccaaaatggtttgattctttgttagtgaaaggagcttgctttcttcagtgtgacggttgagattggttgaaagatg

SEQ ID NO: 2285 - DNA, 3000 bp, Unknown
  misc_feature (1)..( 3000): cDNA_ID_2153183_gDNA_ID_1620515_Annot_ID_159253 3000 nt of promoter + ATG
caggagcttattcttcttcccattcaacatcttcttcttcttcttcctgactcatctgtcctctcagttcccctactacatcagccactccttccctgatcatccatagagggaggttttccactctaggatcttcatcttccctggtcggattcaatcttgcccgattcaatcttgtccgattcaatcttgtctttctaaaacgtgcttcggctgaagcgaaaaaactagcagacgatattgaagaagatgaagatgatgcaggagcgcttgtagcagctactgttgtgtttgtactcgagatactcgaatcgggttccttcggtccagaacaactatgatcaggtccaaaccgatgtttcaagcaatgatcgacattttatagagaatgtcaagacttctttgcacctagaaacaggacattgtttcttcttcttcttaacatcgttttcgtagtttgagggatcacaatctgtatcattaacatgtttatcccaagttatgtttgaatcttcgtcagggtttaacctaaatcctatagcacaaaacggacaaataatcactgtgacatctcctctgtttccttttggacaatcgtgttacatatagctacaatgatccaaacaaagcacctgcaaatagagttttaaaagttagataaactttaccacagccattgttcctctctatttagaaaatcatgcaacattgtagatcgtagaaactagcattggaataaaaagacaaggagaaagagacctgaaggcagcgatcacatgtgaagggcaagaaatcgatctgcgtgcaaacatcgacggagcagtgtttccctagatctggaaattccggagtccccatcgaaataagggtttcgacgttcagaacaattcaaactcgaagaagtaacaattcgaacccgaaagatctaggtccgaggaaccgagcgaactatgtaaatcaaaatctctatactttgagaacacggtacgaagaacggagagaactaggtcaaacaaaatctctatcccttgagaactaggttcttctccttttataacacgcaacagtcggatgggcctccttaatgattaatatcttgatgggccttctctatactaatatatgacccaaagagaacccattccactatatcccccttctgccttgtgctaagtttttagtacttttccaagttacctaatcctacaagaaattctggaaagtgaaatttctcataaaatatatcatttacttatttcacttataatacaatagaataaaacaacgtgtagaaaacaatattaatctagcttatcttgtaattcatcaaaaaaaaaaaaacttaacaaactgtcacctttatttggggtcatcccaaaagtgcctccataattcctcacaatgaaaaatttcacaatacgcaacttaaaatattaacattttttcatcttatataaatccaatcactgactactattatattcatatcaagataaaactcaataaatcattccaattctctaatcaaaatgtggagcaacaagttcttcttccttcttccagttgtatgcatcgtagtgttcgctacttctcaaccattgccatcaccacaaccttcccaactagattgttggtcatcactagaagttattcccgactgtgtcccggaaattttccgatcgataacaaatggacagttcgggaatgtaggtccttcttgctgccatgcttttataggtctcgatactgaatgcatccctcagatgtttatcttcgctcccctcatcccgccttctcgcagactcagggatcattgttcccacaaaataattgtgccataaacattttgagactttgttagttgttacaaagagtttgttattctacatgttttagactataaatgtgcttatagtgttatgtttctgcttaattaactacgtacgttctctactataagatatcaataattaacttccatgtgaacatgtgtcatttagctataataagtgaatacgtactaggatacgttggtttatttatcaaaattgtacacattgcatttgcttcacaattgtttggatgactttacaaagcgcttgtttacttatggccttatgggttgtgaattttaatcgagcattgttcatattgtagtccttcaaattttgagttttttctcgtatatacacatatgtaaactccaatactcaatagctgaccaacatcgagttacaagtacgactaccaataaaaagattttaccgaaaataagaaacatcttcgatatatattttttgattatctcttaatcattagtttgcgatgtttatagtgcgggaattgagtttgagatcgactcaaaaattataattggttttctcaaaacatggattagacgactcatatattcattgtctttcctaacatgattatagtatggctctatcgtgaaggactggatagtctgtattttatatatctatagaaaaactaacagttttataaatgagttagcaaaatatacttttttttgttgctttaaaactttttttttctaattctatcccatattatattaattcgattttgttgaatgattctagaggatcgatatacccgaaacatgtttaaaattgtaatttatttttagttttttcagtgaagtaggaggacatttgtccccctcaaatcaccaaatttttaaaaaaaaaaaacttatacatgatttaaggattatgcaattgtattgtctgtccgtcatttgactcattttcccactggtaagagctcaacttcagggattaatgggcttaggcctgatccgtttaaaaaaaaaaatatatatcttcataagagagtttggccgtttggaaataacgtgtaagtaggacccacttttgtgattatccgccgcacagaagtctctcctccactccacaaatagcattcccggcgagagacagagagcgaagaagaagactcaaaccaaaaaaaaaa

SEQ ID NO: 2286 - DNA, 3000 bp, Unknown
  misc_feature (1)..( 3000): cDNA_ID_2153132_gDNA_ID_1620515_Annot_ID_159239 3000 nt of promoter + ATG
tcaccagtagtccccttgagagatcctctcttctaatattagcttcgtcatcttttgtctaattaacccaaaaaaagagcacactaaacagtttagtgaaagaaagagaaacccatctatatagcacatcataaaaaggataggctttaaactcacatgcgtaaaatgaagtgggaagtagcaaccaataacttcaaaaagatcagatgcatcagaagcgagtggaccagaaggactggggaacaaaggagccaaaagctctactagatgaaaaactatcattaagcattgaggatctttttctccgtcgatggcttcacacatagcataaacaagtagatcaccctaggaaatggccgtttagtcaataggattacaagaaagtgaggaaaggtcccgagtagtattacaaatttggatacatataaataattatttgtcttcctacaaagctgactcaaatagatttccaagaaaacattcctcacacagtagatcgaatgtttaattctgaactaagtagagagcattagcataccatagtcaaaatagcttcagaatgttgttgtaaaaggcactccagaagttcaaaagcgagctgcaaagtcatttagcagaagataatgaaaaaaccatccagcgtagaacacaatcattcagattagataacagaatactacaaataaccgcttcatactttgcgctcatgcagtgctaaagcttgcacttgcacattctgtatcattgacttcgccatagcttgtacatcgatatcagtaaccacaccagctacatctttcctcttcagtagagccaaacaaccaacaagcgccccgcacatcgctctccaatctgcctgattcaagtacaacaatcgtttcacttctatgttaaaacaattgaatagacacattggaatcgagtataatcaaacttaagaagtatcaaattaccagcttttcggaaaagaatccaacgagcgtatgaactattgtatcgttcaacggctttgctttcaaacaatcgagaatctccgcaagcaggagaatacctatagttatgaacacaccaatgtccaattgcgttcaaattgataagctcattaaactaagctagtgaatcgaaatacctcgtgctcgaacgaggttatcggttgttgtcaaatacatctccatctctctaacctaaacattagcaatacagaaataagccaacaacacaaataaagcctacggaagaatattcagaagttgtcaagtgagtggaaattgttaccaattgggtaatagataaagaatcattctccaaagaagaagcaattgctttaagactatcatcctgaaaacaaaattaaacttggtgaatcaatgaaactgttgttctaagtctcaaaattgatcaaaaggtacctgttgagaagaggaacgattagtgtcaacaaaagtttcgagatgttgaacgagctgattcggttctaccatcatcgctacaaaaagggtttttagggtttttgatttctgaggagagagagcttcgcgagctccgacgaaaagaggaagagaggacaaaaaaagagccgccaaaggaagtgaaggaggaggaaaacgaagtggtatttttgtaatttagatgaaaaattatcgatataacgtggcggatgtacattggtcgctgagtgtaaatataggctcgctttgtttttgtttttacttttgggcttctgattatttgggctgttaggcaatttccatgttgttgggcctgatcccaagaaattagaaatagtacttcgctggttttggtatgaattgcaggaactttgtgctgatgaatagcataaaccaagttttaagaattaagagtgattttttttttgtcaaaaaaaaaaagaataaagagtgatcaattttttttaagggaattaaccgaatttagtcgtttacgtgttttatttatttacgtattgattctttatgtcctttagagttcaaatttaaagctaaccgtttagggcgttttctagaatttgtaatgtttcatattgtttttgttggcatttctttatctatgtggtttaatagagtacactttaaataacttaaagatagcatagaatactaaaaatattgctgtcatttttaccaaaaaatctatgttagccttttttttttttgtcgacaaatctatgttagtctagtaaatccatttaaatctatgttacatgtgtgtcaatataagtaattctctaataatttcctactttagcctccttttccctgttttctatgagcgaattcttcctaagtaagcaatacagtacttcgatttcctctcttgattttctcgtaatgtacgatggttgcaaaaatatatatttatattcgtagaaatactcaaatcactattaattaacgtatattacataactcgaagaccagatcgtaacatcataaataagcgtcaccaaaatgtctggttagaactatttagagtcttgttacagttaatgcatgaaaaagaaagaaagtgttggagtaaaaaacaaaaatgttgttgaaaaaagcgaagaaaaaatgttataatacaagatttttcaactcttctcaacactcgaggaacgtcgtcttcaacttcttgccttgaattttgagatcttctttttgagctcaacactcgtgcgcatctgactttgacccaacatctactacgcatatatgtgtgtgtgcctgcatgcaagtagccatattatagtttaatgtttgataaaaacgaaaaccaaaagaaactttctttttctcaaatcttccttagcgtcctcttgtttcgtggatcctagaaccctttttcttcctcttcaatccccaaaacacgcaactttcttcttcaaaaatataatagtgaagaagaataaatgaacgaccaaatgtctccagtttcatcataccatattggttttgatatactttatctacttagttttcacaatttatatactcaata

SEQ ID NO: 2287 - DNA, 3000 bp, Unknown
  misc_feature (1)..( 3000): cDNA_ID_1019772_gDNA_ID_1620516_Annot_ID_159268 3000 nt of promoter + ATG
atatatatatttactaaaagtttttgctaacttattcctttccaaaaatacaataaatttaaacatgattgatgttaaaaaaaaaaaatttaaacatgatttaaatcatattgtatacaacaaaataaataataaaatggttagtaaaaatttaaaacacgaaatgaaaaagggatattcacccaaacaagttgagttttgaaacaacaatggtaattcaatctctgattagtccttctttagttctttacaagaattgggcttgtggtatgttggatttcagccctaattgatatatgtctaattttcaaatccaaataatgttcgttctactaagtaaattgagatctaagcaatagattgcttggcttgggcacaatctttaaggccgtgcccaaaaaaaatacagacacaacagatatgccctcagataataggccgtgtctagtaactctcttttcttaaggccggtgggctgattctggataggaaattatttgtttaaaacccaaaatgatgattcttgaaaacaaaaatacagatacaacacaagtgaagaaaaagatgcaaaagaagtagagcaagaccaagaacaatgaagattaaaaaatttacttgggaaaaatttggctcaggaattttggaaactgtttttgacttctcgtcttcgcttggcgtcttataaggtcaaactatctggattctcaatgatctttgcaaaggtttggagaaaagcagccaagtcagctccatacacaatgcgatgatctgcagtcacattcacctgccaacataacaacaaagcgacaatgttactgttagcatagccaaaagctatagctaatcgtattttaaactttctaagtcgaagtgattcaccaaacccatcaggaagtttattaagtcaaaataaaacttaccagcattgtgttttttacactgaagaatccatccttatcagcaactacagttggctttgacgctccaacagccataatagcaccctagagatttgagtataacaattaagtaaattccttgtaatcactattcatagaagaggcaatgaaagtttctttcatatacctgtcctggcggaagaatagcgtcaaatctatccactccaaacataccgagattcgataaagtaaaagttcctgcattccatagatatatcccttaaatcaaaatccttaaacacacttcacatgtttgtcatctaaacaattcgttaagaatagtaccagagttgtattcatggggttgaagttgcttgcttctagctttccccaccagctctttccatttttgagataacaagtacaaatccaactatcaaaacaaccaacacgactcacacattcagttaaagaaaccagcctaataataccaagtgtgtgtgttaattcactcacacgctagctattttctacaactttattgcttatgcttaccttatctgcatcttgtagaacaggcgtaatcaggccaccattgatagcaaccgccactgcaatgttaatgctactattgtaactaaaactcttcccgtctttgcagctagcgttcaccacaggatgctgagccaaggccatccctgcagctttagctaataaagctgtcattgttacaccctttggcttcacctgtaaacaaaagcagtgatttaacatcagcttcatcattcaatacaacatcagcttcatctgtttcattcaattcaatttcaccttctcgtaaagtgcatcaagagcgtcagtgttcacaggataaccaacacggaatgtaggaacagagagactctcaatcatgttcttagatactgcagattgcattgctgtgaaaggaacaatgcttgaatcaggtaacagaggaggcaaattagtggtggttgctttagccgtcaccggaggtggaggaggaggcggtggtgcgatggaggatttggacggagcaattccagccgccgtctccacatcagaagccgtaatcctaccgaatggtccagttccagcaacggattcaatatcaaccttgtgttgtttagcaagcttcttagcatacggcgtcgcaacagtcttcctcggaccatctgatactgccgtcaccggagccggttgagcaatcgccggagcaggagaagaagtaaccggaggaggagatggaacgacagcctcagccacagaagaagaagatttcgaagcggctttactcttagcttcttcgatctcagcttcagtctcagctaacaatccaatcgcagcaccaaccggagctgtttcaccttctccgacgacaatcgcagcaagataaccatcgtaaaacgtttctacatccatatcggctttatcagattcaacaaccacaacactctctcccttggcgagtttctcgccttctgttttgatccatgacacgattttgccttccgtcatggttgatgataacgccggcatgaaaatttcacgaatcttagatcggaccgtcattgaacgacggtgagaagtcgccggagtcgtggagcggaaaacgacgctgcggagggatggggatactgaggaagcgaatgaaatgttggatttggaattggttagtgaagctgtcgatagaaacgaagaagaagaaaccgccattgttgaatcacagagagagagagatctgagagagagtttagagagagtgaagtggacggagaagacgaggttgaagttcgttgagcgtcttcgcctacatttgtatcagttaccagtttaataaccggatatataattaaaccggattaatttatctgaaacttcggtttaggttaaaccatctagaaacaaagaaaatttagatgcttctcaatggatattaggtaacataacaaaaccagttttcttatatatcttctctgctctacctaagttagagaatcagattccaaaatcttaatttataagtatacttttgttttcttaaccaaaaacatatcatacaatattgctctttcgtctcatg

SEQ ID NO: 2288 - DNA, 3000 bp, Unknown
  misc_feature (1)..( 3000): cDNA_ID_3066941_gDNA_ID_1620516_Annot_ID_159289 3000 nt of promoter + ATG
tagagtgtgccactatgatgaatctgatccgttaccagtccatcaagaggagaagatattctacaccgaagaagattaccgagatttcttggctcgacgaggatggacatgtctgagagagtttgacgcgtttcaaaacatagacaatatggacgagcttcaatccggtcgcttatacagaggaatgagatgagaaaacggttactacagaaggctagaagaaaccttttatttttcatcagtcactataaatagctttttttgatccaaaatactttattttcatcagtcactgtacatatgcacctcttttgacatgccattgtgaatcagaggaatttgatttgtttattgagaaatctctttttgatccaagagccataaagtttgattggtaaacaaaacggttcagtacaagagacagggacaatgaaaaagctgataacttttgaacaaaacacaacacaagtacaggattccaattctcatacaattcagaaaaagaaaaaaaacagaagagaaaacgatataggtgtgtgaataaaggattcacgtgcctttaagaacaatgagaactcccaaagagataaacgcaagctgaacaaagagccttgcatacgtgtgtcccgacttctgttactcttcttcatcccactcgtcgttcttgtatgagacaagcgtgtcgactttgtgaatctgcaaagtatgaaaccaccaaaatacttagacatttcaaagtgtataaataaaggtttcaaaattcttcctcctccttaccttggtatcaaaaccgtgtaacttaaccatctgtggattagcaatcaacttcgggtcgctctcgatccaagtgaatggaacagccacatcagtatccgtatacgccaatacatcaaacacacctaatacaaacaacatgcacaatcaaaaacgagaatccaaatcaaactagttccgaaatgatgatcactcaaagttcctatgaattggttcttacatgtttcatcaagacaaggcaagtaagtaacacttgaagcaacctgtctcataatagcttgaatctccctcatgatctccttatcactcttctccctcgacacactaaaaagttccataaagataacataatgaaacaaagaatcaaagaaaacaaacaaacttgcgaaagtatcaacactaaaaacaaaaaactgaccctttgtcaacaacttcattatcagtctcaatacgaaaattccacctctccaagacttcaccagtagctttactcataatcactaacactactctctgcaacttcccagcttcaagccattctttagaccaaaaacaaaatcaagtctcagactctctcacaaaaggaatcattgaataaaagtctgacatttgtaaaattaccggagatctgagaagtgagattagacatgaaagatttgacggattcatcttcaataagcaacatcggaagtccatatttcttcactttcacaaaactttcctctggataaactgcacgattatacaatatactgtacccagaaaccaataacgaatcaatttcactgtaaaaaaatcacagaatcgaagatttccagacactgaaattgaaaagttccgatccaattctcacctgttcgcagcgtaacctggaggaagaagaagaaggaaaaaaaaaacatcaaatcgagaagaagatatctgaaattgagtctaagaaaaaatgaagatacgtacagaagaattcgctgacgatggcagcagatccgtgtaaagtgatgatatctttagcagccgctgttttggacgccatggagtctaaggatcggtgattttgaaaattgaattcgcaagtgttaacagcgtcgcttagggttttaatgattttgaagggaaaaaaagatatttgagggaaggattaaaaagaaggaaagaaagaaaaagaaaaaaaaaggaataagagcgtaacggctagtcttcctcggaaatgcacttgcaacggctagtttgggttattatagtttaaggtcgaatccactaattttttttaaaaaaacaatataatatcattaccagaatttttaaaatatcaaatataaaaaaacaacaaattatttttagccaatagcaacatctctacaaaccattgtaataattattatttttggtttgcaacacattttacatttaaaagaaatacaccaaatattaaatatataataactttgttttaaaaatttaatagaaaagtccatagttttctgccatacggatttagactcgccatgtggtttttaacttttaagccgtatgtctctttgataaacgaatgaagcatcaatcaaaattttaagaagccttttaagtgttgaaaggtaaattttgtagtttctattggtaaatcgactcatctatgacttttttttttaaatagatttcaaatatacttcatatatatgtatatataaatttatgtcgtgacacccatgaccgaaatctagaaaaaaaaaaaaaaaaaactaaggtatttttttccagtctaactgaaaaaatacaattttacaaataactcaaacttcaaatgtgttttgatttacttaattaagccattattaatccacataaggttattaacacaaatttatcaaactaactagccacttgataatccattactaggtaaattcaggtatatatataagttaataataaactgattatttgaccaaaaaaaagcataattaaaatatatttttatacataaataaaataaaataaactctctttgatgttgacatcatatgaacacagagaaacagatgaatgaaagcgttgttagcctctctactagagagctctttaaactctttccaaaagctttcactcactcactgttacgctattaaatgtggttccatctcagatatatacgtatccaatcgaattttggattcttatataaaatttggcttcttgggttatgccaatatgttgttcgatgaaatg

SEQ ID NO: 2289 - DNA, 3000 bp, Unknown
  misc_feature (1)..( 3000): cDNA_ID_2047921_gDNA_ID_1620516_Annot_ID_159292 3000 nt of promoter + ATG
acaaggaaagcttcaatgagaagaaaagaagaaaagagaagaagcttcaagcgtaaaaaaaggagtaaaaggaagaagaagaccctaatatgggaaagacagacgacgactccaatgacttaattttttttgtccaaaccttattatgggcgacttctcttctcaagaccttatgggctttacgggcccaatattaccatgtttcaacgtgtttgataaaaaaaaacaattgttacattttcatttgacgtatttgtactatttaaagtttttttcaacactttgtaatatgacttgacttctattattctataaactattgacccaataaatatcttataaaaagtaatcgttttctgttgtgttcactgaacaattattttcttttatttctggaatatgtcacaaagaagagacgaatcttggaagttttaagttcatcttttattattatgttccaagtttatattcttctacgaagtattccttgctaaaacacggtatatatcaaactttacgtgttgttttatagaacttattaacaaatattatttggtacactttccttcttatttattttttaaaaaccattagacatgattttaataactggttgtcattaactaagaacacatttcttacctgatttgtgcttttaaaatgccagtttttgtttcacaaaaaaaaataatttcagattttatattgccttggtttattggatcgtatttaagatatctatctacaagatatttttttttgtttttttgtttactaaagcttatctatgtacaagatacaactatctttattgctatatcacatctatttatattcttttattgtgaatctttgtggtttttaaagcaaaacattatttgttccactttctaggtatataaatctaccaaataaatatgtctcaaactcatggcactgaatatttaatgaataaatttggaaaaatgacctatttttgggttttcatttgaaaaataccctatctttatttctttttttaaacaattaattttcaatatataaagtactaaaacagcttcagtaaaattaggaaataacaaaaaaaaattaaaacttaaaacaaaaaaaaaatcataaatacaaatttgatgtaactaataattttaaagataattattatcttaaatatttttaaacaaaatgttgtccaaaaagtaaaattaaactttatcaagtgatagactttttagaaatatttgtaaatattgtttcataaaattttaatatataaaataaataaagtgatagactttatatgaattcaaatttaatttttatcttaaatattttaaacaaattttcgtccaaaaaaataagcaaacaagtttattaggtgatagactttagaatatttttcaaaattttataatatctaaaaccaataactttttatctcaaaaaatagttgaaaacataattaagaattcgaatttattttattttaattttgtttttctaaatttcgaattttgttttaatttatgaataaaacaacttttattttaaatctggataaatttgtcatcttatatatcaagaattacaatttttatttaaaatagaaaaagatgtatttttcaaatgaaaactcaaaaacaagatagttttcaaaatctcccaataatgaatttatctaaaccaacatcaaaacaaaaatagaaagaaaaaaaaaagtagtttcaatagacaaaattaattctatttaaaatcaacaaactaaaaagatactaaacaaacattttactaacaataaaatataatgttttttacaataattaaagtttattatacatataaaactgtctattgaagatctgaacgttacaaagagaaatgcacagtaaaattaatatttatgtagaattattcatcgtaatcacatttatctttttatttatttttattttgttattgtaatcacatttatttttatatgcagatagataaatatcatcgtaatatatttagctcaaacacttctggtattaatccatgttaaaagaaaagaaaaaaaatcatatattcctggtttatcttcatactgaaaaatgacaaaaaaaaacaaaaaaaatgacacgtgtttaaagattttgacgatttcactctaatcttatctttcttttttattattatttaagtttgtttaattgattttgtctccaatagtttttatttttctctccctcgtaaaatctcaacccctaaaaataaaataaattgagatttttcgcacaattttctcgtcgtttccattattttctctcttcttgactcggtcgacgaaattcaccaacccgttctctctttctctttctctcttctttgaattcccaaagtgattgaatcaaaaacttcgtttgattacaattcgatttcccccacacaaaaaaagagatcttgttttaatttcgcggcgagggttcggtttggctttcccgttgatcgcgttgttcttcttcttctttggtgattcaatttcttcaattcaatcaaattcgtatctttcttcttctttgataatgtttaggatttaggtttcgtaatttctgaaaaccctagtttagtttttgttcgagaaaaaagaaaaggaaaacaaaaaaaaaaaggaaaaatcaaatttattcaattcattctttttgtgttacccaaattcggttgttaatacgtctcaatttcgaatttcttttctagggttttttagggttccaaggaagctctcaaaatttctggtgcctagtatttttttgttgccatctgaaatcaagagtttcctttttctctccatagatctattaattcatctttcgattatccaaaaaaaaaaataactttttagtttatcttcggatctgatctatcttctttagggggttttgagtttttctagggattgtgtacaaaagagggatttttttggttttgttaggtttaaagtgtatatagagattaatagaaatg

SEQ ID NO: 2290 - DNA, 3000 bp, Unknown
  misc_feature (1)..( 3000): cDNA_ID_3066931_gDNA_ID_1620516_Annot_ID_159296 3000 nt of promoter + ATG
aagaagctaacaaagatttttcagttttcagtttctcagcgaaaccaccagatttggggataaaattagggtttttcgatctccagagaaaacaaaaaaaatgggagaatcaatttgtcttgtgagatctttctcgcaaccttcagagttttcatcgcgtgaaatcaacgaggttagtgcttaagatttctaaatctacaatcttggatttagggttttgataatagagattgattttgctagtgaaatttctgtgtatagtgtgttgtttgatgaatctgaagagaatttgagatttggtttttggtttttggcaggtggtaccgaatcgagtgcttacggaatcagtatcgtttggtagatatgcgaatgaaacactagcgtgggcgagatggtcagcttttactcagaatcgttacttggaagaggttgagaggtttactaaacctggttctgtagcagagaagaaagctttctttgaagctcatttcaagaaccgagcttcagggaaagcagcaacacagacgaagaagattgaacaagtaaaggttaaagatagtgttgagattgtttgtgatatacctaaggatattctcgttgattcagaagtaccactagcggtgaatagagaggtgtctagtaatgaggtggactctgttgttccatcaatttctgtaatagatgaaactggtaaagtggagaacttgaagtcagtggttgttcctgatgaggtaaatgcatttctgttacattgcaatttcctgtttttattttttctctctaaacgtccatggtgttttcagggcaattctacttctttgagcaaagaaagacctcctagttcttccggatcgaaggtctcaagctcaaaactggaatcttccgttgttatagaactggatcattcacttaagaacactaaaaaagagtcatcctcgagtagtacaaggtcacttagtgcatcgaagaaccgaagtagatcacctcctgagcccattcacatgtcaatcagctgtgtttcttctagtaataccgagaaaactattgtggggaggccccagaacggttctaggagtgcagtgaaagcagacaagaagaagagatcaggtccaagttcagttcacatgtcactcaattttgcttcttctactcttcgtacgaccaaagaagccccaaaaacactggcaagaaactccactacacagggaacaacttcaacaaatgctagaaacaaacttttcccaaagataaacgaaccaacgggagctttaaaaagctgcaagagaccattgtctcagacatccaaagacggttcaaccaatgtaattctcttcccaagtttctcttcttgcgtatatcccaagcatatttgctgagactgactcttacatatattgcaggcctctgctgtcacgttacccagacttcctcttctcagtaatctgctatcagaaaacaaaaggttactgatcaaaccatcttcaacaccaattcatcgctttatactattactttattattaactcaaccctataattaactttgcttcttctgatatacaggaaaaacatatctgtaaggagttcagtttcatgtagaatatccaacaatgagcaaagaaaaccttctgtcgggtaagcggtttaagtaccaacctcttagagaaatactatcttatgtcacttactgcaaatggcctgagttggttaattgaaagtgtttgtgttagttccctgatttatgtggacataagacgagatgtttttgtctaatgcattttgcagctgtgaaaatctgtcaactcatagcagaaccaaagcaaagtctttgactgtatcttctcccttcgtcttcagaagtgatgaaagggcagagaagaggaaagaggtagaactaaagaagatccttttactttatctttgagattatttgaggacttatagagccgtagtttaaaaaagatctcttttgttgtggatgtgtcttgtctgttagttcttcaagaaagtagaggaaaaaaacaagaaagagaaagaggataaattttcttgcggcttcaaggcaaatcaaaacactaacttagcatctgaagaacacaagaacccacaagttggtggttttcaggtatattcaactctcagactgtaacttgtcataaatttgggtattgaatctttgatgtatgacattataatcatgtgcaggtaacaccgatgaccctgacttcaccaagattccgcaggaaccaaactccaggaaaagagaacataaaaaaacctcatcaaactcctcataaagcttcctcaatgaagatcatcaacaccaaaaaagtagtcatggagaagcacaaaagcagcaagatccatccctcctccaaacagcagacaacaaaaagaactcaagaaaatatgtctcctaatattcttcagaactaaccagagacaaaccagatcaatcgattcctcttcttcaagtctctagatcatcgtaaagattcgacttttcactttgaagattccgaaagttttgtcccttcagctagtaatctcatctcaagcttatggtttaggtgactagcccttgattcagattgtgtaaccacaagcttttaaggagctgtgtagaatagatagaactcaagtctacttactcttcaaagtaactatgtactcaatagttctgtagtatcaatcttgtatcatttgtatacatagagatttgaaataaagaattatgtctacttttcaatttctcattgtgtttctttcttgaattagtatagacaggaacatggcaaagctttctgttttacatttgttttaaacgacgacgttttggtatgatgttgtgatgttgtgttgttgtggtgtgggcctctcgtttcagaggtgagagaaaaaatcttatctctgtggactgtgattgtgtgatgtttccatatcttcagcttttcttctactacatgctctaatcacgtccttgtagaggaaaagaaaaaaa

SEQ ID NO: 2291 - DNA, 3000 bp, Unknown
  misc_feature (1)..( 3000): cDNA_ID_3066924_gDNA_ID_1620516_Annot_ID_159300 3000 nt of promoter + ATG
accactcaagatctaactcacactgatctcttcaagaacgcattaaacgaagtcatgcaattgatcaagatggtaaaataacatctctctttcactctcttacgcacgccttcaagctattctcttgattctcatttttttgtgctcatgaatttgaagaacttggtaagagattactggtcatccatctacttcatcaagttcaaagaagaagaaagctgccacgaggcaatgcataaggaaggatacagtttttcatctccaagactgagttcagttcaaggctctgatgatcctttctatcaagaacatatgtcaaagagttccagatgcagtagtcccggttaaggagtctaaaactggtactagaccagaacccaaaccaatgttcatagcaatccaatccatgtaatcttccttcacatttcttgtacatgtcattttctctcttgttatacctaactgtaagagaaaatgtccggttcggattttggtttagttttaaatgtgtataccggacaaaaactatggaaccatactaattaatatctcgaagaatttatacgtatatgccatctgtttcaccaagaataaaaaagcacctgcagattgatcttcatgtccttgcagagtgatgatgttgcatcacatgtttcatgatgtgatgacatatccattggcctcgctaaggcttttcatcaacattttgacataatgtttttttccaccactatattttgacgtgtacaacatctataacgagaaggtgggatggtcatcaaatatttcaattttagaatataatttgttactgaaaagagaaagttgaagaattttttaggtttatcatatgattaaatgatattaaaagttttaaatatctataaaatataaaattaaatattgttgagcagcaataaaatgtctttaggtaagtttttaaaaaaaaaaatcatctgttaccatttaagctctaaattattcagtaaaattctgcaagaaatgtcaattaaaccctaaattcagtaacttagccagatttattctgctgttaacatataaaaattaaatgttcaaaaaataaaacttatatgtgtaggtaagaagtcttgtcagcgaatgaaaaaaaagtttaaattaatgtttcattattatggtgaatctttcccaaatattagtggttctcatctcaccataaataaatattatttcccaaagaagttttttttattttatttttggctgtctaccatatggttttggtatatatatgggtagcaattattgggtgttgtcgatgttctctccaagatagtttataaaactaaaaggaatctttatcagtttatctttcaccaaattagttaatttcaatatatttttttggttaaattgtttagcttatggggaattctctaaatagtaattacatctattttctgttccaagactattatgaataaattttcgaaaatgctacaaattagttgtgataatgttatttccttttcattcttatatctcaatcttaatatcttcattctatctttgtttaaaactcaaactaaaatgaaaactctataacatctagacatgaaaactctcactaaaatgaatttaacaaaatttacttctattttcggtgaaaataatactccttataaacatgaaaaagaatgaggatgtcatcatagtggataactatgtaaggactcatgagtaatataatcaaattattagcagatattaataaactactataaagatccgttggatagatagatagataacttgttctaccactcaaaccaagttttggatgcacacgtctatatacacacataacacatgcatacatgtattgatcatcatgatgttatattccattacaatcaaacatatatgtgacatataatcacaaattttcttataatttgttatgttatttactgagaaagagatctgatcgctttataagtccgcataaagagacaccacaactttctttcttcttcattcacttctatcaacgccaaatttgcagactttcccaggaccaaaattatattaaaaaaaagttccttttttctgatcaaattgtgaaattcgcttgcttgctttcttcacagtcaattaattctctaacaaaacattcttcgatcgttcgttttcatcttctatgcttctctgatcagacacaagaacacaaccaaagaaactcactatagcttgtctgtagattctgatgttcgaattcttgttgttgatgatgattgaattgatgatgatgatggtttgatgcagatgggttttcaaaaatctcatcttttttcttaacaagtaatcatttttatccatctcaagtctctgttgaattttctatgattttgtctctgattgtgaatctgggtaatgatcaaactgtagtattagttactaacatttccccaaatggattgatctctctgatgtgtttgtttggtcaatcaaaattgatttctgggttttctgttgtgatcatggtaaggtcaaaagttttgagtttccgtgtgcagaggagaaggagtagtcctttgcgtgtgacaaactgttttcttattatcttccgtatcagatccaatctttctttaagattcctttttcatctttatagaataattcattgttgattcctacacttctcttccaagttttcttctttcattcttggttgatttgatttgattgattcacagattctttctctgttcttcattagtcaaaaggtttcaccttttctagtttctgtttataacaattgattatgatttggaaccttacttagtttctgtttcttatgtagatcaaaaagcttagaacttgttgaacaatactagagactagagaatttgcaggtaagtttttggggatcttgttctgtttgttttctcatatttcaggctaatcagagtgtgactttcttgtcttaatttgtggttttgtagataatctgtttcaaaa

SEQ ID NO: 2292 - DNA, 3000 bp, Unknown
  misc_feature (1)..( 3000): cDNA_ID_2992902_gDNA_ID_1620516_Annot_ID_159297 3000 nt of promoter + ATG
aagaacccacaagttggtggttttcaggtatattcaactctcagactgtaacttgtcataaatttgggtattgaatctttgatgtatgacattataatcatgtgcaggtaacaccgatgaccctgacttcaccaagattccgcaggaaccaaactccaggaaaagagaacataaaaaaacctcatcaaactcctcataaagcttcctcaatgaagatcatcaacaccaaaaaagtagtcatggagaagcacaaaagcagcaagatccatccctcctccaaacagcagacaacaaaaagaactcaagaaaatatgtctcctaatattcttcagaactaaccagagacaaaccagatcaatcgattcctcttcttcaagtctctagatcatcgtaaagattcgacttttcactttgaagattccgaaagttttgtcccttcagctagtaatctcatctcaagcttatggtttaggtgactagcccttgattcagattgtgtaaccacaagcttttaaggagctgtgtagaatagatagaactcaagtctacttactcttcaaagtaactatgtactcaatagttctgtagtatcaatcttgtatcatttgtatacatagagatttgaaataaagaattatgtctacttttcaatttctcattgtgtttctttcttgaattagtatagacaggaacatggcaaagctttctgttttacatttgttttaaacgacgacgttttggtatgatgttgtgatgttgtgttgttgtggtgtgggcctctcgtttcagaggtgagagaaaaaatcttatctctgtggactgtgattgtgtgatgtttccatatcttcagcttttcttctactacatgctctaatcacgtccttgtagaggaaaagaaaaaaaatggctgcttcatcttcctctttcactctctgtaatcacaccacacttcgtactctccctctgagaaagacccttgtcaccaaaacccaattttcagttcccacaaaatcatcagaatctaacttctttggctccacactcactcactcatcgtatatctccccagtctcttcctcttctctcaaaggcttaatctttgccaaggtacatttctcgactcttgcattgatagattgtttgctacagttgggtaacaactagttctgggaattagcttctttgttagaccaatgttttttggacaatctaagttctgttccatttcttttttatatgtttttgagtattacgatataaatattagcaagacaatagattgttagatacacagccatttttgaataagaaacaaaagatgtaaatattgggttttaagtctgaatttaaatgttataagaacagatttatgaatgtgttagtgcagaatcaaagacaaaatcaaagaaacttgtaatcagtgtttgttttagagaccataaactttcacatacctgaaaataagcaaatgctagaatgttcttgaatatgttcaatcctttattcatatgatttaagctgacacggcatatgaactctctttaaccttctgtgaattggtctctttgtgatgtttggtgggcagcaggttaacaagggtcaggctgcaccagacttcacactaaaggatcaaaacggaaagccggtgagcctcaaaaagtataaagggaagcctgttgttctctacttctaccctgcagatgaaacccctggctgcaccaagcaggttgttaaatctttactttctcctccttcccgcattcattgatcgcatatttagtgtttctaaacgtaaatggttttacttgtgtacaacaggcttgtgctttcagagactcttatgagaaattcaagaaagctggtgcagaggtcattggcattagtggagatgactctgcttctcacaaggtacacacatcaaaaatctctggtttcttgaataaacccatttcttttttccggattttaaagagagtggtgggactttaaacattgttgcaggcgtttgcaagcaaatacaaactaccgtatacattgttaagcgacgaagggaataaggtgagaaaagattggggagtgcctggagacctgtttggagcattgccagggagacagacttacgttcttgacaaaaacggtgttgttcagctcatctacaacaaccagttccagcctgagaaacacatcgacgagaccttgaagtttctcaaagctgcttgatcattctctctttctcttctttctcttctttcatgcatgtctcatgtctgtctccatgagaccatgaccttcttatattgtttctgttgagtatgaattttcaataataccatgttataccaatgagaagggagttggctttggtctagtacaaagatcacaacaggataagtactgaagtgtggttaaaatgttagttggttctgtgtatttgagtctctcgttttcattgtgaacacctctactatctctttctcttgtatcaattaacacttcaagtaaggtacacatatcaggtaactctagctagcccttgattaaaattgtcaaacacaaagctttaaggaattgtgtagaatacatagaactcaagtcttcacacaatagttttagtatgtgaactcaagtactcaatagtgttgtggtctcaatctaatatttgaaatttaaaacggttattttcgcattgtgtttctttcttgatttgagtatagacaggaataaaggtagagcctttggactgtatgaagaatatggcaaagctctgtttttttacgcatttgtattaaatgacgtcgtataagtcggagcaccgagggcctctcgtttcatgagagaaacaaaaaatcttatctttctgacaacggtggtggtgtgtgatgttgtcagccatggcaaagacagagctacaacgatctctctctcttttcttcttcttctgtgtctgtctttaaatagagtctctttgaaacgaagcagctttgtcctgttctgatatcc

SEQ ID NO: 2293 - DNA, 3000 bp, Unknown
  misc_feature (1)..( 3000): cDNA_ID_3066933_gDNA_ID_1620516_Annot_ID_159294 3000 nt of promoter + ATG
cccataaggtcttgagaagagaagtcgcccataataaggtttggacaaaaaaaattaagtcattggagtcgtcgtctgtctttcccatattagggtcttcttcttccttttactcctttttttacgcttgaagcttcttctcttttcttcttttcttctcattgaagctttccttgttgcaggatttaatttaggattcacaattccaacacatacaaattgtttaaaaaatacaataagtcataaagtcagaatacgttaaacattgaaaatgtgaagtataatatttggttttctcttcttgttttttcacaagttaagaagtgtctgaaaaatagtcatggcttcttctcaaaaggtttctgattgggccttatgaggtattgagaaaagagaagtagcccattaaggtattgagaaaaagagaagtagcccattaggtcttgagcaaaaaaagaagttgagtcgagcaagcaagagtccctgactcagtcctcttttctcagctgtccagaaagtagaaaccctaaattcgaaaatggaaacacgaaatcgaaccatacatctcactgatgcgatatggacggagattctagcgaggttaccactgagaatcatcgctagattcaaatcggtaagcaaaacatggaaatcaacaatcgaatcagtctatttccgccgtctctttgtgtctgtgcaccgaaaatcctcaacctcgtggtcgctaatgtggtacggacaaaaagatctcgtaggtttccatggatgcgagacatggggtcttccaaagtctctatctttttacatcccatcgtctctttgtattatcgagggttcctcccatggattggttttgatttcagaaaatgatgatgattgttgctttgtgggtaatccagttttacaacagtggatcaaaatccctccacctccagttcactcttcagtgtttggtttggtgtctcgcgtcgacgatgatggctttgttttgggcttcaaagtcgttaagttagctgaagtaatagtgacgaataactatgtctcgtgttctttgagtgtgtttgtgtattcctctgagactgggatttggacttgtaagactattcactgcccttatcaaatcaccaactttggttctttcactttggatggtaccatttactttgaccatcttagtgaacctggagtgctcgtagcttatgatttctattctgaaatctccgatcagttttgggttatacctctcccggatcatccgaatcacggcttcaatagcgacttcaaaggtgctttgactacgtcccaaggatttgtcatgtatatcagaacattagctcaatcttcgtctaatgttttcaaggcttggaggttgaacaatgattcaacttggcaacttttgtggaaaatcggcctcccgtcacttatcggtgattatgtacctatggcaatgcatccatttgatagtgacattgtccatctttggagtcaagatcatcgtcatgtggtatcatggaacttgcggactcagaagaatagaatcctcggagctgaagataatgatgaagatcataaagattgttacttgaaccagcctgtttgtgaggagtgtatggatgagatatgcggctgtaaagcttctgtcaggttactacaacttgttctcccacggtggatggaatcggtgccttgtcctccccaagttgagatgatgaatacagcttcggtaatctcttacgttacttcaatgcaagagacaatgataaggaattggcttcatcaatgatttcaatatctgcttttttttcttttctcgtcttttggtttctttcttctatctagtaccatctatgtaatggaagacaaccatatccatatcatgcaatatttgcatcttcttatttttgtatcagttcaatgacatgttttgccatttcatctttctaagttgttacacaaattgtcacttcctttgaacaagagtttcttcaattgcagttttattccagccgcacgtagtttcttaaagatatgttattcgatagctttaccatatgtactagcaaaacgaactaaacgacggcgtacgtagcgtaaagtagtgcccgcttcaaaatttcgtaatcaaaaaacacaagaagacttggtagcccaatccacataattaaatactattttaaaacaaataaattaattaaaaaaataaagtagcaaaaaagtacgatcgatgaaactgagaccgttggatcaaacctatcgaattataaaaactagatcacgagaataataaaaagaaaaagaaaaaaataaagcagaaaattcatctccaaaaaaaaagaaagaaaaattcatacttccaaaggaaaggggaagaaaaacaaaaacaaaaaaatctcaagtcaacaaacaacaacgaaggtccgaagaactttgaatgttgttatcatcatcatcataatcagaatcatcaacatcatcgttgtattcttttctgggtattttctcttgttgaccttctaattatgccatctccgattatcgatttttgtagagcaatcgtattttatcgaagcccttgtttctggttttagtctcttgtctgaaatcaatctcaaaaaggttctgttttttcggggaaatgtgcagcttttgattgtttcattttccgattgtttcagaagaactggaatcgccgtaaagttcgaatttttttttgttagattgtacaaaagggtgttgtgattaaggaagaagaagaagaagaagataaaaaggttttttttttggctgttgttgtaatctgggaaagtttgggattttgtatcgatctcaggtttgtgatttgattctgtttctaaaatttattaggctgatctaggatttgagtttttttttatatggactttgctttttttctcagatggtgaaaagacgaagaagtgtgattgttttggggatatgattaaagaacctgaattgttctggtgttgagaataagaaact

SEQ ID NO: 2294 - DNA, 3000 bp, Unknown
  misc_feature (1)..( 3000): cDNA_ID_3066937_gDNA_ID_1620516_Annot_ID_159291 3000 nt of promoter + ATG
aactgtctattgaagatctgaacgttacaaagagaaatgcacagtaaaattaatatttatgtagaattattcatcgtaatcacatttatctttttatttatttttattttgttattgtaatcacatttatttttatatgcagatagataaatatcatcgtaatatatttagctcaaacacttctggtattaatccatgttaaaagaaaagaaaaaaaatcatatattcctggtttatcttcatactgaaaaatgacaaaaaaaaacaaaaaaaatgacacgtgtttaaagattttgacgatttcactctaatcttatctttcttttttattattatttaagtttgtttaattgattttgtctccaatagtttttatttttctctccctcgtaaaatctcaacccctaaaaataaaataaattgagatttttcgcacaattttctcgtcgtttccattattttctctcttcttgactcggtcgacgaaattcaccaacccgttctctctttctctttctctcttctttgaattcccaaagtgattgaatcaaaaacttcgtttgattacaattcgatttcccccacacaaaaaaagagatcttgttttaatttcgcggcgagggttcggtttggctttcccgttgatcgcgttgttcttcttcttctttggtgattcaatttcttcaattcaatcaaattcgtatctttcttcttctttgataatgtttaggatttaggtttcgtaatttctgaaaaccctagtttagtttttgttcgagaaaaaagaaaaggaaaacaaaaaaaaaaaggaaaaatcaaatttattcaattcattctttttgtgttacccaaattcggttgttaatacgtctcaatttcgaatttcttttctagggttttttagggttccaaggaagctctcaaaatttctggtgcctagtatttttttgttgccatctgaaatcaagagtttcctttttctctccatagatctattaattcatctttcgattatccaaaaaaaaaaataactttttagtttatcttcggatctgatctatcttctttagggggttttgagtttttctagggattgtgtacaaaagagggatttttttggttttgttaggtttaaagtgtatatagagattaatagaaatggctttaaatttttcacatagacctttttcttctcatctatctgaggaaccaatgatgatagccaatgggaattggtgttcaagtttcgataatggaaggaagaatactggaggagatgcttcttctgttgatatacttgatgttttgccatctgatccgtttggtatggatatcaacaatactttcacggctattactggatggcttgaggatttggaggatgattataataaccaatatggaagaagaagaagagatgacatttggattggtgatggaaaccgtcagcagctgtttgctggattgagtttcttttggaacaatgcaatgcagtttcagagtagtggttacagttatggatcagagtcattgtttggtggggcgtttgatgggtctctgttttccacatgtaaattccctgaaagtagtggggaaaataatgggtttggaggggcattagatggtgatggatcttgtcatggtgctttcatatctgctagtagtgttgatgaggtattgagccatgagaatgcgaggaatggtgaagttgtaggaagtagtgatcgctgcaataatggagaagaggatgcgtatgttcatccagcgattggtttttgtctttatcacttgcgagggaaggatcttctttcagttagtatggtttgcaagtctttgcatactactgtttgtgatgacacgttactttggaagcatatccacatttgtcgaccgttgaatgagaagatcacggaagaggctctactgcatttaactgagagggctcagggtactatgcagtgtttgaggatcgtagattgctgtagaattactgatgattgtcttaagcgggtggtggcgcgcaaccgacaagtagtcaaggtgagcttctttccttaatttactttaaagcgtatttggattactaataagtaatattgtaagtttttatagaagtgcctggtaattgaattgatttgtgggatcctattaaaaccgaatgttgttttgtggttggcagattggtgtgcctggatgcacaaggataactatcgatggtattttgagcgtcttgagggatctgaagtctgcgggaaagcttcaagtgaagcatttacaacttcgtggcctctttggagtgactaaagatcactacgatgaactgattgacttgttgaacattgacaataaagtcaagcagactattcagaagccgcgtttttaccatagaggagaagcttgtgtgtcctgtgatgatgaccgggcactagatattgagatgtgcccaaagtgtcaaaattttaagcttgtgtatgactgtccagcagaagattgtaaagggaaaaagaaaggttctgaggaatgccgtgcttgttctctttgcatacagaggtgttatcattgtggtcggtgcatcattgacactgaatacgaagaaatgttttgtttagagcttttgtgtgctgtttgttcgaagccgacccctaagttaactctctaggtataaaattccatctgagcctttctcttctctatgattgaatgactcagtctccacggttcaatggagatgatcttcaactatctctagaacctttttttttttaaacaataaaaatatgttccatttcatatttgttgaacactcttatctttattattggagatctattaaaagtttgcatctttgggttgttcttgttcttcatctaataatcaaacaagagagatcatttatgtaaatttaagataagctttgacaaataattaaagactcacgcgccttttatattaatctttgacatcttctgctatctctccttcttccttggagaaaacatg

SEQ ID NO: 2295 - DNA, 3000 bp, Unknown
  misc_feature (1)..( 3000): cDNA_ID_3066948_gDNA_ID_1620516_Annot_ID_159284 3000 nt of promoter + ATG
tctcactctcctcgctaacgcgacgtcgttttttctatacccggtgatcgtccagacgttctgacacgcgctcgtcgcctccgcgagtatcaagaggaggagaagcccgtgagctccgtgaccgacggcgaatctacacgtggcgaaaacgtatagggtcgcaatgtggtggaggatgaagatgaagtcgttagggaggaagattaagtaatggagaagatcaacggtgaaataagccatgctgaagtcgagtacgtttgattccacggcggtattgggagaagcgaatgagtgtacgtcggcgcgtggagttgtgagcagcgcgtgggaagccattataacggcgggagtgccgtggaagagtgacattaagcagctagcgcctaaatgtgatgattgtttccatgtacggaaaactaggaaatagccgatggtgtatacggcgaggaagaggaggagaaacgacgggaaagtagccagaaaagacgaaggattaaacgacgccgtttccatggttcttgttttgaaactgtttgagaggtttaaatgtttaagttgggtttttaaactgagaggtgggaatgatttggtgtggtgataatgtacagtgcatctacgatagtcatcgtagtcaacggatttgtagccgttggattaaggagtaagattagttttgacgtgcaagtgtattagtgagcgtgcttacaagttttgctctggtgcttatttggatattcttttcgtattaaagtgataatatttgtcaataagtaagattaaagaacactacatgacattgcaaaattgagttggtttacatatacataaggttctaatgatggcactgaatcattgaatatgcaacattaatgtaagaaacaaaactggtatgctctgtgaatatctgaatcacaatgatggaaacatcaaccttctgtgaatctatgagcacaattggggcaagtgtaatatgttgtctgtccttcatcagctgatctcgtctgcaaatccgatgaaaacatttactttgaaattgaaacaagaagacaagaacttgaaaccacataatcaaaaagcttgaggactatacctgtctggttgtgtatacaagctcaggatgctggcatttctcgcatgcctttttgatctgcaaagagaagtatcatcaaaaattacaagtcatggattcagaaaaaaacacgtacataaaaatctgtttcgtataaacaaacctttggtagctcagcttctgcctgcgttttttcaccaaacaatgatattcctagttctcttctgatatcctaccaaaagcaaagatcatgatgaaatattcttgcaagaataacaaaacagtcatccatttttcaggtctgaaagtaatcacatagcacagaactggttttctactgtgtgtgtgtattcataagcctaataacaattgactaacaacacaaatcaagagcagagagatttttgctactccatgaaaccgaaacaaaatgtatgatgcatacctcagcagaaactgtgtaagctatttccttgtcgatgatatctgaacgataaaagcacagcaataagattaaaccaaccaagaaacaaaaactttgttttgatttgatgatatcaagaaagattcatcaaaaccttttgcattccgtgttgttttgcaatgtggacattctgcatacttggttgatttcaagacaagcatagtcccacacaaattacagaacaagaactcgctttctctagatttctccattacagaacctttaacacaatgacaccaaaaaagaaaaaaacataactcatctctacatgtctcaattgcttgaagaaatttacaagtaatgagtaaaaagattaagacgatcctatgctcaacagatgagtaaagtaagcatctttaagctaaatatctccattaacatcatctaaaatttcaagagtagtactatgagcatcaaaatcatactcagaatcgaaagttcgagactttaaattccgttaaaacccaaaattataactttaacaaatttttacagttctatatacttcaaatgagaactaaaatggaaaaggagaatcatcgagtaccttagattacaacagatgctttcgctatcacagagcgtctcgggagagaagaaaaaaatcgctagggtttttgggattcagaggtaggagatgcagagattataatgggctggatatatgtctgtttggcccattaacttttcattttagcccgtttagctaattatgtcttttcttttaccaactctctctaatgatatttaattatgattaaaaattccgacaaagagaataatgttttatgtcatcaatggcgtgtatccggcagttaccaaacaccggtccactcacaccattttattaatggaatatttcaatggagaattggtaatatgttgtagaatgagatcatattattcgattgttttcttttttgatatacaaatgtttttttgttagacttagcattgtctctatcctaatttgaataagcatatgactagtcttttgaaaatttcagtaaaacgttttccgcaaactcatcacaagttaagcagaatctgaaccgaaatctaaatgatcaagtgatataacatggagattaaatcactataaatcgttatgtaatttctttaaatgattgcatattgtgggattgaacttgaagttatagcgattttacgcttttggttctaatccaaacctactttgccactacacacgggtttaatatagtattacttgtgtgtataattttattttattttgcaaacgagaagaagccagaatcaagtcgttaacccatgcctttcaattacccaatcacctaagatttttttttatattacttcctttgacaagttaatccacttccaaatatactataaagttgcacattgacaagaggttttagcagaagctagaagaagaaaggagaagaagaaacaaagagagaagatg

SEQ ID NO: 2296 - DNA, 1563 bp, Unknown
  misc_feature (1)..( 1563): cDNA_ID_2025638_gDNA_ID_1620516_Annot_ID_159269 3000 nt of promoter + ATG
gatcctcattgtcattgatagtcgtaggcatttttgttgttcacttgtgttgttgaagtcttcccctccatttaaaaatatgagtaaaattgggctgttattttagttgtggtaaccaactcacatttagaatttcagaaagctaagatttcaataatgatgtgtattgtaaaaggtttatatactcggctctcccaaatgttctaaacaatagtttgggtttcgtttttcccaattaccaaacaaaattttagatatatgtccatttcggaacgagaccttgtctttaccgtattcgtctcgggtttctagtcccatatccgctcgtataattaattgttttgagacaatgtaatgcattgaatatatatcaacttttatatatactaggtgatcatccgcactgcgctacagagttttctatatatttgtacatacaaacaaacgtgttggtcattatatgccattgtttcttctaatagttctcacaaatgtttaggcattggaggatagaagaacaaacgaattagagatatctaacacaacaatggtgtggtcatctgatcaggttgattagaatattcatgtggctgttcatacggtagctcgtgctcgcttccttcttctcctccatggccattggtgagatcttcaacttcgagaatctcaaccctccgtttcatcttcctttgcagttttaatgcaacatcggatggtcgaaaccgtccgcaaaggattacttgacgttcctttttgttgatcatgtgtgtatcaacttcttcataaaaaagtatccaaaacatgtgttagtattgaattttctataaatccaccacgactaaacctacataaaatggtgcatatagtaacatcgataaaatttaacgatgtctttctaaaattttcagattttccactcaaaaaatcctccttgaactttaaatcttattttcataacatccttctttgctcatttcatccacatattattttatataaccaatataaaccaacctttcatattgatgataatcctcctagcttttctacaacaagcattgcaatccaagttaatcctcatcacaacacaacattgcttctgcatttcaccaccccaaaaaaaaaaaaaattatcacaaatccaagaaaattattgttcaaacaaataaaagaaaacacaaaaccttttccgacatgagacgaaagagcaatattgtatgatatgtttttggttaagaaaacaaaagtatacttataaattaagattttggaatctgattctctaacttaggtagagcagagaagatatataagaaaactggttttgttatgttacctaatatccattgagaagcatctaaattttctttgtttctagatggtttaacctaaaccgaagtttcagataaattaatccggtttaattatatatccggttattaaactggtaactgatacaaatgtaggcgaagacgctcaacgaacttcaacctcgtcttctccgtccacttcactctctctaaactctctctcagatctctctctctctgtgattcaacaatg

SEQ ID NO: 2297 - DNA, 3000 bp, Unknown
  misc_feature (1)..( 3000): cDNA_ID_3066909_gDNA_ID_1620516_Annot_ID_159283 3000 nt of promoter + ATG
aagatcatgatgaaatattcttgcaagaataacaaaacagtcatccatttttcaggtctgaaagtaatcacatagcacagaactggttttctactgtgtgtgtgtattcataagcctaataacaattgactaacaacacaaatcaagagcagagagatttttgctactccatgaaaccgaaacaaaatgtatgatgcatacctcagcagaaactgtgtaagctatttccttgtcgatgatatctgaacgataaaagcacagcaataagattaaaccaaccaagaaacaaaaactttgttttgatttgatgatatcaagaaagattcatcaaaaccttttgcattccgtgttgttttgcaatgtggacattctgcatacttggttgatttcaagacaagcatagtcccacacaaattacagaacaagaactcgctttctctagatttctccattacagaacctttaacacaatgacaccaaaaaagaaaaaaacataactcatctctacatgtctcaattgcttgaagaaatttacaagtaatgagtaaaaagattaagacgatcctatgctcaacagatgagtaaagtaagcatctttaagctaaatatctccattaacatcatctaaaatttcaagagtagtactatgagcatcaaaatcatactcagaatcgaaagttcgagactttaaattccgttaaaacccaaaattataactttaacaaatttttacagttctatatacttcaaatgagaactaaaatggaaaaggagaatcatcgagtaccttagattacaacagatgctttcgctatcacagagcgtctcgggagagaagaaaaaaatcgctagggtttttgggattcagaggtaggagatgcagagattataatgggctggatatatgtctgtttggcccattaacttttcattttagcccgtttagctaattatgtcttttcttttaccaactctctctaatgatatttaattatgattaaaaattccgacaaagagaataatgttttatgtcatcaatggcgtgtatccggcagttaccaaacaccggtccactcacaccattttattaatggaatatttcaatggagaattggtaatatgttgtagaatgagatcatattattcgattgttttcttttttgatatacaaatgtttttttgttagacttagcattgtctctatcctaatttgaataagcatatgactagtcttttgaaaatttcagtaaaacgttttccgcaaactcatcacaagttaagcagaatctgaaccgaaatctaaatgatcaagtgatataacatggagattaaatcactataaatcgttatgtaatttctttaaatgattgcatattgtgggattgaacttgaagttatagcgattttacgcttttggttctaatccaaacctactttgccactacacacgggtttaatatagtattacttgtgtgtataattttattttattttgcaaacgagaagaagccagaatcaagtcgttaacccatgcctttcaattacccaatcacctaagatttttttttatattacttcctttgacaagttaatccacttccaaatatactataaagttgcacattgacaagaggttttagcagaagctagaagaagaaaggagaagaagaaacaaagagagaagatgaagaatgttatgctgattattgacgagagcaacgcaagttatgatttactcatttgggcacttgaaaaccaaaaagataccattgagagctccaaagtttatatctttgcaaaacagccacaaaattcctttactcctcctaccgtactttcttcatcagtcggctttgctcaaattttctatccattttcacctagtaagtcattttatcgactaatttgttgggagttttcaataaatatcaaattttctatccattttcacctagtactttcttttgttgaaaattgatcagtttttatgtgtgttttgcagattcagaactcataagattggctcaagaaaagaatatgaaaattgctttgggtatattagagaaagccaagaagatatgtttaaatcatggggtaataatctattgactgaatcatttaacttgttattaatacaatatcatatatatatttttaaataccaaagttttaaaagaaaaaaatgaagttcttttcatgacaaccatttgttgcaatattttagtctcatgatctcatcataatcatgttgaaaacagatcaaggcagagacatttactgatgatggagaccctaaagatctaatccgcaagataattcaagaacgaaatatcaatttaatagttacgagcgatcaacaaagtctcaaaaagtaagaaacatcttttaatttcaaaatatcagttaaaaaacttagtattgatggaaaagttgagataacaaacatcttttaattaaatgcaggtgtacacaaaatacagattgttctcttcttgtcgtgaagaaaagacttcgcaaagattaaagattaaggaagttacaaaattcaccaatatatataattttctatgtggttaattgagattgtgtaatgatttggggttgtagtttcaggtgttgatttggggttgtagtttgaacttataattgtgttatgtgtataaatatttgtgtttatatatatcaagttagtataaatactataatttcttatcgtttcttttattggcactggtgtcttgatcatcccgactaattcagacatgagcttatctgaaaacccactttggacacaaacgaattgatacgaacgagtaacgactcttttattgaaaacgaaaaggcctaaatttgctgtgaaaggcccaataaacaattaagtgattatgtaagacgatgtcgtttaactcttaagtttctcaagaaagttatctctctctatctatcttcctcaaccttatccttgaagctttgtttcatctgttgttccctgtgaccatg

SEQ ID NO: 2298 - DNA, 3000 bp, Unknown
  misc_feature (1)..( 3000): cDNA_ID_3066963_gDNA_ID_1620516_Annot_ID_159273 3000 nt of promoter + ATG
tccgtaacataacatgatcatgatcactctaataacttgcaaaatcatttaagttcggtccgatttgaaccgatcaatttaaacttgtattttagaggttaagctcatccattatttgatatcttacaccatgaacgaacatttggttaacctaaagaacacaaaataaaataaaaatttctaacattttttgctcgattctatttggtttcggtcctaatagttttgaaacaacttaaaacaggtcgcttccagattaatccaaaaagttaacatctctagattaaaatttatatatcaacttcaaattttatgatttttttgtaaggttcattacgattcgatcgattaaaaatttaaaacattttttactaaagaaataccaaaaaaatattgaaagtgtcattttctttcaattccataaaacgaaaggaactcctaatttccaaaattttgtttattccacagcttttttaacatatcgctcgcattgccacattggtccagacctactcccctttttatttacaagattgccactttaaagagttggataattaatttagtttaaactaaacatttttctgcaacaatatagtaggaaaacaaaaagctagaagaaaaaagaaaacagtgaacgcacgcctgaatgcatgtgattgcctaccctacgtgaagaaaagacgatgcaattacagaagtaagaaaaacattttctccaccaatatacaatgacccttactaattattactatttcaacaaaacgtttcctacgtaaggaaggcaacagattcatttgatgtcatttttcaacgacaatagacaaaaaaaaagtaaagcaataataaagtaaagttgtacactacatatatactttttaaaaattgttgaaacacaaaatgtgtgcaaatttataacagtgtatacaaaatggatgttcaactacgtcaaagactattcatgaagaaaaacggtcgtgacaaaatttagacaaattaacaatatattaaataaaaacttttaaaataattttagtattacagaaacattattagataaattcgcaatatttttgttctattgaaagaaaaacaaaaaagaaagagtaagggatcattacattgatttcacacatacaagtgtcggattatcagtgtcacgtggtgtttaaaatgtagacatttcaccatgtggactaatacattcataaataatgcagccatcgacgacgaccatcaagcaatttttatatgtggaaagttttttcaaaaattattagtaagtggacacgtcagacaaaacagagagttgaaaaaaaaaaaacataagtgtagagagagcgaaagacacaagtggagctggtcggaagttggaaagttggaaacagcttagccgcccacgtcggccctacaattgattcgacgttgttaagatataaagcccaattataatgtacttaactaaaaggcttttactttaggcccatatgtagatctttgttttcttttgttaaaagttaaaacaccaatatcaattagtgcttacattattcgaaaaatcattacaaatttacgtgtcattttaaattgatagtggaaataaataaataaataagactaggaataataatcgcaagaaaatcttccccacgttaacgatgatcacaattcacaagttcttagtcttccttatttatttgttgtttggccaaatttttttggtctttgttaaattataaaaatatagatctctatgtatataaaaatatgggtaatattagaaactaactatgaaatggaaaagaattgagagaatgacattgtgtcagaaaagttaggtaaataacattttctgaaaaagagaaaatacaaaaatatccttgtgtttacttatttttacaataatgccattggctttagttataaagtttatatgtatttgtctaaaatagcatgatatatttacaaaaatcatgcaattctttaaaatacatacagaatatatatacacgatatatatgtttctctgaaataatgtgtttctcagaaatagcacgaaatatttataaaaagcatgcaattctcttatagatcgcgaagtttaaaaaaacatatagaattgttacaatattacatgggtttttattggataacatgacaaatatttatttatttcatgagtttttattggatagcatgacaaatattaatatatcagtgttaataacatgttttgttcttaaaatacatgcattttaaaatcagacatttgttttaaaatcaaatctaatctcttatatcacaacgacattgacggaaaattcaggtaaaaagagaaaataaagaatgagagatagagagatttctatggaaaaagaaagagagaacatgtaggtgaacaaaataaagagatatgatgatatattttatgagaggtggtgaagattattttaggagagggagagagaaatagaaaaagaaaatgacatggtgaatctgaagaagatgaattgtgttaaagatgaagagagaaagagaactccatggctaaagtctcgtaaagaagatgaaaaagaaacaaaagaaggaagaagaaagagaaaggctaaaatagactaactattgccaaaatttctgtagccgacaaatactatttggtccaaggttattttgtgtattcttttgaagtcaaaagttatttcttacatatactctaaaaatatagccgataccaatttttccacacatggacttcctttattccaaaagtcaataaagtgtgacgtcatgatacttacgctttaaaacatcgcatgatgatgtcattagcatcaatctccaccgtccaatttatttagttgttgacaatatcgaccgtctaagttccacaccgacggctataagagtttcattataaattttagcaaaataaaatcagcaaataattttttcttgactaagcttaaacgacgccgttaacattttcttctggctaacatg

SEQ ID NO: 2299 - DNA, 2271 bp, Unknown
  misc_feature (1)..( 2271): cDNA_ID_3066997_gDNA_ID_1620517_Annot_ID_159322 3000 nt of promoter + ATG
gatctataatgctattgctacgcatgacccatcgacatttgatttcaatattacttgatcaatcactattatagaagcatgataacaactcctctacccaacagaaataatagaaagtataaataaggtaatttcatgcgtaaattttacgaatgaagaatcattatatgtctttgacttctatagagataactcatgtggcaaaagcgtaatcataatgcaacatagggtaaatttgtgtgtaaatcgtagtttacttttcttttgttactttttcataaacgaataattgtgagagaaaaaaaagtgtgtgtttaagcagagacaggttgacaaaagatgcggaggtttgggttggggtgtagcgagaaaagggtaagtaaacactttacaatgatgataaccacgctccaattatttctatcaacagagcatcatgagcatcctctaaagttattttccaaacatatatgtaacacaaaattttaatactatacgtggactttttcagtacaagcaaaatatcatacattcctttaaagtatcatataatgtatagggtttgtgtagtaagtaatacatggagtgataattataacgtaatttgcgtggatgaatcacatagtactatttagtgacatatagataattggttggtagtacatggatcggtaaaagcatgttttgtgtatcgatggccaattatgaatacataagtaaaaactttgagttattacaaaatgtaaaatacgaaaaagtgtttgtaaaccatcttgacgtgatacaaatagaagaagaaaaacagcgtcgtgttgtgtgtgttgcgtatttagcaagttcagcaaatttacgtctaaaaccgtttccacatactgtactttttgtttcactgaaaatgtctagctagtgtattagcaattgcaattatggctaaacagttccaaataattattaacatccactttgaactaacttttttccagtattatttttcaatcctatttaaaacctctgttttttcccctagccttaattatagttaagagtggaaacaactttgacatcatttatgtttgtgtcttcatgaaccaccgtggtaattaaaagatgtgcgccatgaacataagatatttctgtaacagtagtgattaagatttaagatagtaataaaaaacacgacttgatgtaatattttgcaactttcgtgaataaaatcccgaggtttagatctcaaactttaaaataacttcaggaaatcaaatacaaatccaagagatttgttttaagaaacataaaccttttagtcccctaaaatatcattattaatttcgaatgttacgtcgtgttattctgaagctttcacaattatcattttttttaacattcatttgttgactattccttaactaggcattatattttgtaataaaagttgaagtcttactttgagtaagaaattttttcaaatgtagctagtaaaatctcgcggtataatagaaatcttgtgttgaaatgtttccttgctaaacaatatagtatttgatatgtcaacatatgttccattatatgcatcaattacttgcatgattaatgtaatgtttggtaagcaaaaaatatataaatctcttctggtcgacggctctacgttgcttgtaaacaagggttatccaagacgggccttagtggcaacatcctcaacaatatttaaaatgaaattaaaattgtttttttataaatcatgcaacaaatccgattaattatactattcaaataacaatgctgaaattatacttggacggcttcgagaaaataacatatcaatatatctcaatttttcatgtcattatcaaatagctcttttgtacatctttcacaaatttttattataaattcgtcaaacaattataacttttgatattgtggaaattagggtgcattatctttttatgaatgcaagttaagcaattcgaggaattttccaactcaatgatttgaatcgagtttaataatattattttaacaaatcttcggcgcgacatcgttcgagaccatgacaacaattcctttccgtgtccgtatgattataaatcttaatcatatcatttccccctataataacgtacttaaaattattaatactactattattgttaatctctccgccacataataagaccactatataaacgtttactccattaatgtactgtaatcgaatcgacaagtctctctcttctctctctctattcaaaaattataccggcaaaaatg

SEQ ID NO: 2300 - DNA, 3000 bp, Unknown
  misc_feature (1)..( 3000): cDNA_ID_1557632_gDNA_ID_1620517_Annot_ID_159326 3000 nt of promoter + ATG
tttattcaaattcacttttttctactttatagattcatttgttggataaaggtctgcaagacacataaatccctacttcaatagattttttttgtgaatccatgtatactatgtgtagatccaagaatgcatttttcgtaactgaatttgttgctactaagtattccaaccttaatttgtggtgatatatattatataggttgttcgatgggggcgatcagtgtatgccaacattcagaagttcatccaatttcagctcacagtcaatgtcgccgctctcgtaattaatgttgtagctgctatttcgagtggtgacgttccacttaccgctgtgcaggtttgagtttctgttgcatttagctctttttgaatatctctctctctctaaatattataagtttgctcatatatttggcgttttctttaacatacagcttctctgggttaatctgataatggacactcttggagcattggctttggctactgaaccacccactgatcacctcatggggaggcctccagttggcagaaagtactgttttttccgccttctctcattcaaacttaataaaacatttggttttgtagacatagacttattgttatctttctttgcttcgacttctttttgcagagaacctcttattaccaacatcatgtggagaaacttgctgatccaggtaaaaaaatcagtgaatagactctgttatttgaaatcaccccgtcttatatattactaaaaagttgaaatgtgattctttcaggctatttatcaagtgagtgtattgttaacactcaatttccgaggcataagcatacttggcctggagcatgaagtgcatgaacacgccactagagtgaagaacacaataatcttcaacgcctttgttctctgccaagtgagttaattaaatcaaagtcttcccttactgtattaaaaccagaatgtcaacgtaaatgttaatcgaactctttgtttacaggctttcaatgagttcaatgctcgtaaaccagatgagaagaacatcttcaaaggtgtgatcaagaatcgtctctttatgggaataatagtcataactcttgtgctccaggtaaataatgatttggtgtatcagaaaaacttagtaagttacatttcacaaactcttatttctaaatcaaaaccgtcttattttcgtttgccaggttatcattgttgagttccttggtaaattcgcttccacgacgaaactaaactggaagcaatggcttatctgtgttggcatcggtgttatcaggtcactttcattataatattgtttacaattgaaaatgttgatacatatttataaataatatgtgcaatgcttgttgaaacataactaacgttatagttgaacctttgtaatttgaacagttggcctcttgctttggtcgggaaattcattccggtgcctgcagctcctataagcaacaaattgaaagtactaaaattctggggcaagaagaaaaattcttctggagaaggtaatagtaacttacagcttgtgattatcaattgaactagattcataagaaaagtttgggttggtcagcttgtgtagtagaacttatcctgaatttaaactgtagtaaggatttggtttaagctttatgcaggactgaaatgaatttgaaaatttgaaaataacaagtttgcttttatttttttctcaggttcactctgatttggaggccagtttattatctctcagacactgatgagattgtttgatactcttttaggactaacagaaaaaaaaacgtttggtttggtatgatggatttattgatatttttcggaaacccaaccccccaagtacagtttttcggggtttgttggtcgagcaactttggattactggttttctttttggtctttttttttgtaatatgatcgactacctttcgaatcattactggtaaagattttaaccaagaaatcaaaattcgaaaaaatggaaaatttttactctcagtgtgacctagttattcaagtggcaaagcgttgttggccatattattactacacctactgaacacggatgcaatagtcgttaagaaagttatactcatgagaaaacattgaagtataaatcaaagcattactaatgaaaatgttgaagtaaagtcgaggttgtttgttgtaaaattaaaaacaaccacgattttaagattaatgtcgaacaccggaaacatttttaatgtcgaacaattcaacacccgcatatgaatctggaatgtaaggagacatcaatcaattccacacaaacatcgaacagactgtgaacaactggttaacagaaaccgtaaataggtcctacgtgtcagacaggtttggccacgtcatatattcattatcggatacggaaatcactcgatgaaaagccaaaagagctttcctttgtttttctgtcgactgatattattatattcttttctttttctcggttgaatagttaattaatgtaatgtttatcccattctataattttattttgaaaataaagaacgcggaaaaaataaaataggtaaaaaattcacgcgtgaaagcaagaagaagagacagtagagtctagagactactaaagtgtttggtttactcattccctctccttttcaagtgacagagccagacactcactacctctgtgttttttttaatggtcggtgaagaaaccgtgatttgctcaaatcaccaaaataatactctcttcaatctccatcttcccgttatctccgccacgtgtttctctctttttgtctcctttcttcttctccctaatcttaatctcagaaaccaacaacatcagtagtcagtacccccacacacacagagagaccctttttcgattctccactttctcataaaggaacgatttttcgagatgtgggtcagtgttgatttctctcctcttggcttatgagtttcgaattcgaatctcaaactaaaaagctttttgaaacaagcaacaaatg

SEQ ID NO: 2301 - DNA, 3000 bp, Unknown
  misc_feature (1)..( 3000): cDNA_ID_3066984_gDNA_ID_1620517_Annot_ID_159329 3000 nt of promoter + ATG
gatgaggaagagacagagttagggagacaacaagcacctggatcgtgtccttattgtggaggtaaagtgcaaatgcttgatgtcgaaagaaaatggatgttctgtttcgttcctctttgtttcaagatcaagaggaagtactcgtgttcttcttgtgatcgtcgtctcgttttgtatcattaaaattataatattgtagttttttttattaatttcctttcttaataattaaagtcaattaattagcgttttaatcaagggaaataattttagtcggtggtatttggtacggttagtatatctagtcgtgtaaaccgacattgatcttttagaaatgttatagaactatctcgattcaaccttaatgtactttttcttttgtcttcgagtgtcttcttaagtcggtccaaattaaaaagtgtttcaaatatatgtaatcgtgttgttagtgtaatgatgaatctcaagtttggtgtatttgtggcgatttcttttctatatcactagatatgtttgaagcgggaaggaatctatgatctctagctagtctccatgatcttgcaactgaatttgattttcggtcgtgtaatttgataataaatacagataatagtaatagttgcatgcaagtacgggtgtcaataagtctgatcttcaatgcgagaggtttttattggaccggtccggttgaattttgtcgcgtgggaaaatatcaaaacaaggagcaatatcggccgaatttgagtggtaatataagattggactcgacttaatgaaacggtgttgaatgtggtggcgttagcgtatattaattatggtaacaacattactatttccaaatttaccattcacacattaagatgattaatgcacatttaaagcatcaactataagaattaagaaacgtctatggcatagaatattaatctttatgcgttactaatttgaggtccttaatattaggaataagattatgggcagtccaaaacatcattgtgtagcttgcatttatactttacagccatcaaatacgaatctgaaaaaaataaaaatctacatatacatgtatgagaatagtttaagaaaagatagagattcaattgggatgatctcatgataatgtaaaattcgctcgtgacttatttatgagacgcagagagagaaaaagatcacaactgattctgtcacatgcaaatgcaaatactgacatcagtggccagtgaattatgttgttttttagtcagagcagaaactgtattttgtggacatttcaaaagcaaattaatacagggaaaatgaaagaacagctcttatatttttggggattataaacagctcttatctactgaacagaataatagaaacagctcttatctatagtatattatagcttatatcaattctttatttgttttaatatatacaaggagatttcgaaccaaaacaacactttttatatatatcattctactgttctagttatatttttgatatgaatcttgttaatagtttcagtaagttgttattctattaccactgttacgttttttggactgaaacatgtgaaaatctgaaaacagaagcctcactgccacagccgtatttgtgaacggtttgctctttgtagcaacatagtttcatgattccctcgtataggctggtttaaggttttaattgttttaatgatctatatgttattcttatgataaatgtgctgaacgaattacatttttcttaaaagtaaagcgtattgataaaattaggtagaagaagttatatacatacgtgagggtgggccaaagtcgtatttatttcggaagcgtgtactataacattagataactcgtagctgcaacaagaaagttcaatgtacgtactttcgaaaatcaagtggcaattggagagaaacacaaaatttgtttcaacaaggaatgaactagggtttgtcatcacccgtatcacattattgtaagtttgtaacaccgtaacgtcgcgaataccgtgtggcaggctaagaacatcaacaggagcaccaactctcagtaatagacatttcatatgtaacatcaaaagtgtttaatgtagagttttcactaatgcagtaataaaattaccatctatcagtcgttaaacagaaatatataacctcaaaacaatttctaataatcccaaaaaaatgtattcagaatgaaaagtatagtttgcaatatttctctgtatttcattacttaatactatttatttatccaaaaaaaaacttcaccaaattttagtttcttcctatagcatctttggtatccaaaagaaaaagatacaaaattatctaaaagtctatggatacttacttgtatatttggccaacacagttttcaaatttcaaattctctaaaagtaatgcttctagaaaatattttctatacgaaatgtatagaagtttccatgtatagtgtttgagaaatttgtgaagaatctccgagaaaaaagtgttcagatacttgtctatttttagagatacacattttcaaaatcacctgtagaaaaagaaacaaacagtataacccaaaagcgtcttagataaattgactaattttggcaggtaagaaaaataaaccatagctgttacttgtttgcctgttattgattagagacaagtaattatgttattgcccattgggctcatacatttttttaatgacccattaaactcatactttttttgtaatgacccattgggctttaagtctagtaatgaaacaaaaaaaaaagagaaaaggaaaagcttgcaaaccataacgaaataaaccggtatagaatccgggtcgggtttaatttgcacacccggtaaaaaaccctaatttattttggttccaggcaatttttttttgtcttgagctcaaattgaaaacacgagcttcctaaaccctagcagcagagtcttccgtaaacccagctctcttagctctcacgcctcgtcaattgttgacctgtaggatagatatg

SEQ ID NO: 2302 - DNA, 3000 bp, Unknown
  misc_feature (1)..( 3000): cDNA_ID_2048012_gDNA_ID_1620517_Annot_ID_159335 3000 nt of promoter + ATG
ttccaaaaaataaaacacagacttatccactaaaccttttaaaagtgcagtactgttaccagttaaaatgttattcaagtcgcagtgataaaaatctcaaaagtatatgacaattttcattcgtagcacctatatatttgcatttttacatcttccacttcgaatttattgattgaggcttcgacctctactacaaatgttttcacgaatatatccattgcaaaaatttagccacagacgaacaatgccgataccgcattgatgactatactattactaatcttatggtacgtagtatagcacatttgttttaggattatagtttgtaatgaagaactacagctgttggaaaaaaaaaaaaagagttatccgacgatagaaaatgcagcatatagaatttgtaatgaaaaactacgtctttgagacgacgtaatctaaagcaaacactaatcttctatcttgttaatccgtttcattttttttgctgtgagttcttttatcggtcaaacaacaaatgcatggtggggttaacaccaaagtccttttaccacgtggttttaaactaaattacttaattatacacatggataaagacatatatgttgatgaagagaatataataaagcccttttaccatgaagtttctttttcgaattttgaccgaaaagagattcaataagatccgttatatagatgagaagtgttattgggaaataaagcaagagtggcaagtggacgatagtgtgcttgcacaatagtcgagagaaaaacacattattttgagtttaaggagtccattaacaccatgatcaaaccaattactatctattcaaattcaagattaatcactaattttctagctttttgagtaattacattcgcatttgattgttcttcacttaaatcaacttaattttatgatgaaccacaagactatatctatttaagtatttatagtaaaacttcaatgtaagttcttgtaatgaaaacaaagagcgtttttgtccactatctatatgttacaaacttacaatacaattcgtttaagaatgtttggtgggagattttcacatgcaacatatctaatgtgggcaagcaagagattgcttgaaatagaccaatcctcgagcgatatccgcgggcaaccattttaatcttggtccccttagccgctttttgaatcaaaatcttttaaagtttctttatttcatgaaatcaatcaatattaagaattttttggaaacatacaaaatatttatagttacagtagttagttcgtcattaccaatatgcaaagttcgaaacatgtattaacaaagatgattctaaagctaattttgggcgacattctaagtttttgcttctttttatagttcttttagttagtggggaaaaagaagtattaaagtgggttgttgggatttttatggtaaataacattgttgggaatttttgtatcagacaactcaaaaatatattccctctgtttcttaagtactatatgtttttgtgatttttgcacaatttaagtaattatttgcaataccaaattaagtttcaatttattaattgattattataagtttataactaagatttacattaaattgaatttaataggtatgagtaagaaaatgaaatattactgtcacaaaaataaatcttaacccttttttgtttgtaccgaacacatttcattttgttttccttcttcctttacttcttctctttatgcaattcttgaggatcgttctcgtcacacgttagcacttagccttagcagaccagaggagctacaagagtttttttttgacaaatacctttcacttaagaccaaaattgattgaagtttatataaaataataaatgattatgtggtataaacaaaaggagggagagatgagacagaaggttgcttttgcagtattccgggaatgcaatgctgtctctctccgaggattggcgtgagtgagtgagagagagagagagagagtctcattcatctcttttgtccttcttgtaattaattggttttcactattacaataaaaatgatactataattttcgataaaaatatgcctttattggagattaaacaaatgcgagtctaaataacctttttaggaccaacctaagatatacataaaaagatcaagaagatctttgtttggtcactcctacgcacatcaatgcaaaaagagacaaaacttctcttaaccaagaaatgaataaatttttactttttacaaatgtccaattcaattagcatgcattttaaaaacgattttttctccacaagttattaatgtgtaaattagtatatatttgaaaaaaagacagcttttttttatgctcttattcgctaataatgaccaaaaattaaaagagatatgatgagtacactgaagctgcactgttactgtaaaaccaaatgagaggagaggaacaaagaaaagagagaagacaaaaaagttgagtgaaatgcaaaaaatcaaaagcatacaaaagctgctcatttgtccaaaaagaaacccatcataaagtaaaagcattataatgagatcaaaacccttcgaaaaatttaaaaataaaaaccaactttttcttaaaaaataattcaacaataggaacagaaaacacacagcatgaaataagtataaaggaaccagcttggtctaatttccttatctgtctaaaactctcttaaacctctgtctcttctctctctttcttctcttacttatcttcttcttctcttctctcatttcttgagttctctctcaagactcttcttttcttcagtcttcaaacataagaaaggaagttccttttgtttcttctgttttagttctcttgtgggtttatctatttggggtggtggttaaaggagggagctttgggattagaagtttttcagtgaaatcagaaagctttcgagagaggtttttttcaatttcaaaacgtgggggtggggggttagggttagggtttacaagtt

SEQ ID NO: 2303 - DNA, 3000 bp, Unknown
  misc_feature (1)..( 3000): cDNA_ID_2048000_gDNA_ID_1620517_Annot_ID_159338 3000 nt of promoter + ATG
agaaagaatgcggctatgttaaaacttaaaaccctcgaataccataattctgactgtcctataaaattcaaaaatatttcatttgtacaatcagacattgtagacaacttgtttacaattatcttaccatgtagttatttcggccacatctaatgggtcttaccattttttgttcttatactataagttaacataaaccacacgagaatatatatcatagatgatacacaaaaatgaaatacatgttgtaggcagcaaaaagaaaaacaactctacagaaaacatatctcatcttataaaaccctatttaaccattcatttggatattgaaaaaccaagtaaaatgaaaacacttatagctaagaaaaaaatctacatgagactaggcagatctgaaaatgtgaacttatagatttttatcaaatgggtcatggctcaagagtaagtaacccaaatagttacaaacaacaagtgaactatttcttctcttacagattggaggggaccattaaaactatctatgtcttgctctatatttcaaattctaattttttttttattatcagcatgggtaataatgcaatagcacaactctttcatagattgccttccatgcttatgataaactgttgatatccaaagaaggaaaacaaacaaataagacaagtaactaactagataaatatagacaattcaaaagataaatgttagattgatagattgagagtaagaaaaaaaaaaaaacatacttcgagtatgtacggacaaatctataatacactttattgtgacttaatgtcttatgtttcaataaatgaaatatgaaataaagatactatgatacaaatcattatatacacatacaattttgaggtcaggagtcaggattcataaataacaaaaaaataaaaaaaatgaaaaacacagttttagtaatattggtagtatttagaaaatgggatttagctagtgtgggcttacatattgtgattgcttatacaacaattgtctttaagccgattttgattgttcgagtataagtgatgctaatactaattcaagccaattgtcattagaaagaaatcataaattcttttcttatggttatctagatagtcacttattctctcgttccttactcattcattggatccgaaaaacgttaaaagcttatcataagcatggaaagacaaaagtgaaagagttatgcgattgcatgattctccatgctcattccaaaataaaataaaaaatcgaaattaggaaaaacataactctctattggtcccctccaaaatgtaaaaaaaataaaattgatattttacatttgggctgaaatttgcattgtaggcccatgggattccggtttgataactttatattgcccaattttatatcgatttttaatttcaattttaaagataaaagtaaatgaactggtaagccactggttttggttctgctcttaccgttatcccaacttccatatccaaactgaaagacactggttttggttttgtcgggaaaaggagaaacttcaaaaagatgcccactttgaatctcttcactaacataccagtcgacgccgtcacttgctcagacatcctcaaggacgccactaaggccgtcgctaaaatcatcggcaaacctgaatccgtaaccaactctaaccctctgtttcggccatttctacgctaattcataaattaaaacttcaaattttgttcctgtttagtgttttgattacatgaaagcagagtagaatagaaatttccttttgttgataaggttcatgacgttggttgtattatgcacatgaagtgttcgatggaattcctctctgaattgcaattcctcataacttaactcttgagagttccctttagattaccaatttactaattcatggaactttgtggaaaccaataatacagtatgttgacaatatcactaaaggattcttaagcttgtgttgtggtcttaacttgtgggctacgtctgttttcttctttgttttcagtatgtgatgatactgcttaacagtggagtgcccattgcatttgccggtaccgaggaacctgctgcatatggagaattgatatctattgggggattaggacctggcgtaaacgggaagcttagcgagacgatatctgagattctccaaattaagctctccatagacagctctcgcttttatatcaaattctacgattctccggtaagtccccttttgcttcaaattcaaagctttgcataagaaagatctcattctcaagaacttatatatagaatgctgatttagattaaagctagatgctgatgatgggctatataaattaatatatggatacacacttagatgaaagcacgatgttctttagttcttataaacttgatcaatgaatagaatgttagttaaattctttgttttgcttttctttggcagcgacctttcttcggttacaatggatcaactttctgaaaagaggcgaattcaaccttgtaatgatatttgggttagaactgtttgcttattcatttcaaaagctgtaattctgaaccataatttataattttacctccctcaaagccaatatatttcgtatttaaactgcttttgggcctagtttgtcacttgtgtgatatgatctcataattttgtcaatactactaaaaatgtaaactgcagcccaaaaaaaaattgtagcccataaatccactttgacgattttctaaattaatatagtacacattggactgaattgattgattaattaagttacaggacaaatgtgtaatatagaataaatagttactgggagagaagaccgagtcactgtaacttggcaggtcttaccaaaaccggccgtgcaacttttcaaacgcgacttccttctccggcaagcaattcacgccgctgctcagtgattctccgtcactatttccctgattaaccatcttctccggaagaatctataattccggcaaagtaagatg

SEQ ID NO: 2304 - DNA, 3000 bp, Unknown
  misc_feature (1)..( 3000): cDNA_ID_3066988_gDNA_ID_1620517_Annot_ID_159327 3000 nt of promoter + ATG
ttcgatggtcatatttaatattcttacgatcgatcttacctttgtatgcttgtttccactgcatgccatggtaatggactagtaatgtcattttcatttgtccccatttaaattgtttcggaaactaagaaaccgtctaaaagtataatgattagttttctgtcacaatgaatgaataccataattagaaactgctattgagctaaaaatttgctcaaccgaagagtaatcgttttttctggtaatttcataacttcagtcggtttgccaatgccacgtaaagaatcatacttctagtaagtcgacacgtcatctcaataagaccaaacagcttcacacgtcagaaagtattaaatagtaaatacaaaatattgacgttaaaaatcgaaaagaaaccttttttttttctctgtaaagataatatattaagataaatatcttacaaaatacaaactgataaccataaacttagccccaagaaccccttattccggttacaaaatccggcatcagttaaacaggaaaaacaaacttaaagccatgtttgtggaatctctaaacttcttacaatcttaacttgtaattgctttccaaaaacttgaaaaatataaaacattaagaaacaatcaattttagaattgattttcaagtcttcttgacctcacttgataataaaaagacttcggcaattaagacttatgcttcccaaaattgcatgacggagcctcaattgaggtgaattgaaacagtctaaaagagcaaggaccggtttaattttaaaagaaacctagctgtcttaatttaatttatttttgtagcattttctcgcctgtctaatccacttttttattcgacatatttgttatatataccgtacatctggactatacgtatatctatcacacacccatattattatagtttgtaaatttaataataatatctgacgattattctaataattgagatattccgtcacaaatcttaatttattttgttacactttacaggtgttcatacttagtggtgtcgaaaagctttacagggactcatctacgcgtaatttaaaaaaggagaccccattatgatcttttctatataattacaacaacctctttaagtaaagtaaattttatttttagttgaattatattctttgtgaatcgtttattcgctttgcatacgtggaaatgaacatgatattgagtaggaatcgcttcttattaacgtctcccaaatacaaacaattttttcatcattcaacacgacgttttttgaacgttccgtttcactttccatgtttccgcgtttttttgaaacgcaatttaccttttatcgattcggcaatttttagtggatagagttataaaacaattaatcagaatggtgactataaacgaattattcgtaatgtttgttgtatactattgaagtagtcggtgcataaagacaaaacgtgcgttggtgttagttaattacttctaccaaggctctattaacagtatacgataatgaaaagttgaaaacatactaactaacatgtattcacaagtaaacaatgccatactctagtagtccaaagttcaaaatactctttacagtgtgtaaaaattcaatatgtgggctcgaactctgaaatagtcgaagataattttgtgggttaagacaccagaatatgcaatttttttacttatgttttttttgtctatttgttagtaaatgcaaatttccaaaataattgtaaaagaagagaccatacaagtaacatgcgaaataacgtaataatacataatacataatacttaatgtgactccaccactgtacacgtaagccaaacttttattcaatgttatgatatatttcaattttcatttttttaatataatttttacttaattattagatgatatgacacatatatttataaaatttcagttccttaaatgttattaaataatttaaatagtaccatgatttaaattggtaaaaaatatgaaggaaagcttttgctaaccttctttacttctgtttttttttctttttcttttggttagatagattccatttaacttaaaataataatccacagttttttttttttttttttaacacaataatccacagatttttttaatgagaataaaactaaaaaggaaatttgatgccaccagcatttaattagcgcgtgccacgtagtttagtttccaaacaattaaaaatttacccataaccggcccaagaacttttatttacttacctattaaccctagatctatatatttgctcactactgttttatcccaaactttagagagataaagcattctattagtttcccggcgaggactagtcacattttccggcgaacttaccggaattttctctccaggtagaacttgtttctcgtctcgattttctcttcaaccgactacgaaacgagtttcggatttcgagaaaagcttacgaataaaaattttaattactgttttgtttaaattaaaatttcgcagtgttggtcgctttgtctcctgttgttcttattcttcgtcttctttagtcttacctaatttgaatttttgttgactactactggagtaaaccgtttcacagcgtttttctcgtggtaggagtgacttcgcgttcatcgatttttttttttttttttccgattttacatgatattgttgtgatttaaggctaatgtcaaggatttttgaagaaatctgagaaaatatctgtggctgttttgtcgcactctggatttttcccagagagaagaagatactttgtttcgaagaagatatttatcttttttttttttcttactttttttttatcccggagaaattgcttttttcttgcttgatatttcacgtggttgtcgaaagcagaagcaacctttaaactgcaaacttacttatcttttgattttttctcagtggttttgagatttagggatttgagtggttttcttcttgtctcttgcgactgcaacgatg

SEQ ID NO: 2305 - DNA, 3000 bp, Unknown
  misc_feature (1)..( 3000): cDNA_ID_3066992_gDNA_ID_1620517_Annot_ID_159325 3000 nt of promoter + ATG
cggttggggtctagaactcacacaatctgatggcggagttgagactaaagctgccgtcagcggcggcggtatgccgggattctgcccaagcccggacgttgatacgaaagccgacaatttcattgccaggcttagagatgagtggaggctcgataagatcaattccgtgaatagaaagaggtaactgggctttttaaggcctattattaggcccattacgaaaacggcgtaggtttcaacctcttatgccctgcaaggctgtgcaatgcacaaggatctcatacgagaaacatcttcaagggaagtcggtaaaaattgttggagatattttatatttgattggcgaaattcgttgtgattttaagcaatgtgcagcaaggactcgagttcaaaagttacgggtaatattggcattattggtatagttattagtggtaaatggtttcaaactggctggttagttttttgggtttaaccggttgagggattttgctttggtgtgttttgattattcggtttgaactttggagtgtcagatgaaaactcaataacttcggtgttgaatgttttatattttggttggtacgcattgatgtatgtacaatgtatggcccattgatatgaaaatatagttgtgggctctgagttttgttgggcctacctcttgtgacctttccctctcccttacaagcaattcttcttcaagttggttgatgattgtcataatgactggttgtcgtatgtatctctaagaataaattcatttgtgtgttgagtgagattcttatagcttactagtaatatgtatatgatatgtcaactgaattcatgttttgcaaggatatcattaccagtaccgaatgatgtgacatatctgatgaggtttgaggtattgaactctcatgattgtcaagtgatggtcttgaagcttataaacgatcctcaaaaaagtgttttgatatttccataattctttagagtagcttgaccttattatataattcaaaactttggccttagataatgagattcaggcagggaggtgacgtgttactcacgcgcgagagctgcgcgttcaaatcataaaaagccgacttgctataaaagcaaacttgttgatgatggttcaaaatttcgaaaagcttttcaaatttctcttcatatcgcgcgctcagtcaaaaagcagagccaaagatgaagaaaccgtataaaggaaagttgccgacgggaactccgtctctggcaatgtcaacactcgtcgtcgttgcttcccttctcgccggagcctccgttgtccacaacatctacaaaccagatctcgtaagcttcaccttctctttctgtacatatgttagggttctcaaatgtattaggtttgctcactttcttcgttcttgataatgcccataagcgtgatcggtttaaaaccattcatttcgttctctggctctgtgatctctcttttattgtaatgcacataaggtgttcgatgaattgcccatgagagatttgtaatctgattgctttttacttttgtgcagagtttaccaccgttggaaagtagtgaagtggccaagaaggatgattctgtaaacaaagtttgaatctttcaatagtttcatcctgttttatcaggctacattcactttggttgttctctttcaattcatgagttaacaaaaaaacatggataaagtttaaaactgagatcacttattaaaggcttttattcttcttcctcttgtgaagatgtaaagaagaacaaactctttttaggtttcttgttggtcaattcaccgttttttttaaagagatataagaaatcgcgatgatcgtgtagatgacatagagaccaacgaattgatggagtctttgctacggattgtggaaaaccatgtcttcgatacatattggaacttcaaaagagattttagtgataatctagttagtatctccatcgttagatccataggtccattaggcccaaacgcccaatcacgtggcgtgataaatacgttaacaattgcaatatgaagaaaacacgacaattaaatatggaagagaggctaattattcatcggtccaattgccaatgtctttgactgtagttaataataaatcattaagagattttcgtttaaaaacaaaaatacaccgtttcaagattaaaagataagttaattacaattgtatttttcctgattaaaaatcagatgtttacagggaaccgcagatcgctcagaaagtgtagtaagatgctcgcaaaaaccatgtgcatgtccatcaaccttcgccgtctcaatagcttacacaaaaatcgtttttgttttcttattaatataaaacctaatctaaatttacaaatttgttttcttattaatataaaatctaatctaaatttacaaatttgtattacacgtacaagtggatccaagtatctgactctacagatattttgaatctaacatttgtgtaattataatttataatctctgaagcatttaattttacttacaaataatgttagaccacgagacagaaggtaaaccaatcttccttatcccaagataagattcttcaaattaaatataacggctttttgcagaagtaataaagatagaaggaatatctagtatcaacggaaaaaaagaaaaaatctagagcacttcgaaaaattatggaccaaagaagattcagactgaaattattactgtattagtatttgtccattcacaaaatgccgaggaagaaaaaaggcattttggtttatattttgtttatttgatattcaaatgtccaacgatcctctctagctaagcttagctataattcaatgtttgaacacgaatcccattattttaacacaaacaacattaattaaatatcgtctcaaggaacttcacttccttgtccataaatacgttatttcacaccacatatactcatctatatctctatttttcttcttcttctctctctcgccggaaaaagtaaatcaaa

SEQ ID NO: 2306 - DNA, 3000 bp, Unknown
  misc_feature (1)..( 3000): cDNA_ID_3067014_gDNA_ID_1620518_Annot_ID_159350 3000 nt of promoter + ATG
ggtgtatgtggaaagtgagggattttgggtgcggtgttgaactcataaacaggatccataaggttgctgaagcttctggtcattacccttctcttcacttggaaagtcctacccaagttcgagctgaactatttacctcttctatcggtatgtcaaatatttgatgttcgagtttgagttttaatatatggtttcttaagacggtttgttggatgaataatgcaggagggttgagcatgaatgatttcataatggcggctaaaatagatgatatcaagacttctgatctttcccctaggaaaagagcttgggcgtgatcttcttttcattattttggaacatttttgtttgatagtatgtaatgtatgtgatgtattctaaattgtgtgtgatcggtctacatgtcgagttatatagaaagcattgtcataaccgcataagagatatcacgcaacatgtctttgagattcattcatcaatcaaaagaagaaagaacatcaatcatatggagcacaatataagaaatgagacattattattagattaagacattattattatcatttcttcttctagaacattctgggactaacaaaaaattcgaaaaaacacaactacatttttgcattctaataggcggtggtggttggaggactagccattttggagcattggtgtttcatcataggagggaaaaacgggttggatggaagatttggtaagcagttagcttcagcgtcaaggaaagctttacaacaagcaggaccaacgccttcaaatttgccggacattacggcttgttgaatctcttcaaagcatcccggcaaatccatcactgttgaccaacatttgctcaagtcgggacttcctgccataccgggacttggtttgaacggatttggaaacgggaacatgattgggggaaactgcggtagctgagcattaacggaggctgcgatgcatacaactactaggagagaaacaacactcttgatcgacatgatgaatatttgggggactatgcaacaagagaaatagatgacttgagttttgtttgatgagataaagttattggctatgagatccaatttatactgtaattagtttggcgaaacgtatttttaaaagttgctttcaaaatcaaatttgtcgttttaattttggaagaaaatcaaaaatagtcaaaacgtttgatgcacattgaatttgatgctgtcatatttctcatatgtaaagaaataaatctttcctaacaatatgataggaaataatacaaagatgacagaagggaagcagtaacaaattttaagtctctttcgtctttattcatcttgatatatatcatctcctaattttttttttgagattttatttacattcatagcaagaaaaagaaaaaaatcttttcaatttaggaattgtttttcttccaactttttggaatcctctatatagtaaaagatgtggcaagcccataattgttctcatcatttttatttttcatttattgaatataatatactcattgtcaaacactattaattccactatccttatccttatccttattattttttaaaccaaacatattttaatattaaatacaccatccaaaaataatattttcggatttctaaatatttagcttatagaaagatttcttatttatcaaataaattaatttaatcaaatttaaatttactatttcccaaattactaaaaacttaacttttaaaattaaaacattaaattatatagcccatatttttatcctataaatttcatgcagtatactatatagtgtctatctattcaacacaatcatagttttttcctataatttgatttaaaaaaaatcattctcctctatacataagagagtctttagtgtttaggatataatcccacaatttttctcaagtatttttttctttaattctactatatatcattattaccaaacatttttaattgcaaatactatttatcttattttcttaaaactaatttttaaacactcataaaagatttttaatatataaatttaccattttaataaaagtaaatagtataaaatttacggcaataattagataaaatttgttaccatttaaatttgaagatatgtttgaccctatatgaatctcacatatgttctcaaacatttggattttagaataaactagaaatggtttcatacgttaaacaactttgtattggttctagtttcacttatttccgttgtctcatcatatgcaattgcaagattcaatacaaaggttacagaaagtgaaatcaacgtcatatgaacaaacaaagatgtcaatgcatcattttgctttgagttcttgaaatcatcctctcaaattgcaacactagatgtctggtctagccaaattgaaatcatcattttgttttatatggatttttgtttaaaaacgaaattaaaaatcgtaaaattaaaccaaataatttatattttgctttcgatttatgaatgaaatcaaacaacagaaaatagcaagaaacaattttttattttgattttcgatttgacaaaaattaaaacaataaaaactgaagtcgtgtaagatctgactcctccaccaagatctgactctaagcacattgtttaaaagcatcaaaccatataatttgtatttaaaccacatatacaacataattaatcatatatataaatccacactttaataccaaattataactgaaatcataaatatcatgtattaatttttttcattcactcaatgtcatttaaacacacaattattataattttaatcttttatttttgaactacacttatttttacaggaacaaaaacaaatataattcaattgaaattagtattttaacactaaccaaaaaggaaataaatttgactatgagataagaaggcgggcttagttatataatagcaagaaagaatctgtatatttgttgaatcaaaaataatcagtaacgctttgagtgaagatg

SEQ ID NO: 2307 - DNA, 3000 bp, Unknown
  misc_feature (1)..( 3000): cDNA_ID_2153372_gDNA_ID_1620518_Annot_ID_159369 3000 nt of promoter + ATG
aaagttcccttgtggctcctaagctgcaataccaagagttcacgtgggaagaaattattaacgcaacttcatcattctctgaagatttaaagatcggaatgggagcttacggggatgtttacaaatgcaatctgcatcatacaatcgccgctgtcaaagttttgcattctgctgaaagtagtctatccaagcaattcgatcaagaggtaaccaatcaaaacataattcttatttgaaatgtttctctgatttcttcaaaaaaactgacatttgtattcaccatttaacctcttagctcgaaatcttgagcaagatcaggcacccgcacttggttcttcttctaggagcatgtcctgatcatggcgctctagtgtatgagtacatggaaaacggtagcttggaagatagactgttccaagtcaacgatagtcaaccaatcccgtggttcgtgcggttaagaatcgcttgggaagtcgcatcagcgcttgttttcctccacaaatcaaaaccgacaccaatcatccaccgcgatcttaagcctgctaacatcttgcttaatcacaactttgtcagcaaagtaggagatgttggtctttccacaatgatccaagctgccgacccattgtcaaccaaattcacaatgtacaagcagacaagccccgtgggaacgttatgctatatcgatcccgaatatcaacgaaccggaaggatatctccaaaatcagacgtgtatgctttcggaatgatcattctgcagcttctcactggtcaacaggctatggcactgacatatacagtagaaacagccatggagaacaacaacgacgatgagttaatacagattcttgatgaaaaagcaggtaactggccaatcgaagaaactaggcaattagctgctttagcactccagtgtacagagctccgttctaaagacaggcctgatttggaagatcagattcttccagtattggaaagcttgaagaaagtagctgataaagcaagaaactcgctttccgctgcgccaagtcaacctccaagccatttcttctgtccattacttaaggtaataacttgtttgctacgttatctgtttacttgcaagagaagtgaggttaatttaaagaagaatgttgttatattgcaggatgtgatgaaggagccatgtattgcggctgatgggtacacttatgaccggagagccatagaggagtggatggagaaccaccggacgtctccggttactaattcgccgttacaaaacgtgaaccttttgcccaatcacactctttacgcagccatcgtcgaatggagaaatagaaatcagtgaggcaaaacagagaaaagcgcgctccattttggtgcctctctttgaaactgcgtagcgtttttcggcatagagaaacggcgaggtgttctcaccgcctttttctcttttcgtttgtttgttcttttggaattacctttgtactgcatttggatttattttattcacttttgtggattcggttgaaatgtaaagagttgcatactgtaatatgtaatttggtattaaccgattcataaaccatttcgatctaaatctgattagattctcataatctcgtgtttgcttttattacagcttctactttaatgcgtctagttttagatacaaatgaacttttgaatggttctataacttcaaatttgtatcaccaaaagataatatatcttttgacttgtccgaaaagtaaacatgtccaaaggacataaaaataatcaaatctgtatcccttatctttttttttgttgttgtgatcaacgaaaataattaaaattttaacacatgctaaatagtgtttattgactttttctccaaacgtgagatagttttggtcataatacattaatggtataattaatcagcccttataaacacgttattggttaaataacttgaaacttatgtcacaatcaattccattaacactccacgcgtaggcgtagcttagcgtgcgtgcaactatccgctatcataagttcccattatcactagtattaaactttggattaaggatcttactcagattttataatagtttatgaaattttgttacttttatagtctcttaaatcagaaattgacttcattaaacagatcgtacgaaattttctgatcagtaattcttttttcctttataattcatcacatacaaacataaaatgaaaaaagaagaagacattttagaaataacttaaactctacatctaaacttgaataccatgtctaaattaatgtattatttaacataataaaatgtctatttaagtaaaattaaagaataataaaactcgaatcacataacaagccttcattgccgaataatttagacattaaaccaaattaaccaaacattttttttttaccagactattatgtaatgcatatttaaaaactaattacgtcaggtgaaattaaaaaaaaaaaggtatgacgccgtcaaaggacccggtagtggacccaacggtgcatcaacggaatccggatctacccaattgtatcttaattttagatccgaacccgaaacgaacagattcttttattggattaattagtgaaaaataaataaataggctttcttttcttacacgtcaccgaccgaccactcctgtctttgacattctcctccactgctttaaatgaaagaaacagagcactgttccgattcttttcatttctccattgaaattacaattcaaagctttcttcttttgtacgttattccattaatccaatttgaaactttcaaaattttcccttttctctggctttcgagtttttctcgattcctttctccattttattctttcccctcttcttcaacatctcaatataaaccctaattttgattctagtttctcaattggtgtgaattctcagaaattcagaaaaccctaatttcgtttttttctctgttcggtttttttttgattgattcgatttcctttgattctccgatg

SEQ ID NO: 2308 - DNA, 3000 bp, Unknown
  misc_feature (1)..( 3000): cDNA_ID_2153383_gDNA_ID_1620518_Annot_ID_159371 3000 nt of promoter + ATG
ccaaggaaccatagagaaatcgatatcacattgctgaataaaaatgtaaggttttgacaagatcctgatttcaaacagagaatgcatcgatcaagagatgctttgatacgatcagaattcaatatctagatagaacaaaaggtcaaaagccacattccaaagtctatttagatatagacagctagacaatgcaattgcagaggaattttgtaactctgaacctgaattttgagatttaagcacataaagtttcgaaatttactagaacaaaagcttggaaacaagaaacccatcaagccaagcatgatcggaatctctaataaacaagaaaaagtcacaactttgacctacctgatatttaaaggatgcaactttaagctgtggcataagaagaaaagaaggtatctttctcactttgccatcttgaagttgaagaagcgatggagtcttctattctcacacggagacattgacacaaagaagagccaaagacccaagttcgtggcttcgttcgtgctcccaatttcagagacagtcaattccttttgaataaccacataatcttatatttatagaaacaagaaaaaaaatgaagataacttggtcatgcatatgactcatgattcattgttgaagattcttctttcactcttttttattttgtttttgataatagattctttcactctcgttatttactagctcacacaaggattttcttcattatcagagagctacaaagaagagggaggggcttatattatttctcattttttttttatgtttgaaagtttctgccaattctcaacaatcttatgaagggatttgctaactagtatttttttttagatttggaaaatgtctgttttggaaactaatattatttttgtgcacggctggatatactttttcaaaaacatgaatattattaattcatcaagaaattaaaattaaagatgaagtatatattgttcttacttcggaaaaattgcatcacatgatgttagtcactttatatgatatcttgaggatttaacgtttttaaatatttttgtagtccatgttacatagtgtaaaactgtaaagtaacaaaatgcgtattcttcttaaatctcacatagttctgccatgtatatataatccctctgcatggcacttcaaatgagaatattgaatggagagtcggagaccatatgaaatcatggatcacgttcatgatagagatctatatatcccaattcacatatatactatatatattctataatatatcatctaggaatacagatgaaactgttacagagaataacaaaatttcgtgataattaaatctaatattcatttattattcttaatactttgaatatatatggaaaaaacatttatctaaaataattcttctatttaaataggggacttcagatttttaaaatttgagtattttgcttgaagaaatgagtatttttttataaaactttccttatgttttaagatgaatttttcatcttgtaactagacatatgatgtaattccaatttcttttacttttattttttattatatatgtaattccaatttcatttggtttttgcggttagtttacgaatgaattctacatattacaaaaatatcataaaatacatataatgatctatattttaatggggttttcctcccttggttgctcgcatgatctatcttgccatcacgtctttttgtctcccgatccctataatataggtatgtgacaatgtgtgtctatctttttctttctcttttaagtttttaaccaatccaatttttgtcaacaacacaatccaatgaattctaactaatatactatgaaagtggcatattaatataagtttatatgaatgaacgagaaaatgcacttagacataaaagagggaaagagagatacatatgcaatgtcaacgttgctcagcttcacaaacccatgttatgaatctttttcttaggtacatcaagtcgtatgattctttttaaacaaaccatcaagtatgattcattatatggttatatcccaaataagaaaatatatagataaatacatttaaatattgcatgatgtcatgcaccaaaaagcaacaatatataatcaacatgatatagaacttcgaccccaactcctccttcttacttgaacttgtttttggaattgatattatttttgggtaaaattaatggttaattcatttgagtcaggtttattttcttttgaattcaggtcggactttgaatttctttttcttttcttagtcaatatcatcatggttagatgcgaaccatgaccgggacaatatcggctatgtattttctgttttggtacatgtcactatgtcaccttgtttaattttagttgttctgtttgtgtaactacgagtctacgaatacattgtctaatgaaatgtgttgttatgttatatcacatgtcatatatagtgtaactcacaaaagatgtatcatgtcattttctttatttaaatcgtgttacgtaatgtgaagaacttaacaatatattagcaattttaatacatctgaaaatcattcaaaaaatcgaaaaacagaacaaaattttgttatcgtaaacaaccaagttaaatgatagatgaacacaatagatcaaggataaaaaaaagttgagatttgagatgaatttgttttttttttgtttttgtcactgaaatctttattgaaagcccattaacttacagataataggcccaataaacaaaatttacacgccgtctaaacccgatttccgacgacctacagaaaaacttcggtcggtcagtgaccctttaaaggaaagctattagcgattgattcgagagatgtgcaaagcttgttgatttgaggctctctctctactagggtttgttgatttgagttttctattcctcctatacgtgttcttcgattctcctgggatttttttttgaaaaagggaatagaagaagaagttgctgaattctcgat

SEQ ID NO: 2309 - DNA, 3000 bp, Unknown
  misc_feature (1)..( 3000): cDNA_ID_2153376_gDNA_ID_1620518_Annot_ID_159370 3000 nt of promoter + ATG
aagtttttctgtaggtcgtcggaaatcgggtttagacggcgtgtaaattttgtttattgggcctattatctgtaagttaatgggctttcaataaagatttcagtgacaaaaacaaaaaaaaaacaaattcatctcaaatctcaacttttttttatccttgatctattgtgttcatctatcatttaacttggttgtttacgataacaaaattttgttctgtttttcgattttttgaatgattttcagatgtattaaaattgctaatatattgttaagttcttcacattacgtaacacgatttaaataaagaaaatgacatgatacatcttttgtgagttacactatatatgacatgtgatataacataacaacacatttcattagacaatgtattcgtagactcgtagttacacaaacagaacaactaaaattaaacaaggtgacatagtgacatgtaccaaaacagaaaatacatagccgatattgtcccggtcatggttcgcatctaaccatgatgatattgactaagaaaagaaaaagaaattcaaagtccgacctgaattcaaaagaaaataaacctgactcaaatgaattaaccattaattttacccaaaaataatatcaattccaaaaacaagttcaagtaagaaggaggagttggggtcgaagttctatatcatgttgattatatattgttgctttttggtgcatgacatcatgcaatatttaaatgtatttatctatatattttcttatttgggatataaccatataatgaatcatacttgatggtttgtttaaaaagaatcatacgacttgatgtacctaagaaaaagattcataacatgggtttgtgaagctgagcaacgttgacattgcatatgtatctctctttccctcttttatgtctaagtgcattttctcgttcattcatataaacttatattaatatgccactttcatagtatattagttagaattcattggattgtgttgttgacaaaaattggattggttaaaaacttaaaagagaaagaaaaagatagacacacattgtcacatacctatattatagggatcgggagacaaaaagacgtgatggcaagatagatcatgcgagcaaccaagggaggaaaaccccattaaaatatagatcattatatgtattttatgatatttttgtaatatgtagaattcattcgtaaactaaccgcaaaaaccaaatgaaattggaattacatatataataaaaaataaaagtaaaagaaattggaattacatcatatgtctagttacaagatgaaaaattcatcttaaaacataaggaaagttttataaaaaaatactcatttcttcaagcaaaatactcaaattttaaaaatctgaagtcccctatttaaatagaagaattattttagataaatgttttttccatatatattcaaagtattaagaataataaatgaatattagatttaattatcacgaaattttgttattctctgtaacagtttcatctgtattcctagatgatatattatagaatatatatagtatatatgtgaattgggatatatagatctctatcatgaacgtgatccatgatttcatatggtctccgactctccattcaatattctcatttgaagtgccatgcagagggattatatatacatggcagaactatgtgagatttaagaagaatacgcattttgttactttacagttttacactatgtaacatggactacaaaaatatttaaaaacgttaaatcctcaagatatcatataaagtgactaacatcatgtgatgcaatttttccgaagtaagaacaatatatacttcatctttaattttaatttcttgatgaattaataatattcatgtttttgaaaaagtatatccagccgtgcacaaaaataatattagtttccaaaacagacattttccaaatctaaaaaaaaatactagttagcaaatcccttcataagattgttgagaattggcagaaactttcaaacataaaaaaaaaatgagaaataatataagcccctccctcttctttgtagctctctgataatgaagaaaatccttgtgtgagctagtaaataacgagagtgaaagaatctattatcaaaaacaaaataaaaaagagtgaaagaagaatcttcaacaatgaatcatgagtcatatgcatgaccaagttatcttcattttttttcttgtttctataaatataagattatgtggttattcaaaaggaattgactgtctctgaaattgggagcacgaacgaagccacgaacttgggtctttggctcttctttgtgtcaatgtctccgtgtgagaatagaagactccatcgcttcttcaacttcaagatggcaaagtgagaaagataccttcttttcttcttatgccacagcttaaagttgcatcctttaaatatcaggtaggtcaaagttgtgactttttcttgtttattagagattccgatcatgcttggcttgatgggtttcttgtttccaagcttttgttctagtaaatttcgaaactttatgtgcttaaatctcaaaattcaggttcagagttacaaaattcctctgcaattgcattgtctagctgtctatatctaaatagactttggaatgtggcttttgaccttttgttctatctagatattgaattctgatcgtatcaaagcatctcttgatcgatgcattctctgtttgaaatcaggatcttgtcaaaaccttacatttttattcagcaatgtgatatcgatttctctatggttccttggttgtctagttttggtttggctcaaagatcttcatttcaattgtgatgttgttgaatgacagattgctactgtctcatttggttggaggaaagaataggcgatgagcagaaccgttgctgaccatcttgcgtagagctggctgtgacattgtagaggctctacaagccggtgctttgactttctggagaataaaatg

SEQ ID NO: 2310 - DNA, 1122 bp, Unknown
  misc_feature (1)..( 1122): cDNA_ID_3067034_gDNA_ID_1620518_Annot_ID_159373 3000 nt of promoter + ATG
cttcatcacaagtattacgaatctgagtttggaaactgtcatggctacttcaggatcaacaactacacaatcccttcagaccaagaagatgatcatcacaacggtgatgagcaagatttgatcgaagggctaggaatgcacactgacatgagttgcatcacgatcgttgaccaagatgacatcggaggtcttcaagtcagaaccagagatgggattggtctgatggatatcaaccctaaagatgaagcactcgttgtcaacgtcggagatctattgcatgcatggaccaatggacggctgagatcgtctcaacacagagttatcttgaaacgacgtggtttcgttggtaatagattctcacttgcttttttttggtgctttgacgatgggaaagtcgtgtttgcccctgatgaagtcgtcggaggttgtgagggtatgagggtatttcgatcatttaaatgtggggattatttgaggtttagagagagtaatgagaaagggaagttcgagaaggttggggacacggtcgaagactttgcacgaattgaagaccgtcgttaattaatttttccctaaaatgaaataatattaataatttttttttgacatacactgagtatatttgtgtatttttccaagatacgaaatagtcagaaaaacaaaaaattagtcataaataggctgataatgtttaaacatgctagaatatttgagattcaatgcatagatgtgaaccaaagttggagaccagtttcatatctcatttctcctaaaatcttatattagacaaaattagcatatacactaacattaacattgcgttttaaaaatttaaatgttaaaatctgtttttattagcttagaatttttaggtattaattgattttttatttataaaaatgtaaatatttaaactttttttttttttatcaacaaaatggtttaaaaattaaaacattctcttaactaaaagtgtaagaaaattgaatttaactatttgggcttataatgggccaaattccgcgactctgctcaatatcgttttcgataataatctctctcatgtaagtcgcgacatttcttgtcttagatctgaaaccctaactcttgagttttgctatg

SEQ ID NO: 2311 - DNA, 3000 bp, Unknown
  misc_feature (1)..( 3000): cDNA_ID_2153387_gDNA_ID_1620518_Annot_ID_159372 3000 nt of promoter + ATG
atacctttaagagtgatgttctttgcaagatctgtggtgatggtggacaccctactattgattgcccggtgaagggtactactgggaagaaaatggatgatgaatatcagaacttcttggcagagttaggaggaactgtacctgaatcttctctcaaacagagtgctaccttagctcttggtccgggaagttcgggaagtaatcctccatgggctaataatgcagggaatggtgcaagtgcgcatcctggcttagggtcaactccgactaaacccccctccaaagaatatgacgaaacaaatttgtacattgggttcttacctccgatgctggaggacgatggtttgattaatctcttttcatcctttggtgaaattgtgatggcaaaggtaatcaaggaccgtgtgactgggctgagcaaaggctatggttttgtgaagtacgctgatgtacagatggctaatactgctgttcaggcaatgaatggctatcgtttcgaaggccgaacactcgctgtcaggattgcaggcaaatcgccaccgcctattgcacctccaggacctccagctcctcaaccaccaactcaaggttatcctccctcaaaccagccgcctggtgcctatccatctcaacagtatgccactggtggttattcaacagctccagttccttggggtcctcctgttccttcctattctccatatgctcttccccctcctcctcctggttcttaccatcctgtccatggtcaacatatgcctccttatggaatgcaatacccaccaccaccacctcatgtgacacaagcacctccacctggcactactcaaaacccatcttctagtgaaccccagcaaagcttcccaccaggagtacaagctgatagtggtgctgctacgtcgtctataccaccaaatgtctatggtagctcagtcacggctatgcctggacagcctccatatatgagttatccgtcttactacaatgctgttccccctccaacacctcctgcaccggcctcgtctactgatcattcccaaaacatgggtaacatgccatgggccaacaatccttctgtctcaacacctgatcactcacaaggtcttgttaatgcaccttgggcacctaatcctcctatgccacccactgttggctattcacagagcatggggaacgtaccctgggctcccaaacctccagtacagcctcctgcagagaatccatcctctgttggagagtctgagtatgagaagttcatggctgagatgaagtagcatgcgtgttctgatgagaaactccttagtggagaggtaagatgtcctcatttgatgttattgtttgttctccgtaggataaaatttgaaatcgaatcaactggctttcaacataggatcaaaaaagttccaacgtttaaaaaaaaaaaaaaaaaaaaaaatctttctcaacctcatatatttagagttccagtttgcaggatactgactttttgtccataattttgttctcgaaagccttccttctcatgtaatatatctgttctagttttatcacataataactaactgctatagcttataatatggtcactgatgtgtttgtgagcaatgccacagctacaggagcatctgtcctggtattcaattctgaaacatagaatccgggagttggatgttcgaattttgtcagtctaccctttttgctctatgttttattcagtaacttttaatgtgttttctatcccacatgaaaagaatttgttttcactaatcattttttctattttacaacatctaaactgctactagaatagaatccaaaagtttgcccctgttattgtatacatctcattaacacgaatctttgttttgttgacattgttaatttttttcaggtgtgatgtttcttggagatcttgtaccctgatttcttacatctttcttgttggaagtttgggactcacatcctaacccttgctatgctgttgtgaaatatgcagagattcaggctggaagctccctgttcagacaattgcctttgcagaaaggccatgagaattttattaatgttactgataataattgctgctcttttgtaggactactagcattatggcccctgctatgcagggtcatagtatctggcataaaatatatcaaattttcaattcagtggcttgtacaaatattttgcttattattcggatgcgtgaaatattgaaaaaaaattctagatgaagaatatggagagaaaattccctctattttttctgaaaataataaatataagtagacacatggagatcgtggaacttgtgggagttaacccttgtaatatgatagaattgtttagggactattgggcagtatcatatgatatgataaacgaaaagcattgtactcgacatttgatatcacttatctctggcagcgatatgtatacaaactccaaaacagtaaacgaaacaatctcttttcaacaatatttttcaacaaaagactattggaaatcatctaaaatcagttttagtagctttctgataaagaattgctaagtttttaataatatagttgatttagaatgatattaatatgattgactaacatgagattgtatttatttggaatgaattaatataaatatcactatatcatgttcaataacataaatcctctagtataacggatttgtaattcaacatgagtgtattggacttttccaagttaataatgtcttttattttttggggacttttattgtcaattagataatatatatggacaaatattgaagccaatcttcggccgagcctagtgatgcaattggcccataatgctcatatgcagcagatcaacaaaattgtagccaatcttccgtccgtcttggctccgccgttcggtttccgttaatattttacaaaatcatttcattttcttttttaacttccaaaaaatcgaattttgttgaatcttctaagctcaagctaataccgatttcgaaatg

SEQ ID NO: 2312 - DNA, 3000 bp, Unknown
  misc_feature (1)..( 3000): cDNA_ID_2687670_gDNA_ID_1620518_Annot_ID_159366 3000 nt of promoter + ATG
ggctatcgccttgtagaaaagattttgagcattagtaagccaattaaagtaccaaataccaatgacagtaaatgctctaattcagtaatcttattcactttcacattgttttcatgatcatctggatgctaacagctagcacattcccttgtgtaggtttctttggtttgatataagtaaatcaaatgaaacagagaaacaaatgaaagattgattcgcaaagcaccacagcttcttctaatttcattcaaatcacaggggcttgttctccaaaggggtgaaggagaaattgccggagaatatggactctttatctgtgtatgacaaaaaagaaccatataagaaaaggcatgtctattcgaaatgcaaatgcgagtaacataatgaggcattccaactatagcgtcataggtacctgttaaagaaagagaaccaagttctctccggacatatcttgccattgcctgaaacacacaagcaatgtcttaacaagtttggtacacaatgcctaaactagtatgtcaatgtgtgtgtgtttgcgagagagatagagaggagaaaatcatgcctgtgctgtttttaaatctgtgttatcaggtgttgttgttccatcatcagaaaatacgttcctacaatccaattgcatataaggttctgagacaaatccgttatctatggctgccatattgtatataaattcaagccgagctacttagctgtgtaatctctaccgaactcattgcataaagcatgacgttatagaagctttacctccataatttgatttgtaggtcatttggtttagcttccggaagtagcgcagcatcataggcaacaacatttccataaaatattctctccaactccttcatccacttggctagcagcaagttaacctgtaatttcaagaaagattaagaccatcttattttaaggaatctaagaaactaagatatctcttcgaaactatattaaagcaaaaccaagtctagcacgtaccccggctttagataccctgagttcaacatcatgattgtagatctcatagacgtattgaccaaggtcaacaccttcctgtccatcttccttcaagcggcgtaaaacaagccacatatgaaggacaagcagcgaatacgttattttgaatgttttctccaagttgaatactgcagcagagacagagcacccgatatataaacaaagcacaaaatgtaaatacataactctgtttgcaaaagttgtgttggaaaccaaataaagtaccatcatatattgcaggtttatcaacttgtgcaatgatccgcttgtagatcacgttagccccacggatagacatgctctgtttgctatagaacatcatcatctttagtatgaaacgacgaatccctacatagtctggttcatcaattctgagaggagagtctttaggcagagccaatgaacatggctttgaccaaaacatcttatccaagtttatctgtcaaacatagaacaaatccttttcatcaaagaagacacgattgtccagaagcagttgactaaaagagcatgaatctaaatcacaaacatactaatgaaactccaacagaaaaaaagggatgaatcctaaatgaggtacaatggggaggcagaagtcactttagtcccgcattcgatgaaactagaaacagagagaatcaaattgagcttaggttcgaatactatagtgagacctaaacattcacaacaactacgcattaacagctacttctgaaaacgagatctttaatctgagtaaacaaaatgttaccactttaagatcataccggagatttactggggaaatccttctgcgacggaggatcagctgccgccggcgcaacagtcgcgtacccatatcgggagaaaaaggagagatttttcatcgatccattagtggtcaaagatcgaagctttgaggtttgagtgacgactcgagctaatctgggcaacattagagagaaacccttgtggttttactcaacagatgaataaatctgaagggagaaatttgaatgagtaagatcgaattctaaaaccctaggcgaaaaaccctctccgactccttttctgtgtgattgatgatggggctaggtagtcgtccacgttagcgtctatttggccagatattcaattacagtgctaacttacgccgttattaggaacggaaaaccttggttatgcaaaaacaaacacattttaccgatattggtgacacgaaactgatggtcgattttagatagtaagagttgatgataccataaaatatgtttgtttataccattatcattttagggggataaggaactatgactactttgtcatccatttttttggtggatctctaatttgaactcaagtggcttatattgaatagttaagaaattatgctttctcatggccattggggaatttagtttcaattagtgaaaagagttttaattagattttattgtgcaccgaattttactgatttaggacatggtttacgcttattttctcaagagcaaaaatatttacggtctcctcaacaatatcatcaatttacactttttattactcttcgaaacgcttcatctctctctttctctctctcaagctgtcaaagtcacctctgtattcgcgtgaagataatttctcacaattagggttttttttttcttctgagttaactgttccatctccatcctaatcttcaccttctccttgatttcgagatctctgtcaatttgttgaatctgttctttatctaattagctcaactccgagtctttgctggattttgaaggtcaccactgttcaagtttacattttttttcctgctaatcgcttgatacccgtttctgctgttgtgggatttattgggtttttcttctttacgatttttgttgcagcttttgtagctgaagcaaatttgtaatctgtgatggtgtatgcactgattctgggtatggtattgtactctaggatctcgtagcgaga

SEQ ID NO: 2313 - DNA, 3000 bp, Unknown
  misc_feature (1)..( 3000): cDNA_ID_1398026_gDNA_ID_1620518_Annot_ID_159358 3000 nt of promoter + ATG
cacaagtagagttacctgtttattacccattgaacccaaatgtggtgtagctacagtaataaaattcatagcctcgagtccacatattgtgcctttgggagtctcttgactactgtccgctaccgagtctttaacatcttcctgattagcgggcttgtacaatttcccaattgcatatcttgctgcaagccctcccaaagaatgtgcaacaaaggagattttacagatatttggttttctctgaataatatcaagaacctgacatgcattttcgttacatcaaacagagtccaactccacaaatgtaaataaaagaggacctatatgtgacgccttacctcagctgctagacgttcacccattacatccacaccatctagagtaagcgcagacacattcttttcactacctgcttacaaaaggtaagatcataagaatcttggagcaataaacctagcatcataagaatcttagaatttaaagataattgccagtgacacagacccaatagtagcaagaaatggaaaacagaacctattaatagctgaatgattagataaagggtccactaactaagtttaattctgaaaaaggaaactaatttcaattttggaactttgtaaatcatcattaatcaaagcgcaagacaacttacagtgaacaaagactttgtctggcatctttttgacgaactgctcagctccaaacttccaatcatccgtactgcagttctcaagaacaattctcattattgagattttggcgaattgcataaatatatcaagtaaaacagaacaatcaaaattctcaactccatcaaagtttgtttaccttcccaagatcccatggaccataacgacaaggtgatcagcggaagaagaatcagaattctgacaactccaaacatcaaggctaccatcaacagattccgccttgcaaagaccgttttcctcctcgtgcttctccatgggatccaaatttcaatcgaatccgatcagatcagatccaattacagcacaaacactgcttccaaccacccaatttgaaatcgtggatcagaaatggtgggaattagagttgaggataggatttggtaaaaagtagaaagtgtgaagtgggaatgaagagagagtacgtacgaagcagacttgccagagaaggaaacggaaggaagaaaacacgacaaaatgtaacgtggaagtaagtaatcgtgacgtgaagtcggcttcgatagagataccgacttcctgagaacaaactctctccctctacgcctttgcttttttcttaatttggggaaaacaaacaaacaggataactttgacttttttcctcttcttaacaacaaaataatatctttgactttactggtttcaaaacgtaatcaactggatcccgttattccgttacaacggaactctgctaagtactgaactgtattaaactgttaattatacggaagttacaaattaccatagtaactaaacgttttggattgccggtctttggatttttctttttcttcaactataccaatttttgattaagactaaaaagttcatacaatctgactacctttgaatcactaacggtgataacaaagtttgtgaccaatacttttgtataatatattttttacaggttttttcgaatcaattttaagtccccagccttcgtcattgtaggcaaattgggtgctcgttggaacatcgttggtaactgccattagtttctaagatatctgacgactgctctttaacaagaacacgccaatgtttatgaccaaatgctttcaaatcaatacacagggatcgattacttcggattcaactaggtacgggcactagataaaatagataatttcatacattaatttgatattctcagtgtcaaaacaatgttttcagaattggcagactaaattatctatttgttcgaatatggatgtcctaatcatattcgaacaaatagataactattttgtgtcgtgttcaatagacatttaatcagacaactattttgaatgtattagtcaattcttccgattaaactttactcgtagtttgtcattaaactgaagcaaatcacaattgaacaaagttagattcagaagctaacagttgtaacttcacttggagatgcacatagtatctctcagatcaagtgttggattagattaattttgcttcatcattatctaccatctaaattcgtttttactgaatagaaaaccaaaaaacaaactcttataaactatttatggggattaaggggataactcagtagtggctagtgatttaggttcgattctgccagcaattctcttcagcttaatcagaagagggagctgtacatcctcatcgtaatctccaaaatccccatcatcattaaaaaagcgcaaacaccgatttcaaaatcgataaaaacgtataaatcgattaccagagaatttcaaattcgaaaacgcaaacaaatcagaatcaaatgaaaagagaggaaggctcagatcagcggggttatcgacacagaaacgactcaaccaataaattggaagaaacgcctaattccggtctgttgagcttgaaatttccgagtcatcactgccaatctccctctctcgattagagaattataaagaaacttaaaaactatcaatcatccaaaaagacccataaaaacgacgattgaataacagaagaagagaaccctagatgctattgaatactgataatgatgaaacctccggcgattggtgtctaatttatagggaacgtaattagggttttgctttgatcttcggtgaaggcccattctcggcccgttaatggtttccgaattgtgctgctttgtcttcgcggatggttcggtttatattcggttcgctttaatttggttatattagaatcattttggtttaatctggtttatgcttgaaaatgaaatctggtttaaatagtttctctgtttggtttttctgttttaattaatttacgggcaatg

SEQ ID NO: 2314 - DNA, 3000 bp, Unknown
  misc_feature (1)..( 3000): cDNA_ID_2153338_gDNA_ID_1620518_Annot_ID_159360 3000 nt of promoter + ATG
actcttgttgtacaacatacctcggatagtcctgaagtagtgatttccaaagaaaggaaagagcgagtatggtcatcattcacaaagacttcccacttattgaaatctatcaagtatctgtcaaaaacagaacggaaaacaattcacaaaccccatcgtaatttgggtagtatggtaggcaagaaatgatcttacctcttctgcaactgaagcttttgccgaagcatagaaatcaccgagttaatctgatgaacacgtagtggaacgtttcttcctaagcttatgtggaactctctccccaaggcacgctcaaacttctgatcatccttgcatagaatgctgagtggcacatcagcctctaccaaatgaagatgaggaacaactgatgcaaccttctttaaaaaacatacaatctccttctttggcagtggaggtatacaaactagaatcccaaaaacaaaataaacaatgagtgaaagagaaagacaagtgatacacttcatcaggcctgcacttcatcaatacattctcaaacacatacgtatcctcttatactaaacaaccacttcagaattcaaaaacctcgaaactctcagaaattttaagctacgaaatgaacaaataccaggtacgtaaacgtgcaaagcgtaatttccatcgacatgaggaaagtttcttacacgaactccaggctctgttgagaagaaatccagtgaaccttcaagttcagacgaaataaaaaataagtgatgagtgaaatctctaagaatttgattgaggaacaatcacagagacaattgatgagcatcttcacctgtggatacaatggaatcgagaagcgcaagcggtggaggaggcaaggaaatcgaatctttctctccagaatttgcagtaacgggactcgccggagaaagatcatcggtatcggaatccgatgaagagtcgccgtaggacgctctcaatgcttccattgcccgtaaattaattaaaacagaaaaaccaaacagagaaactatttaaaccagatttcattttcaagcataaaccagattaaaccaaaatgattctaatataaccaaattaaagcgaaccgaatataaaccgaaccatccgcgaagacaaagcagcacaattcggaaaccattaacgggccgagaatgggccttcaccgaagatcaaagcaaaaccctaattacgttccctataaattagacaccaatcgccggaggtttcatcattatcagtattcaatagcatctagggttctcttcttctgttattcaatcgtcgtttttatgggtctttttggatgattgatagtttttaagtttctttataattctctaatcgagagagggagattggcagtgatgactcggaaatttcaagctcaacagaccggaattaggcgtttcttccaatttattggttgagtcgtttctgtgtcgataaccccgctgatctgagccttcctctcttttcatttgattctgatttgtttgcgttttcgaatttgaaattctctggtaatcgatttatacgtttttatcgattttgaaatcggtgtttgcgcttttttaatgatgatggggattttggagattacgatgaggatgtacagctccctcttctgattaagctgaagagaattgctggcagaatcgaacctaaatcactagccactactgagttatccccttaatccccataaatagtttataagagtttgttttttggttttctattcagtaaaaacgaatttagatggtagataatgatgaagcaaaattaatctaatccaacacttgatctgagagatactatgtgcatctccaagtgaagttacaactgttagcttctgaatctaactttgttcaattgtgatttgcttcagtttaatgacaaactacgagtaaagtttaatcggaagaattgactaatacattcaaaatagttgtctgattaaatgtctattgaacacgacacaaaatagttatctatttgttcgaatatgattaggacatccatattcgaacaaatagataatttagtctgccaattctgaaaacattgttttgacactgagaatatcaaattaatgtatgaaattatctattttatctagtgcccgtacctagttgaatccgaagtaatcgatccctgtgtattgatttgaaagcatttggtcataaacattggcgtgttcttgttaaagagcagtcgtcagatatcttagaaactaatggcagttaccaacgatgttccaacgagcacccaatttgcctacaatgacgaaggctggggacttaaaattgattcgaaaaaacctgtaaaaaatatattatacaaaagtattggtcacaaactttgttatcaccgttagtgattcaaaggtagtcagattgtatgaactttttagtcttaatcaaaaattggtatagttgaagaaaaagaaaaatccaaagaccggcaatccaaaacgtttagttactatggtaatttgtaacttccgtataattaacagtttaatacagttcagtacttagcagagttccgttgtaacggaataacgggatccagttgattacgttttgaaaccagtaaagtcaaagatattattttgttgttaagaagaggaaaaaagtcaaagttatcctgtttgtttgttttccccaaattaagaaaaaagcaaaggcgtagagggagagagtttgttctcaggaagtcggtatctctatcgaagccgacttcacgtcacgattacttacttccacgttacattttgtcgtgttttcttccttccgtttccttctctggcaagtctgcttcgtacgtactctctcttcattcccacttcacactttctactttttaccaaatcctatcctcaactctaattcccaccatttctgatccacgatttcaaattgggtggttggaagcagtgtttgtgctgtaattggatctgatctgatcggattcgattgaaatttggatccc

SEQ ID NO: 2315 - DNA, 3000 bp, Unknown
  misc_feature (1)..( 3000): cDNA_ID_2153357_gDNA_ID_1620518_Annot_ID_159365 3000 nt of promoter + ATG
tgagtggattgctgggcacctgaatcgagacacacttttcctcactcatggactttagctgcagcaatggacaagttataccagtaatattttcatttaaataatcaagactgaaaactaatggcaaaaataaaattcacagtagcaattacttccaatttactttttcaaataacaaaagaagttcaatacacagtccttatttcaatacagggagcataaagtcatagaacaagaggaagacttgggcaatagtgtttacctttatgaagcaaggctgcatttcaacaagagagactgtgtctactctctgtcccaagtccatgtttggtgatttctgccacgacgcatacagtgattgcagaggtattttgctccataaacaatgtcctcctatatttcctggcagaaaaaaacgcttccgatggtaagagttaatgaaaaaaaagactttcagaaactcttataattggagtcaaagaatccctaattcttttgttaataaataggactgagattttccatactattacatggaaaattggtaatgcccaaagatacataacttttcaatattagaatgttatatcaatgaagaaatggaagtacctgaatgaatcttgcctgaatcaatgccaaattgagaattttgcgcaccagctacaagaagaaaattatgtgatcagtttatctgaatactgtacatatataaatgtctttatataattttgtacacagtcagtcttaatcaccaaagctgataaacaagatagcgagtgatcctgattttgcctccaatgcgagtctattcatatcagggagaagaaagttggcttgggcttgactaactccatcaacccccaatccaccagttaggatacatgctcgactgaacctatatactgcagaatactataatttgagaatttcaagaaaaatgttagcaaagaataggtaagttacaaataataaagatcaatgcaaatctgtctgaggttcaaatgcatacctcagcgacaggcttaggagaaacgagtcttgccaacaaaatatacagagggaataatttttgagtttgtaccccagcatctatagcgcccgagaggaatacagtcatttgtattctgcaaagcagtaatatatattgataactatccgaaaacttagaaagcattcaagtccggaatgaattactaaggtatagtgtaatagttacccaaaagtaatggagattctgaacagagaaaggaaggaaaaaaaaaaagcttacctccttttatgttttgcctcaatcttataatgcaaacatcgctgaagaaacaagggctacaggggagacagagagagagaaatgattaggatggactgcatagcaagacaacacatacttgcttataccaaatgaagtcaactcaaactacattttcatgtaaattttcattgtcaaaactcaaaagtaaaccaatacatgtgatatatcagctgagctcataagtcataactaaacatattctgtctaaaaaaggtaggaaggaagacatacattcctaatagcacggcgttgaatgatattgtagagttcaacaggcttgcaataggcagccaagctctcttcagcagcaatctcctcctcttccgaaatacgcagacgggagtcttcatggcacatctgctctgtgcttcttgaacaactgtgatttcaccatcatacgcaaccaaaattgtaagcaaccccacaacaaaataaaaatttgataagtttgaattactaggattcctcagcttatacataagagaaacagtataaagttacacaatgctgcagagacattatagaagcattaggttgttcatgagacttacgaagaggtttcacgactaacaagaggaatgcctggcattctcgctacgagatcctagagtacaataccatacccagaatcagtgcatacaccatcacagattacaaatttgcttcagctacaaaagctgcaacaaaaatcgtaaagaagaaaaacccaataaatcccacaacagcagaaacgggtatcaagcgattagcaggaaaaaaaatgtaaacttgaacagtggtgaccttcaaaatccagcaaagactcggagttgagctaattagataaagaacagattcaacaaattgacagagatctcgaaatcaaggagaaggtgaagattaggatggagatggaacagttaactcagaagaaaaaaaaaaccctaattgtgagaaattatcttcacgcgaatacagaggtgactttgacagcttgagagagagaaagagagagatgaagcgtttcgaagagtaataaaaagtgtaaattgatgatattgttgaggagaccgtaaatatttttgctcttgagaaaataagcgtaaaccatgtcctaaatcagtaaaattcggtgcacaataaaatctaattaaaactcttttcactaattgaaactaaattccccaatggccatgagaaagcataatttcttaactattcaatataagccacttgagttcaaattagagatccaccaaaaaaatggatgacaaagtagtcatagttccttatccccctaaaatgataatggtataaacaaacatattttatggtatcatcaactcttactatctaaaatcgaccatcagtttcgtgtcaccaatatcggtaaaatgtgtttgtttttgcataaccaaggttttccgttcctaataacggcgtaagttagcactgtaattgaatatctggccaaatagacgctaacgtggacgactacctagccccatcatcaatcacacagaaaaggagtcggagagggtttttcgcctagggttttagaattcgatcttactcattcaaatttctcccttcagatttattcatctgttgagtaaaaccacaagggtttctctctaatgttgcccagattagctcgagtcgtcactcaaacctcaaagcttcgatctttgaccactaatggatcgatg

SEQ ID NO: 2316 - DNA, 3000 bp, Unknown
  misc_feature (1)..( 3000): cDNA_ID_2153349_gDNA_ID_1620518_Annot_ID_159363 3000 nt of promoter + ATG
tttattcaatttaagttacttcatttttgtttctttgttgtttatatagaccaacttgcctattttgaacaatgaaagtttgaatttcctgcatgcaagttatatagaacaacttgccaaataaatcagattagaagatgttcaataaattcatggtcaagctttgaaaaactccggcccccacaagagtataaacaaaatgctggaaataaaagttttacgaggagcatttcacgaatgttggttaatcacaaaagtcttaattacttacttcaaaaattcttgttgacgaacaacaatgaaaagaaaaaagatacaagattttttgtcaccatgcataggcccgaataatatacagaaacgcaagatggatacaaatgccaaggacaccgggtaagtcggagaagtgctggtcgagaggacctacaaacataggcggagaagagctaagggtagaattaacttcattaaaacaattaccaccaaaataagaaacattggatgagaatctaactcctacactaggtgctcgacatttggatacgcatgtcggatttggtttttttaagtaaagaaatttaggatccaataagatatatataaaaaacgggtttggtatcgattcggatttgggtcgaatttaagatttcataacctataaactcggtacttttcagttcaaatgtttttctatctgattgtacctgattactcgaagttttacttgattaactgatattatatccgattatccgaaatttttacctagttatccgaaatattatcagattttccaaaatattgtccgattttccgatgtaagtaaagcttctatccatataagtgtagctaattttgggtaatcgggttactcgttcgggtatcgggtaatacccgaagcgacctgatacccaagattacaattacataggatccaataggtaaattagttatatcctacttgacccaaaccggttttttgggttggtttcgattcgggttttcagtttcattcatccacttctgttaatttgttaaatctttgaagttcagaaaacacaaggagtaagattagtgttggaaaactagaccagattcattcgcattcaactcacgccgtcgatcaaaggtatctggcgactccaattttgcctccacatagtctcaaaccgataaatgatcacttctccaaataacctaaaatagctgcccagtaaaaaaaatccctaaacccaacaaccaaatcaccacgatcacaccaccatccagacttgctagacgcaaaaaagtcatcgtgagtttcatcatcgatctaaaatctaaaacctttcacttctataaggcggaaccaccatcttttaagcttaacaaccataacaaacctcttacattatcggcaaaaaaatgctagtgaccgatccaaattaaatatattttttttttttttcacaaaaagtgatactttttatatagatcaagtgttgcaaaagatacaactgtggaaacttccacttacaaacttaactaacaagttaaagcatacattgttaaaacatggatcttctaaagtgaatgaagactccattgaacataacccaaaaggttgcagctacatcttcagattccatttctgcttgaatctccagtctattcaaacggaattgctgcacactaaccattaggtatgcaaatactccaataaaatcctgagcataccaattattcaaacccttgcttcactgagctaacataccattgccaaaaggtgtttaacgccaaaaagtgatgacagaataattagagtggttaccgcttctttggaggtttcagaatccctccttctttaagctctgttactttctgcttttgattccttcgaactgcctctggctgttcaacttgtgtggtcttgcgtttagatgagtcaccttcttcagttggcctggaaccttccccaatctcagctcttcttgatgattcaccaatctctaaaattcttgaaaatctagaagtgacttcatctgcaattggtggagagagatgagattctgacctgaaacgtggtgtaagagttgccatttgaggtttttcaaccatcaagttctgaggagtagctgttcttgaagggaacaggtaaagtcttgcagctgcaagctctgcagaattcaaaggaggggtagcagtccttggaggtggagttataggagcaggaaaggagtcatctgacagttgtgattgagaattcatatccgacctgcaaagctcctcatgtaaagccgctcttgtcctttctgccatgtcttgacctctaccatcatttcttggtgcaggaagaggaaccatgtaaggacaatgattccgttgatgagtgaaacgaagacaccgactacaaattcttctaagacgttcatattggaaacgtatgattgcagtctctccagaatcaaaccggattcgttggaagaaccttagtctatcagttataccaaacctgactcttactctgatgtatgcaatttgattagaagtagcttcctggaagtctatgaggacaatatgacccaattcctgtgcaatctcactaacagtttccacacaaacatatggcataggaattcccctaatctgaacccatagatcaatattggctagaaaatccaagtcaggaaagaactcccacctttgattgatgataaaccaattattaaaaagccaaggctctcttctttgaactgagatcaaatcaaatccaaattaaatatagaagattaaaaactaaattaaaattgaaaattaaaaaaaccgcgtttcactttaaaaaaaaccctaagtgctcgtctccttcgctttcctctgttctctcggatttaaaactcaaaaaaatcgtatttctccataagagtaacatatcactggacgtttcccaattatctcctcctacgctcccgactagcgtttatcctattccggtcgccgccggagaccttgtatctccatata

SEQ ID NO: 2317 - DNA, 3000 bp, Unknown
  misc_feature (1)..( 3000): cDNA_ID_3067006_gDNA_ID_1620518_Annot_ID_159353 3000 nt of promoter + ATG
tgtatagaggagaatgattttttttaaatcaaattataggaaaaaactatgattgtgttgaatagatagacactatatagtatactgcatgaaatttataggataaaaatatgggctatataatttaatgttttaattttaaaagttaagtttttagtaatttgggaaatagtaaatttaaatttgattaaattaatttatttgataaataagaaatctttctataagctaaatatttagaaatccgaaaatattatttttggatggtgtatttaatattaaaatatgtttggtttaaaaaataataaggataaggataaggatagtggaattaatagtgtttgacaatgagtatattatattcaataaatgaaaaataaaaatgatgagaacaattatgggcttgccacatcttttactatatagaggattccaaaaagttggaagaaaaacaattcctaaattgaaaagatttttttctttttcttgctatgaatgtaaataaaatctcaaaaaaaaaattaggagatgatatatatcaagatgaataaagacgaaagagacttaaaatttgttactgcttcccttctgtcatctttgtattatttcctatcatattgttaggaaagatttatttctttacatatgagaaatatgacagcatcaaattcaatgtgcatcaaacgttttgactatttttgattttcttccaaaattaaaacgacaaatttgattttgaaagcaacttttaaaaatacgtttcgccaaactaattacagtataaattggatctcatagccaataactttatctcatcaaacaaaactcaagtcatctatttctcttgttgcatagtcccccaaatattcatcatgtcgatcaagagtgttgtttctctcctagtagttgtatgcatcgcagcctccgttaatgctcagctaccgcagtttcccccaatcatgttcccgtttccaaatccgttcaaaccaagtcccggtatggcaggaagtcccgacttgagcaaatgttggtcaacagtgatggatttgccgggatgctttgaagagattcaacaagccgtaatgtccggcaaatttgaaggcgttggtcctgcttgttgtaaagctttccttgacgctgaagctaactgcttaccaaatcttccatccaacccgtttttccctcctatgatgaaacaccaatgctccaaaatggctagtcctccaaccaccaccgcctattagaatgcaaaaatgtagttgtgttttttcgaattttttgttagtcccagaatgttctagaagaagaaatgataataataatgtcttaatctaataataatgtctcatttcttatattgtgctccatatgattgatgttctttcttcttttgattgatgaatgaatctcaaagacatgttgcgtgatatctcttatgcggttatgacaatgctttctatataactcgacatgtagaccgatcacacacaatttagaatacatcacatacattacatactatcaaacaaaaatgttccaaaataatgaaaagaagatcacgcccaagctcttttcctaggggaaagatcagaagtcttgatatcatctattttagccgccattatgaaatcattcatgctcaaccctcctgcattattcatccaacaaaccgtcttaagaaaccatatattaaaactcaaactcgaacatcaaatatttgacataccgatagaagaggtaaatagttcagctcgaacttgggtaggactttccaagtgaagagaagggtaatgaccagaagcttcagcaaccttatggatcctgtttatgagttcaacaccgcacccaaaatccctcactttccacatacaccttattttcagaccacccgcttcattatccactatactccatcccaaaacctaaaacgtttacataataatcattgagattgatgtaccacatcattagagtggtaaccgtgaaccaaaacaccaacatgagccttatcaacactaatcatttcatttttttttaatctcgtaaccattgttcctaatatgtccctcatgatactaaaattttcattggcttttctatatttttgggtcacaattctatctttatagattagaaatctgttaaacgcagaatcaataacattttcacaatattttgatcaaccaacaaacttgtaaaatcaaaactcgaacatttttatactaagagagaaatagtataagtaccttgtggaggagagttctggcatcatcgccggacaaaggaggctgtgaagacgaaacaggggaacactgaagctgggagagagacaaaacagatgcgtttggtatcaaaatcttgtgctcagtgctttggcatcccaacactttatctccgaattgactcgctatctcctccgggtaagggtcacgagctccgaagtcaccaagaaaatcctgcgccagattagaccgggtcaccgttaaccggccgagtttacggttattcctacttacaggtggtaataaaccgaacactttaaggattgagcgagaaggttgacggaggaggagggaggacgcggagatgttacacggcggtgatgatgacgtggcggccatcgggagctgtgatttgctctgtaccgaagataagagttttggtttttagagagcgaaacgattttcagaccactggactgagttaaatgggtgaggtgccacgtaatcactaatgactaatgggaaccacaataaactttcgtgggaccgactttacacgtcacgttttaatctgagaagcccattgggtttgattgtacttttgtgtccacttttggtgaatctacttaagatttcataattccgaaagtatcctttttgggtatctttaattacaaacaaaccttcccttctttcccgatttcaagccctaaaattccgagacttctgtttctcgctttaacgacagtcgccgagtgagagatatagagagagaaag

SEQ ID NO: 2318 - DNA, 3000 bp, Unknown
  misc_feature (1)..( 3000): cDNA_ID_3067091_gDNA_ID_1620519_Annot_ID_159387 3000 nt of promoter + ATG
cagtcttaattaatgttatcttcctttggatgtaattggtaacaaattgcagaaaaaagaccatggatgatcttcatggaagaaatggtcgaatgcacattggtgtagcgcaaaatccaatgcatgtgcagtatgaagatcacggtttgcaccatatcgacaatgaaaacagtatgatggatgaccatgctgatggtgggatggatgaaggagtggagacagacattccttctcaccctggaaactcagctgataatcgtggtgaagttgtagaccgtggaattgaaaatggagatcaattgacattgtccttccagggacaagtttatgtttttgaccgtgtctcgcctgagaaggtaactttaagttaattttggttctttgatgttttagttttggatacatatggtcaacgtatccacctggttggttttgtttttcgcttattgaagtgctgctcaatattatgcaggttcaagctgtgcttttgttacttggtggaagggaagtaccacatacactcccaacaaccctaggatcacctcatcagaacaatagggtactggtaataaaagatttaataccatatgggaaatcagtttattccccagtttgttgctgactaataaatgaaccagggtctatctggtactcctcaacggcttagcgttccgcagcggttagcttctttgctcaggtttagggagaaacgaaaagggaggaactttgataagactattcgctatacagtcaggaaagaagtagccttgaggtacgtttatgtcaagtactagcttttgtgtatgtcgagcttttgagatacgtctgttttgcaattaaggttttgtttgttcatgcagaatgcagcgtaagaaaggtcagttcacgtcggctaaatcaagcaatgatgattctggatccactggatcggattgggggtcaaaccagagctgggccgtagaagggactgagactcagaagccagaggttttgtaagttgaaaatgctttaaatttcttacaacagttatattaactttagtgaactcgttataaaacctcaattaagtctaatacatggaaacaatttatttggtaaccatttaatgacgctcttttcacttccataaactttgtctatatacgtcaactctgaaatttatagttatacttatcatgatggcatcactcattcgatacctgcaactgataacttatacttgtgagaggataaaaataactgaaccgactatgttgttgcatgttaagtcattgtagttgatatgaacttatttatagcttggtatacttggaaagcttgtctctgttcttattcttcgtcaaatggttgtgaacatgttaagatgtcgacactgtggaacaagtgagaagtcaactccaatgatgcgacgtggacctgatgggccaagaacactttgtaatgcgtgtggactgatgtgggcaaacaaggtaagctaagagtttcttagttcacattgatcacctcgtctcgtatcacttttttgactcattgatcaggcctatatatccgagtatgaacctaacaataacattccctttgactttataatatcaggggactcttagagacctatccaaagtccctcctccgcaaacacctcagcatctatctctgaataagaatgaggtgagccgtgagcgcagtatttcatagagctggagttttgatttgcttattaagagaacatacattcattttttttttctcaatcacttttgttgcaggacgcaaatcttgaggctgatcaaatgatggaagtaactggtgacattagcaacacacagtgagaactgagaaaccattggaagcaagaaaggatctcaaacaaaaacagttgttatcatttcatttgatgatggaatcgaatctgagttgtgtttagggtttctctgggttaatctcagtctatgtgggcacattttagtcttctacaaattataagacactcttcacttatttagaagctcactcatcagaaaagaaaaaaaaaactttgctcagtctctcatctgtgtgtttgattatattttcaggcagaaaacttttttttgttcttgtatttgattacaattagttaaatatttaagacttagtagagataatgcaatctatgtataaaaatagaaacaatgattggttatgtcgtgcaacccaagtgaccttaatgtcgtacacacgttcatcaggttaaaacgaaatttctcagcaacttcactattctctctgtcacattgttttattcttttccattatctttattggaaacttgattagaaagaactgattaaggtatgaagataattagtgtaccattcttcacatgatacgaggtgaacaatagtatatcagaatactagaataattttataagttataaagatgaatggtataccacttattacaaaacgaaaacatagttagatctgagaagaaggaaagatttttgttttaaaaaatgagatggttagatatatgccatgttaagagatgccaccatgttcttcttcttcttcttacccggaaaaaactctttcttcttctctttcccataaaaagaaacaaaaaaaaactaacttcccacaaattttgccaaaccaaaccaaaaatagtaatgatctcattcaatttgaaccctctctccattttctttcatagtttttttttagggtaaatcaaaatattaatgttggttagaaactcaaaaattagtttctcttttttttctctgtgattgacagagaggtaagagaaaaaaaagagagaaagtgtttcggtttttgttgccttctctcgagttaggccttctctcttccgtcacaccatcattttttttctccataacgaccaaatcataaaaccggtcgttcctattttttctttctctgcgttttttgtttcgaattcttcaatagaattttaaaagaaagaagaaagctgggtgagacgaaggaaggaaga

SEQ ID NO: 2319 - DNA, 3000 bp, Unknown
  misc_feature (1)..( 3000): cDNA_ID_3067083_gDNA_ID_1620519_Annot_ID_159394 3000 nt of promoter + ATG
gtgtttaattgtgtgtgtgatttaggttgtgttttataagagaatcaacaaagtgttcttcactgactctattcctaaagctccatcagggaagatattgaggaaggatctaagagcaagactagcaaatggattaatgaactaggttttatatgatccacgtatatgaatgcaatcttatcagaaaaatgaaacaaaatttcgttttgtgaacaaaggaattaaacttacacgtaaaagaataatatttgtgctttttcctttatgtgtatgtaatggataaatagttgtatcttttgtttggtgggaatgatgtaacctttccatattgtggcatattgctcgaatataatcaataattgccttaaaaagtaagcaaaactacattcacccaacaggaataagcatcctagaggggagggaaatacttgagtatcaaagactagagacggccacccatagagaatagaatcaagtgatcatgaagtcgtgatatatcagaatttggagttacaatttgcatagagacaatccaagggaagatgcccatttgtgagatggataatttggttagctgaacaataagtttcatttgcggtacttaaagagttactgaggttttgtcgtgttcctataattaaatctaatcggaccggtaagcagaatatgctcgtgtgttaggtgaagatttgtcgctattgcaatccattgagattatagtaatcaaaatgacactaaaatttatatgatagagaaattacaacacgttcgtggtctttgactattggtggttctataagtcttatatttgcaacttttgagtcaatgtcatatttaggggccaccaaaattccgaatattttattggtaattctacttaattatttggtgacaccaaaactatagtgacataaacagtttttttttttttttttgggaaaaggcgatacatatgtttataacattttttaatatacaacactatttacacccatgtcgtcattattggggatccattcattattgtttcctcttcttcttttaggaatcactcatccaaatcgatatccagtattagatttaatttaagtatgacttattgagaacttataagccttaaggtatgcacctaagacgcgaatttatgagcattgggacgagttagagaataatcatgtgatcatttataaaaatcaaagacatacaactacaattttaaacctagcaggaacggtggtagcaacttaaatttcattatttcaaggcaacaaccgttccaataaaatacaaaaaggtggaaactactgcaaggctaattcatattttctttacatttgtccttatattttggagaattcttatgttttagctatccgtataattcttatgtttttggcatttgccataataaatctatcacaattgtttttggaaaatattttctaaattgttttatcagaagatttaggttaattttaatctattgtatcaaatggtgaatattttgaaaagtataacccgatctaatgcagagtttgtaatttctccaagttgttttgcaatagtcaaaactatacatccatggaaatgagatccgggtcactataaaaaactaaacaacttggtaacgacttgcgacctttttttttgcttcaagtccctgttttgtttggttatcgaatacgcgttagtcgcttgtgaacatttcgtagaaactctgcataatcaaatatgtaaaattatctcatgctatattaaaaagatggttaattaagagttaattgcaattttcttatattaattagatatgaattattttagattatcagtcctgcgtttacaaaaggccaattagatatatcatcactactactttggaagattagtaaggtaaatacagttttgtatggttatttcttttggggtgttttttaaattgtccagagagcagtaaataatatcctaccaaacaaacaaacgaacaaaaaaaacagcaaatattattgaccaagaaatgcaaatagattatccttcgaagatgaagtcacaatcaactctataatttataaaatatcgtacaaaacttatagtcacgtttaaagtataagtgtataacaatagtatgaagtctgcatgctcaaatatgagtattcacattatgctcatggagaatttttggaggtcaactgcggaatgtatatagctattagctactacgcgcctttcttaatattctcgtataaattttggtattattaattttataagccaagttgtcaatttcataactaattattatattaaaattaaatttcatacaaggataacatattaagtatacactgagatatatattaacaaattttagtgttaattaaaaatagtttccgattattatgatataaaatacttattaagttataatattgacaatttttgatgaagacacgtagaaatggcccactcaccaactacgtagcaatggcttatatacaaaatcattaagaaaatcgcatctaatgggaaataaatcactattactataaaacaaaatcagccttcgtccattaattaataattactaatccaaacgtaccattataaaaacccaaacaacagaaaaaaaaaggaaagaaaagcaagtgttacattttgaaaagaaagaagtaaagaagaattagaatctccacacaaatggtgctccaacaacaaacgcattttctcacaaagaagatagatcaagaagacgaagaagaagaaccttctcatgatttcattttccgatctaagcttcctgatatcttcatccctaaccacctccctctcaccgattacgtcttccaaaggttctccggcgatggcgacggagattcctcaacaacctgtatcatcgacggtgccactggccgtattttgacctacgccgatgtacaaaccaacatgcggaggatagctgccggaatccaccggctcgggatccgccacggagacgtcgtaatg

SEQ ID NO: 2320 - DNA, 3000 bp, Unknown
  misc_feature (1)..( 3000): cDNA_ID_3067079_gDNA_ID_1620519_Annot_ID_159395 3000 nt of promoter + ATG
acaaagactgagatttccaaatcaaaagatataaaatctttctgataaaaccattctttttgcaggctctagagaagtgtcagctcaagacaacgattagcaatcttcctaataaacttgattcttcaggtaaatggtaaaaaagctgtaatattttcatttcacaaaaaaatgggtttgatgacacttaggtttatgttttttcattggtgagaagtgagtgatgaaggagaaaactggagcgtgggacagagacaactgttctgtcttggaagagtactgttaaagagaaacaaaatattagtgttagatgaagctacagcttccattgattcagcaactgatgcaatcattcagagaattataagagaagagtttgcagactgtacagtgataacagttgcacatagagtaccaactgtcatagacagtgacatggtcatggttctctcttttggtaaacaacattttctctcattctttcatctcttaaacctactcataatgaccaatgaatgagtttcggttttggttttggataggtgatttagtagagtacaacgagccttcgaagctaatggagactgattcttacttctctaagcttgttgctgagtattgggctagttgcagaggaaactcttctcagaatctccaattataagccagctgctactgaaactgaagtgtcagtgattgttaatcacgttcttcatctaccattgtagttttgagaaaaagatgtaaaataaaaattcaagcatggataatgatagtagagtagctcaccaacccctacatgaactttgagacagcgattacgaccaatactcaatcattgctagaaagacaaaactacccctacataaaaaaacatattacaataataacatttcaccaaccacaaattcttttatatggaaacactgatcatcatgctctgtttcaggctcaaacgttactttccaaaacaatcttttcagttttagataaaaatttgatattaacttctgattcatgacgacacaagatgtgatagtcaatgatcagaatgatcagaaacagtgtagtaatgacgtcattttccgatcgagattgcctgatatatacatccctaaccacctcccactccacgactacatcttcgaaaatatctcagagttcgccgctaagccatgcttgatcaacggtcccaccggcgaagtatacacctacgccgatgtccacgtaacatctcggaaactcgccgccggtcttcataacctcggcgtgaagcaacacgacgttgtaatgatcctcctcccgaactctcctgaagtagtcctcactttccttgccgcctccttcatcggcgcaatcaccacctccgcgaacccgttcttcactccggcggagatttctaaacaagccaaagcctccgcggcgaaactcatcgtcactcaatcccgttacgtcgataaaatcaagaacctccaaaacgacggcgttttgatcgtcaccaccgactccgacgccatccccgaaaactgcctccgtttctccgagttaactcagtccgaagaaccacgagtggactcaataccggagaagatttcgccagaagacgtcgtggcgcttcctttctcatccggcacgacgggtctccccaaaggagtgatgctaacacacaaaggtctagtcacgagcgtggcgcagcaagtcgacggcgagaatccgaatctttacttcaacagagacgacgtgatcctctgtgtcttgcctatgttccatatatacgctctcaactccatcatgctctgtagtctcagagttggtgccacgatcttgataatgcctaagttcgaaatcactctcttgttagagcagatacaaaggtgtaaagtcacggtggctatggtcgtgccaccgatcgttttagctatcgcgaagtcgccggagacggagaagtatgatctgagctcggttaggatggttaagtctggagcagctcctcttggtaaggagcttgaagatgctattagtgctaagtttcctaacgccaagcttggtcaggtttgttttcctaatttttgagctcttattgatatttttttcttggttattttgattatcatttatattttatttttctgaggaaatttaatatttcatgtttgttagtgatgttatgcaaattctgaactttattacatttgtggcccctgaattccgaaatattggacaatgaatattatggtgtttgaacccattttattcaaattttgttggtaaatgatttaaaacttttggactatattacttgatttgtactctctgcacaaaggccatactaattttctccagaaggatggatgcattttattcagtttatttactatatgaaaccttacatttggaatatggacattaatagacttactattttttattttgtttgaactagatatgaaatcaacacaaccaaagttaatgaaagatttttgaacatttttaaattgattttggactgttttaacttttagagcgtctactaactctctttttaaaaacgttttaatttttaaagccacacctactagtttcagcgttcataaaattagtttagctaaaaattaagatataagctttctatgataaggacttaccaatttcgagtttgagataattatttgcgccacttagttagcataatgaataccactcgagatcatttccttagttccacctataggctatgaactttttgatttaaagattattatacaattctaataactttttgtcccaaaagttataaatgtattttgaaatatttgttgggtaggtgagataagattttgtggtataggtcatgtggttggtcgatctttatttgaattttttatttatcatgcaaacacaaattgtgtttgaaagttttaaaaaattgaagactaaaacggctctgtttctaaacttaacgttttggatgttggttactacgagcagggctatgggatg

SEQ ID NO: 2321 - DNA, 3000 bp, Unknown
  misc_feature (1)..( 3000): cDNA_ID_3067072_gDNA_ID_1620519_Annot_ID_159397 3000 nt of promoter + ATG
attaatcataccgatagattaatgataccgtacgtttactgctaattttttcgtttttttttatagtgataaaaagatttacctgaaataaactaaagtgtgtatctttctgaccacttctgcgattaaaggagaaagtaaacgatcaaaatgaagtaaatagattaatataccaaacagataaaccaggaaccaatacacaattagctactaggtcaaacataggggtcgataagagattcgataaacaatcttcatatattaagagaaacttctacaaataatctactattaagtacgtacttcatattttataagatatgattaacaaatatcccggaatcaaaaaactcaaaaatagagagattcaataaccgattataaatagccgaatttcctgatatatgttagttcagtagaggcatacacacatagtcaacaaggtagagacaggaacaataattggtacaaagatgaaacgaaagagatgtgaaatggaagagacaacgaagaagaagaagatgacagagattggatctgccattgaagaactctctgttctttccatagccaagaccacaatagttaccaccgaaaaagaagccatcaacatcatcaatttacctttgaagcctctcctatctttctgcaacattatagtccaagttcttggtaatttataaatctccataaattaaaattaatccttatgcgtttttttccctttccataaatataaataattatttctaaatactatgttttaagttaacgttaaagatagtttctgctcttccgaatcttgttcactagtactgcttggtttgcttgaattagttcctccaatggttgtcctgaaactttgttgattcattgcagataagattggcccgacaatggctgttctccgacatgacattgatcaaaatattcaagtaattaattttgtctctttcctttattttaatactaatatatatacatcattttcaatgctcgtaagctcttgcgtaaccctctttagatatatactccatatatactaaattactaagtacatatttattaagaaaacaaagaatgctccattttttttatcttgttagaagaaaaaagagtatttgtatacatacattattttaccttgttacctaaaaaaatgcaatgtatatgttgcgactcgtctcccaatatctctttagacacgtagacccatcgatacctttacgttgctttcatggtcatttttgttatactctctctctctctctctctcgaatgaatggacctcgtttttttcctccacactcatttttcttattaattatcaacaattattgacctattatttttattgatttttgttgttgttgttttgtttaactgttctgtttgtagaggttagagaagatgtgggaatctgatcctcttgtgtactcaaatttagttgagatactgagaaaagaagccaaggagggatcctctaggaaacctaaaagttgtagtagagctgctctttggctaacgaggtacgtacgtatcattttggttcatatatactccaaattgaatatgaacccacaattgtttttaaactattgattcccaaactatatatatagagcgatggattttacattggcgctattgcaacggctggtgaaagacatgtcacaaaacatggaacaagccatagaagaatgttataatttgactataaaaccatggcatggatggatctcttctgctgcttttaaggtaattattacatggtcattataagttgacagtaaaaacaatttattctcaaattattttatgtaatatgtttgtgtttttatgaaaggtggctcttaaactggttccaaacaacaacacattcatcaatgtgcttgcggcgaaagacgagacacaccaaatggtccaagatgatattacaagtctaatttcgttgctcattccacttctaagccaactccattctattttggtaggcaattttttttttttttgtcaacagagaaaaaagttttgtcgctttgtgtatctatttataatttcgattattgttattgtttttaatttgggtaggaattatacgaagtgagcaaattaaagtcaccgtgaggaagagaaccgaagaaaaagactgaagggtatagttttggttattgtaacaaagtctaacttgtagcatcactcctctttgataagttttattaatctctcttttttaacgagttactgatctaactaactgttttaccatgcatacaatgatgatttccgtgtatatataagcccatgcatgcacctaatgaatagtcgattcataaatgttttaaaaaatctgaagattgggagcccatttacattactggcccaatttgtgaaacctgagtttttcttttttggtcaaccaaatggttcataaaaatataaaaaataaaaatagtgtggaagatgaacatattacacggctcgagaaagtgcaatgtcccacagacaccaaatccttaaacgatgcttctcttctcttacttactcagtcactactagcctacctctaaaccaaaactgccagatttgtgtcgtttttaaacgacaaagaaatcagtaaacacatgtcaaatgttaagtaaacaaagccagaaaaagagaaaaacagagtttttgttttcttctttctttctcacctctataaaatgacaaaagatccatcattatcgtttaattcacatcggaagttttataacaaacagatccatgaatttcattacgtaagcaattacgtaatagaattatttgtttagagatcgacgagaaatgccgtctaatttcgtttcaatcattctaacgaaaaaagtagatgtggacttcattcaatacatcgtttagcttaggtaacaaacatcaacctcacatttcagtcataaaggcacaagctttttctttctttttttttttcattgattgagctctcttgcttctcctacaatg

SEQ ID NO: 2322 - DNA, 3000 bp, Unknown
  misc_feature (1)..( 3000): cDNA_ID_2153493_gDNA_ID_1620519_Annot_ID_159405 3000 nt of promoter + ATG
caaacattctgatgccttaggaaatgttcgtaaatctgacaaaggggaccattttccacttgaaatgctttctagtcgctcaggaaaggccttcagggacaatcagagagatgatgttcatttgaaaaataagtttccaaggaataaaaaagatggtgagtcagccattcgaccttcattacctaccgagacatccgatagaaagcccgatgaactggatggaagtgacaaggatcccaagaatgtttcaggcttgagcataggttcttctcccttagatagccagagaacatatttggcgaaattacctaagggaaatggacctgtcctccaaaaacaagtttcggaattggagttgggtgaactccctgagccattgggtgaagatacagcattgaagccgatcgaagagaaaacttcgtttaggcagtcaaatttaaaaccaagcacttcagagaaattgggtattgactcggataaacgaaggtctaaaaaatctgactcaaaaaaggcagctcctccacatacagtaaatggtagcaacgaacacgttgttgaagattcagaaagatcccaaaagtgggctttgcagtcacatgggcagaaccttacaggtacagatactgaaatcagctcacagaataaaaatttagaagatgcagcttataaatctagacaaaaagatagtagagcaagagtagggaacagtgtggaaggttatggagaaacaaacaaaaaaacgcctgttgtaaagcatggctccaaacgagcatccacatcccgctcttcaagggagagcaaaagacattcgtctgtctcaaattcaatcaatggacacaaagatgcaacttcaataccaggtggcagtgttgtccgggagaaacaaatgacatctttcggtgaagaagactcttcttatttgaaatacgagaaagcttctcctgagcttaagggacctattagtgatcatttgcagtgagtaaaatgaaacttcaatgtttggagttataaagtatttctgttttgagtagataacaatggttttgtttttctatttcaggtataaagcctatatgcaggagtataatgataaatatgatagctaccactccattaacaagatattagagagccacaggtagctagatgaacactcagatcatttgtgttgtcctagattgtcagcttttttgaactttatgtttaccattattcgcagaaatgactttcaaaagttggggcaagaccttgggtttgcaaaaggaagggatgtggagagatataacaaaattgtggagcagataaaggaatcttattgcaaatatggggaggtaatcttctatctataaccacttcatagttatttgtctcttatattttgtattaccaaaatatgaaacttttgtaatatatcgttgaagatagaactcaacttatataccgaagttttctttgcatcagatgatttttagcgtcgtataaaaatttggaatgataaatttgtttgcttgtgtatgatttgagaaaatttgaaagacatgaggagctgaatattatcctattaaggtaataggttaaattggatttgggtgagaaattgttacctagattgatcttcatgagaagaagtgactatattatattgaaagggaatctctcagcttatgtgcattttatttacggatccgattatgtgagttttttttacgatacttgctgttgactcatacttaagcatttttccccctatttgattgtacactatgatacttgatgatggctttcttatatatgttatctctcactcaatctgcagagacacaaacgtttgaagaaagtatttgttgttctccacgaagaattgaaggtgagttacaaaactcccctataaaccgtagtgttggttgttcatctcccacatgcattcttactttagatgtaccgtgcatcttcatggatggatactaatgaattatgataacctcttgcagcacctgaaacaaagaatgagagactacgcatcatctcatggaaaagattgatggaaactggaaccaaaactctcctttggtggagtcatcttgttgaaacattagctctgtttttctttctttcttgtgaaattagaaatgattcataggcccaattttgtgtgagttgtacttaggaggacctttggtagattttattcttgttgcagttggtttagttggagcgctcgataaacgaatatgtacatacatgggtatcaagatcaatgtagattcttctggctctgctttaatttaactttgataagtcatcatggcattttggtcttccatgtgaagcttaacagagaaagcttaatgggtctgattggtggtgacctaaaccattaaggatgattgtacgtactaccattttctgacagcgccaccgccacggttgcataaatcgaaatcactgttgtagtcttgtagaaggtgaaaaaaaaaagtaacctaaaggaaaatctaaaacgcagtcgttttgttttcttagtttggtatcaaaaactctgaaatcaaaagaaagaagaaaaaaaagtctctgttttttctctcttccctgtttttctgtgtctttctcctccgtgttccgtcgtcttctctctctgcgttccttcttgaagccggaggaagcccaaaacccttggaataaaaaacaacggcctctctgctactgattgatagaaaacaaaaatctcaaacctagagaagaaagcgacgtactgtatattctcaagactaactggatctctcgttgatcttcaataaaccctttttgcaatcagtctcataagagtctacaactcgtgggcttctatttttcttgttggggtttcaacgttttcctctgtgaagaaagagattgactttcatggagatgaacctctgctggaatttgtagattcaattagggtgttttctgggttttgtggtgcttcgataggggtttttggtgcgttggtggtgggtg

SEQ ID NO: 2323 - DNA, 2479 bp, Unknown
  misc_feature (1)..( 2479): cDNA_ID_3067060_gDNA_ID_1620519_Annot_ID_159408 3000 nt of promoter + ATG
ctcttaatgtttctttatgaatagcataaagagattatagtgtataaatagaaataaaggatttgtcgggggtatgtccatgattctgcacccatgattaagagatgaaagtggtccattatcacatatacatgtcaaaacaaaacatgaaacaaaatttctaggagttaaagagcaagacgacgacatttttagaaaccgataacattctttctctttcagatactttggctcggtacggtttaaatggtccagaccggagctgtacagtaatctaagctatctgactcttcttcactcttcttggctcttgctctctcccttccattattgaatggttcacacgtgaacacaacgttctccataagcacgtggctcttcgtaattggttgtgatcttggaggatagtagtcccacgtgggaaatcagcatggcgtcatattgtggggactcacagaagttcttttcttttctttctttttttttggttaaagaggatctaaaacttttttttcgtttttgtttttgtttttaacttttttctttcctcttgtgtattgtaacatcaccccgttaatgaagttaaatattatcctgtaagaataaatgaatgttgacaaggaaacgagcttcgatcatatttgtaccttgacaaacacattcatatacaaaattttcatacgtgtaggcttgtagctccacattatatctataacaaaaatccggttaggttacattttaaaagaatcagaattctaaatccatacgaattgaaatttaagaaaataattttagtatataaacccatactaaatttagtttatttctcacatttttatttattgtgtttgaagtctcaatgtgctagcgtgatctgcaatattaagtttgactatatcttttcattgtattaacagaaatatttttttaaaattttgcttaataaaagaaaatttcatattatttttattagtaacctaattcggaagttttgttttatattcttttaacaaaaaaactttcgtaattttatctatagttgaacgcgttaaacagtcaactctaatgaataatttacgaggtagaataaaaagcttaaaatgatagaagttatcacaaagtaaaacaaactcatcaagaagttgttgtaattaaacttatcattgtatactattgacttagttaatttctattgttacaaaaatataagcaatgttatttttattagtaacctaattcggaagttttgttttatattctttaaacaaaacaacttccgtaattttatctctagttgaacgcgttaaacggtcaactctaatgaatactttacaaagtagaagaaaaagcttaaaatgatagaagttatcacaaagcaaaacaaactcatcaagaagttgttgtaattaaacttatcattgtatactattgacttagttcatttctcttgttacaaaaatataagcaatgttatattatcacaattcacaaacattatattacatatcattaaataaataaataaaaacctttaatcacgaaagtaattttcagttgtcatcaatgagatgactcacagtctcacacggtcactggtcacgttgcttcaccactgtctccaagtaagatgtctaaaatcttgcaaagggccccaaagactcacactaaatgaaactagtgggctcaagcccacgtatgcacacgctctcttaacacgtcaaaattttaaaaattccacaacgagacgtcgacctttcacgcgcttcggcacgtggaaatccatggtcctttcctatgggttttgtcctaaaccatccttcggtccgaccaaaccgcgtaaggtaagaaagactccgaccgaacacggcaccttctcccacaatagtgtaaagtgatcgtgatcagaaacagatatttcgctaaagattagcccaatttaggaaagatgatgatgaagttagccaagagagagataacaaaaacatgtggctgtgtatgtaaaagaccgagtcacccgaacatctccaccttcacgccattctcctaccactcggacctaaccaaccaataccttccacgtcatgtacaatccgagttcccgtgagatagggatctttacttgaagcaaccagacatgaccgcagagtcacacacacacacacccctaagctttttgtcgtcccctcgtatggaatccattgtgggacgacacaaaaatatcttcttttgcttctctgctttcttcttcttcttcttaaaatttgtttctttcaggtggatttgatctccatctacgtaaaacaaaaacaaagtttataatctttttggattttgggattgatctaaagtgagatttcgatcttggcactaggttttgcaaggttacctaacaatttctggttctgatttcatttctttaggttacgtgtaagggaaggaattgttaatagggtttgtttgtgagcgtagggaaaagatg

SEQ ID NO: 2324 - DNA, 3000 bp, Unknown
  misc_feature (1)..( 3000): cDNA_ID_3067068_gDNA_ID_1620519_Annot_ID_159402 3000 nt of promoter + ATG
tgactgcaagtcaatttctttattaacattaattgcttcgcgcccagatgtgtcccttaatacattatttttccaggctgatggttctttttcgatcatgttcactctgccctttgtctggactggtgtgacattctcgttagctgcatgagttttagccatattcccaatcccatatggaggggtattgtattgattactaggagacggtccgggtgaagctgatagcctatttttcatagtaggggtagaagcccctggtctgaaagaaggctttggacctccgactggaactgtcacagtaccacaagtgaaaaactgtagcattagaaaaacagcaagggaatataaatagcatccaacagtatttgaaaccctaatgtgttaccacaggctcgttgcaaagtttgtttatatatacctggtggtggatcaactttccgcttcttaggtggaggttccttcttctgtttatttgacattctccatggacttcctgaaagtacatggtagatgttacaatattattggtatacccaaatataatcacatgctagataataaaaagttttgaacccaaaagataagaaaacctgccacatagtaaaattaagcgcatgggtttcagtttcaaacaagaatggctatctactctcatgttcttaaaccgccgcattgaaaagaaaaggagaaatgttaccttcagcatgagctaactgcttcgttactgatggattcccaggatctaaaacaatggccctgacaaaagcaaaagtataagggtatttcaggcacaaccactttgattagactaaagttatggacacaaaagtatgcaatttgttacacacagtgagaaattttctgtgagtctggctttcacgaaacagctcaaaatacctcaagttgaaaaaatatgagtaagctaaaagagaaacccatttaagccataactaactccaaatgtaagtagagactgacatccacagcagcttagctgcaataagatgaacaatgcgtataccgatagtttgttcacaactccaccaaaggttatatccttatatgctactgtgccaagacccataaaaagactaccctacctatagaagactgcaaaaccagaaaaactaagagagcagacacctttgcagctaaaggacaggctatgcagataaaaagttatagacattgagatgcaacaaaaatgtttggttagaacttgtacttgcgtgatttggttctctgttcagcttcaactgagcgcatcttcatatggcttgtggttgactcatctagagttcgtaggacgttcaattttcgccaagcacatccagcctcaatcagcaaaccatttccatcttcaccactttgatgttcttcatatatatcacataactcacctttctccccagaccaagtaaatttgaactcctttccaccaacattaattatctgtttatatcaagatccaaaacagcttcacggtgtcaaaattcaaaaaaaactaaataaaaacccaaaaggatacctgaaggaaaggcatagtaacaacaaaacccagatgcagtgggagacaaatgaccaaaagaaatgcagaagggcgttgataaattcaattgacaaccagtactaccggcaaaaccacagttatacaaagaaacaaagttaccagtagagtaaagagacaccaaagcagcaattcaatgagtaaaccaacataccatacaatacatgctcaaccaataagcaagtcaacgtctacaaagaattggccaaggaatttatgatacaatagtcacccaagtagcaacggaatcttcatcaacaattctatgcaacaaataatcttctccagggctataatttagaatggcgtaaaaggttttccacaggataggaacagctatagagatgccaaacactattgggttcttgtccaatatcacattaccatctaatttctataggaacaattgtccccaatttcacttatctagggtaccttgattccagtgaattgccaatatgttcgaggggtataaactaccaaaggaagcaaattcaagattcagccaacaaaaaagagcaactagcttgaagcaattcaactcaatctagagaaatcctctatctctagattttagaattcagtagaaactcacattctcagtgctattgttaggaaacgcatcgaacttgatcttggcagctccaccttgtgcctccacacgcttgatctcatccaccaaatcaggagataaccttataatcattccaaaagccgaagaactctccctcggaacaagattaaacgtttcctcaaccgtccgcgacgacaccgtagtcgacgcagccgccttaacgctagtagaattactccgctggcgtggagcggcggagccaccaccaccaccaccagaagacatcctcccgatgggagaaggatgtcggtttgtaggaggagggaatgaattacggttacgggaaggtccactgcccccaccaccacttcctcctctaccgccacgtttcgacgatcctttgaacataattccggtcaaaattactccgccgtcactgcaattgcgttaccaacatgtattgatgcatacgtgtattgtagagattgaactgattgagacgcgcgagcagagaagagagacgagagacgatgatttgaagaaagagagagagagagagggacccaaagagcgcttctgttcttcttcttcttcctcttctttttttttcctttaattttagatttatttttatgtcagcaaaacgctgccgtattgggttttaggtctgttgtctttctgaagcaagatggtgatcaaacccgacccgaatcaacccggatcgacccacccggttcggatactggcatatatagagacgaagaaagaagaagaaggcaagttttttttttttgatatagcttgccttggcttcaagaaagaaatcaatctcgtttctcttcagcatcaaacaatg

SEQ ID NO: 2325 - DNA, 3000 bp, Unknown
  misc_feature (1)..( 3000): cDNA_ID_3067076_gDNA_ID_1620519_Annot_ID_159396 3000 nt of promoter + ATG
tatcggtgtctctcgaggatggtgtcttctatggtcaagcgtattgggtcaggttggctttgtagtttttcaggctgcatcaacatactggctggcttttgccatcgggatccctaaaatcacgaatacaatgcttattggagtctatagcattatatcaactcttagtgctggttttgtatatgcgagagctattacgactgcccatcttggactaaaagcttccaaagccttcttctctggtttcacaaatgcagtcttcaaagccccgatgcttttctttgattctactccagttggccgcattctcacccgagtaagatctctttgcttataattatatggaatacactacagctcaatgtatgatatagttgaatgtaacatgtgcaggcttcgtctgatttgaacgtgttggactatgacgttccatttgccttcatatttgtggtagcaccggctgttgagctcactgcagctcttctcatcatgacgtatgtcacatggcaagtaattatcatagcccttcttgctttggcagccacgaaagttgttcaggtacatgattcgattctacttctgtttttagttgttttatgcagcaaataagtctgtattaacatccgcttcttctttgaaaaaaggattactatttagcctctgcaagggagctgattaggatcaatggaacaaccaaagctccagtgatgaattatgctgcagaaacctcacttggggtggtgacaattcgagcttttggaaccgcagagagattcttcaaaaactacttaaacctagttgatgcagatgccgtgctattctttctgtctaatgcagccatggagtgggtgattttgaggatagagactctgcagaatgtgactttgttcacttgtgcacttcttcttatccttattcccaagggctacatagctccaggtacatgaattattataactcatcatatcttcctgcagcctgcaattttaacttacctgttttcacagcttgtgtcagtatagcgtgagcatttccttgaaaaatttgatcaaactgaaaggttgtgcatgaacttgtgcctttgtgttgcaggcctcgttggactttcgctctcctatgcattaacactgacacaaactcaggtgtttctgacccgatggtattgtactttgtcgaattccatcatttcagtagagaggatcaaacaatatatgaacataccagaagaacctcctgcaattatagatgataaaagaccaccttcctcatggccttccaatggtacaattcatttgcaggagcttaaggtgagaagtaaacataacttgttataagatgatagtaatagttatgcaaaaggcattgatttgcatcatttctttgtttcagataagatatcgacccaatgctccgttggttctcaaaggaatctcttgcacattcagggaagggacaagagtaggagttgtcgggaggacgggaagcggaaaaagcacattgatcagcgcattgtttcgcttggtagaaccagcaagtggttgtatattgattgatgggattgacataagtaagattggccttaaagacctgagaatgaaactgagcatcattcctcaagaaccaactcttttccgtggctgcataaggacaaaccttgatcctttaggtgtttactccgacgatgaaatatggaaggtgaaataacaaacaaagactgagatttccaaatcaaaagatataaaatctttctgataaaaccattctttttgcaggctctagagaagtgtcagctcaagacaacgattagcaatcttcctaataaacttgattcttcaggtaaatggtaaaaaagctgtaatattttcatttcacaaaaaaatgggtttgatgacacttaggtttatgttttttcattggtgagaagtgagtgatgaaggagaaaactggagcgtgggacagagacaactgttctgtcttggaagagtactgttaaagagaaacaaaatattagtgttagatgaagctacagcttccattgattcagcaactgatgcaatcattcagagaattataagagaagagtttgcagactgtacagtgataacagttgcacatagagtaccaactgtcatagacagtgacatggtcatggttctctcttttggtaaacaacattttctctcattctttcatctcttaaacctactcataatgaccaatgaatgagtttcggttttggttttggataggtgatttagtagagtacaacgagccttcgaagctaatggagactgattcttacttctctaagcttgttgctgagtattgggctagttgcagaggaaactcttctcagaatctccaattataagccagctgctactgaaactgaagtgtcagtgattgttaatcacgttcttcatctaccattgtagttttgagaaaaagatgtaaaataaaaattcaagcatggataatgatagtagagtagctcaccaacccctacatgaactttgagacagcgattacgaccaatactcaatcattgctagaaagacaaaactacccctacataaaaaaacatattacaataataacatttcaccaaccacaaattcttttatatggaaacactgatcatcatgctctgtttcaggctcaaacgttactttccaaaacaatcttttcagttttagataaaaatttgatattaacttctgattcatgacgacacaagatgtgatagtcaatgatcagaatgatcagaaacagtgtagtaatgacgtcattttccgatcgagattgcctgatatatacatccctaaccacctcccactccacgactacatcttcgaaaatatctcagagttcgccgctaagccatgcttgatcaacggtcccaccggcgaagtatacacctacgccgatgtccacgtaacatctcggaaactcgccgccggtcttcataacctcggcgtgaagcaacacgacgttgtaatg

SEQ ID NO: 2326 - DNA, 3000 bp, Unknown
  misc_feature (1)..( 3000): cDNA_ID_2153439_gDNA_ID_1620519_Annot_ID_159389 3000 nt of promoter + ATG
tactacaccagttgtatggcaatttttcttctcaagtatgtcgattctaaggtctactgctatgaaacggccaccggatttacggctatgagtcctcaaccgctcaaccattgattcagccactgcattcacttcaggttgcaactccaaagacccaaacattgctaaacaggctacaggatcagtttcgccatcttgtgaggattttctcaagtttacagaagggaagtatgatgcaactcgaatgtttcctttagatttaaagatgggatcaatgtgctctttaatgtaatcttctgtaactctggtagggaccttcacaatggccatgttccttagagaaacttcttcaggcaattttttcacaactttaacgacattttccaagcttttaatcagcttatccgcatcatagatatcttcaaaattcctagataaagcagttaaaattagtttagaaatctaagaaacaaattagtaaaccaaaaatgaacatacaaaaaacaaccctaacctttcatcaccaggtttgcttcctcttatatcaggaagtactagagttgctccaagatgcttagccaccattacagcatcagtgatctaaaccaagattagcagaattaaccacacaaacaagaagaagaagaagataacaacacatctaaagaacaccactttagagttgttataaagcatacctgagagatatggtactcaggaccattggtaagtgagaatgtaacataccctttcgatgatacagcgtcatctgcaacaatcaagtccttagtaaaaaagtccaaaataaatgatgcaaagaaaataagaaagacacataccagatagtaatgttggccaacaaggagtaagatcagtgttatcttccatccaaagtcctttactgccttcaacggttccgacaagaccatctttcacagagactttagatccttcaaattcaatatcttgtgcatctccctgagctttctcctgtacaaaaatacccaaaatgacaaagatttagagtaagattttgagttttggctacagaagtttcactattagtttacaccaaacgagatgaaatcaatcatgtcctaaagatccgcagaaaaaaacagttgagtctaatttgggtttcttatgatcaatgtccaatccaacttatgatccaaaaatggaaggtcttgttttgatcaagtaaatttcacagaacaactaaattttctaactttgaattagatctaacttcaaaaggcatctaagataagaatcaacacagaacctatctgaactaagctgaaatgagtatcacattaagagtgaaaaaagtgtcggcaaagaagattacctgaagagaatcaaagtaatctctatgaagcatctgtccaagcatcacaaacatggtaatggtgagaataccagcaactacttgcctcaaatcaacacccatttcttacctttctctctaacaaaaaaaaacagaggtttctgagttaaaatagactaagggaagaagaaagaaaaagagagtccaacaaagagaggtgtttgtggggcagatagagacaagctatcttcctcaaatacgaaatctcagttctctttcaattaatgttttgtcaaaaaagctctttttttttttgttttaagggagtgttattgtcagtgtgttgattgttgaagttgaagtcttacgctatcttacacacaaaacagccaccgacacttctgtcatggattttggtataaacactaaccggtggctggtttcactaaaccggtcaaactaatacaacattctaaattatttttggtaatctttacagttacattacattttagagtttaacagtttatactttagttctttatactatgtaaagaattattagaccttacactccaaccaaatgaactatagttccaaactaagaattcatgagagtcaaaatttttgttttaaactagactaattgtaaaattcaataaattaagctgttaaataatttatataacttcgaactcacaaattgttgagctcgttcaattggtttttacatttgttagtgttacattagcaactataaaaatattattttaaacttcaaaatgtggttgatgaaaaaagaaaaagaactttaaatcacggactcatcactaaccgtatcaaaaagaggagttggtaatgacacaatacataaactaaaatcccctttatatataataaaaatagttatttaacaaacaaattataagcaaatgataaagcactggattacagataggttttgaaacacattttaaacatatcataatgttagacatgagactaatttagtaattatactaccccaaaagcaattgtaatgatgcataattgcatatagtttttgttagagagcccacgtacgagttcaactttttgctaatcacacattgtttactaatcatttaattatcaatgtaccgaatcattagtagtacattagtcatatcccagaaaattggtggaacatgaggaaaaacacacatgctgatcaatgattataatccatgcatgagtcgacctgtttttttttttttttcgtgtcttctaagtttgtgaggggatcacaatgagcacttgattgattgttgaatggtagcgtaacgctgtgtgcaattactacaccacttcataactttttgatgtaaatctcttcttcttctttttttacccaatgcaggcgtcaatatatctatctacgcaatcatatactatcgttgtatatgattttggaaacacatataagcaacaaataaataatgaacgaaatcctattttcaagctaaaatagtctcggagacccattaaaccggggaaattttgaataaccggggaaattttgaatttgtttcggttaacatcgataccgtaccgatcctccggtttgttctttcggaaggtttatcttgttttcgtcaaacacagcgatcctctctatcagagcaaccaaa

SEQ ID NO: 2327 - DNA, 3000 bp, Unknown
  misc_feature (1)..( 3000): cDNA_ID_2153443_gDNA_ID_1620519_Annot_ID_159390 3000 nt of promoter + ATG
ctaaaaattacaatctcgaacttcattctaattagcttacatgctatactctctggtggttgtgttgtggaacaatagttgttgcctaatttaaatgcattgtctactgctctgaatttgctaaagtttctgattgtttgataaattttgtacctagtttgatgaatatctagcctaggtttggtgatctgatatatgtctcatgttgttttcaaatttttttcaattgcagaatattaaggataatccaccttgcaataccctatttattggtaatcttggggagaatataaacgaagaagaattgaggagcctgttgagtgcgtgagtatctgttccctttagtgagactcctgtccattgctttccttgagatcttggcctttttgtagacctgtgttctcaagaattctgcggtaaactgtactttcattttgcaggcaacctggtttcaaacaaatgaagattctgagacaagaaaggcatacagtttgctttattgaattcgaggttaactctgagaccttcaccatctgtgtatatgtgacagaaaatattcttctagcatattgttaaattcttctatctggacttgcaggatgtcaatagtgccacaaatgttcaccataatttgcaaggtgctgtcattccaagttctggttcaattggcatgaggatccaatatccttatatacttttactctttctgattatttaatattccagtatgccaagttcttttttcttttctgtttgattcttcttaacccaatgatacatattcaaagaatccatatgggaagagaaaggaaggtggcggctattctttctttccttctccgagtgctaatggagcccaaggagccctgacatatcagtaggccttgaagggggacgtactctcttccttatctcccaacaactgcacgaatacgatgcatcttccaggcagtctgcatttcatccatttccattctcgacatttttaagcatcagcattgctttgtcatgtgttgggtgcatatagtgtgacctcatcaacatataacatgtttcagtttctattagctctgctacatgcattcgcagtgtggtttttgatgattgtttgaattatataggagtttggtttgctatttgtttatcttattgcggctttaatacatcactttgtgggattcattttcatcattctgatcgattcatcctaatgaaacgttagctaggaaaaaacataacattacattagatcataacatgataacatccggaggccttccatcaacttcgtttcactgcatggacacggaatgttgctctcatgattgattcatcctaacgaaactccatttgctatgttagctgatataccattacattagatcataacatgataacatccagaggggtttgatcaacttcgtttcactgcatagacatggaatattactctcatgatctatcacatcggtttcattcttcagcatttcccatgtcgatcattctctgttcttacttaggctgatgaacaagcacatccgttttgtcagaagttgacagctgatataacatttgaagataggcattccattacattgtaggtttattatagttgagcaaacatatatacattcccagctctggcttggccttatgcagggacaatccgtaaagagaaagcccaagctctcgaatagagatgcgtttcacctacaaagttgaggtaaggtcatcttcggacgtccaggaacagagccaggagttcctaagagcctatctttttacaatggagtctacttatccaatccaacttatctcttttctaactgatgtttctgtacggctttgggctacttgactctggatgtgaaaaccagaagcgaatttagtgattcttcaaatgagaaagtttctcttccattttcaagaacaatgtgtgtataattggtcgcttacttatcagattttgaggtataggatctctagggcctagtttcatgttttgtttctctgaattcgaaccatggtaaatttgctgtaaagagaggtaggtaatataattaacccaagagacaacccaagaagaatcgataaaggagtgtctcaactctcaagtaagaaacatgttttcattattatgattggcgagtctcaagctttcatcactgtagacaacaaagaaaaagatttgttgcacaaaagggtttgtgcattccttagaccaactttccagagaagcaaaacatctaaaaccacaaaaccatggtcttaaaagaaaattcttaaacgtcaggtgtgtctgagcgcagaactgtcaagaaaaacaagataaagagttgggaggttaataaaaagaagaaaaaaaatataaaacggaactgagaggtaaaagattgaaacccctcttcaagttgttcaagtaaagatcatcaagcaaaaggtagagatgtcgatcaaattggtggaacaaacgcacggagagggaggagaatcgtgagtaacgtgcctggtttctgaggctttccatcggaccattttggagagggagaagtgaaccttgtcgcgattgattgtttcagctttgaatggttctttgagacggatatacgccgtccccatactcgttctcagcccattttaggcctttctgaattaggcccaaatacgtttacgtgtttttagaggaaaactttcaacgtgcatgtcaaagacaaattgtttgtttattttctcatcaagcaagacagagactactattttgctttttttaaaagaaaacgatgtagcattttccttgtcgagaagctaaggaaacctgacaaaaatgcaagggataacaaacgcattaaccaaagtataattttttacaagcaaagaaacatttgcacaaaacccataaatataaacctcattatcccataattagcaatgctgcataacacataatttaaaaaccctaagaaaaaaatcggaagtttgtggaagcaagaagaagaaatg

SEQ ID NO: 2328 - DNA, 3000 bp, Unknown
  misc_feature (1)..( 3000): cDNA_ID_2153530_gDNA_ID_1620520_Annot_ID_159425 3000 nt of promoter + ATG
tttatttgtatgttcgaagaaaatgtcattaaatgtaaaaaaatagtctcaaacgacggcaaaaagtctctctccattgagtatcctctacggttcttgaattggtttggatacatatttcgtgtatgaaaactgaggcgtatcaaggctatggagaatttaaatcataagtgggatcgttgttcctcttctcatcaaactcctctttctttcaaaggcaatcagaagcaggtttgttgattaattttcgagattctttgttatagcgtagagaaaatgtcaatctttgacattttaatatgttgctatactttggatctttttttacttgctgtgtacacttgaattctcaaattctttgtagattggacaaggtcagagagaagtgttcacacattttgtgtcacttccattagccatataccctgacttgacgaaaaatatcgaggcttttcagaattctgtattgggaaacaatgataaggatccattgaagtttcagagtactttagctggtaagatcacaaaccaaataaagaaatgttttaagtgtagaacatgtttctatgacatgtttttggatattggacagaaatgggaatagaaaaatcgatctttgtaactcccaaaactttccatttgactgtggttatgttaaagttagagaacaatgaatctgtggttaaagctcagaatatccttcaggtataagtgattcctattctaagagacatagtgtacttgttcttcttcttaggattgctttgatgattgaggtgttgtctttttctgaaaagcagagtattttttctaatgtgaggcaagctttgaaaaacagacctgtcttcataagactcagaggattggtaattgctacaatttctagtggcttgaaacataatctttgaatcaatcccaatggttttttgtcttgttaaggaatgtatgagtggatctttagacaaaactcgcgttctctatgctcctgttgaagaagttggtcgtgagggccgcctgctaaatgcttgtcgtatcctaatttctctaagcgcttatttttacttgtgtgaagacatgacttcaaattactatgcaagtgcttctgaactctttaactctctagtttagatgttatcattgatgcatttgagaatgttggatttgctggtaaagatgcaaagtcacgcttgaaggtaatgcttgtcacttttctgttgtttacgtctttgactaggacaaagaaaaagatggatataacaatgtttcagcttctccttcatgcttgttccttatttgcagctacacgccacgttgatgaatgcaagctacagaaaagataaaagcaaaaagatggatacttttgatgctcgagagatacacaaagagtttgagaacaaggattggggaacatatctaatcagagaagctcacatctcacaacgttataagtatgaccccaatggctacttccattgctgcgcttcactaccttttccacataagtgacattgacaacgatcaaatctcctccacatgatttgcattaggaaaattaatgtcaaaacttaggtaagtatggtatgtcactgtgtaactgtttttatatgtgtgtgtcacagcgattggtaactatgtgttgtgtaacttttgtttgtaagttaagttttggacagtaatattcttccttccgatgattggattagaaaattcgtgaaaagtgtttgattttgtattatttctgtttatatcgcatgttacttcttttggtaattttgtagaattgatggtgtattagggtttacgagtagatgttttctagaaacaaaagtatttctcctaatgtgaggcaagctttgaataaccaacccatcttcataagacgcatccttgagttatacatatttagtggcttgaatcatctttgactttgattatctatccaacttttaattcctaaaacatagagattcataataaatctgtaactttaattcgtctctttaccaattgaatgccaaatctagatagatcaaaaagcgaaccagctctttctagacgaataagctctttaaactctgtcgtatgtgttgtttcataggacctttcatctttttcttcttctcataattagttaccagtggcaaaaagggaaaagtctaaaaggaactctagagtgaatttagtatgcaattaaataaatcatttactagataagggtttgattacaaaccttaggataaatatttgattgtatctcaaagtataagaaatgtgtcaagcagattctgtgttttttttgtttcgattaaaaccgctaaaaccttgacaaggttgtctccacaaacaatattcatatcaatctcaaagaatgcaacatgcaaaatgttgtgcatattgtttgtggaggaccaccatcgtaagaggatttatgtaacataacttaaaagaaagtggctatatataactttttttgaaacctttttctacaaacaccttggatgttctttaaataagatgaaaaggctattattctaatgaacaacatgaagccaaaagaaaatccaaggcgtttgcagaaagaggttataaaaggctccgaaatatttcatccgaaccataaacttgttaacacacctaaagaacaatgatgcagtaatgggaatgaatacacacgtccatttgactgctgtgatggaaaggattttataaggtgagaaatttttagggttttgattttgaataacttaattagttttctaaaaattgaactaaaaaatcaaaacaaaatccgaaaggaggggaagtaaatatttctttcgaaatttgtggagatctatatttcccttttcaatactttgatctcgcttttttttttttgaaagtatacggtcaaatatataattttctaaacgtaatggggtttagcagcaaatagtcgtaaatactggcggaagaaaatgatattttacggctgaatcatcaccggagaatgagaggaag

SEQ ID NO: 2329 - DNA, 3000 bp, Unknown
  misc_feature (1)..( 3000): cDNA_ID_1830234_gDNA_ID_1620520_Annot_ID_159439 3000 nt of promoter + ATG
tctagtgattgttaaaaatcgttatttacttacttatttaaatgtcacatagagagaaaagagatttgcatacttgtaataatataatcgtgcttgtataagaaaaaaaaaactttatgagacaagaaaaaaaaactcgggtgtacgtacgtcgtaagtaaaagggccaatgcaagcaagctgtttggctctttccttaaagcaaaataaaagaaaaagttatctttttctccttttatttcaacttttttctttaattttcttttccattttttatgcttaatttttcaactccgagatatgaaactctctactttgtgtttagtttgaactcttttagtcataaaacaacaaactctgccgcaatcaacaaaaagcgaaggagtcaaataaaaacttctttttacgagtgaaagtgactattttacttcaatctcttttgattttcaaaactaagaaaaaaaagaatggaaatcaaagttgtgcatgttcttcccttagtcgatatgtaaaagtgatttgatagacattattgtatgtaaaagtaatacaactctgaaaaattttaagaaaaattgctagtatcagctaatccaacaattagttatatgttttggagaatgtgtaacatgaccgattataaagctaacatcactttatttattgaatttataagtaatgcaattatttaaataggtcttctcgaagaacatctagatggtatacgcttttgtgaggtgagctcccttttatgtttgatttaatagaagaaatgtaatgtgtaatgacttgcttcaaatgatttgtatgttcctattggataagggcatcttgattttatttttattttttgtatctataatgtgcagtaaactttttacttttcattttagtatgatagctggagtttggttgtttcaaagataggcaagtattgtgtttaacaactaaaaataaaacaacacatatttttcaatagaattatttacaaattataaatctaaacacagggaaaatgttagatacaaaaacaaaaaaagtatcaaagacaagcagtgtatcagacatatataatatcatattttcaattcattagaaatacaacttgccatatcgcaaattagtccataatcaccaaggtagggaacgattgtctatcgataagttatgattgaaagaaaaggatttcatgaagaaaaaaaaacttaatttttcttccagaatcgtgacttagaatttttgttaacaccgacgaatttagataacaaaagctactccctcattgactaagccaagaaagttgagtagttgactaacaatgggactaatattttagcaaaatcaatacaattttggtaattattttggttcatgaaaatgttcaatttttttggtctgaattgtggaattcacgatttatttagcctttttgcggtatatataaaattaagatatttttatgtaacactttgttttataaaggataagcttgtatagtttatatataacggctagtcatgctcaaagcctttatcatctgtgggcttcacaatcttatttcttcgacccatttgcttcaagcctcaaaccaaaacttggctgagttcttcgaaagctcattatttcttatatagtaattcttttacatagtgttggaaaatgaagtaaaagaatatcgaaacttgaacgcttagatgacgaatctgtgacattatgatttcaagtatcgacgtgttttatcaaagtgaaaagttgttaatgttggtgttgggtccgtgaaagctcgaagccatggagattaatttcaaacacttttgacctttgagccttgcaagtttggtttatttgttcaacgccagacacgtttgcacagatatgagttggtgagtgcaaatcccatcataccaactaatataaagttataccatcaatgatattctatcgtgaaaaaatatgtaaagtctaatatcattaagtatcatttattaaaagaatgaattgaagggaaaaaaaaaaaaaaagataggcaatccactagtgttcataatgaaagatgatggtcgatgtaatatgtatactaatattatatctctagctttgatcctcaatagtcaatatctatagtgtttatagtgttttaacagcttttgtataatgttaactgtgcaaaatacatgacataaaataaatgattttttttggcttttatgttataagtactattagttggttatctgttttaaaggtttttccttgaattagaggatcagatttacatgcccataacagaaccaagctggtcaccaaatccatcttatgtagtggcataacagaaccaatcttggtcaccgaatacagtagtttcacctttctctttctccaaatataataaaaaacttttttattttgtgcaaaataaactttagtgagatatattgagcaaatatgtatatatatataaagatttcttgagacgatatctctttgcctctttgggtcattgttaattccatgtatcgatttttagggttgaagagacttgtttgtaactttgaccaattgtctactctttttagaccacaatgttagtaagtatgtaggtaggacttgtttcgaatgtgatgatttatttaggcccagacaaattatttactagacccattgttgttctattatttactgtttgaaagaagttgtttttgtcgttgattgtttactagtatttcaaagaaaagggtatgcatagtttaaacttcaaggaaatcccttatatatagtaaaattaaaagaaattccacaattagatttcgtaatacaattttctataacaaaacctagttaattagtccacatgtcctagctcttacccactcagcccgcatattcctcacgctttctttttattttccgaaattttttaaacggctaccaaatcaaaatgcataaataaacaaacccttctcttctttaccaattcccaaatccaccaaaaaaaaaaaa

SEQ ID NO: 2330 - DNA, 3000 bp, Unknown
  misc_feature (1)..( 3000): cDNA_ID_3079737_gDNA_ID_1620520_Annot_ID_159442 3000 nt of promoter + ATG
tactatacattcaaacttatatatcaacacacatatatgatcatttgataacacctaccatttgtgttatacatatattttatagagaagttatagaaaattatactgagtatacatctatgtgtcatcgaaataagctgataataacgaatacacgttttctttttatgtctggagtagaatacagcattcatgcccttacgttgcaggttcccatcattttacaaatattctcttctcttttctactttctcttttttgatgtaatacgatctatttatttattctatatttcactatatatatctcagatgtccaacgtttcagtattgcattgccactcgaattacctaagataaaaacgaattatcactttgatttttcgcacttatagttaaatctattctcaaaatttaaacaaacatgcagaggcaagtggcactcatcaagcagtccctctttgatcaggttttggtcgtttgtttcttcgtattttcgtaatataacttcgtacgtcgtaccacttatatatgaatttcttcatataatttagaaaatgactaatataggaaaatgcatgcagggatatctcgacgaacaattcatggagttagaagagctccaagatgatgcaaaccctaattttgttgaagaagtttccgcattatacttcaaagattcagctcggttaatcaataacattgaccaagctttgtgagtattattttgttttctattatatatatattttttttttttcagttttctaatcatttttacaatgcagggaaagaggatcatttgatttcaatcggctggatagttacatgcatcagtttaagggaagcagcacgaggtaatttccccccttagtttttgactattctaattacgccttcaagaaataattttacttaaagaaatgcgaatacttaaatgtttataagataaaagaatgtaacgcaaaagtacattaaaattacttccattctcattcaggattcaatgacagaatctactttaaccagaaataattagattttatgatcgttagttatactgacaaatgttgcatttcttttttttgtagcattggggcaagtaaagtgaaagctgaatgcactacgtttagggaatactgcagagctggaaatgcggaagggtactttcgtctttatacttatataccttcatgcttctcgtttttaacagaaaactaagtaacggggtcaaaatgaaaataagtatagtttagatggctaaaattgctgcaattaatccgctgaaccttgaacttttactttacttcattttcgaccccctaattagttttcttcgctttttcttacttgcagatgcttgaggactttccagcaactgaagaaagaacactcaacgttgagaaagaagcttgaacattatttccaggcgagccaataatcaattatgcttaataatttacataattagaatgtgattagaagttatcatcaatcacttttgatatagtatttgctgaagtgaaattttttgtaatgaacagttggcaaggcaggcggggcctaaggagacagcacgtaggcccaagtaagagagaaagagagagagacagagataaatgaggaatcgtcgtcgaattttgtagcaaaactatataataaatagttcctctttatttttatatatttcgatgtacgttataaagaaggttttggacttttatattatgtccgttaataaacggtccaaatgtctctatgtttttccccttatatcgccaaattttcccttgggagttttatagctacgattacctcgtaacatatggcttcctctaataacggaatacagaaaagagtggaccaaaaaaatgcattttttcgattctatgatgaatgcattaccttgtttacaaaaggaaaaaaaaaagaaactaagctttacattattcggtttgtttccaggaaccgtgtccaaatcctaaatattcttacctatttttatatcattatgttaatatttgtctctactagtactgattaataaatatttaaaaaagaaaaaaaaaaccaaaatattcttaggtaaaagtctaaaataacattatcattatgttactatttgtctctactaaaactaattattaaaaaaaaaagaatgccatggcttagatgcaaactattcttagctaaaagtctaaaataataacattatcataaacaattaatattacacttttccatctaatttctcttacatgccctatttttcaaacgatgtcgtttaagaatatcacatagaccttctatttcatgaaaaaactaactcaccaatgcaaataaataaatcaaatgtttgtttgtggataaagtaaaacgttttctttcaatggcccagcatttactaaaatttatttcaagttcttccacgtaaagtctacactacatacactcatacaggcagtgtaacgctgattcgtagagctggagagtatcacaacaataaatttctcttccgaaagaaaacagcctaatattagggagatatttacatactctataagatgttctttaatctcttatatatattacatatgaaagaattaattgtttaattattatccaaagcgacgtgaaaccactctcatttattagccctagctatatctcacaacctccatcttccttactttaaaaacacagaccagatcctatttatagcatccatgtgcgccattgaaaggtaaatttatttaataaagtttacctataatatcaaattatgcaaaacacaggctggttcagttttttccacgaatcaaaaatggttggagaaatattgaataagagagagagagagagagagagagatagagtttcagagttgacacaacattgaagtaaactaaactcctaacctctttatctatgtgtatatataaaactcaaaagtacatataatcttcaccattcacacatagtcacataccaaagcaaaaac

SEQ ID NO: 2331 - DNA, 1433 bp, Unknown
  misc_feature (1)..( 1433): cDNA_ID_1830246_gDNA_ID_1620520_Annot_ID_159443 3000 nt of promoter + ATG
ctatgttagggaaatttcatggtatttattgacctggggaagatatggatgatggtcgatagggaagacttttagtttacatgatatggcaactcgtttttttcttctctttcttatttcttttatgagaagaaagattctcactatacgtaataaagatctgtatcttggccacgttcttcaaataagtataatctccccttgcatttttggcttaatggattggtagtgttgccctcaattctcaaaagggaaaccactttaagaattaatagttgtatcatgtgtggttgattaattgattgaagtaagatcatgtatatttaactatactaactaattctaaagctgatggaacgtgttcacgcacattctatttcatatagaaacaacgtttattcggtttaattcatttgaacctatccagtaacataagctgtcgaccaaaaacaaattaaataaatgaatatagtgggacgtaaacaaaggaaacgtaaacaaggggaattcttaccctttagaattttttttacagaatacaatttataaatatttggttgacagttaagttttccggacaagaatacaataattttgagcaggaaaataaaatataacttttcttttttaactcgtcgaaaagattattattatagaaaaattgtaaaataagttgtcaaatcttcgattgtttcaaattaaagacatgaaaatttcgttagggtgaattagtaggtaaggtaatctgattttgaacataatttaaataaatgactataatggcaagtaaacaagagaaattcatttaaaatatactactttgttatttgtcaaaagaatatgctactttaagattctcatacatcatatgaacaaattagattaaaatataatttctagaatacacaatgggaaaatatattaaacaaatcaatagtgtgtgagttggcattgacatggtaaatgcaaaatcaaaatacagcataacctatgcaattacatgatgggccttataaaaactacatactaaacaaacccaaaaatagaatactagccttattaatctaaaactcaaataagcccaaaattatttggaatgggctcacttccatatttggataaatttaaaatttcgggtatgagcaaattaacgcgagtttaaccactaagccatactcgcggcgcgtggagttccgtacgaaatatcgtaccgccgtctctgtgcgcgctatgattacggttataacagaacgatacatacatctatatatacacactccaagacaaaataagacctctctgctttctctcgtcttctccatttactcttttttctctgcagagtttttcggaaaaagaaattgttctttctcattgattctacatttctacagaacgagagagagataaggatttgtgagagaacaacaatg

SEQ ID NO: 2332 - DNA, 3000 bp, Unknown
  misc_feature (1)..( 3000): cDNA_ID_2153571_gDNA_ID_1620520_Annot_ID_159441 3000 nt of promoter + ATG
aactcgggtctatatttttattttacttttatgattatgattagtcgttatcggccgatttatttgttatttaacaatttgtttaggattatagctttttcggattgggaggaatcatgttcataatatcgcggaggtgtaattattcacgaaagtgatagaggataaaaataaatttgtttagcatatactttatttaacgggtgatagatgattgaagttacatctttcaaataattggatattattgaatttatattaatagttgagaagaatgtttttaattgagtaatcaacacaattaaaagaattaaaaatctgtttgtgtgtcgacatttgaacttttaaggagtcatcttcaatcacgaaccagtcaacattgtgccctttatacgaaatacttagttcaattaggtgctaatagctacttctaataactttagtagcacaaattctggcatcatgtatatccaacaaaaaatctcaagataactttccgaagaatatctatcatttaaaaataaactttctctaaacatgtattaatcttccaatcataggaattaatagtggaacaagctagccttctaaagtattacaagactgattttgtcttgaatatgaatataagttatattacaaactagcctatagtctagcaatttcctaataatatatgaaaactaaatctctacatattttctcccttcgaattaattagtcatttgtaccagaggcagagatgatagttacgagttcataataattaagagttaagactatatatagccttaaagcttagaaatatacaaaagatcataagaacaaaaaataattttcttttataaaattaagatcacatatatatataaaggaataattggattgtgtaacacatatacaacaaaatttagataaatgtcatgaattttgtcctcttttattagaattttatcttgtataatactaaaaggtaaacataataacatttgatttaaatacaaaattggggtttatcatgtaaaaccaacctcacaagttttggaatgaattgttttgtttcttctaattttgtggtattacatatttgttattagaggggaggtcggaattaaggagaataatcgagatgagacagcaagcaataataaaacttagattctaaacccacttccaccgaaaatatgtagtagacaagtcctttatgtgagattggtttggtgggcggaggaataaataaagctgatttttttttgtatatgatcaatctctctctcttctgtaattcgatctcacgatgcttgtctgagagagaaagagatatagaaaggaacaaattatgctgtaatgataaaaagatcttttatgtctttgtgtcaatcatttagatcacacttgttatgtgctcttcagtttttcctttttagatacttgttccttgtttccaataacagaaatttatggtttattttttactcgttggatatatgtataccttattctctctctctctctttttggtttcctacttctttctttttttgttacaatatagaagtaggaaacacacgcatccgcacaagtactagcctttccttggcacacaacaccctctcacctccacacattaatggaagaaacttggaaaagatttgcatctaatttttcaatgtttgttgcagcggtcaaagagaaagaaaacacatcaaacagaaaaccccaatagaaatctatttatttctggtcttgatcatgatactaaccttgactatgtttttaatataaaaatgtcgtttaatgtttatcacaagatataatccttacttagtaattgaattccggaccccaaactaaaatacttcgaattagtattgctttctgttgttgaaacaaaagataagcaataatagtgtttgctagtgtgctagattccaacaattttttcttccaaaagtacaacttttttttgcccatttcgtaaattcatatgtacatatatagttgaatgttgtgggtgtacgtaattggtaccattaaaatcaggaaatcacaaccttaaaaataacaaaaaaaaaaagaaaaaagaaaagacaatgatattatagaaaactttgtgaaaacatgaattaaattcagtaattaatcaagacggaaatggtctgttcagaatatttttcttgaactgtatactttttcaatctataactttctttttcactttcaggaaaattcgtgtccacatacattttactagtatatatttgcctcatttccaaaggtgtgtttcgtatagtatcaacgtttagcttttaggttctatattcgaaattttacatgtttctatgatgtacgtatatatataatattagtcgtattcccattcgtgagatcctttgattacttattaattaagatgcatttcagttatatttttgggcaatagatcaatcatccacagtagtttaagtttcataatggaccatactattaattaaacaatcaacattgaggaattctctaattgaaatctcttattcaaaactttaacataaacactatcttatatatataaaagattactatacattcaaacttatatatcaacacacatatatgatcatttgataacacctaccatttgtgttatacatatattttatagagaagttatagaaaattatactgagtatacatctatgtgtcatcgaaataagctgataataacgaatacacgttttctttttatgtctggagtagaatacagcattcatgcccttacgttgcaggttcccatcattttacaaatattctcttctcttttctactttctcttttttgatgtaatacgatctatttatttattctatatttcactatatatatctcagatgtccaacgtttcagtattgcattgccactcgaattacctaagataaaaacgaattatcactttgatttttcgcacttatagttaaatctattctcaaaatttaaacaaac

SEQ ID NO: 2333 - DNA, 3000 bp, Unknown
  misc_feature (1)..( 3000): cDNA_ID_3067113_gDNA_ID_1620520_Annot_ID_159436 3000 nt of promoter + ATG
aaacttcaaactatgtgtaaagaagaatcattcgggaaatgccattgaagtagcttttaaacaccgaacatcaagtcaaagaactttgagaccattgactttgacggagaggccatagcgccaccacttggttgaggagagaaagcgctgccgttttgcaagtactgaggacgagacaggggtcgagcagtgtttctagtggatgatggtggaggtaaaggcatgaatccttggttgttgagtctctcgtttaacgcttgcttctgtattgggtctactggcttcactcctactattacaactccgtttatcatcatccctgctttgttcagcgccttatgtgcatcagaccggttctgtatcaaatacacagaccattgtcagttcgttgtttcctttatataaaagatttgattagactatcatgtatgatgactcgtctagaagaactatgaatgcttatcaacatgcatcaaacaggtttgaagggaagaacagtaacctggtagaggatgtgcatccagttggcatttcttggaccaggaacatgtttcaagaccataccacatttttcaaactcccgtagtactaaatttgtatcacctggagaaaatctgaaggcagttattatgatcagttcttaagattgaaaagatgggagataaacacaagataaggcacttaataacactaccagttattatccatgtaaagagtcagaattcacaatgatcaaaacataaaatcacaatcaaaggctgatatttgagcatcatgatggtaaagaacagcatttattatgaacagttctctaagattgaaacatgggagacagacacaagttaaggcacttaataacactacccagtaccaatataactgttatcatccatgtacctagaatttcagagacacgagaatgttgacaaatcaagaacatttgcaacagtaaagtgagaaaaacgagagcaataaagcttaaatggccttacccatagacagtgacccactcttcctcatcaaggtttcctgtaggtataatctgcctctgaacctctggcctagcaacttctcttggcggcggaagagtgaccaatgcacctggctgaaccaccccttctacaggagatcccttccctttatcatcctgctcggtactactacctgcctttgactgcgaccaccaactcggactccctgaaacttgctgactctgttgtgcattcagtagagaaaaagaagggcttgcttccaactttcctttaccaggagttacaatattctttccagaactctggaatggtgttcttctgtcagacttagcatctggagacgcagagtagtctgcaataccagactcaggagagaaatcggaccggtcatccaaagtatacattggaggtggtggaagatcagatcctccgaaattctcacgccatagtgcagataccgcagctgcctgtcccggactcgagaatttccctctacgtgctgaaacaggagaagctaaatcttgaaatagcagagattgcctccctgatttaggagtcctgtgtgctgcagcactcattttctactcaatagagttttatttatctccctgcaaagacaaaaaatcatatagctttgagcaaaattacataagaaagctaaaaaaacaaaaacaaatcaattttgcgactttaattcacttgggcaagatcaatattgaatcttgcgattgaaatcactaatctaagcttagctacgggtttctagaggattaatcgaaagaaaattgaggaaaaagttcaacaaaatcgcaagttactgggttttaaacgagaaggtagtaagattgacgccaatcatcgaagacagtacacaaataggagtaatcacactatctaatggatcgatggagagggagagagagagagcaaaccttgaggatgaaaatggaggtgtttgaatttcagctttaggaatcccggagaagctcaggtagagagctcaagggcgcggagggaaggtaagtgaaaccctagaaaccaagattctgaaaacgcaaaattcaagcgccttacgaaaaatgacgaaagtagccttgcatttgtacaatgggtttgaattgggcctatttggaaagttgttggcccagaaggtttcttcaacatataaaggaataaccatcaaaattctcaatccaacatggtgtaaaattaaatggttgtaacttgtaagctaatttgtgttattatttttttggtcaacaatacataaatatctagcatatacttaccaattagtatccttaaaatgtgagaattctattagcattaatgcaatatctctcatcttatccttaacttaatttaaagagattttgagtatgttttcacaaatacttttctaaaataagaagaaatactcaagttagaatacgtcatcgttttaatacaaaagatcgttttgaaaggtttaagagaaaattgccgcgtttttttatctaacggttatacaaaaagtcgtttagggtgtgaaaaaattatcgcgtttgttatttaacggtcacataaaagatcgttatgggaatattgaaaaaattgtcgcgtttgttacccaacgattttacaacaagcaattgcgtttaagatacattatagatgaatttccatagttataaattcaatgtttaagctatataatttcagttgcatatctaaatttggggcactctaatcttacttcatttgtgttctttgtctgaaacttgatttctattccagaacgcgattttttcttaaaacgccaaacgcggtccttgtcttgttgtctcgtccaccaaaaaaatctggggcactagtgtcacaaaaatcacacgctcgtcgcgtgagaaagttaggcttttgaaatactttagcggcgcgcgattacttaggcgacattacacacacagcctccgaggaacaacaacaacatcgattgtctcgtcaatttggtcatcatcatcatcagatg

SEQ ID NO: 2334 - DNA, 3000 bp, Unknown
  misc_feature (1)..( 3000): cDNA_ID_2153534_gDNA_ID_1620520_Annot_ID_159426 3000 nt of promoter + ATG
atttatgtacttggtcagcttatttctattcactcatctgtcatgttgcttatttgctatattcttaaggattgtatgagaggaccattagacaagactcgtgttctctatgctcctgttgaagaaattggtgatgaaggccggcttttacgtgcttgtcgtatcctagattttagtacgaatgttatttatagtagtggcatggttagaccgttaaattaagagtttagtgtaaatgctttcgattttcttaataccaagttcagaagttattactgatgcatttgtgaaagctgggcttgttctcgagaaagatgcaaagcaaagcttgaaggtaaaagctttctgagtatgacgagattgttgcagtcacttaacgttagccaaaggctcagaactaatggaattggaagtagtgaatcgtgcttctgtttcatactttttcctttctttgcagctgcatgtgaccgtgatgaatgcgaggcacaggaaaaggaggtgattgattcccaactccagacttatgtttagataaagaaaacaatgttacaaacctctgattatctgaaaacccttttggtctcagaaagaacaataagaagaagatggagacgtttgatgcaagagagatacacaaacagtttggaaacgaagactggggagaatatctgatccaagaagctcatctctcacagcgttttgtgttcgaccagaacggttattaccgttgctgtggttcaataccatttccaggagaacagagagcctgagaagaatcatctaaccagcggccacagtctcaaatctcaagcatcttcacaggttttggtcccgtggtatgagcacttacaactttgagaagagaacctgataaaattgtaaagttgtaccggtcatcttgtgttaaccaaatagttgtcttcggtttggttctttcttggtctttgttcaataaaccgagccaaaacgttcttgtactctttctacaaggtaataaaaaggttcttagtacatttaatagaaaaatgattatttacagctttattagaggctattgattgatttagtaatgaactaataatgcaagtcaacagatctaaaattggaaagattattggcaatggaggcaggacaacgaaaatcaagcatattaaactctttaagattcgtataattccaccggcctaaccaaatctctaagcaattgttgtttatgtattataatatagttcaccatctatttaagcttaaacgagtgtctaatacatagacgtatatgacaattaattaatgatccgatccaaacgacccttggcgtatttggtaaggtagcagtgatgtgcttaattattaaccaacgatgtactgagtttctagaattagtaagaaccataagagttttaaaaagtgtaaaacgtaaaacatcaacacatgtcattccagttaacatacatatatctatatatatgttaacgtgtttgcataatttttttaattagagaaaaacagcacactatgcaaaagatcgttcatatatctaacgtgtgatttaatcgatctaacaactttttattcccttttatattaccaaaatatttatttccattgatcatatatttgaagtagcaaaaattggtaaaattttagttaaaaatgagggagatgaaaactgatatattatgtaaatctcaagtttttgtaatgcataagaaaaatgttatcaccattgcaactatccatggtagcaaccgtatatctcagcatatgatacaaaaaaaaaacaagaagaagctcatattcaaatttcttacgttcaaacgaataacttgattgctaaacaacaaatctagatagcattggattcatcagtaagagttaaaatcgtacagcattgtgaatcataaaatgttgtacaagattgtgaaataacaaataatattgtaaatttatcaaaaaaaaaggggattgtggatcaatgaatatgatggagaatgttcatagaagaggtaaataatagagggacccaaaataacattgttgaaatggaatataatcataaatgagtcacatcttcaaaatctgatcaaatcacttggaaaaaaaaagatcaagtcacatgcaaccagtaaccacaatcatattttggccggtctatcaccatacacattgtttacagctcacacttgtccctccttatatttgttcgtatccatttgttttcttctctctctactctaatctcatctttatgtttatccctttttgaattttgaagctactctgtcctttgggtccaccctccaccacctctaatttcaatcacgttaaaccggccatattactttaaaccgaccgttttctactaataggaaaatccgacccaaatttttgactaattataagacataccgccgctataccatgatattgtcaaagaaaaagtttctaaccaataaccactatagactaaaagatttcaaataatttgattgatactgcattgaacattctacaattctacttatattgtgtagttcaaataatgagaacatatcggaaagactagccgctattagattatgaatgcgtatgaatacattatacattatagtatatatatatatatatacacatatattaaaatgtattactatataataatttgtcttagtatagtactcaaagaaatagagttttcttacgtagatgtcatatattttagtcattttaggcaccttcctaactcaaatcacgaatagaacttatgtagcaaaatgtaaacacatgaaatcatttattaattcgggtccaacgtaacccaccacaccacagaaactcattaaatagtatttttttataaaacttaagttatatgcatggatacatgaacgatactcctatataaagagaacagcattcaaaaggtcttatcatcttcttcactaaacaaaaaaaaacccttcaaaacatttccttattctttcttcttcatctacaaca

SEQ ID NO: 2335 - DNA, 3000 bp, Unknown
  misc_feature (1)..( 3000): cDNA_ID_2153536_gDNA_ID_1620520_Annot_ID_159427 3000 nt of promoter + ATG
ctggacaaacaccaaaactacatatcagacaaataaattcaacagttcttttatgagaaagaaccatagttgagaagactcacgcttcatgtccagcgagaatgtgctgggcagaatggaatctcttcatccagcttcggtatgtagaactatttgttacagaagctggacttagatgaataatacaattaacaagcttagctccatctgttgaattgtcaagacatgaataataagtcttcatagacgggatagatagcagttcctcggcatgtgactctgttggacaatccacaagcaaaacaacaggaccaggaactgaaggtcccatcacatcactcggatgaacctatgattaagcgtgaacagtgttagtctgcttgtatagaaactgatattgggttgtgaagattcccaatgattgctctttgagacataccgtaatatctttaaaatctgacttgactgactgtccagactgaagataactgtactttggaccagctctcaatccaagagccatggccttctttggatcaaactttcctttgatttcaggtaattcacatacatatataactgctgtttcaccaggtttgctgccagattcctctaagcgacttggttctaggagaatggcggatattttcacaacttcgtcatccacaagaacataggcatcatctttgggtttacttaagccaatctgaggcgcagagtcagatatattcaatgatggaccaaaacttcttgtatgaaccatggcagcacgagggataaatgacctcatagcatcaaccaaatacttaagatctgaaggaccccatacgttgacctttgtaacaaaagagattttagaagttgagcaattccactcatataataattgtcataagctcaggaaaagcagacaggaaacatacaaagagatcatatgagaagaacactcacggatagtccttgttccccgataccagctagggtcagtagaagacctaaagcatttaaaataggaacaacacttatcactgtctaatgatctagcagcaaacacaatgcagctgatgcctaaatcaaaagaaaacaaacctggaagcccgcctgctgtctctgagcacacacgagacaaaaatatatgatctacctgaaaagagttaagcgaatcatcacatattaaactcgtctcatcacagacacaagtagtagtaagtccaaaagaagaagtttggtcacacctttgataacttaattttatgttcagtacaaaaacgttgcaacccctgcaattcaattctttaaccaataaaacactaacaaaaagctacacactttataataaaattgcagaaaaacttacctctccagcattaaagatgaatctttgtttgtcaaagaagagtaatacagaaggtgacgtatcctgtgtatccattccagtcccaaggatctaacaaaacagatgaatagttcaaaattatgcatcatctttcacagtttaagattggagtagatatgaaattgaaacctgaacataggcgatggtattggtagggttaagggtgcgagtattcctcttgagattcttcttaggcttatcgaccttatccaatccctcagctcttctcttattaaactcgaaagaatcagaagagtgattaaagctaatagctttatctttctccatcggagacctaccttttctcttctgctcctcgaaactactccatttgcgtctcggaggagaagggccactgcgacggtaaccggcggtgcgaggaggacgacgactcggagccggagaagaagaagcgaagattggtgggtagagagaaaagggtctgagaataagagcgaacgaagaagacttgagaggagaaaatccgaaaaggcttaggttttgaggcattgatgaagttaacatttttcctcaagctagtgagtgacaagctcaagcttcttcccgttttttttttctcagagtcttctccttcgaggatcgatttttttaatgaaattgtcaatttagcccatgggcctttgtattacatttccggcccatcaaatgtcaactacaccttattattcacaactcttacattacttacgtatatattttgtaacatttttactcaatggtgacaaacctttttggttaagttcaaagtgaaagtgtgttgatcaacaatgttggagatcgtaagtctatatttttatcatcaagaaaattttagacaaactgacttaagactaagaaaacagagacatgaacaaagttcaagaaaatgtgataaaattattagacttgcaatcttaacctaaaggaactaggacaaaactgggagaataaacacaatgaaaacaccagaaaccaaaaccaatttgaatcttcttgaaaaaatctcccgtgacaatatagatgcaagccggtccagtttcatcgtcgccaggacacaacattagggtggtctggtcatagaccaagtaactaatgccataacacttattaaaccgacataagttttatttaattgtaaaatcaaaaccctaatccacatttgtaatcccaaaccaatataaaattttatttaattgtaaaatctaaaacctaattcatatatataaactcaaaaccgatatataatttcgtttgattataaagttcaaattctacagataattaactttatttaattaaaaatctacaaattttgttttctcaaaattattgatttaaattaaaggagtgaatacgaaggttcaaccccaatatttttcctatatacgggggaaaacgtttcaacgtttctattaactaatttaatttggttagtcaatagactaaaccggcgcatacacacattggataagagataaaaagaggcaccactcgcctccacagaaacctcatggcatataaaacattatcccaattaaggacccaacctttttttttggttctgtttaatatcttattgtttaaaaaagaagaacaagactatg

SEQ ID NO: 2336 - DNA, 3000 bp, Unknown
  misc_feature (1)..( 3000): cDNA_ID_3067163_gDNA_ID_1620521_Annot_ID_159458 3000 nt of promoter + ATG
tcatgcaaacacaatacgtgaaaaaagatataagatatattcgaagtttatatcttatttttttagtgacttaacaaaacaatgagctgttaatgaaaaatcatgaatcacgtccacatgagctgttatcatctttgttagagaatatgcgttctgcaaatgaaaatcctcgaccatattcatattcacatcattttcgttaccacttcgatagctacttctttggccaatgatattggtgtggttctttcttctcagtataagatgttacactcactttagatattggagtattatcatgtggacatgattcatgattttaaattctactacaaaattattataaccctaaaatctacagtaacaaccaaaacatatgcatcctaaagtttacagtcaaattttttaaaaccacagtcggaaccaatcacactcatatctttttcatttatgattaaagaaataaaaaattagcaattcatgattttgaatttatagctggagttcgagtctactaatcatattaccccatataataaagattgttgaaccaaatatgttagggaaaaaaatatattcgtcgtggactattcattaaattttggttttctgtagactatatcaaattctacactgacatcataagcaataaatgtttcacccgaaaatgcgaaactacttgataatgcaataaaagttttgctgaacttgtcttcgttggagcttaaatcatccacgcaggtacataaatatgagtattgaatcaaaaggtttagaaaattaagaaaaagatatggcaaagaatttaggatttgtgttcttggttcttgtggttcttttggtgccatgctccatcaactatggtcttgtttctgcacaaccacaagagttactcccacaaatcggttagagctggttctaattatatatatttatctaaatttctcatttcgcatttttctatagtttatacatatgttatttaattaaaaatagtttgatcttagcttgaaatatccaaaacataaattccagaaaaatgttaaaaataaaacccagggtgctgaatctaacttttggctcagttttggtttgattcttgttttttttggatatatatatatatatatatatatataaaagaaaataaaaccaatttgattcttttttcctctctgtttagtctttagaatttggtttggtttatttaaaccagattagacacccttttattgactagatataataagttttaggttgtcaagctaatttcaattaatacatgattcttaatttatttaattacgatttaaaaatcagaatggagaagaatgatgatcacggtacgatcatcaagaagccaaataggtaggcagaaaagagcgtcgccttctccatcatcaccaccttcgttgttgtcgcaagcaccggggctttgaggaacaccatttcttgatgaaaagttgaaaacgaatagaatttacttaaatatcggtttttggaatcattgataagctatgcatacaatttacttaaatatctattttgttcaatatatatatatgatgaagttgtttatttgacaaaaaaaaataatgattgtcaaggttggttgggcaattttttttttttttttttttttgtgtgtgtagtatagacctacagtcaaatttaaatattaattagattgatttttccatcttttattaatgatctaacgatattatatatttatttctagcatgtatgatatattactatggatggtctatgttggacaactcttccgccaacacacaaatcattacgtaccttgcaccacagtgaaattcattacacatgacataagtacataacatacatagccacaatggatgaattacctacaacaagcttaacctccaataaattttgcatctatcatctaaaaattgcattctctcaataaacccttgagaccaatgggcttcttctgtacttgccgtttagcttgacgttaactttttcgttaactttggaagtccctttgccattaagccaaagctttaaaatttctacactagatcttaggtttgagtttttgataatgcaccttatcgaaagaactatccgtcgtggtatcatgtattaaagtaaagatgtccatcgtcgatataatgtagataagaatcattagttggagatccaatagctgagaggagagttgcacgttgtggaagttgttcatagaatcgttcatcacaatcgtatgtgtaacgtttacatgtagttagattcgatcagttgagcaaatatctctgatgattatgtaacaaatggtaaaaacataaaagaagcatcattgaactatacagacagattaaaagtaaatataatatctaaatacaggaataccatatattaaaaaaaaacgttgcatctaaattgttttgaattttacatgtaattctttaagacacattttgaaaatacaacaagcataaaaatcttcataagttaactcaaattctggtcaaatacatatagaaaataatataaacctgaataaaagaaaaatattgtaaactataaaataattgcttgtagctcactggtactcgattagtttaaataacacatgattttgacttctaaaagccgtgtgtaaattttcgtcgttgaattttcaacaattttttgtcgaatgccatcacccggttttgggatattcgaaatcaccatgagggttaaaaatttagtgggcttgggatgtcggctgcttgtaaactttctttcattttttgtttttttttcaataaaatccttcagaactaaaatacaaagaaagatcactataaagtcgttgatcaaaaaaaaaaaaagatcactataaagcaagagggtaaagtattaaaaatgattggcagagatttcatcagtttgctttttggctttttacgtgtcttcatagcttattggaatttaaaagattaaaaggaaagaaaaaattctgagagagag

SEQ ID NO: 2337 - DNA, 3000 bp, Unknown
  misc_feature (1)..( 3000): cDNA_ID_2157410_gDNA_ID_1620521_Annot_ID_159480 3000 nt of promoter + ATG
aaattttattcattcaattgttgaacccatggtatattgatctttaattcagatttctaattaagtgctgagtgaaagaggttagaaacgattcatacaaaaaataataataaaaagaaatagaaattgtcgacaaatttaaaaaaataaaaaataaatagaagaagacatgcatgagataagaagaaattcaggagagattaaagatagaaggagaatctagtttcagagtgcaattagaaaagtgataaaaactaggaactactcgtctacaccctgtttgcatgtcctagttttcacccaccttgtgcaggatgtaattgatgtttcatacttagaaaatcaacttaggttacattgaaaagagtgaaatagacatggagaaagataaacaatacgagtttggtgtagaagatgccatgattaaggtcaatagggttttggcgggaccgcacttgaaatatggcctcaacttggattttcacgataatcatgctacaattatgctattttacaatgatttaaaatgaaactaaaaacactttccaaattgtatgatttgcttatgtagttatatgtcttatttggttgatagcattttgttcaatattattcccggtagcgtatcaaagatcttatcaatctctttttcttatattccctgaaatagagaaattaagagtataagtaattcataccatatatattaaattgtttccaattggtaaaaaagaaaagaaaaattgtttcaactaatattagctcatcagtcatatgtatcctcggtcacaggtggatttgttacacaacaacactcgttaactttttttgtttgagggaatgatttgtctccattacttccaaatttttaagaagactttgataaatagtaaaaaggagaaatcgaatatggtaaaaaaaaagagaatccatgcacctttataaagggaagtacatttttacaaatgaagaaattcaaagtctatctttagcatttactgttcttttattgaattttgcttctaccatttttattaaattccttatggggatttactgtttatggtccctgaacccatttccaggtttcttaattgctctttaacataacccttctcttttgttatacctataaccaaagtgatgtgcttaattagtgaaatagagaaattataaattttgtgaagagtccgtgactatactaaatgttaggtaatataccatttttgaaacaacctctttaagcgtcttgtctagtttcttcatctatttaacaaaataactcttacaaagcgaagctccattgtaggccttagaccccattagcaagtcttgttgctttcttattttttcttttttgttggtgcatgtgtgaagagtccgtgactatatcagatattaggtagaataccatttgtggaataacctatttataagcttatcgtctagtttcttcatctatttaacgtaagaaatcttacaaagcgaagctccattgttggccctctagacccaattatcaaagcttgttgcttcttttttttgtgtgtgtgaaggtccgtgagtataccagatattaggtatactataccatttatgaaataacctctttaagcctctcgtctaattgcttcatctatttaacgtaagaactcttatgaagcgaagctccattgttcgtcctagacccaagtattaaagctttgttgctttcttttacgtttttgaagagtccatgagactctattgatagatgttaggtagctattttaatctctgtggctgtcctactgttttgtatgtatggatatataattatatatgcataattgtcttttttgtgaccaaaagcttagtatataccatttgttaaacaacctcttctctagttgtttaattttctgtttaatgaagtttcgggccaagatccatagtctcctaggataatcttttttttgtaaattttcccttaagattaataggcaatctctctcaagaagcctcaaattcagggagcagtcatctcactcttttaggagggagtctgacacgcaactagcccaattacttggtacatcttgtctagtctcttcactttttcattattagctatagtagtcttagaaagggaaactctattgatagtcccagacccaactataatatcttgttgctttctttttcttttggtgatgagtccgtgactgtactagatatgttactatgttaagctcatgagctgtcgtcttacctttgtcagatgagtggaatagtaagaccattcaatagaaccatatacaaagttatagacacatgtgtgtttgtgtgtgggacacttttaattcttgcattctagttgaactggtttactttgtaacacattatggttcctcaatactctagataatcattctcgtgttccatatatgatagcttatgaacaactatgagtatgcatatgcatacatatctcctttgtgactaagtgcgtattatatcattggtgaaactgaacaaacgtgatagacacacaaacacgagaattctccaaacctcggcgcacgagtttcaacttaattataaaaaaaaaattaagatgataaatgtttagtcaaaaaattggtcaaaattcgatatgttttcttgtagtatataaagttcctcacacatatttgtgtcctcccaagaaaccaagtggtagctaaacatcagattaaaaacagggaaaaacaattcttgtcattgaacatagcaaaactatacgtttttgaatattaatataacatgtttcacatacactaagaaaaatatgtaaatatctatttctagttatattgagttgatataataaagataaacacaagattaatttttgtaaactgtattaaaaatacaaaacaacaccgctcattaaatggagagaataataaaattcaccaattataaaagaagatcaaaaccgctcctcagttctctacatcaaatctatgaaaaaaaatg

SEQ ID NO: 2338 - DNA, 3000 bp, Unknown
  misc_feature (1)..( 3000): cDNA_ID_2157416_gDNA_ID_1620521_Annot_ID_159483 3000 nt of promoter + ATG
cacccaaagaccatcggaaattccattactcttacaaattacaatcggagacggcgaagaagaagcaccgtaattccgttggccggtggaagaaaaactcgaagcacagtactttaacggcaactgaaatatctgcgtcgtcatttcttcaaaaaaaaatgtgaaattcgtttctacaatttcacagattctgcatctctgaagatatagtttcgattgaaatttccagaggaagaagacgatcaaaatctcaactttgccacttttaatcttaagaaagggagattgaaaatttgaatttttatagattggagaataatacgagtggctgagacatgtagatagcctccgaacaactgctacttggataatactataaaattactattgtgttttccatatttaggattccccatatttaaggggttttgcatcgaacttgccaatttttttctttttttcttttatctctaaaagaatacatactcattttatgaaatcaaaaataataaataatataacttttatattttgcattcatgattttaatatctcaaaaaaaactaataattttaattattttaatataatattcaatatagagtgttatttcatcaactatttgtttaaatatttgattcttaaagtacaattaatttatcaattctagaatactgaaacttgaaatattggaaatgtttcatttaatatagtgtccacaaaatttttacatttgaatcactattttagtattcaagtttgataaccaaacaatatttataacagaacgataaattgttactcaaacaaactacacatcgtgcatatattaacctagttggttaatataatgtaatgatgcatgtttcatcaattccttttcttttcgctcaataactttctgaaccattttgccgatttctttggatatctcttacgtccatcgttgaaatccacgtaaactagtccaaatcggactgagtagcccgttgcccattcaaaattatctagcaaagaccacgcaaagaatcctttaacattggctccaattgatatagcgtcttgaaccatcttcaaatgttgagcgtagtaatcgatcctctcactatctttaaggtcgattttaccggtactagcttcatctctaccattctctgttatatacatgacaggatccttgaacttgtattttgcatagagaaggagatcacgaattccttttggatatatcaaaagccaatctgatgctgcctttggaccgataggcactccttctctttcacctgtgacgctagcacaaggatcagagaataatgtaacgttttcgcttgagcaaggaacatccttagcgtaagaagatgagtaataattgatgccaatgaaatcatatgatcctttcaacatcttagattgttttgcagtaaatgtaggtaagcgaccgtcttttacgttgttgaccatgtcaaccggatatttaccggttacaagcggctccatgaaatagtcgaatgtgaaggccatggctcgtgccgcagctaatctatcttcagctgattcggtataaggcaagttccaacccgcgttcaaagcgataccaacttgacctttttgagatgccttatatttttctctatatactttgactgcttctccatgagcaagaatgaggttgtgaccaacaatataaggctcggtagctccatttcccgcggtgcaattagggtttgtgaattttgaacaccttccaggagccattacaccagcaacatatccttgttgcacaactgttaatggttcgttcaatgtcatccaatgcttcactcgatctccaaaattcttgaagcaaatatccgcataatcgcggaagtcattcacaatctccgcgccaaagaatcctccgtaagcatcttcaaggctttgcggtgtgtcccaatgaaaaatggtggcgaatggcttaattcctttagacaaaagctcattgatcaagttgttgtaatagtcaataccagcttggttgatacctccttttagattcccacgtggcaagatcctcgaccacgagatagagaatctataggcaccgaaaccaatttgatgtagtaaacccacatcttccttgtaaagatggtaagaatcacttgcaatagatccattggtaccatcttttatcttctccggatatttttcagagaatgtatcccaaatacttggacctctaccatcttcatgagcagctccttcgacttggtaagctgacgttgcagctccaaaaataaaatcttttggaaaatcacttcttcttaatttaggtgttgaagagtgtttcttggctataacttcattagaagccaagacaataataaacactagcaaagaaaaatatttagttctcatttttatgattgattgttgaaacttggtttgttgtgaaaagatgaatagagctcagaattatataggcaagagaattgttatggcaatttgttatgttaatctataaatagagaagtataagatagagatagtataacaacaaatcttttaagttttacttgttcataattagtaaacagaacattcaaatgatcttatcaagttgtatttctaatgaagaaaaaatagcaaaacattcgtgaaggttcgttttcttttttttgttctatcgattttcttaataaccagaatcgattatctttagagtttagaataagcatggttgtcttgatcaaatatatatttgaaaaggtccattttaaaggtccaaattataagcccaatatataagcccaaagtttaggcccaattcacgtatcgctatactttttagcgggaaaatgttagaggaccccacctaaaactcccgccacaacaagctcgccatttctttgcccatagtggagaaaggttttgttttccgttcaaacgattttagggtttttgtcgcaaacagtttttggtagtgaagaggaaaatttcgagtgaggtagaatttgaaaaatg

SEQ ID NO: 2339 - DNA, 500 bp, Unknown
  misc_feature (1)..( 500): cDNA_ID_3610778_gDNA_ID_1620521_Annot_ID_159486 3000 nt of promoter + ATG
aatattaatcgaaaaatgacaagaaaaatgaataaaataaattagtttctaataatggcatatatatataaatggagaattctaacagcaacaaagagtctctatttataattttcatttctgaacaataaattcacatgaataatttttgttacaaaaatatattactaattaataatatgtaaaatgtatataatatttgaaggaaaatttgaacaaactgtgcaatttatttttaattttatgatattacaacacaactacatatttacctaattttttatgattatactagtaaacacaaaaaagtgttttttaatttacgtattcataaaattaaaaattataaaatgagactcttcaatcttcattactgttaaattctccaaattttttcttctctctctcttccctctgtcgcttcactttccctctgcttcatagttcatacgattcttcgattcgtcttcttcaatcagtgaagaagaactcaaaagatg

SEQ ID NO: 2340 - DNA, 3000 bp, Unknown
  misc_feature (1)..( 3000): cDNA_ID_2157424_gDNA_ID_1620521_Annot_ID_159485 3000 nt of promoter + ATG
ttgaaaccgaaactgattagagccaaaattgaaagaaattgggggaaacaaaaagcccaaaaacgcaaaccttttcaggaattcgaggaagacattctcgacttgaatcgcttgttcatccattacaaatccaccaaaagcttccatttttcaaattctacctcactcgaaattttcctcttcactaccaaaaactgtttgcgacaaaaaccctaaaatcgtttgaacggaaaacaaaacctttctccactatgggcaaagaaatggcgagcttgttgtggcgggagttttaggtggggtcctctaacattttcccgctaaaaagtatagcgatacgtgaattgggcctaaactttgggcttatatattgggcttataatttggacctttaaaatggaccttttcaaatatatatttgatcaagacaaccatgcttattctaaactctaaagataatcgattctggttattaagaaaatcgatagaacaaaaaaaagaaaacgaaccttcacgaatgttttgctattttttcttcattagaaatacaacttgataagatcatttgaatgttctgtttactaattatgaacaagtaaaacttaaaagatttgttgttatactatctctatcttatacttctctatttatagattaacataacaaattgccataacaattctcttgcctatataattctgagctctattcatcttttcacaacaaaccaagtttcaacaatcaatcataaaaatgagaactaaatatttttctttgctagtgtttattattgtcttggcttctaatgaagttatagccaagaaacactcttcaacacctaaattaagaagaagtgattttccaaaagattttatttttggagctgcaacgtcagcttaccaagtcgaaggagctgctcatgaagatggtagaggtccaagtatttgggatacattctctgaaaaatatccggagaagataaaagatggtaccaatggatctattgcaagtgattcttaccatctttacaaggaagatgtgggtttactacatcaaattggtttcggtgcctatagattctctatctcgtggtcgaggatcttgccacgtgggaatctaaaaggaggtatcaaccaagctggtattgactattacaacaacttgatcaatgagcttttgtctaaaggaattaagccattcgccaccatttttcattgggacacaccgcaaagccttgaagatgcttacggaggattctttggcgcggagattgtgaatgacttccgcgattatgcggatatttgcttcaagaattttggagatcgagtgaagcattggatgacattgaacgaaccattaacagttgtgcaacaaggatatgttgctggtgtaatggctcctggaaggtgttcaaaattcacaaaccctaattgcaccgcgggaaatggagctaccgagccttatattgttggtcacaacctcattcttgctcatggagaagcagtcaaagtatatagagaaaaatataaggcatctcaaaaaggtcaagttggtatcgctttgaacgcgggttggaacttgccttataccgaatcagctgaagatagattagctgcggcacgagccatggccttcacattcgactatttcatggagccgcttgtaaccggtaaatatccggttgacatggtcaacaacgtaaaagacggtcgcttacctacatttactgcaaaacaatctaagatgttgaaaggatcatatgatttcattggcatcaattattactcatcttcttacgctaaggatgttccttgctcaagcgaaaacgttacattattctctgatccttgtgctagcgtcacaggtgaaagagaaggagtgcctatcggtccaaaggcagcatcagattggcttttgatatatccaaaaggaattcgtgatctccttctctatgcaaaatacaagttcaaggatcctgtcatgtatataacagagaatggtagagatgaagctagtaccggtaaaatcgaccttaaagatagtgagaggatcgattactacgctcaacatttgaagatggttcaagacgctatatcaattggagccaatgttaaaggattctttgcgtggtctttgctagataattttgaatgggcaacgggctactcagtccgatttggactagtttacgtggatttcaacgatggacgtaagagatatccaaagaaatcggcaaaatggttcagaaagttattgagcgaaaagaaaaggaattgatgaaacatgcatcattacattatattaaccaactaggttaatatatgcacgatgtgtagtttgtttgagtaacaatttatcgttctgttataaatattgtttggttatcaaacttgaatactaaaatagtgattcaaatgtaaaaattttgtggacactatattaaatgaaacatttccaatatttcaagtttcagtattctagaattgataaattaattgtactttaagaatcaaatatttaaacaaatagttgatgaaataacactctatattgaatattatattaaaataattaaaattattagttttttttgagatattaaaatcatgaatgcaaaatataaaagttatattatttattatttttgatttcataaaatgagtatgtattcttttagagataaaagaaaaaaagaaaaaaattggcaagttcgatgcaaaaccccttaaatatggggaatcctaaatatggaaaacacaatagtaattttatagtattatccaagtagcagttgttcggaggctatctacatgtctcagccactcgtattattctccaatctataaaaattcaaattttcaatctccctttcttaagattaaaagtggcaaagttgagattttgatcgtcttcttcctctggaaatttcaatcgaaactatatcttcagagatgcagaatctgtgaaattgtagaaacgaatttcacatttttttttgaagaa

SEQ ID NO: 2341 - DNA, 3000 bp, Unknown
  misc_feature (1)..( 3000): cDNA_ID_2106497_gDNA_ID_1620521_Annot_ID_159482 3000 nt of promoter + ATG
acaaaggtaagacgacagctcatgagcttaacatagtaacatatctagtacagtcacggactcatcaccaaaagaaaaagaaagcaacaagatattatagttgggtctgggactatcaatagagtttccctttctaagactactatagctaataatgaaaaagtgaagagactagacaagatgtaccaagtaattgggctagttgcgtgtcagactccctcctaaaagagtgagatgactgctccctgaatttgaggcttcttgagagagattgcctattaatcttaagggaaaatttacaaaaaaaagattatcctaggagactatggatcttggcccgaaacttcattaaacagaaaattaaacaactagagaagaggttgtttaacaaatggtatatactaagcttttggtcacaaaaaagacaattatgcatatataattatatatccatacatacaaaacagtaggacagccacagagattaaaatagctacctaacatctatcaatagagtctcatggactcttcaaaaacgtaaaagaaagcaacaaagctttaatacttgggtctaggacgaacaatggagcttcgcttcataagagttcttacgttaaatagatgaagcaattagacgagaggcttaaagaggttatttcataaatggtatagtatacctaatatctggtatactcacggaccttcacacacacaaaaaaaagaagcaacaagctttgataattgggtctagagggccaacaatggagcttcgctttgtaagatttcttacgttaaatagatgaagaaactagacgataagcttataaataggttattccacaaatggtattctacctaatatctgatatagtcacggactcttcacacatgcaccaacaaaaaagaaaaaataagaaagcaacaagacttgctaatggggtctaaggcctacaatggagcttcgctttgtaagagttattttgttaaatagatgaagaaactagacaagacgcttaaagaggttgtttcaaaaatggtatattacctaacatttagtatagtcacggactcttcacaaaatttataatttctctatttcactaattaagcacatcactttggttataggtataacaaaagagaagggttatgttaaagagcaattaagaaacctggaaatgggttcagggaccataaacagtaaatccccataaggaatttaataaaaatggtagaagcaaaattcaataaaagaacagtaaatgctaaagatagactttgaatttcttcatttgtaaaaatgtacttccctttataaaggtgcatggattctctttttttttaccatattcgatttctcctttttactatttatcaaagtcttcttaaaaatttggaagtaatggagacaaatcattccctcaaacaaaaaaagttaacgagtgttgttgtgtaacaaatccacctgtgaccgaggatacatatgactgatgagctaatattagttgaaacaatttttcttttcttttttaccaattggaaacaatttaatatatatggtatgaattacttatactcttaatttctctatttcagggaatataagaaaaagagattgataagatctttgatacgctaccgggaataatattgaacaaaatgctatcaaccaaataagacatataactacataagcaaatcatacaatttggaaagtgtttttagtttcattttaaatcattgtaaaatagcataattgtagcatgattatcgtgaaaatccaagttgaggccatatttcaagtgcggtcccgccaaaaccctattgaccttaatcatggcatcttctacaccaaactcgtattgtttatctttctccatgtctatttcactcttttcaatgtaacctaagttgattttctaagtatgaaacatcaattacatcctgcacaaggtgggtgaaaactaggacatgcaaacagggtgtagacgagtagttcctagtttttatcacttttctaattgcactctgaaactagattctccttctatctttaatctctcctgaatttcttcttatctcatgcatgtcttcttctatttattttttatttttttaaatttgtcgacaatttctatttctttttattattattttttgtatgaatcgtttctaacctctttcactcagcacttaattagaaatctgaattaaagatcaatataccatgggttcaacaattgaatgaataaaattttagaaactaagatcgaaaattatattcaaagtgctaagagtaatcattattttgtgtttatattctggtttctacttttatgttcctattttttcttctcattattatatttttttggtttaacactttttcttttttccaactcatgttaacaaattaagctacaaaaaaaaatatgttgtaatgggaaacaaaataaaaaagaattatgttatgcgaaaaaaaaaatatgcggcaacaaaattttggcttgttttaggtatcaaataaatttggaccggcactgtttgcgagcgtagaagaaactgttcacacatactaaagtaatggttgacaagatcagtttcagagttgacgataagaaatcaactaggttaacaaaatgtaatgaaatcagaacatggaaatctgaacgtggcagataaatatacatattcaaactcttttctgttaatttgcgcagaaatgcaaattcaattgctaagcctatgcggcctttacaacgaatcagttaaaataatcaaagtaaatcaaataatctaatgatgatatatcgtgtttacaggtttatatggaggaaaatatagtgatatgataatcctcatttaaatcattatatagtgaagatactacttacacacgtaacctcctcgatcgtcttttccgattgaagtggtacagaatcctatatatatgactaccttcttgcaagttttccaccaacaccacatctctctctatct

SEQ ID NO: 2342 - DNA, 3000 bp, Unknown
  misc_feature (1)..( 3000): cDNA_ID_3067145_gDNA_ID_1620521_Annot_ID_159476 3000 nt of promoter + ATG
tatattcgtttacaacctaaaataaatttaactgtaagtaactaagtataataatattatagatgaaattaaatttatttaaatcatatcaaacaaaatatggatgtttgtaatcatgtatatgaaattaatatttataaataaatttatgtgatgtagttataaattggatgttaattttaatttataagttctatttgtattgtagttcaaggttggaaaacaaaatgtctatttgaatgattaatatatactgtatgttccgtggccattcagttgcttacgtgtagccttagagaccaacacaaatatctcttattggagagaacaaatcgtgtcgtttctaagcactcgttaaatctattaaaaacacacacaaagtccacaagtcaattagtcaaattcaatccacgtgtggtttgaacactgatattttatttaccaaatttggcttatagtttcaggttatgttatatgccgtttcaggataagttttggaccggtccgtttgtcagagacttgaacacaaaatttgacattccagaatcaaaaacagtgccgtttgtacgatcaataaacggcaagacacttaccgttgcaaatagtcaatcttgctttttgagctaaagactgtaatctgaagaaaggataagactttggacacagagaacacaaagagatcactgaaaagaagaaaaaaaaaatggcagctttgagttcttccatgaccatctcatatctacattcactttcttgcaacaaaagttgcttgcttacatctcaattttcaaaacccttgtttataaaccaaactcagaagaaactcagattctcgatttccttttgcctcaagcaaaacgaatctggtattgaacaagtcgaagaagaagaagaagaagaatttaccgttgtgacggccgtaaaaagcagatacaatgagattgttatagtggatacttttgcttctagatatcttcttcttgattccactagtgagaatttttaaaaccctaattcctctgtttttgatattagatcctctgtttataacctaagtttctcattatgtagggaatgtgcatagtgttatcaataaaggaggccagaattggactggagcttattgggtatgttacatttttacatcatcataaagttgcaaaaatcatagcttgagttgtttctctgttgataggtaaatgttgttattgtgtttaattttgaatcctatcaacatttttgtttgaaggacgagtctgcgtgtttgccgcctattatccctaatggtcccattgcaatctacggcttggtgagaaactacgtggtgaatcttataccgattgtctgagaagtacatgaacataggcatgcaatgagtcaatgatgtgtttaaatttttgttcatgtgtttgttagggtggtggaacagctgcaagattgattcttgagttgtggccttcaacggagcttgaaggttgggaaatcgatgaaattgtaagtaaactatcggattttcttgcggcattacgtttgcatattggaaaatcttgagttcacttgtgattttcttttatgaacagtagttgattgagaaagcaagagactatctcgggctgtctgagctagagataccgacatcaaaaggcggtagactttgtattcatgtagatgatgctctctctccttgtcaagatgattcaaaaagatatgctggtgagatttacaggttaatgtatgttgcttattcctttgttcttttatgaattcttgaattcttatgtcgatattttagggatcatcgttgatttgttcgcggatggaaaagtgcttgatcagctgcaagaggtactttaatttgttatggtgttagtattatatagtcaactttgtgacaccgagtattttgaattcgagtatgtacagattccaatgtggctagaactggctagtaggttaatgcctaacggtcgccttatggtgaattgtgcgggaatcgaaacagaagtaaagaatggaaaaccagagttggtgttagatgatttggcttggatgttgaattctactgtcaagatcttatcagaagcatttcctggacaagtaagtaacacatttcatcttcatatccttttgttaactacgcgtttaagataaaaagaaaaacatcgcgattatttattgttgcaggttagttggaagagaacaccagattcagaaggtctcaactttgtggcattaacaggaggcttacctgatcttagtgactggtctagtaaggttccagtccgtttaagcgaatcagtgaagctatggaagctttgcgagacggtccctttgcaactcggtgctttgaatgcatcttaacatcaagagttttgccaaaagatttgatcagaaactcacatgtggatagtgaaagttgtgtatgatttgttttgccaattgagtacagagatacacaaaaggacaaaaagaaggtacatatgaatttcacatttgaacttaagaatttttaaatccaaaattcgattatcataaaattttgaatttatacaagaaaccttttatgatactatgttatatatatgttactattagtcagacaaatgttttgaacaatttcttggttcagaccgatattagacaattgtttgacaatttaaccacttgacgaaacttgatatgttgctcgaactctaatacattgtccgcaggttaaaatctagtttcttactaaaaagcattttgatcgatattgttggcaacaaaggatcttattcaagagaacaaatcacgtcgtttcttctaaactcgtttgagctgttaaaacgtcaccaaagttttgactttctatatacacaaatcgtgccgttttcacagtcaataaacggcattacacttaccgttgcaagaagtcaattttgctgatgagactgtaaaactgaaggaagaagaaaggataagacattaaacgcaaagagatcactgaaacaaaccaaaaaa

SEQ ID NO: 2343 - DNA, 3000 bp, Unknown
  misc_feature (1)..( 3000): cDNA_ID_3067155_gDNA_ID_1620521_Annot_ID_159465 3000 nt of promoter + ATG
gccacggagaggtggagggggaggaggaagaggaacgcaatccaaacgcaatttgttcctttctaacaatatgtatgtaccacaaattgtatgattaatttcttcaaacaataaatatgattaaaactacaacagaaaactatgtatagagagtataaacaaggtaattacttttaaaaaatacgtaattagggaaatgataattgctagagctgctattagaaaggaaaaaggacaaaaataaatgtaacaaattaacaatgtaatacattattatttaaaaaataataaaataaatattcggttggtagtctagtacattgatataatactatttaacactatcaatactaatacaataaatcaaacttagataaaagataaataattatattcgataaaatagatgtccacataaaaataacgtgataccatggaaaaacattatgtgttctgcaaccttagatgttgagaataaaaccaaactaaaactccaaaccaaattataacagtattactatatgtggatgtggaatgtagctcgtttttaatagacacacaaactcaatacaaaagtaagagaggtagtgttaaatagttacgttggagacgtttggcctgggcgactccaacttgagataagataaacaagagcagaataaacaaagacagaagaagatgacctaaatttgatgtctttgtagccattacttaagtgctcgactctctcaaaactccattacaagacacatatataagataatgaagcataggtagtagatatggctactataaatgtagtactgggcctagtagccgacgaacatttccattcaacgcgctttgactttatgaagctgcgaaaagtctttgcaaaccaaaattatatgtataaatacaattgacgtagataataatttaatttttttaattaaatataaaacggtttttttatatatgtaaattgtaaagtgatgatgttgtaaccctttttatttctttctaatgtttaaaaaacgctttctgaaaaaaaaaattactttggtttgtcatttcattttgaagcattgtagtctttcaaatttataaagaatatgtaaattataacctgaaacatataatatgagaataataaatgttgttgagattggtgggagtcatggttgtgagattagctaccatccatggcatgggattatatatgggaggatatgttgcattagtaagagatattcattgcttgcaggttgtgatgtcatggactaaagttggtaacaaagtttgcgctgaatgttcttgaacaccacataacaataatcgaccaatgtaaggtctggtagtgcgaaaatcagatcctcttggggaattatgttgcatcaaagaatgttgctgattttgatctgcttttagcagagagcggttgcagttgatgacgtatttgctatgataaaaatgatgacggaggcatatgagtgtggctgctaaaaaaccttgcaagtgtttcatttaaaatattcagcaatcaaatccgatattatgtgctttcttaataaaaataagcaaacacatctttacacagaaataatcgtagggacgctatggcctatagcaaacagaggaatgcgtttggcctttttctaaacaccaaaaatatattagtcaagtcttttcgattttgtatacattcacaaaaaagataaaactacaattcctacatatatataaataaaaaaaatactacaaaataataatttctatcgtctcgtctaactgaagtcttcagcccacttgcaaataaggtacgtagatattaaatatagagataattcatttaggtggaaatagtatttttcttaagattagttttttttttttttttcttaagattataatataattcttctcaaatgggcttgggccaaagcctacaacaaaaaacagtccagttacaaaagtggttaatcgacaacattgccggaaaaaaagaaaagctctctgctcgttgatagatgccagcagaggaccggagccttaaatccggcgggctcaagagctaccgtttcgtggtcaccaacgaagatcgggaatctccaacgaaagagaccggttttcatcatcaaaaccatccctccgatgcaccaacccacaacagatctcccggaaagctagttgctccgactaggcacatcgacgaaatcggatcctgaaaaagcaacccaatccactgggcggtaacccttctcttccaaaccgaaagtagccaaaaaacctgagtttcgacgattcaatccggctcgatggatgctaaattgaggcagatctaaaggatggtggctcaaatccattgcctttaaacccgaactcctcaaccgccctctaagaccctatggatctgcagctaaccaccgtgcaaaccaattttttaagattagttttcttttataacaattttagttttaattagaaaaacttgacaagattttgaaggtttaataagataatttagacttctttttaaatattcatgatcaaatttacagctccaaatttttttatgtttgacatcaaaccacaaacgcattattaatttttacatttcctaactacacaaaattttaaaactcagcctaaaactgttctaccatttttaagtgtttgatatttctccactggtgacgctgaagttaaaaaagactaagacaaaatatatgaatggagaccgaactgtacagtgcagtgtgattccaatagtaacaaacatgattatggagtatgacataatcacaaaatattaaatgtcacaaagtttggtagactttgcggcaaaatggaaatgtccgggcattggacggtaggcccagactagactttgtggcaaaatggaaatgtccaggcgttggaccgtaggcccagacggtcagactcatagtaccacattttacatgtagtatataaataggtcttataatggagttttgagaaagtggaaaacctagctta

SEQ ID NO: 2344 - DNA, 3000 bp, Unknown
  misc_feature (1)..( 3000): cDNA_ID_2157396_gDNA_ID_1620521_Annot_ID_159475 3000 nt of promoter + ATG
gcatgtacataaatatgagtctaaactcgagaaaaaaataaagatcgagaaatgagaaatacaatttcctcaaaaatgggtcaagttctaattgtgcttcttctcctctgcaccgtcctttgccgtaccgagtcagctcttccttcgggtcaacattcagtcctactaaccggtttgtgattccatatattcataatattcatgcacacgtttgtatatttattagttgattgataagatccatgaatcatatggtctaattacatggaatatatatataggatgtatttaggacttgttaaaacattttaaagctgtatttgtgcttatgataattaggttctcacatatatagaaagttagagaaaacctaaactgatacatgagtacatgtaccaatccattcattgttaattgcgtatcaattaaaaacctatgaactgtataatagttactttcataatactttttgtttggtatgaaacatatacatatataaaaattcgatttatatgttttgttaatttctcaatagtgtaatgtatatgtgttaataaatacgacaagtaatcttattaatttacaacgtctaactatcttaaatataataaaaaacgaaggaaggagattgatgggttcgggcgcttcgggaccagtaagatcatcgcagagtagccaagctggtggacgttttaatgatgctgatcctatcgccatagattacggaaaatattaaatttctttttgatttcagtttttccaaatttaatgatgttttaatcgttttctgctgctttttcatcagtttacagtcaactgttacgtgatatttcccttgtttgaagtcatgaaatttcttgtatcgtgatctatattatatattttgtgtttttgtttgttttcattgttagaacatatttatttccttaaaacatggaaacgtaatctatatttggaaaaactaatgtcatacgattttttagccaagggaacagaaccatcgatatatggacaaattaatggtgctcctctctaatttcgccatcatctcttcctaatttccaatttttggtttaagaaatgtatttttttgtattttagctatcggccattacaagtccagtttttttttacattttgataaaaagaaaaaacaaatccagtttttaaagtctcagtgatgtacgtgttttcagatatatatatatatatcacatatgggattgttgagatggtggggtttttaatggaggatcgagaaggacgatctaaaccaagatggaacggtcgagatgactaaccgatattatagaaatagcgaagatatgattatagaagaatcaaccatcttttggtttcttcttgatttttctataatcatatcttcattattttcataatattggttaatcatctcgaccgttcgaactttgtttaggtcgatcttctcgatttcccaataattttctagttcattattttggatgtggtggttgggaagataaaaagaggaaacaaaagatttgtgaaaagcggaacaaagattagaaaataagaaatgattagagtcatttcaatatccagtgagcaaaaactctaccgaaattgaaggaattgaggagttttgaagaggaagaagtagtggcgggtgatgaaatggcaattgatggagaggaggaattagggcttcttggtgaatttgggggaaattttgagagtgaagagagtgtttatgtcattgaagaaggcgaggaggcaaaaaactgaaatgaaaggttcttatttagtttatccgttgcaatgtgtgccaatctttttttctaatttattattaaactgtataaactttttttttgtttattttctgtacaacaaaccgaagaaacataaaataaatagttagtatcttatatgcgtatataaaatctaaccgtctcacagacaggttagttaactatgctttgtctttacttatagatttgcatacgttgcagttggttcgaatggatgttgcaacgatattacatgatgatattgttggacaatcgcgtcttagactagttccgatgtaattgttttttttttgtttttgctttaataaacacatctccttgtcactcacaaaaaaagaaatatgaagaaacatgggacaagataattgaaactatcgaaattggtttgcctataattttgttttaaaacaataatgcagataatgtgtaccaggatacaaacactgtgtttaagaaacacggtagatgataaattctagtgttgtttaatcgaaatttatgtggtatattcgtttacaacctaaaataaatttaactgtaagtaactaagtataataatattatagatgaaattaaatttatttaaatcatatcaaacaaaatatggatgtttgtaatcatgtatatgaaattaatatttataaataaatttatgtgatgtagttataaattggatgttaattttaatttataagttctatttgtattgtagttcaaggttggaaaacaaaatgtctatttgaatgattaatatatactgtatgttccgtggccattcagttgcttacgtgtagccttagagaccaacacaaatatctcttattggagagaacaaatcgtgtcgtttctaagcactcgttaaatctattaaaaacacacacaaagtccacaagtcaattagtcaaattcaatccacgtgtggtttgaacactgatattttatttaccaaatttggcttatagtttcaggttatgttatatgccgtttcaggataagttttggaccggtccgtttgtcagagacttgaacacaaaatttgacattccagaatcaaaaacagtgccgtttgtacgatcaataaacggcaagacacttaccgttgcaaatagtcaatcttgctttttgagctaaagactgtaatctgaagaaaggataagactttggacacagagaacacaaagagatcactgaaaagaagaaaaaaaaa

SEQ ID NO: 2345 - DNA, 2922 bp, Unknown
  misc_feature (1)..( 2922): cDNA_ID_2157321_gDNA_ID_1620522_Annot_ID_159494 3000 nt of promoter + ATG
atctcttgcattgtatcattgttacccacacgtttaccgtgatggagaaaattttcttatcaattcccgagtctttccacttttcaagaatctcaatagctaagtatgcacaagtatgcggaggaggcaaagcacaaaacactaagatcttgttcttcaacttccaatttttgtcgatataatttgttgtcaagcacatatacccttcatgcgtgagtgcagaccataaatcagtagtgaagctaattcttccaagaacttgtgctaattctctctttaacttatctatcctagactcataaaacctataaacatccgcagttgctgtgtttcggctaaagaacttcacatccggattcaaatatttccaaatttctctaactctatcatactccacataagtaaatggcagatcgtgctggataacatgctgatttatctttctagcttgcaatcttgcttccgaattaaccatcatctgcccaatatcaccatttttaggcacaagcttacatttaagcaaatgacgtctaaatgtgtttgtaccaattttgtgagcattgtacgcataattcttcttgcaaatgcatgcattgtactcttcctcaagctattaatcttggtaatcaatgcgaaatgttcccaaacttctgagtattgccttctcttctttggttttgatgactttcccttgtcagcatcatcttcatcatcatcaataaacccctcatcatcataatcgtcgttatcaacatcatcatcaccatcatagacttttatttttggttttctagatgattatggttcatcactacttttctttttctgcattttaggtgtttctgatgcaccactcactttcgttttctgcttttttgatggttctggttcaccactcactttccttctttgctttttagatactccagattcatcaaaagcagctcttccctcttcttcagcattcagaacattgacaagtctttgagtttccagatctactgatctcatgtcgtaagaatcatgtgactcttatcaataagaaaataacaaaaactatgtcaatcacctctaccttgccgcaaattcatttgtttgtgtttcagtatgtttttcagctcactatacacagtttttggaaagagtgaaacgggagacggcatggtgagtcacccattccagctcccaatctcgccaaacgaatcgataagaatagatagaatcagttgagtactttggttgcttctggatcacccgtcttcgagggcgggctgcgatatttgttcaacacccattgtcgttagctcttcacttctgtttttatctttttgagtatgctttcaaattttttgcttaacgatgcatttattgtaaaaccgtcttttttggtggataaattttaaattcataaaaaaaaaaatcaaaacataatccaatctaaggtcaaggttcaagtatgaaacatcaccattatagtcacatatgtctttagatgaatatagctccagccttcaagtcttcaacgttactcacaaaagaaaatctctcaagtatcaaaagctgaattgtaacgagacactgttcagtttccttgttgggcaaactcatatatatgtctagggtttttcattttaactccaaaactctctaatagtgaccaaatgttttaaatactctaagtgaaaaagaggttttaaatgaattgcttctactttggcgggtcaacccgctaatccgctgtccgcaacgggtcaatccgcttcagcccgcaacccatgatgggccaacccgctaagcccgataattcatggacataaatattgatgtccaagcccgccccgccacagtactacttgggctagtcccgtgggcattaggtccgctttatgcatcacaatttctcctctttgcacccaaaagtgtgtgattcatggcttcaacctgaattgactcaaaccaataactacaataaatctttataaattaataaccattataaattaattaaaatttaataaaataagaagacaataaaataatatattttttatgaaactcctatgtaaatctattctctcacaaatatcataaatttagaattaaatacagttattaatatatatatatatgtataattgtaatgaaatatgactatagtgtttttgtttttttttcttttgaattagcttttttctactgtatccaaactttttgatgttgttttgtcgaattacatcaaaaatttgtgaatgattttggatgcaataattttctttacgtgtaattagttttagaaaaatatggattttaacaaaacattcttattttaaatatattattttaataaaattatgaaagtagacaaatctctctgataattatctttaaattaatttatactagtatttttgaagtatattttgtatatggattaggttacaatatatccgaaattgtgaaccaaatattctatatataataatataaatatttagaagatttggttaagatttaaatttataatacactaagttaagagaaatctaaaaagattcatgattatattgtgattcaaaattttaaaaacaaatatatattatctaattaattaaaaagacgtgtgtttaacgtctgtatacattagtttctttcgtaactacctttctgtatattaacgtgagactgtatagactatttattgaccatcttggactaataaaatagcaatgtagtgatatctcaccaatttacctaaaaaatataataacgaatttatttagtaaaaagacagaaccacttcagtttagttgggtttatcgaagacccttcactttcgcgattcaacagtctgactcaagaagatcttctttttgatggtgtctttgttctgaagctctttttgttaaagacataaacaaaatg

SEQ ID NO: 2346 - DNA, 3000 bp, Unknown
  misc_feature (1)..( 3000): cDNA_ID_2157334_gDNA_ID_1620522_Annot_ID_159499 3000 nt of promoter + ATG
aaatcaaatgaaaataaaagggaaaagatctttctttttgtcttctatatttattatttattgcaaattatgagaaatgttacatacacaattctaacacggacaatttcttccgacccttattagatccacgatagataacacatccttctccatgctcttgattttaattcatttaaattctttgtcatttattgtcgaaagagtttttctaaatatttaaatttcaagtccaaaactacaggatttataacatccaaaacactaattttatttagataaaattgtcttagttcatttttcataaaatttaaacaattgaataaaatctttataagttaatatcagtatacattaataaaatagcatggtactaacattatcaatttatagatgttttattgtattattgatgagtaaatatgcatatttatgtccactgaaaataattaattgataaatttaaaatatattgaaattatagtaatcttaattttaaatttaatttcatgtaatagtatttgttttgtgcccatgatgatgagcccatataatttgacatcatgttgttttaaaaaatcaatcgttgagttatataaatgattgcgacgtatcgcacgatattaccatcgatagaacgaaggaaacttccatttagcagttttttttattcaaaaaacatatctttcatataatagaagtggaaaagttacaccaaggaaaattgaacctacaatcgaaataaatgagataacaaaagtattacaataaatttattgaaagacaccaaaccagatgaatgatccgttgagctatccaacaagggtctagatgacattgaagaatgttaatgataaataatgagaactgaggctggctttgaggatgaattatgcaatcttgcattgcgcttttttccatatggagtacagtgaggcttgataggcaattcgaagaatcaaagtagttttcttgtcacgacaaggattcttcaaccatctaacttcatcctcaaattgatttagaggagaaagatgggctttatcatagaaatagtgtcatacctttgcaacataagagcagtcgaagaataaatgttagcgagattcatccatcaaattacagagaagacacgacgaaggagtagtcatgccccatcgaatcattttgtctctagtgagaagtctatgatgagactttagccaagcaatgaaagcatgcttaagaatccttcctggaaatcacacagattcaaaccgatccatctttgtgtcaggaggatgaagatgtgcataagtttttttttgaatattaatgtgcctaagttttagcagcagagaaaatatttgatgcatggatatcatcaccttccaaaggtaaacatcatcctctacatcctcttgtaagttaacagtagaataggaaggaagacattctttaagcaactgaataatgggactgcgacttcgagaatttgtaagccactattgtctctttctcaatgcatccgcaaccacaacagaacgagggagaagagaaattcttagtcataaatcttcaggttagctcgacaaatatggtcccaaaaaaatccaattatcagtccagaaattacaagttatttctgaaccaatttcacaaacgatgaaaaacctagttaagggtcttaacttgcaaagattattccaaatccagcttctccaagtgatacactccatatcccaaattttttaaaaattattcaaacaagatccatgtgtattagttttctcttttggtaagtaaaatagtggtatccataagatgttggattatcgggcatctatttgctaatgattgtttctaaattagaacttagatttgcgaatctaataatacatcacttatcaatagataaacctttgaccattttttcaacgaactcataaaagatccaacaaaatattttttgagttattaaattaaatactactataaattatctttaaataaatcaaattatgggagtatttggtgtttctttcatcaatgaatggagcaaaaataaaaagtatttaaaataaacaacgctaacatttatgacaactctattatctctctctcactctctcacttcaaatactataattcattgtccttttcatcgaatccaagacctcaaaaaaaacaattattatttttcaacgatcaagatctcaagagtcaaatccaacggtcaaaaagaagtgactctggtactgacaccacctctcataattctcgttagtaggacctctcttcttcttccttctctccactgtatcggatccgggtcaaatccgggtcgggtggagtcgggtcgggtctcttataagaggaggaaaaccacttactcactttcttcttcttttctctctctctttcacccccacgcactcttcttttctctctctgacacatatctttttctctcactaaccatttctttctctctctctcttctgtttttgaaagccaaagtgtctctcttggacagtgatggaactgcttcaagagatttaattttttacccacgagagaagtcaagttgttgaagaagaaagatttgttcttttgtcttgtttctttcattttttcatccacaaagatctcaaagacaagagtttttttttttctgttggggttgcttcaatgcgtacttgtagtagagagcttgtgttgttgttcatggtttgatgatgagaagaaacagattctggttttgaagaaatggggtttgttctgtttcttgtgtttaagggttttatggatggttttttgattcgaagctttcactgagtcttatggttgtgagtgagatttttgggggtttgaacaaaggagatggagaaagacgagtttgtacttccggagctaaagagttatagctactgtagtagctggaagtgaagaagattttttaatagattgtacggaaaaattagggttttcaaagtttggtttcttgaagttgaattagac

SEQ ID NO: 2347 - DNA, 3000 bp, Unknown
  misc_feature (1)..( 3000): cDNA_ID_3067199_gDNA_ID_1620523_Annot_ID_159501 3000 nt of promoter + ATG
taaatttttagtatatttatatgtgagttacgttgtagacgaaaacatatagcatatatatctttgctttgttatcttaagtaaagtcgtcgtgactgggagtggctaagcctgtctaagacaagcaactatgaacaccgtgcgtacattaaaatagtaatttctgattagtttttaattattcaaatagtacattagaaaaatcggatagtgatatttattaaatttgccaaatggactttctgcgacaagcttaagtgaccttttgaacatttaagatatggtatcttttccttttcattgcgctttaaagtttaaaccccatctcactttaaatgttgagtggaagaaaaaaaatagtgcacaaaattgttatttacatacatatctaaaaattgaaatatctattgaaatgttaggtaactaatactcgtgcatacattaacacagaaaaagaaaaagaaaaaagtaatcgtgctcacacgtgacatgcctttcttagcttaatttagtgttctaatgaaattcatcatttgatttagcgtctaatttagacgactctgtaagaaataattcatcctataaaaccaaactaatgaagtaattcctcgtcggtggatgggaaaatagtagttatcactttgcaactaaaagaaaaagtgattcctcttttgtgtttttaatttattatatatttcgatcttacttttaaattcatcttttgttagttgctttgttttgcttatgatgaatatccacataaaggactttcttctttcttttatggtgtccctaggaatggtgatttcatcttattcgaaaagtagctagctgcatttcaatcttccatcatcactcatcagtgacaatgtataatgatctcttagtaccaatactcatgtatattgttatgagctgccaactacaaatatttaatctttgttcccaaatttcaaacttcaccgagaaaatagcttatgtctatccaaatatgactgactgaatcgaataatttgattttaaaagcaacaactagtaatagacattttactattaattcttgtgagacataaaccagttttcgtagagaacaaaagatagtgacattaaagactccatgtatttgtgagactccgtgctatataattatagccaactccattgctactataagtaagtaattaacaatagatatatcacgtattgtggttagatacagtagatttttatatccaaattaatactacaagctacttgcacattacaaaatttgatcattataagctttcttggaaactacagtctctgatcttgagctgcgtcagtggacccataataatctatgaaatcaaccccacgatcgacccaccaacatacaaactttatactattaatctatacacacaaacatatcatatagttttcttaccaaactacattagggtaaattaaaattgaccacacgattgcatttatttttggtgcagctctcgtatatataagatacatctagaaccagagaatatactgtacattatatattgttataaatttcatacatcagaactatttttctatagctagtagtcaagtcgtgaaataatcgtaagaaccactgacagtatgtaaatatatttttattttagaaatcgtctcgatataatttgtgatatttgtaatatattcaaatcattgtagttatctaaaataaacatttttttttgtcaaaggtctacagtaaaggccgtaaaacaaagcaaaacatgtgatttattttctgtgatgttaatcatgtgattaaatcattcacattgtgttgacattatactgtatatctaataaatgctaatctttttaaggaaaaagtggaattaaattgtttttggagtataattttgtcagtttatggtggaaatcttatgctaatgagcacacgtaaacatgtgaatatatacatgtggggaccaccctgacataaaccattcccgcgccccttcctcgataatctcaaccgcatgatttaaccctttccttcattctccaccgtccgatcatcttctctcccagggtcacaatctctctctctgtagcttttatgtgaatcgatcacttctctgttttttttttttggatcttcacttttgctgattcactctccttagtatttttgaatctctgtttctcactctctgtatcttcgtcttctccgtcgccgagtggttgtgtcggttctgcattttctcttcgctgtttgaggtaattttactcttttcttttcccacgattctcgggaaagtttcttcgctttgggtttggttgaaacattgccgtttcgttaagctgataaaccacttcaatgccgttcttctaggttttatcacgctttcgttttgcttatatatgtacaatctaactaaacctagattaaattttatgtttcgaattcgattcaaatcggagcttgatcatttttgcttcgttgattttaagaacaaattcttagcgatttatgtatataccgtcgtctctttcttctccgagcttacgattttggttaatttccgaaatttttgatttctcctttttttcttggatccgtcaaaagttttgaatcaaatctgaaatttgtttttgtcgtttcttattgtttgtgatacttgttcataaatgcacggacgcatcattcagctgtttcttcgggtccatgatatgtatttttagcattatcgaaagatgttttgatatcaatcattattatcttcttcttcctgcatttctttctgcgtccttgaggaccactttttttgtttttttttgtattctttcttctctttgataccgtgatcattgtagaaaagaacttttcagaaagtgctttcaatacactttttgatgtgattgattttggtgtttcttcaatttttcagaatccaggaagtcatataagttagattgatgtgaatccattggttctgtgactagctactactacaatctatg

SEQ ID NO: 2348 - DNA, 3000 bp, Unknown
  misc_feature (1)..( 3000): cDNA_ID_2048071_gDNA_ID_1620523_Annot_ID_159511 3000 nt of promoter + ATG
acccgaagatttgatgagtaaacacatgcataaaatattttttagctatatttggtatctttacgatgtttatatttttttctttttgataaagtgtttttgaaagatatgcctccaatttgatataattaataatataagatgagatgtagttttgagttttattcccccgaatggaatctctcttcctaacaacgtgtaaagtttgtaaactacgtgtattcacgtgttctttcacaatgcatgtttattatctttcttactatttttgtttctttctgacatttacgttttgttctgtcatatactcatataggctttaagttgggttaagatgttcaaataaatatacatgtaagatgaaactaaaacaaattacattaatatcagatttttattgttaaaggtttgaagatattttttcctgaaaactaaaaagtatgttcttaacaaaaaaaaaaaaaaaaaaaaaaaaaactaacaagtatgttgtttactgaaaagattagtgactgattttgtgagccttgacgataaaaatgtagaaaagtaaacacttcagcaagtggataatttataggtacctcatattctcgtcttttgatcaaacgtttcttttcctataaaaattaattacagataaaaagcgtcatatattaattaaccaatataatagcatatttattttggtgtattactttttctatcaattaaatatataaagggaaactatctcaaatctaaaagggaatccgatttaaagaagcttaacttcttctgttctcttttcataaaaaataaatataattacagatataaagtttaaacaatacaatagtatatttattttggcacattacttttttccattaaagaaattaaaggaagctatttcaaaactaaaaggaatccgatttaaagaagcttaacttcttctgttctctcgtttgcactttggctctacgtgatcaagaaaggtcggcaacttatactcagtctctggcaacctataagttgaatgacctgagatccggcgcagaacgttgaagaatctcactgtttgtaggcaaaatgtacctccttgtggatttgaggattgtttggtagacaactaattgagaatcaaaattggcaacaaaaaaaaaaatatggttaatccaaaatagtaattacgttatggaaatttggtaactgtcagagaaaacagactgtacctacattttggatcgtctttctccggaaacttaaacctttgtcgttgactctatccctcgttaacctggatccttgtggacagatcacgctaaatattcaccaaataacgatcaagtagtactcgtaaaaacaaggtgtgaatacatgagtgactttcatgtggaccgtatatgtaacctcaccataaataaaaaaaataaaaaaaaaaaaataaaatgaaaaagggtttaacgtccattcaccatatcagctatttttttgtttgtctgaaaatgtatgaccatatcattatgacattatctgctaattaaactgccttaataaattaacttcgtatatattttgctaatgtatctctaataattattcgttattatcaacttctttaaattttattatgaagatacgatatcaactctagttaaaattttcataacacagaagcgactctgatgtgatgggagtgaaaactaatacagctccacattctcacatgatgcataaacaatgctaaaacctcagataccataacttttcatggaattatgtttctcgattacaactatgtacccttccagatttcagaccaaattttaccatattttttctaataataaaagaaaactttatcttacatatatgcatttagccttctgtatacgcatttgcatgcatgcattaatgagtttcttctgatatacatgtgtgaggatttgtatatttaattcaaaaatatttgcataatggtcttactttttttttgttttttttctttttgacggcacttactttttatatattaaaagagttttttaacatgtgggttatgacaattttctcagtaactttaatttattttaatcacaaaaatatactatatagtggaatataatgttgtttatgctttattgtatgtgagagtctgggtctagtttatttattttaataaatgtgttacatctttctctttgcaatattcttgcttattgtttatggcgtcgatgttgtttcatggaccaactgaaatatataaaaggaataagcatctaatcgactaatcactttaaaatactccatatagtactaatcaaatacgtaccccataaaatagtccaatgattcaccacgaacttaaaaaaactgtataaatgggattcccacttttcctaaagccttgtgaccggctgtaccaatttaaaacgattttatgctataattcatttattgaatgttagggtaagatttgattaaaattaccctaaaatcatggtaaattttgatttaatttataacaataacgacacaaaattagagacaatgaaataaattttgatttttagtatgtggtggagatgtcaaacagaatctccattcaatttttttaaaaaaatacttatatacatataaattagggcatataattatgtataaatacatacaaatatgccttatatttatcttatattctagatatggggttttattccaaaaaattatattgtttgtatcattcactaatcataagtcttaaaatatattgcaggcagaaccgtctatcttagtttcaagtgttacggattgtttatcgctgggctttcgcggaggacgacaaaataacatatattaaaaatatatactcttaataatttttaaaatagggctgcaaatcgtttgagacaactctgaacacggtgcatgtatgatctcttctatataaagagatcttaatttgcacgtatatcatcatagaaaataaaacaattactacattttacaaaacaaatg

SEQ ID NO: 2349 - DNA, 3000 bp, Unknown
  misc_feature (1)..( 3000): cDNA_ID_2048171_gDNA_ID_1620524_Annot_ID_159524 3000 nt of promoter + ATG
atttcaattccaaaaatttctgatcgccgtgtaaacgtaagaagaaacagagaagcttacttgtttgggagatacaatagagaaacctgagagttttggaatagtaataaaacttgttccatgaactcgccggcttatcactctcgtaatcgcccacatttcttttcccggcgatcgccggagacgatgatttttaagcttctagcttcattctaactctaaacgtactttattgggcctaactcagaagcccattggatttggttatattagttttatactagatgctaaaacggcgtcgtaaggagagaactaagtgctgattagtgattaggtcctaataacttctgcggccataataactagtagttattaactactggtctaactttagtcaaaggtaaagcaaaatcacgcctcaaacggaaaatcaaacgtaaaaattcataaaagccgtaaagaacttacaacatgaaaaataaacacgcaaagtatccgtttttttttgttttttcctactaaactacatatttttgttgttgttgttgtattaaactacttactattcaacgtcaaagaaagtgaagtaaacgaaaaccgtcaacaaaaagtaaaattcgtatccttaaaaaagcaaataaatatgatcggagaccaattgttttagtgagccgtctttttttctccttctccaagttcgtaactttttttcttctcttttcatattcttcatacgtcaggaataaataaaattttgttacctttttcttcttcttaattgagaaacaacaaaaagaggaataacgtaaattcaaaactcttctcatcatccaaaaccagaaactttgaccggaaaagaatcagagaagtaaagaaaaacagaacaaaattaaaacagaatttcttctctaatccattacgccggcgatttcggcggcgtaggagatgaaagttcgtaggaaacttggtggtggttgcggcggagacgtcgttgtttcatggcggacgttcttttggttcgtgattctgtttgtcttctccttcgttctcttctccaccatgtttatttttaaggggaagtttcgtccggtggttcgttcgacgataagcttctcaacggctgttacggcaagggcggttttccgtgagtctatatcgtcttctccggcggttacgattcgtgaagcggtgaaattacctgaacaaactctggttttcctaaaataccctcagtctcgtcggttatttacaaaagacgatctcatttgcgttttctccggttcgtcgaagctacggaaagtgtatccgacggctgtggacagagacaaatttggaggtcagatcgtacggtgtcctgagacgccacgtggctacaccatttcgcttgccgtttcgagatggacgaccgatgatcatctcccggctggaccaactcaccggtatgattggctggtttacgacgccgtgatcgactacgataactctacggtggtttttgtcaaggggcttaatctacggccaggaagagttgctgacgtgtcgagatatgagtgcgtgtacggttgggatttcgcgaaacataatcggttaataagatcagatgtcatcactgcggctcaggagatcgtacggtgtagaacaccgttagctgtgttagacggcccaaaagcggcccgtgggcctgttaaagtctcggttagaatcaaaggaggaaccggaatgcttccttctatcgctcagccggttcggatcattaacccgccgcgaaagaaaccctttcaaatgtgcgtttgcaccatgacccgaaacgcagccgcggttttgagagagtgggtgatgtatcacgccggaattggcgttcaacggtggttcatctatgacaacaacagcgacgacgatatcatcgccgagatcgagaatctcgaaagacgtggttacaacatctctagacatttctggccgtggattaaaactcaggaagccggattctctaattgcgcgatccgtgcaaagagcgattgcgattggattgcgtttatcgacgtcgacgagttcttctacatcccatccggtgaaactctaacttccgtcatcagaaattacacaaccaccgactcaatcggtgaaattcgaacaccttgccacagtttcgggccatcgggtttgagatctcggcctcggagtggagtcacgtcgggatacacttgccgtgtggtgttaccggagagacacaagagcataatccggccggaagcgatgaacgcgacgctgataaacgttgttcaccattttcacctcagagatggattcacgtttgctgacatggataaggatataatggtaatcaaccactacaagtatcaggtgtgggaggttttcaaagagaagttttatcggcgagtcgcgacgtacgtagcggattggcaaaacgaagagaatgtcgggtcaagagatcgagcacccggtttaggaacccgacccgttgaaccatctgattgggctgagagattctgtgaggttaatgatacggggcttagagatcaagtgtttgagaagttcaaagacaaaaaaacgcagcgtttagtttgggaaaaagcggaagaagacgacaatgttagatttaaaaagggctcttcggcccatcatagaatagctcgaaagattaaaaaacagattaataataaagcccattagccataattttgctctctttttagttttgaatttctacagtggaactttttgccagtgtcggaatttttttttcttgtaatttttggtcgattagtgatgtaaataaggaaaatcaaatctttaccaaacaaaaaaaaaaggaaaattatgaaaaacatttcaatcaattggcccaacaaaggcccatttacaaattaagatttttaaaaagattccgaccgttggggaaatagtatctttcacatttttttctctcttttcggggagcgttctctgaaatctctcaaaccctagatccagagaatg

SEQ ID NO: 2350 - DNA, 3000 bp, Unknown
  misc_feature (1)..( 3000): cDNA_ID_2048133_gDNA_ID_1620524_Annot_ID_159540 3000 nt of promoter + ATG
aactatgtttagaatatggttagggtatttttaactagttgtttaaagagccgtctttaagtattttaagacgactaaaaataaaaaggctgttttacacatattgataataaattattatttatgattaaactaaatataaaactggatatagtttaaacattctaaaaaggaaattgttaaaattagcgtttctagtgactcaaaccttagtgttgaagattatttagaaccagcctttaccactagactacctaacaaatacaaaattataaagctgaaattgtttttatagtatttgcggccgcaagtttgggtttggcacgcttgtgcttgtgaccggtttgtaagtgtatgtgagaagtgaaagctatataaaatcatatgtatttaaacgtatttagagcatctccaatgaaaagagttcctcataggatctctctatttttttaagtataaatttcaaaaaaagttaaaaagagagctttagtatttttaaaaaaaattcatactccagtcaaagtttctcttagtggggttctcagaaaaaaatatattattttaaaatttttttatttaataagacttaataattattgtaattcataacatattaaacatacattattttgaaatatttttttaaaatagatgtgcaaaaacaaaattgaatatattatcaaattgttgatcgagtaattgatcaaaactttactctatgacatcgtaaaatggaatacgggacgaaaaagccatatcgtttgatagcttgtggtagaaaaagaaaaaaaaaattaaagaatgaaaacaaaaaaatctctttattttttgttaaaaatatgcgtccaatcacaagacgacaagtgtcagactctattaaattctcaaagctctctagagagagtcaatgctctcaattataatgagtttagaaatatttttttgaaataagtgagagagaattcatcaaaaaaataaaaattgaatagaactccccattgttgatattatggttctcttcttgttgttgttgatttagactataatttgtaacgctatacctaatatatgtgttgctccccattgttgtccttaaggagatgctatatacatatagatactagccatgcaaggatcattagaaaatgaatgtgattaaattacaaatagacccttcgaacaatgagaatctcatggttattgttataatgactaaagattacataaacataaataacacaaactaaacatttgtaacaacatcaaatatcctaacctccgtactatgcacgaatttaacgtgtgaaaaatcgggccggagaacaaactgttttaaaataaacccaaaaattgaaatatgaaacgtataatataatcttaaatgtagtatgaaatctccaagaaaatactagtaatattcaatcatatgaagaaaagccatgcaacggctgcgagaacagagcccgagacagagatcacaagcgatgaggctcctgccgcaggagccgaagcttcagggccgtcactggcgccagttccgtcatcggaagatggagacatttctggagtcggagctggcggagaggaggcggtaggtgcgtcagaggagctggtaggaccttcggaagaatcaccggagcttgagtcagggcttgaagccggagttttggctgatgatgactttggagatggggaagatggggaagggcttggagttccggtggaatttttcttggccatggttggagcagctgtaggcggtgaggttggggcggaggccgtgggtgattttggggatgctgcggcggcgggagaaggagaggtagagttcttttcgccgttggctttcggtgcgtttgccggtgttggaggatcggcggccaagacggcggtgatggccaaggcagccacggcgagagataggagtttaagtgtcattgtcattttgtggtgaatgtgaattgcttttgtggtgattaattatgtatttttgtggtttatgattagtgctaaaaaagattaaaaagaagaaaagagttatttttgagagattaaggaagaggtaaaatttaatttatagggaattctacagatttgaccaaagttttggttgaccgggtccatcggaacttgtcttaaaattttattggtttgatcttttgttagtaaaaagagaacatgtggtaatgataattcccaactttcaagaaacaattgagaacacgtgactattgagattgattttgtggtaactaaatgagcactgtttcaacaaaagttaattttaatttaagctatacaaaatactaagaattaaaacttgattaacgtaccagttagtcaataactcaatattaagtggaagttcaattgttcaatacaaattcatacacgtaactgaagaagcacatttaaaagtcaacgaaacatttacatttcgtaaactaaaaataaataaatctactgcaatcttgtgaatgagtctaattagagatgagaaagtaaactgagcccaaaataaataaggcccatttaaaatgtaaggcccatgataatactcataagctttgtaatccacgacgcacgtgttccataatggctaacataaaaacggcaagcagtctacttttttgtcgttatcactttttaacccttttcggcttctatccgtcgattcaaatcggcggcagttcccagcgacattaatctccggcgagacagtttactcggtgagtttcgcggctacatagtttttttgaacttccttgaattgttcattatttcgggatataaacggaatttgcttttccccgatcgtcgtatcactgtagagaaaccgatacttgattggttcttcgctatttttctctattttgatatgcaattcgatttcacactctcaaattcataatcctagtttgtatagtactctatctcgtgaaattgtctgcttttatcgattaaggcgttgttgcgtacattgcagtgtttattgaagct

SEQ ID NO: 2351 - DNA, 3000 bp, Unknown
  misc_feature (1)..( 3000): cDNA_ID_3067227_gDNA_ID_1620524_Annot_ID_159542 3000 nt of promoter + ATG
aatcattgcatagcatctggcagagatttcaacgataaggttatcgtcaaccttgatcaggcggtaagacacaatccgtagttaattgattctctggttccgatgagtattaatggaaaactaacagcatttcaaccaaactgtgttttcttcaggacaaggtcatgttatggagattgcatttctatgtaggagcagtcaagaggcccagaagctcgctccctagctaactttggctgtatatatatggactgggatgttgagatggtgtgatgggctaaaccggtttaatatatttcctactttttttgttttcctgattagtccggttaagccgtgtagtagttggtcttacatggacggttaacaaatgaaaatcggttctgatttggtaagactttgtccttcgtcccatgaagatttctctaacaaaaaatcattgaccacatcatgacatgaatccaaagaaaacacatagtttgctaatgtgtctgttagacgattaatctctttagatagtgtgtatcaatttcattatttttgttttaatcgtctgtcattgtatcagtttcggttagaaactaagatagggaaaatatttctcgtcctataagatgttttacctaagcacaaaaaatcattaaaacggtattcaagacttttaaataaatcaaacaaaaacaaattttgatttcaaagtaaaacgaaaaaaaaaatcgtaacatgaaaaaaaaagatatttttattttattttatttggaaataaaatctgaataattattttatgacagtcaataaaaagctatgaaatatttctagagctttactaatgggggaagtttgaactagctgcttgatattaatataataatttgattatcaacaaaaaagttatatttaagaattaagattgatatatgttaaacttttggtaattttgttctaaaaccaatattctttggttgacttgactattttattaatatattagtataaattgagaatgtgaatctcctttccaaactattcttataggttttctatatatataatttcctacatagcatctaacagatccccgaaaaaagatctcaactacatacaataccaacccacaacaaaaatttgctttttcgatcttctcaaaaatgaaactaaaacaaaccaaagtgatgtttttcttgttagtcctaatctctgcattaatattgcaacaatcgaaagctcagaaaaattattgttcgagaaccaacatagactatataccgggatgtttccatgcgttgcaattagcgtataacaaagattatagtctcctaacaagaaattgttgcagagcagtgttttcacttcctactacttgtgccttgcttgtctatcctggcaaaacttaccctattactacctttagattaatttgtatttatagcgatcctcttccagcaatgtctccattaagtctataagttttgtttatctcttaataataatataataataaaaatcatatttacattataattttttaactttgttcaagttacacataaaatccctaactctctatacgtgttgaatgtttgaggtctcatatttatcttactctttcggttttcaaaaggatatcaacataaatgtaaatatgtaatcattcctcatttgttggaaattaatttataaattttgatttcaaaaatcaactaatccatttgtaaactatgtaaaatatttatcaattatattattatttttgccaccttagaaatatatgttaacatttgtgtagttaaaagaaatccccaaattaaatcatgttttgactcacacttataatattatcggatttcataaataaatggataaaccatgtaaaagatgaaataacatacgataaaaaatgatcttagtcaaaacatatgaaagccgataataataatgacatttattggaaattcaagtctaaaaataaataataataataataacaacatacgagatgagatcgagataatatagtatataataaattaaatataaattactaataataatgacatttcttacaaattcaataagtgtttgtttttactcatgagtgtttttaacccatttatactcttatattttcataaataacctacttgttatcaccatattacaccagttaatatatttgtaaaattttgaaaaagattgtatatatcaatctctatacatgactcataaggttaacatttaacatcgtttaattgttttggaaggtagatttaaatccaccaacaattcaaggatgtgaagaatttttagatcaaatatatatttaaatgtacaagtgtttttttctaacaaaaaaaatttgaggtattgaacggatgggtaattttcgggtgtttttgccgtgttattgtagccgtcgattagttgggatgtatacttattgggcctaagaagcttaataccttaattgtacaatcggatggatatataaatgggctcaacaacaaggaaaaaggcccatttaaacctaagagttcaagctctatttgtagaaagaccaaagtatccctagatgtttaagtatgtcctctgtgtctctaaaggttaattggggaagaagaaaactctccttctttttgtaacttttgcttcacctctctcttcttctcttgttctattttttttcccgattcaagcaaaattcatcaaggtaaatttactcttcttctcaagctgagtttttttgaattgttggtatcttccttcatcactctcgcacttctcttcttgaagtctctcttgctcgattcgattctacggtttctctcgatccgagggtttttgattgaacttttattggtctctttgatattgaagaaattattcaaccctaatctcaaattgcttcagaagatttcgggaaactagtttattcttatgggtaatcgttttgatgctaaagtacttaactttttgtgattgtagacttgtcaatttgaaaaa

SEQ ID NO: 2352 - DNA, 3000 bp, Unknown
  misc_feature (1)..( 3000): cDNA_ID_3067231_gDNA_ID_1620524_Annot_ID_159535 3000 nt of promoter + ATG
ttaaaataattatagtcaaatttgttatcaaatttttaaaaaacaaaatattcaaaaatatttcgtataaaaattccgaataaatattaatatcttcgtttgcaatatccaaaaaaatatgttcctttgtaatttagtgtagagagatcatttgagtatatttgaagcaaaaagagctgttatgttttaatacaactggcactttattattaaaataaaatggagtttaatgattgcacacttgttgattctgtttgtgacaaaagaaaattgattcattatcaaatgattcttctttttgtcattttataatgttttgagacgagggaatgaatggttgttttataatgcttaaaatccatacggcagattaattcgttttatatacacaaatggcagaaattattacaactagctgtgtctcgtgttgtctagcaataatccgctgtgatattcgtctttttctatccaccatgcacggttgttattacttttaaattaatgataaaaaaaggagaagataaaataagattgttacgttcgcaataaaatgattgaaatttgtaaacctgtttattaatccgatatacataaaatctcaagctaatcatatttgaatactaagtgtcgcagtagtatttgatcacatatagtctgcagtgcgcaaggatgaaatatatggttaaaaccaagtattcatggtgtttaacttttatttcccaaaattaaattcaaaaaagtgtagtataatactatcgatgatcgtgtgaaatgttttcccataactgctggaggcccggttcatattttattttagctctatgctaaaattaaaacttaagcccatatatacttgatagattatctttaacaaatcacgtgatatcctgacatggcaaatggcactataaaccactattaattgcttccaataaataatagaaaaaaaatctagggttttcgcttagattcgcaatcgcatttgtatttgatttgcttcaatagtgcgacacaaataataacgtttgtgatctatgttttaaaacgaatagaaagaatattgcattttgtgtgtgtgtgtgtgtatgtgtgtctactgtgtcatatgtaacgaatagaaggaaatttgcatgtctagttcttatatctagtcatatgtaaggaatcatgttaattttgatcacaaaaacgccgatttattactttgacaacacgattgtggtgtggaaaaaaaagaaaagaaaaaccgtttgtgggtgggggcaaattttgggagaaaattttgtgaagtgttttctgaactttttatacccacccgactttagattttcggaatatttcggggagggtttcatctttcagttgtcatattatggggtcttattttcgatatccatcttcactattgagaaaacattgtggctcatcgaaaactcttcggggcagtagaaatacgtacataaaatttatgttaaagtaagagtagcaagccaatctagttcaaaagaatgatctaatttgaaaatggggatgtgattatatattaccaatcattgttttacttgtataatatgatttatgatcatttgagagacatgggagctacgccgcataagattgtgttgaatatctattcaggatatatgaagttgtcgtggaggtgatacggaatataaatatgattctagcttagtgtaccaaagtttttaaaactccaaatcacgaaccatataatctagaatatagacgtttggataatcatttcttgtcatgtggtttggcagagatttctcttttccgaaggcaaataggggtcataaatcaaatcattcatttggttgagatgaaaaatgaagaagagcatgtagtttttgtgaatggtcaaactattagtatcgaaaaaggaaacggttgaggaaaaagaatggcttcacgagatggacaaggtagaatctttataggctattagtgtggttccccaataatcaaagacgattcagaagtggtcacaaaggattgctaaaatagaaaagaaaagaaaaaatgcttttatgttttttcattgttggaaggtagatagaagaacaataacttggaatgtggagaaagcgtatcgaacggaacagatcaagcatatcaggcggatcaaacgtatcaggcggatcaagcagctttttagaaaagacgttaaatgatggaaaaaataaccaaaaaagattgtgaggaagctaatgaagaagtttattggagacataaagtatgacaaatggaaaaagactccaatttttttcattcagcttctaaaagacgtgaacaaaaaatcgaatatttggtttaacagaatcatggtaaaaatagagatgaatataatattatggtgttacaatatgtttaggatcatttcacaagcaaaacatatgatgtaatcataaaacatatgatgtcacaaacaaatagttccttggatctgaaaatgcaagaaaaacacaacagcaagaaacgacatcgttctcaatgtcaaaaaggttgacattaggcagtcacttttgactaccatgctcaatcaacggttagtaggtttaacttttacatagacattcatcatttcgtttaaacacacaaaaatggttatgtgattttgtatctttgaatgcacgtgaggaagaaaactgaaaaaactacgaaaacggcatcgttcgaggtcaataaggttgactttaagcaaatacttttgacaactaaacccaattaacggtttcacaacattaaccgtatgttaatcacctgaaattacgataatgtaggtcccatagtaaatttaataaaaactatataatatctcacaatactaatttaaaataaatcacgccttcactcccggaactctcctcttcctctttaaatactttccgacaatagcaagcttcaacaaaaaaaaaaacgaaccaaaaacttcctctctcttttataatatctttctctcaatctatgtttagaaga

SEQ ID NO: 2353 - DNA, 3000 bp, Unknown
  misc_feature (1)..( 3000): cDNA_ID_3067247_gDNA_ID_1620524_Annot_ID_159527 3000 nt of promoter + ATG
taaaattcgaagtttattgaattagttaggccgtcgacgacgtcgtttattttttttttgcaataaccaatgcattcttatttcttaattattattttttcattatattttcatgcattcttaatttctagtgcaagaaaaagtggaaacgaatataccaaacattggagaaaattaaatgaaatatgtaaatctctaaaatctctaatcggttatacctcttacttcatctacttatttccaccaaactcacaaatgaaaaataattaaaatacaatttaaaatattatctccattttttttatatttgatgtttaaagttttatacaatgtttgctatagtgtatagtggaaaagaatatagcaaacattggacaaaattaaatgaaaaatgtaacgagtgaagttttctcatcacatcacatcacatgtttgcacgtgagttacattcggttcgtaaaatctactccattaggcgtggttatgaaaccacgaatattttgcaaaacgaatagactaaaaatataacaaacaaaatgactttttctaaccttgaagtctccttaatttcttatattataaggttaataataaacaaatatctcagtaattgtttatactaatagtgtacacatcaaactctatgtaattattttttttgctttcgatttcaagactttcattgtcatcaaatcgttttcgtatgtaaatattaatatttgagctatcagacattttctacacataaccttcttggatataaataacaaattttttgtcaacgcatatctttagttttttctttcttttagctatttataagtatatagtaagtgggaagaaatagtgtagctttctttgatggttgaattgttatgtatggtactactaactacgaagagacagattacttgcaacttaaatctgttttgttttgtgtgtgttacaaaatactcttaatcggttatacacaccaacgttgatacctcttacttcatctacttatcatcaccaccaaactaaccaacgaattttaaaactgtagattttattacacttacattgatttaattagaacagtatttgataatcgtaacaattttattacagcattttttgaagacaactaactctcaattttgttttcctgaaaatgcagtattttttttttatttttttactaaaatgtagtatcgtttgcttacgatatcttaaacttaaggttaattagctaatttatttatctttccaagacaatatgaaattactaactttaattgtgagttcttgagatacaaaatcttgacaaaaaacttcttggaaacaaccattttaaatcgctttgtccaaactccaaagcattgtaataccaaatatcaataaaactaaagaatcatcaaaatttgtccaaaaaaaaaagaaccatcaaattgttagtaattcaacttttattgatacaaatatcctattgtttttgcaatagtacaaaagtttacttaatgattgctataaatctaatacaaaattgtgaaatatattaaacggaattagatagtgtgtgatcgcggatattatttagaaattaaacgtttttgttattaaacaaatttaagccagcagcgttacacattttaaagtgactaaatgtgataattttattaaaaaccactactatttttaattgattttttattttaatcatcgatttttgttgaatgaactaaatttattttactctttagtgatttgatggaacccctaatttttttggcagatgatttagcgacgtgactaatttgataatgtcgacaaaagataacaattaaattaagaaatcaacaaaatcgtatagtaaaaaagaaggaattgtaatttatgctggtgggtaaaatatttgtaataagctcttatttcttcaagtttcaacaatttggtaaatataaaacaatgatctagacgttttggacgatactaataacaaaacaaaacatgatgctgtaatatttttttctacaatcatatcaaatctgtccattttcattacatttcctaaactttattttttaaatcagatatttaataagttactttttttcgcattatttttccacacttgagaaaacacttttatgttgtttattggtctatatatatttgaaaatcctcaaatataatagatcaattaaaacttatttccgtaacatcttcgaataacctaaataaaataaaataaaaattggctgacaaaaaaaaatccaaaaaaaaaatctataaaggtatatattgtcttaaagacattttaataacaaagtcctcattacaatatttataagtaacgtttttcatttacaaagaaattctggattaataattaattaaagtaattatcccattgatttttctctttagttaaataacattccaaatatagcttataaaaaaaacgtttcataaatcaaacaccaagtttccagaatttctcagtttttttccttccccacaagaaaaaaaaaaacaaaactttcttttattttcctttcgcttcaattctcaaccacttcaatttcaacgaaccacatcatcgtaaaaaaaaatcatttcttcccagttcttataatttcattcctatcctcaaaaaaactctgaattatttatttttttcttcaaattagtatttgtgtgtttgattttatcttgttcatctcctagttcgtgggacccagattctaaatatattcttttgagatcttctttttcccccaccacatgtgtttagcttcttgagagaaataatctcacttcttttcaacgacacaacacagaaactattttttcctttcgaattttgaatcccatagacgttacgttgacgagaaatacactctcatcagaaaatcaaaaaaaattctcatcctcagaaaataaaataaaagcttcaacttttttctgggtttttttttttagaatttggttttgtgtttttgatcttgaggttgtaaa

SEQ ID NO: 2354 - DNA, 3000 bp, Unknown
  misc_feature (1)..( 3000): cDNA_ID_2106946_gDNA_ID_1620525_Annot_ID_159556 3000 nt of promoter + ATG
agtctcgcgattgctatctcaatatgtacgcggagaagaaacctgacaaggttgatcctaatgagcagaggctctccaaatggttgaattgtgctttgtctaacgagcctttggctgagccgtgcgtgattgatctccttgggaatttgttcaataaagaagttttggtgcacgctttgttgtctaagaggttgcctaaacaattctcgtacattaagggtttgaaagatatggtgaatattaagcttacgcctgttgctggttctgatggttcatcgcaagatacgactagtgcacagtttcagtgtccggtctcagggcttgaattcaatggaaagtacaagtttttcgctttgaggggatgtggacatgtgatgagcgcaaaggcgttgaaggaagtgaagtcttcttcttgtttggtgtgtcatgcggatgtcaaagattctgataagattgtgatcaatggtactgaggaggaagtagatttgttgagggagaggatggaggaggagaaagctaagctgagagagaagaaaggtgtctcaaagaagagtaagaacggtgctgctgtggtggctgatacaggtgcgaaggtcgcaaagagacagatagaggatgggaatgtcaatggcaatggtataactgtgaagaaattcaaggcggcggataaagtgccggttaatgctactaaggaagtctatgcttctctctttacttcctctaagaagaagtctgatttcagggagacttactcttgcaggtcacttcctctcggcaggaattgatttgttggatcaatgttgtttacctgctcgcttcatttgctctgtaatctgttttgattatattgatatatcaacttgcttttgtaatttcgcctactggataatataatgtttttcttttccttttgcaattggtaaaaacagtaaacatgtttgcatccactatgctaaaactagtaaaagtgttgtatcataagctgcaattgtaacaagaggatatgtatgttgtttacatcaatgcacgggtcaatggctttgcagctcaattcaaaatgttatatagtcatccaaaaacagatagcagatttgcacaagcagttcacataaagccaatagtttccagatcgtggaaactcgtgaccatagtactctcattggcttagccgtgcctctctcttaagcacctgtgcggcatagaagtaaaacaactgtcaagaattaagtttttcccacaaatctagatgaggaaaagagatgaatgtaggcattaacctcatcagcaaacttgatcaaaatagtagttcgaggacgttgttgtccttcaatgggtacaaaatgagccgttaccacagcaggaaaccctgcgttatccagaactccctacatagaggaaaccgtgtcaggctcattatcttcttcctctaccaattaaatttgaaccctattcgtgaatatgtcaagggagcactcaccttcactatgccagcaacaaacgctccgcagttgaatgttcccatgtcttttggaatcgaaatgaacctacactttcacatttgttatcagttttcttgaccttaaaaaaattacattatctcagagtgtttatggaaagagctggagcagtataaacctgttaacaagaagctccttttcactgatcatgtactcatcttcatgttctgttcctttttcaagtgaatcagcaacctatggcatgttcgttaagtgtgagttagaatccaggaacaggcatgtcgatagaaacactcaacaactaattgaatttgaaatcgccactcacctttccaaacaacactttccacacagtactgtgaacgaaagacagaattcccagtaaccgtgtctctcttctgtttccctgaaacaatgaaacaatatatccataagacatgattgaactctgcattgctcttccatgaacaaaactagaagtatggaaacgttcttttttttttccagtttttgaggcaaaacacacaagtaagaatatcagattgcaaaaataagatgtaccttttcccggttgcaaagaagctctagaactcgagatccaactgcatacccagcatcctctagtctgagagtcatcataaaagaaaacacattgttaaggatggaatgtaaatgaattagactaataaaaaaaaatcatatgtatttctaagaatccaatcagctcaccttctttcaagttcagctatattgtcaacctgggtttgattgtactgaacgagctccgagaataagaaagcaaatgcggtcaagctcacctacaacacaagtacagttccaaaacgactaaccaatcagcagatgctcgaaatcgaatgatcacaataaagagatcaaagaagaagaagatcaaaacccgagagatttgaaatcgaaccctcccacaactattagatccggatccaaattgaacaatgttctcaatttccatacttagttcagtgtaaaagtttctgaggaaagctccgaaattggaagagaaaagtggatctacgtagcgaaaacgtacctcttgcttgcctttgctgagaggcttgtcaaggacgttggagtactgtttcattttcccgactccgatcatattcttcggttttccggtgagaacgagcttcccagaaccagaaccctaaacacagaacctttcttagttttccggtgaaagaatctgaagatgcttttgtttattgcaacctggtttgtcttttggttcgatgaaagtacaaaaaaagagtttatttacatttttgttaatattaatttttactttttcactaatcctaattggggtagaaaaaaaaaggggtaaataagtgtataaataagaccctagcgatgataaaaagaagccgagacttgttgagaagaagcccttaaagcttcaccgtctctctctctctctttctcgtgagcttcaattcgaatcggccgttcttcttcttcttcctccaatctctttactcca

SEQ ID NO: 2355 - DNA, 3000 bp, Unknown
  misc_feature (1)..( 3000): cDNA_ID_2157479_gDNA_ID_1620525_Annot_ID_159566 3000 nt of promoter + ATG
ttaaggttcgagaaaaaaacgttcatctcaattttagacagaaaaaacatacaatgggattatcagggagacgaggatcactgatgacgaaattcttctctatgcgctcaagagtggtagctagatcaatcccttggcgtatatccctttctctatccgataggtcccaactgtccctctgccctattacttctgtgctcaacatcaattcttcgggttccatacgtaaaagatcttcatgcctgttattcgagcttttgagctttgacctgcacattacacgaagctagatcagaaatccttgagtgtatatgtatacatatatatacacagcttcagaattcactacccaatccatgtcagaggatacattctaaggcccagcacaaagttacaaaagtacacgagaaataagaaacagaacaatagtaggagattgcaactgcatcttcgtattcgaatggaaattatctatgagttaaatattgactaacacaacaactagattgagattgtgtagtatatattttaccactatttggcaatgataatagcaagttgtttctgcaaaactttggcactgccatcacactttttgggcaatatatatgccttattttatgttcaggaagactactgtaatctggtggttagtggttacgaagactcaccccgttggagtagaaacacgtccaggtgtcctgaaagactttgaagcctcatctgactgtcttgtttgtctaccaggtgtaggtgtagtagaactatcaggctttaccatagtgtcattgctcacggattcctgaacttgagacttacgatgtcttatagtttgcacaacctctgtgatggaatccaaagctttctccttctggcgagctgatatcatcatcaaaaccattacatgttaaagattgtggatcagcactctttgctaaattatatcattgtttttggctaaaaaaaacttgttgaattaacgaagagatgcaaaaaaacagataccatcatatcgaatcaaggatttggagagtccattaggcctcaatgctttatcatttaccccttctgtgtatttgctaacttcaacctgcatcctgcagatggaaatgtgaaaatgattgatcgagggacagtcgattaattagggaaaaacagggaggaattaagggacgtacccaatgaacttgatggtattgccctggtcgtccttgataggagtgactgtgagaagattccagaagggagttccgtcctttttgtagtttaacagccttccacagtaactttttccattcttgacacaatctctgattttggcaacctcattcttgtcggtgtctggcccttgcagaaaccggctggcgttttacccacaaagattaagagcatttcagagtaagttggcatgggtttcaaaagcaatattattctaactaataactgggaatgaaactagaagcaagatacgagatgagcagtaccagtttcttccaacaatttccttggaagaataaccagtcatggtaaagaatccactgctggcatagactatgggacagtgaggctgtgtagcgtcagagacaacaaaagtctgctgcaacgtggatagagcagttttgagctcctgggatactctagggaaggcccctgattcagaagatgtagattcttcggatgacctcctagacatgttcttgcttcgttccacttcactggacagcttgaaactaatgccatcgtctcccgaatccggcttaacagctgacaatccccattcagcggttctttctgtaatcttagcggaatcttgaaactccatccacttactactactacctttgttgttgccatcaagaggaggctttgaagaagaagaagttgatccatgtgtctcttttccactcgaagggttgaaaatctcaagagatctacgttcacttaatgactccgcatcattcaaaggagatggaggggctcttggcctctccataacgtttctttattctctttcttatggcgaaacagagtaatgaatagtctgcaaatcaaaaccagacaccacatagacaagttagatagaaagaagaggcagacacaactgtaggttcgagaaacaaagtaataaatgccattaaaagtctttagaagcaaatcaacaaaacacgttaaagaaggtgaagtagataaaataaatgaaaaatatatatataccaaccagagtagctttatcagctgcaactcatggaaatatagtacacagtctttaaaaggagcaaagacgatgagaaagatagagagatagaccaattaaaaaacacaactgtactgtttccaaaacccagttatattattatttgagttattttaaaaagacaatcatgtttctgaggctgcaaatgagcgatgcggaagcctgggaggatagacatcgctatcaataatcaaactcacatggaccctttttcaccctcaaggtcaaggaccacacaactctgtttcctcttaatacgtgcactcttgttcatcattccctcttctttcacaaattttcttcataatcaaacgaatttattacacccctcacatcaatttttccagtacaataattcagacatgtttcaatgtaaaatgaataaacaataaatagataaaacccagtaaacttacgattgtagtagaacagaacatgcgccatgatttgattagacgaaaaatgaacacgtttaagaaaatgactgtggcttcttctctcccagatgctttcgcagacgacgaatccacaatttgtttcttctttcactgtctgtttcaaataatgtcgatgaaattaaagagaagggacccctaaaaacttgttaggccttattattttcccgctaaaagcccattaagtcctagtgggtcttctctaatgggccttattagttaagattaagaagtaaggaaagtgagggagaggcgagggaaaactgaatccaactgaagcaagcagcaatg

SEQ ID NO: 2356 - DNA, 3000 bp, Unknown
  misc_feature (1)..( 3000): cDNA_ID_2157465_gDNA_ID_1620525_Annot_ID_159561 3000 nt of promoter + ATG
acctgcaaaaccttactctgaatgagttcggctgcatctttaccaagagatagctgttccaacttgttaagagcatcctggcatgcattaaaccactcagcctgaaagcaagacaacaatcaacactgtaaaacacaatagccaacactgtaagatataataaacaccagatactcgaagcataacagctctggttctctaatgtaagtatagtcattgcaacacactgcggaactaaacacattgccaaaatcaacaactgccatatcttacaaacattgaggttaatcaatggaataataaaacttgaacataagagtggctaaaataactaaccgtatcagtctcctctgcatttgtccaggaaaatttcagcattggatgtctgtcgtacaatggcttcctcaccatatcaaatgctacaacatactcgcagcaggtttcatataagaaaactggaatgtacataatcaatggagacatatcattgttattttccattctgtacctaaaatattttctgacggttttccagactgaagaagattttttagtatttccttgttctgcgagaaatagtaagagtaatatgaacttggtaaaaacatagaagcacttaacagcgaacttaaccaagagatcactccaaggacattcttcttttttagtgaggattgtttatgatgtaattgctttcaagcatgaaaagattgacatacctctttcagataagatatctctgactctgaaaaccctctcctgcaaaatccttttataagtctagtatgttcctcgactgtattacaataagatgatcatatagacagcaggtgctcaccggtatccatatttggcttttttgttatcgtgcttgggattcaaaataaaaaggttgtatgcatcctcgagatgaaaatattcgacaaggctagtgaaaatgaattccatcatctcagcatccacttgcagtagagcactttcctcatctctgttaccataaaacgagatagtttaatatagaaccaacacaaaaaataagaatcaggacaccacttaaaaaagttggaagcaggtagcatgagtgacataaagttactagaaccaagtggtctgcaggctcagatatcgctgcatataaattgacagaaatggacgtccatacgacataaactgaagcaaaaaaaaggtctttgtaatgcattacttattggtagccacatcatctttgcgagctaaaactttgattgcgtgttcaattactgatgtcaccttttctcccatttgtatagcatgaacagaaaagctgacaaagggaaacaaatgcccaattaaactttacttaaagccaacaccaccgtgaatgaaccaccaggaaaaaagttaagaaaaagatgactgtacttgtagttcacgcgactgatgataggaagatggtgctgcacctccttttcaatgttaatcttgtaaaagggattgagaacttctttgatttgtggaactcgtgtatgttcaaacatgtgatcaagtttattaaaccaacgctcaagttcctcgggacggagtttgaagtctggaaagtgtgtggaaaaagttacggacaaaagagaaagtcaagtgatagctccaattcaaataaaagcaagacaggcagaagttattcaccttggttcccttttccttcaaaccctatgaagataaaattaactggcactggaagatagacagaatcgacttccataagctctaagtaactcgcaatatttcctgaaaggatgcaatccaaatcagaacgtggtgttgcgaattgagctagtaagtcctttagccattcacagaaacgaaaggcaattacttacctgacttagtgtaattcagcacaccagaattcgagtgaacggaagactccaaatcatcaaaatctgataacagcacgaaaaattgtgatgcaaatgaagacataggaaatccaaaagcaaagagaggcctggaaacagaacacataccagtacgaaaaacagactcgctccaaaatctgcttttatccctaagattgaacaaggaaaacacagaagacttcgccgtcttccggttcccttgtgaagctccatacgatagagatggtatgaactaagccacgaaatcaatcaaacaaattacgcaaactcaattgagaaagagaaaggtgagtttaaaaacaaaagcattaacagataacatcgcagctcatcatcaattttcaaatttggttttgatcaaatactaatcttgcgacagatcgaacgaagggatcgtaccaggatagctacacaaatggtgagtacgagcttggaaacggatctgttcccagccccgaatctccgcatcgtcttcttcttcttcttctcctagtagtcgataaatcgcagtagggttttgctctctcgtccagcaaaaattcccacactggccactgtgctcgttttttcttgtctttccacagatttctttttccggccttcgattagccaatattttcttaccgtctcaagttctcaaccaaaaaaaaaaaagtcttactgattgattattttcaatgaatttaaataacattgactaatataataaactgattgattattttcaagaaatgggcttgcgatacaaaagcccaccttatccgtaatgactctatgagagcactaaagagacaatataaactgattgattattttcaagatatgggcctgtgatacaaaagcccacattatccgtaatgacttttgagaagaccgaactaaaacagtttagactttaaagacatcgtttgacgcgtagcttacgtgtcattttttgtcgttatggggttgccaaaaagcagcggcactcgctcgtgcgtggccgctttaaaacccactggtctggaggaaatagtaccagctaagctcgcagctcaaagctcagtgtttaataattgtatagcttttttggtgaacgaagagtcagatcggcgagcctgagatg

SEQ ID NO: 2357 - DNA, 3000 bp, Unknown
  misc_feature (1)..( 3000): cDNA_ID_2157469_gDNA_ID_1620525_Annot_ID_159563 3000 nt of promoter + ATG
tccaaactcagtcactgattccaattaaccagctagtacagtacaaatgtgaaaccctaataaaggaaagaaacagaggaagtacctgatgttgacgttgtcggtggagatgtgagtagagacatttttagcaacccatttctcagcagctttcaggctagaggcgagagtcgcaagcatctcattgggaataccaaccatgacttcgattccggatttgcccaaagctctgagagtgtcgtattcggcgtcaaagagctttactttctgaataccattctctcttagcatccgcacaactatgtccggtggaagtgggtgcgacgcctgtgtgccccagttagctccgattgaacttgccctctgacaaagaagagccaccgccagtaatagcaacaccgaaccccaacccatctcaggctcgccgatctgactcttcgttcaccaaaaaagctatacaattattaaacactgagctttgagctgcgagcttagctggtactatttcctccagaccagtgggttttaaagcggccacgcacgagcgagtgccgctgctttttggcaaccccataacgacaaaaaatgacacgtaagctacgcgtcaaacgatgtctttaaagtctaaactgttttagttcggtcttctcaaaagtcattacggataatgtgggcttttgtatcacaggcccatatcttgaaaataatcaatcagtttatattgtctctttagtgctctcatagagtcattacggataaggtgggcttttgtatcgcaagcccatttcttgaaaataatcaatcagtttattatattagtcaatgttatttaaattcattgaaaataatcaatcagtaagacttttttttttttggttgagaacttgagacggtaagaaaatattggctaatcgaaggccggaaaaagaaatctgtggaaagacaagaaaaaacgagcacagtggccagtgtgggaatttttgctggacgagagagcaaaaccctactgcgatttatcgactactaggagaagaagaagaagaagacgatgcggagattcggggctgggaacagatccgtttccaagctcgtactcaccatttgtgtagctatcctggtacgatcccttcgttcgatctgtcgcaagattagtatttgatcaaaaccaaatttgaaaattgatgatgagctgcgatgttatctgttaatgcttttgtttttaaactcacctttctctttctcaattgagtttgcgtaatttgtttgattgatttcgtggcttagttcataccatctctatcgtatggagcttcacaagggaaccggaagacggcgaagtcttctgtgttttccttgttcaatcttagggataaaagcagattttggagcgagtctgtttttcgtactggtatgtgttctgtttccaggcctctctttgcttttggatttcctatgtcttcatttgcatcacaatttttcgtgctgttatcagattttgatgatttggagtcttccgttcactcgaattctggtgtgctgaattacactaagtcaggtaagtaattgcctttcgtttctgtgaatggctaaaggacttactagctcaattcgcaacaccacgttctgatttggattgcatcctttcaggaaatattgcgagttacttagagcttatggaagtcgattctgtctatcttccagtgccagttaattttatcttcatagggtttgaaggaaaagggaaccaaggtgaataacttctgcctgtcttgcttttatttgaattggagctatcacttgactttctcttttgtccgtaactttttccacacactttccagacttcaaactccgtcccgaggaacttgagcgttggtttaataaacttgatcacatgtttgaacatacacgagttccacaaatcaaagaagttctcaatcccttttacaagattaacattgaaaaggaggtgcagcaccatcttcctatcatcagtcgcgtgaactacaagtacagtcatctttttcttaacttttttcctggtggttcattcacggtggtgttggctttaagtaaagtttaattgggcatttgtttccctttgtcagcttttctgttcatgctatacaaatgggagaaaaggtgacatcagtaattgaacacgcaatcaaagttttagctcgcaaagatgatgtggctaccaataagtaatgcattacaaagaccttttttttgcttcagtttatgtcgtatggacgtccatttctgtcaatttatatgcagcgatatctgagcctgcagaccacttggttctagtaactttatgtcactcatgctacctgcttccaacttttttaagtggtgtcctgattcttattttttgtgttggttctatattaaactatctcgttttatggtaacagagatgaggaaagtgctctactgcaagtggatgctgagatgatggaattcattttcactagccttgtcgaatattttcatctcgaggatgcatacaacctttttattttgaatcccaagcacgataacaaaaaagccaaatatggataccggtgagcacctgctgtctatatgatcatcttattgtaatacagtcgaggaacatactagacttataaaaggattttgcaggagagggttttcagagtcagagatatcttatctgaaagaggtatgtcaatcttttcatgcttgaaagcaattacatcataaacaatcctcactaaaaaagaagaatgtccttggagtgatctcttggttaagttcgctgttaagtgcttctatgtttttaccaagttcatattactcttactatttctcgcagaacaaggaaatactaaaaaatcttcttcagtctggaaaaccgtcagaaaatattttaggtacagaatggaaaataacaatgatatgtctccattgattatgtacattccagttttcttatatgaaacctgctgcgagtatgttgtagcatttgat

SEQ ID NO: 2358 - DNA, 3000 bp, Unknown
  misc_feature (1)..( 3000): cDNA_ID_3594379_gDNA_ID_1620525_Annot_ID_159564 3000 nt of promoter + ATG
ttatgtaatttatgtttgagaatgaaataacattgctaccaatcagttttacttcatcctaccaataacattgcctacagtttttcaatctagtttctatatagatgctgaaaggaagtcgtcactctgtaattttattgatgtagaaagttcgacaaatcaaacagctaccggtggatctcaaggccctcatggatgggctttcttcgctgttgttaccttctcagaagcctttgttcagccagcatatgtatgcactgaaaggcttgatctttctaaccctctttgataaactgtatctcaaactatggttaaagcttgaaattagtagcttttcctggccccaaaaaagatagaaacgtatttattattcttaggtgatatttccccctctgattcttgtatgcaactccttgctatattgacgtgtcaataacaattgtgataggttaacactctctgaggatcctgcattggctatggctttttcagtggcacgaagggcagcagctgtccctctattacttgtcaatggaacttaccggaagactgttcgttcatatcttgattcatcaatcctccagtaccaattacagagggtgaacgatcacacttcccttaaaggttagctaacaacagtaaatctcgctctgttaagtagtttttaaaaaaaaactgtcaccattcatctcttttgttgtagcaccgttgtagtcatgaaagaagcctttccttgatgctaaactagaaagtagaaactatcttctaccagttttaagtgattttgtgttccttttgtctgctaaatttgtatattaatgtagagactatggctcacacatctatatagatgaataatgttgagaacttttctccgttttacatgtctttcaagttttcgtcctaaggtagtatgccgtggtaagaaaactgcataagttctgaactaccgtattatttactgtcctaaagtttgtgatatctttatactgttttcttcgtgtagacttgatccgtttgagcgattgcttttatcctactgctcagcatttcacttcagatgtctttattcacgtcctattcaaattttgtcaagttatttgctacttgatgtcatgcattggtgatgttgatataatatcatgattggcattaacgctgtaagtatccttgtatataactcaggaggtcatgcccacagcaggtccactcttgaaattcctatcttttggctcatcagtggtgatccgctactgattgacaagcattatcaagcaaaggcgctttcgaacatggttgttgttgttcagtcggaggcctcttcatgggagagccatttgcaatgcaacgggcgatcactattatgggatctgaggtaataacacgtatatgttagcagcttgttatgagcagaaattttatgatactttcctagttaaattttgctcgtcatgagggaattagagtagatgagtttttccttactccttcatttttataacataggagccccgtgaaagcagccatggcttctgttgctgaacatctagctggattgcttcctcttcatcttgtctacagtgtagctcatgaaagtgcaattgaggtatagaattatgcttagatgattctaaatagcactgctttgtagttccatgaatattatcctgttcctggtaactactgcaatcttgtgaatccagcacaaactctgattaaaactctccagataaagaagctgataatctgtcttaccatctcttaaaaattgtgtttcacaggactggacatggtcagtaggttgcaatcccttttccgtcacttctcaaggttggctcctttcacagtttcaatctgacacaattgcccggagctatatgattacagcgcttgaagaatcaatacaagctgtcaattctgggattcatcttttgcggctggagagaacgagtatccttgggagattttttatctctgttttatgcctacagaacagtagaggttttgaaatatgaagaaaatttattacctgctcatctttatttgctagtgttaatatccttgattcagaaacaagataaaaagacgtttaagctcttccaatcaagggaacgtgagctgatgaacaagtacaagtacgtggttagcctgtggagacgagtgagtacacacctctgttcctatagtttgatttatacggttatgaagcctatatgttactggaaggcttcaaatgatgtgtatactaaatgtttaacagctttcgaatgttgctggagaaacacgctatggggatgccatgagatttctgcataccttagaggaagctactagctcgtaagtacacacattttactcttgctacagtttttttaaaagaatgatttgctaatcaatcaggctttccattttatcagatttgtaagagaagtgaatgcaacagtgggtgttttgcacccaattcactgcacaaaagagaggaaggtgaaagtggaagtggacatgacaacaatacctgcctttatcatagtactgattttactttacgctgtcttaaggccaagagctcctaagccaaagatcaactgatgtcaaaagactcccccatacaaatttttttgtcactttctgagacagtaaagttcatcactcttctgtatctttacttgaacaagaattgttgtaatctaaacctgattcgttactgcaaattgcaactgtagaatttagcaaaagttagtacagtacttgaagagattaaaataagacaagaatgaaagaagctgtgtttgggtcaacagtgaacctgtgtttgggtcaacagtgggccctttaaagacaacaacatctttaagccacaaacaaagactcgaaagaaaataataaaataatttggatctgaggcaggaaacttccggagacatcggaggaaccctaaattgaatgagaagaggagagtgagacgggagagaaagccagagcgagcgatagagcaaagac

SEQ ID NO: 2359 - DNA, 3000 bp, Unknown
  misc_feature (1)..( 3000): cDNA_ID_4254289_gDNA_ID_1620525_Annot_ID_159558 3000 nt of promoter + ATG
ttgcttgtcgagtgtggaatttgtaagagcagacttgactacgtctacgactcctaagcctttcttcgaggctaaataagcagcattctgtcaacaaaaacagtgttagtggagcttccttgtgttagtcaaggagcatttggaagttaaatggcttgcctgaatgttgattaaaactccggtgactgcctttgctttgccgagctcaaggaagtccgcaagagtcgtgaacttcccggcgttcttgtttgcggggtttctctggaagcccgtggcagtgaaggggttttctatttgtgctgaagacaaagatatcccaatgctcagtgacttagttgagaataagattagtttaagaaatctatagaaaagaaatcagtttcttacgcttcacagactggatctcggcccatgtaagatcaaaagagaagattccgttggtaggctggatctcaggaacgctggtggctcgggacatgaaagtagtcctggcggtggtacttgctgagaggtctgcagcatcatggcagaaagcgattccgtctttggacatctgaacagagcagtcaattatgtctgctccatcgtcgattgctttctggtaagccagatcagtgcagcctggatagtctccgcttgctccattgtgagttataaccaatgcatgccctgctttggggagattgccgttttggtgagaaaagcaagctgcaagaaaacagacgctttagcttcttcttaataatcagctatctgaggaaacatatatagcaagtcatctcactgattgattgtgatgctgttggcgggaaatcggtgatgacaccatcaacagagaactggccattgtccacaaactggagatactcagcagagggatcatagctgtagttaaagctggtgcgcaagtcgttggcaaaccctgaagcatagacctctagaccggctttgtgagcatcagccacaaaagtggtggcgggcttaaggtacttagctgagtcaatgggccaaatgtagtctttgggcacaagaacgcctgaagcaaaggccttgatggctgcgaggttctgctgaatctcgctgtacttcttgttggtggtgggctcaactgcctcggggtctttgaactcaaatatgagctttgtcttggccctgcccgcgtccatcccgatgctcttcaagaaaccaatctctggagatgagatgacattaatgccgcggaatcgcaagcttctcaggtactcggctgggctcagcttgtgttccatgtagaaggcatcgtactgcacatttgcattgtttgttgttttgatgaatcaacaaaaaagctccatatgttggttaatcatgttctcaaagagaagaaaacatacctgaacgctcaaccagaacttgggaggcttggttccaaggacatcctccactgcagaaaccgacatttggccgtcgaagatgctaggccgagagaagatgttctggaccactgctcaataatacaaaacatgaaaatgtgtggtggtggtggtgagcattgaagggaggaaatgaaagagaagaagacatacgagtgactttgttgaatatggtgtcggcatcgtaatcaatgacaaaccagcccttgaggtcctgaccgttgaccttgtaggtcttctgggctttggggaagaccgaggagatggtggttgcattgtcaagtctgatatctgacaagcaaaggcccacaccgtccttagtcatctgaaggttgcacaacattgtgaagccaggcgagctggtgccaatagccaagtcgtttgcagagatgcttgactcagggaaaagacccgagaagccccctctggccacaacggcaggctcttgtcctggaagacaaaagacaggtacggattcttagaaacaaacaaacaacatggtatcttaagtcttaacattaaacaacaacaaaaaaaaaaacatggtagtatgcaatatgggcatactctgtaaaaggatgcttaccgttaagggtaagccatttcttggcaggaacagctgcggcagcagcaggagtcttgggtgccgcaacagaagagtgtaagaaaagggagaaaagaatgaaaaacctcagcatctctatctgattgatcctgcatttgtgtgtaacgtacgtaccccaatggaaaagcaaagtcaggatacatgtaacaaaaacagaattgtcacatttaagaaaattgtgaaagagagatcttacagcgagaaaagaacatgaatcccctctcctgcttgttttcctcgtttagttagaggaaaggaaaaagaagagaaagaggagatgggtcaaacaaggttaattaatggtaaaaaaaagtaacttgctctcatatcctccatttatggccatttactcctttctatttttatctcttcttctccaccattcccttcttaaccgctttttctttttttgatgctttcttacatcttctttgcacaaatgggtgtaacacccctcagttttggactttgtactatattcatttgtcatacatgtatgtagttaaaatgacaatattagagtttggcattcggaccaaaccaagttgtccgatctaaaccaaaccaatattccgttaataagaaaactcgattggcaaaaattaaaatattctttggtttcagtttttgcctagacttaaaattcttaaaaatccaattctatgtgatggaaaaatctttgattccggtccaattctgcatcaatatatgctaaaccgaaccgagactgcccacataaaattgaattgaaccaaaggtttttaatttttacttcaacatagcgaataagaaaaagagggtatatattcattattcaatgttaatgagaaggcgtctgcgtttggttcgacacctcaaaacttgttttgcctttagcatctccgagtaaggaatccaggtccaaagcctcttctcttcctcctcctcgcttccttctcacgcaaccttggatccaccgcagct

SEQ ID NO: 2360 - DNA, 3000 bp, Unknown
  misc_feature (1)..( 3000): cDNA_ID_2157495_gDNA_ID_1620526_Annot_ID_159571 3000 nt of promoter + ATG
tctatctgtttgtacctaagtggtggtattctagtatttgttggggcactgacgttctcaaaaataacataaaattttaaaacaatcatggattctaaaatcaagttgtaatgtgttctatgttctacatttctagatttcatgtcaaagtatgaaatttatatgattagttaatcatctaaattctaacctgattccggaaagataccacagataaggagcttgattagctaagaggtcaaactcttttttggttttatttatttatttatttacatttagaacaaaaccataaatcatcagttgcatggaggctttttcgaagtacgatttcagcttttatagtcataattaatcggaatttaattagctctcaaaagcataaggaaacaccacagaggtgcgtggttgtatgacaaaaaaatcatatcagaaacacgatgaaatcttgcctttctagttttgaactgtggtggaatgtttgtgtttccatttcgatcgttaatgcagtggaagcttacatttctgtattggaagtgcgaaaacgtaaataaataggaaatgtatttttacgtacacacacttttgatttaataaaaatgattaagaaattttctacctgttaatatttcctctaagtccacaaacatggttatcgttatagcacttaagactcaaatccgcatggaactagagatctgaaatactatgaatacacctaatgccatgaaaatccaaggagttgtcatttaatttttaaaaattcatgttagaagaagaattaaagagatagataagagatgaatataaataaaatcttgaataaaagaaggaatcacaagactttagagttgattacaaagagaaattaagaaaagtaggtttaggggtttaaacatatttatagagaaaagaaaataaaccgggtcaactcagtttaagcacccaatcgaccaagttttggttgtggatcagaggctggattagtcccaatcgacctcttcttgaatttttgtttcttcacttcttttagctccttcttgctctatttgcttccaaattccatgttccactccaagatcctagaagtgagaaatgcaatgcaaacatgcacctaaagacctaaacatgaatgcaaaatgatggaaactaaaagagacgaagctaaaaaaccaacaaaaacacaagatatcagcaaactagacaaaataataaatattttgttttttttgttgttgttgaaatagtggatatatttttgtgtttctaatattaattagtatatcatttaatacttataagtttttttgggttaatttaagtgtaatttaatatttcacatgtaacaagaactccattttattcttgtccggttcttgaataagatgtgaaagtattgtatcaattgaaaagttattttcacacagaacaaagatccagaaacataatcaaaattgcacaagaatggacgcatggtttttaggtcgagaagagaattttaattacaatttgtgaatgtgagcttttgtttagttttgtgtcctatatttttcgaaaagtgtatttgcttatatatatatcaaaaggaccattcttttcactttaaaaatcgaattaaacatcctgctctactacctaagcacgtgttcttccactgaagacggctttgtttatatgtaattttttttttgtaagtataccaaagtttgtctttaagatattggatggaaaatcaggagatatacaaacatacttttcaaatttgtacatcgacgtttgcacatataaggtaatacggcttgtacaaccaatacacttttttgttaacactgaaaaaaatactaaaacaacgcaattcaaagcaaagtaatggtgaccaaaaaaaaatcctgaagcaaattaatagaggagatatatgatcaacctttagtttggtagctaagggtattaatattctttcaccttttaaagagctttaaaattctatgaaaactagagaattaacaaaattcacactttattccaaaaaatttaaatacattaaagatgaatgaacggtggaagattattattgaacaagttcgaataatattcccaaataataatataaaaataaagtgaaaaaattaactttttactttcttacactattttttcctttgacataaagaactactgatttaagtatttaacttgatttccaattctaaaccaattgataaggatcggaatacagtgattcctttctttctttttttttttctttctatttaacatgtatctaactactataaacccaaattatgacgatactattacaattcattggacgacatactatggtccttcactttctactttctagcttattcatctttcttgtattgcgtaaactcatgaataagatgatgaaagagagttttgaaccttaatctttcttagtatagtgataaatccatgtcccatcctcgtcatgtttgtaagatgataatcattattaacttatcaccatcaagagtgaagtaaaaaatggttaaatggacatgaggttatgggtaaaaaacgtgggaaaaggcaaaaggcaaaaggcccaccttctaagcactctcttttgaatggtaattcgtgcctgtcaaagcttagactatgtcggaaacacaaccccaaagccacttacttcatctctttctctcttttttatttatttattttaaaacaaaagcttgagagataaagtttaaaattctacaaaccccaagaaaccccctaaaaataagaggaaataaaatcaaactgaaaataacattagtagtttttttgtttgcttgctctctgttttcctctgtctggagtctggccattgggattaaactaacttctcattctcattccaccttcttcttctttgttcttgtgtgctactaaaaatcaagaaagcacaaggagacaaataaacctatccatttcattaccaaacaagccgtacattctctagttatg

SEQ ID NO: 2361 - DNA, 3000 bp, Unknown
  misc_feature (1)..( 3000): cDNA_ID_3067273_gDNA_ID_1620526_Annot_ID_159581 3000 nt of promoter + ATG
tctggtaacaccatcaccatccaaaataagaaaaaaaaaatacgaaaaatgattaaagagagcgtctcccatcccaattactaaaaaaaaatgggaaagaaaccacccggcaattgctggtagccgtaaaaaccaaacaagaaaatagatattacttttgtcctcccaaagattttgtccagttaaccaacttttcgaagccatgtcttacgttttcagtatatgcctctaaggcaacttgtattttctcaaagtgtggtttccatattgtcataactcggcttacctagaaaaacaagtaacaatggtcacaatgtatagtgcaatgtcaaaagagaatcagacataatgaataaagatggaaacatattaacctcaagatagtcgtaggaaacgtcgaatggttgggtgaaatgtggggtcaaaagcctgcttacatgtatgtaacacctcgatggacttatcggttaagtattgaatttttggttggagataaatggttaatgtcacatacacatctttgatgcttggaatccatttctgtgatatctaagagaagaattcaaaggttaataagaataaagcaataatgacttgtcttataacgaaaaccaaaaactttcagaataaaaccttttgaagagtttggctaagatcttgttgccgcagagtcactatatatgcttgcaaccataataaaaaaaaagaggatcatttaagattgatcactatgacaattttatcgatgttaattatgaaccttcttatagagttacctgagttttatttaggtttagaccaagcaacttcccatcgatctgaacacaagtaaaaaaaaagtaaagaaagcttttgaatatgtacatacatcagatccaagggacaccatgtttcttacattttcaagctttgagccaagttccgcgactttcttttctgcgatttcagctcgagtttccacttccagacttctcttgcgttgcatttccacttcttctcgtagttcaagtatctgccaatgcagaactaaattgaggtaacaaaacaagaaggaaatacacacctcaaactacaaaacaccaacctgtttctgaagttcataagccgttccttctgcttcactggattctcagtctaaataaaaaagcatcaacagcaacaaaagtgtaaataagtttcttctatacataacaattttgaatacatgaaccaaagattaattaaaaatatcacttgaagagatccaaccacatcaaagatgatgcagcttgagtaattgttaactctttccaactttggaaagagacaaaacgtcaaagtgatttccagaaacagagaacggaagctcaaaagtctctcttgtgccaaatatattaaaccctaaaaaattcaacttctatccgaatttctcagaaacaaaacaaagacacataacttcatatgaaattccagtgaacggttacctgaggaagaaccttatttgttatcagtgtaaaataacagagaagaggtacgagtaaaagaaacaaaagtgacttaggaaacgccattgttggagactgctcactggaagatagagagtcgtgagagacagtgataaagcgtatcaagtcatatagagggtcttcttatctttttctttaacatgtgagggttgagttaattatgcgggctgattatagagtttttaaattgaatttacgattgtttttttcttacatataaatgcaatctatatttgtgttcggaataacccatctaatattactccatgtattaaactaaaatattttgcatgttttggtagatcaactttttgaatgatcacagacctacaaacatcaaccctctaattatccaattttaccataatccacgagctcttaaaattcatttttaatatatataattaaaatagttcaaacagtttaaactttgtgaccaagttaaaatatttaaaatagtttgactttgtgatcaacatatttaaatataatcaatattttcatttttaagccggaaaatcacgtcttacaaatatatttctgatagacacacctataattccaaaattttgacttttaaaacaaacaaaaaaaaatctcattaataccactacatacgtttttacaaaaataccattaaaagatattttttcaaatactaaaaaaaactaaaactaaactttaaacctataaaacactaaatcctataaagtttatattcgagtataaaccttaaaagttcaaccctaaatcctgaaagcaagaccctaaacccaaactcaaacttttaaattataaatccttaaacaaaatcatttttagtctttatggtatttttagagttaacagtttgtagttgtatttttgaaaaaaaaacactagtgataggtttttagaataaaaacttaatttagtggtattgaggatatttctctaataaaaattattcacaaaaaatatgtattaaagcaaagtgctatgcttattccatgcaatcttttttgaaaaaaaaaatattttctaaccgattagtatatcttctagaggattcatagaaaaagaggatacaattacaatatgtagagtatcttataggtgacgtaaccatgaaatatagaattctttggaatctgaaactgaattattcagttgataaatgataaaacaaatactcatatctcatcctttggcatgtttaggagccatctctcagctggacggagacaacacagacacttgtgccagagagggaacacaatcttcccaagtcttcgaaagggtaatctcagaccaaaccgttgactttgttctcattaattgtttatgctaaaccacaagatatttggatcaaaagtattaccataaatcactatataaagacataaatgtgcaccccacttttcttatcaatcataaaagtcagcaaaacacaaggcatattcctcttctcttcctcagccttatttttctgatattcagtttcaaggatatatcc

SEQ ID NO: 2362 - DNA, 3000 bp, Unknown
  misc_feature (1)..( 3000): cDNA_ID_2157541_gDNA_ID_1620526_Annot_ID_159587 3000 nt of promoter + ATG
caactttcagaaactgtatttgagctttaattcagcatccgaagcgttgagaataccctcttagtgttcttttagcaagctcacagtgatatgtttaaaatctattttcgaaaaaaaaattgagcaatacactcaaatgaccttagaaaacaattatatacggtaagaaacacgtgtcatcaaatgcaagttctttgagagaaagaacaccaaaagacaaagagtacacacgcccatccttttgaggaaacatacgacgcattgagttatcaaaccagtgttaaacctgtttcataatcatgtccacgtacaaacgtacccgtttttatcagccgatgccaatggtttcccgatcccactccaagaacaacacagtataggagatgtttgctccttgagaatgctcactatattgcctttagatagcgaccatacatgaaccgaaccatctgcagatcccgcagccacataatcatcatctggacttatgcatgaccggctccaattcgatgctaatctgttccccgatgctctcagtgtcccacatatttccaaagtccgggtatcaaatacattatgcacgttgtctctcccgctcgtcaagatcctatttccgttccgggacaatgatactgaggtcacagcagaagaatgtccagctacttcggacagaagtttcccagtttgaatatcccataacctaagattcccatccatgtggcctgagaataccgtaagcccatctatgctgaggcagattgcattgcagttgctggtaaagagtactgtgttagtgcagtaacctttatgcaaatcccaaagttttatggtacggtcatatgctgcactgacaacatgtcggctagagaatttgctcacatccacagcacaaaccttatccgtgtggcctgtgagtgtatggcgtaccctacccgagctaacatcccatacaaacaaattatttgagctggttgctgcgatcacggatttattgtcgtgggttacggccatatcaagtatattcccaagggaaccgtataagcttttgattaaagttccgctattggtgtcccacatttttactgctcgatcttgcccaccagtaaacagagtaccagagttgtattcaaagactattgaaccacagccaccttcatgagcatggatacgattcgcacatgttgacggaatggttgactcaacaaagtgatcggttccatcttcattgcggcggacaataccatcaacttgctgccgagcaagagtttccaaaccatttgccttcagcttagctagcatttcttcatagagatcatttgcctacgtaagaagaaagaattaaggccatcctaaccaaatcgaagaaaggggacgaacaaactctaccattaaagactcatgaaaaataaaagtccctatgtacctcattaagacgttctgcatcctgcatcttctgcaacatccaccgatcaattaacattttattctcagtctctgctttttgcactctacttgtcatctcctccaactgagaccgtatttccaggttttcagcaataagtacatccaccgtcttggtcttttcctctaactcttcttgtaatcgtgtacaatcctccctacagaacaactctagttttaaatatcgcacaacataattccttacagtcactgtaaaaccattcttaccttctttgtgttaattccttctgcaagtcattaattaacaactccttctcttgtaaaatagcctttgaagttctggattcagctacttctatcaccagttgttcagatagtcgagattgagctttgtaacattgctgtaactctgtttccagcttttctgttttctccttccattctgaaccctgcatacagatactcaaaccagatcaagacatgtgtcaaatattccagagcataaaagtagaaagaaccaaatctacagagacgctgaaccaaaacaaaaggattcaatacaaactttgaggcatactatataattgaagcaagtataaacttaactaaactacatatacttttatacttctctgtgacacatgaactcacaaaatgcactgaacaaacatactgagagctacaattgtttttttttctgaaatccaatgaaacgcattacaagaatctacaaggattaaaagagcctttgttccatctaactacttattccatagtgcaaatctttcaatgtttactagcaatttgtatacttcgataacaaggtataaagttgaaactggtgaaatctgaagcaatgaagaaaggaacaaaacaagattacctgagagattaaaggcttagagagagcagaaatcgcaggagcatgagctccttcttccagaagatgacgcttccgcaaagctctcaaagcgtcatttattgcttccatagctttctcctcctgtaccctgaaagttccgacactcatcggaatcaaaatttcaacaatcgcaaaagcttatgcaacaagaaaaggagatcaaatcaagacttacatctctcgattcagatcaaaaagagtcgtgtagtgaggaattagggtttgcgtataacggaagactttgatcggaaccggtggcgacttgaattccaccgccgcttacgagttacgacccaaattagagaaattacaaaagctgcaagtgaattggggattttcccccacaaatttagtttattgaaaattgattataatcagtttttgtattaatgattgattaattagaatttaattgcaccgttttacctgaagttttgttagtagtagccggaaagcaatattattattgggcctataaaagcccatttacattgtgttctgttcctgcaaagtgcaaagagtagagatcacgtcatggtccacgtggcaaccaatgaatccaactctggagaatgaacacgaacacacaaacagaacaacagatcatcagagaagaaactagaattgacaaaattattaaaaagcgaaaaaagaaa

SEQ ID NO: 2363 - DNA, 3000 bp, Unknown
  misc_feature (1)..( 3000): cDNA_ID_2157549_gDNA_ID_1620526_Annot_ID_159589 3000 nt of promoter + ATG
ctacattggaattgtaagtgagaacatttctaatcataactcacaatattaacactcactgagctatcaaaatcaacgccttgttcgttcctcagccacgttcactttaattgctctgccttccaaattctgcaaacacagagagcaatgaataaaagaaatggtaaagtcacaagaagataaccataaacgcatggaggagtgatttcttttacctgtccatcaagagcagcaatggcaacgttaacttcattctcattcgacatttgaacaaacccaaacccacgtgaacgacctgtctctctatcagaaaccactcgggcatcaactactttcccatgctcgctaaataatcgttccaaacgaccactatccacatcccatggcaggttcccaacatagatcctaaacgcagcatcatatacacgaggttgtcgttcaggtcttgatcctcttggagctgctctgtttactgtcaaacgcctcccattcacttcctacagttgtataccaatcaacttcaacatctataatcactatccaaatgacccagaagattgagaaacaagaaaatgattgcttacaaaactattgaacttctcaacagctttctctgcttcttcaactgtactcattgttacaaacccaaatccacgactttgatcagtgtccctattgtatataacctgcaaaaaccagatttcaaagcagacccatgaaacataatcattcctttaagccaaataaactataaaaccagatttcaaagcagacccatgaaacacaatcattccttcaagacaaatcaaactatgaattcgaaacactaaactaactttctcaagaagtaacaatgccacagaaaaatttagttccaattttctcaaccatttggattcaaatgtcaaaaagcacaaattagcaatatatacctctgaaatctcaacagtaccagcttgttcaaagagcatagctaaagcttgactatcaacatcgtacggcaagtttccgacgaataatttagcctcttccggtggctccgggaatccaacaccgtcttcagactcgaaactctcatctacagtgactgaagtacctccgatgcttccatcctcaccttcttcttcctcagcccaattcgaagtttgggaaacgaaagtaacaacaggagatgagttacgaagagttttggatttgagagagagtgtgagattaacgggtcgtgaggataaggaaaaattgaagcggtgagattcagaggacgagatgttgaagatagaaggaatacaaaaaagggtcgaagaggaagaattcgtcatagctaaaagctttaagcttggggttagtactgaagaagtcatttttctgattttggagagattacaggtgaagaggaagaagagtgagataaaaataaaaaaatgttataatctgattagactaaagtttagtctaatatcttatataaacagtaatctattattgggccttacttgacccaataggcttttatatttccttattcacaccgacctactccaccaaaattaagactatatagtacacaaagagccgtttctagcaagatttctttcctcggccttatcgcgtcgaattcaagccggcgaacgaatacatttatttttctgaaacaagatggattatcggttacagattttagaagcaaacgcaattcatgacactgcatcctctttgtagtgatgtgatgtgcgtgttagctgtgtgtgtccgcgtttatcttttttttttttgttacttttctcctaacttagttgttattacgtgcttttcccaatatcaagttaaatcacacacacttcccaccaccttccttcattttctttccgaaatttagcattttagtcctcttttgacaaatagtatcttctttcttaaatttaagatctttctttagtctttagacaacagttattgtaatgtcttttagttgaatgacataagttaggccaaaataatttgagttcaattttcaaaagcgttgatgaaagctaaaaccaatgactaaaaatgacatctaatcggctcctgaaaaccataatcagatatcatatgacaaatactaaaccaaaatttttacctttcaaataaaataatatttgcagatagatttaaaatagtaaaggttattgaaaaaaaaatacaatagaaaaacataatattacctaatatttattacattttaaaagatatatagaaaaacaaaatcttagtttcgacgatggaatttttttttttatatagaacatcacataccaaataactttagttctcttattgtgaaaacaatggaagaaattgactttttaaaaataattttgaaattgatttctttgttcacataccaaacaacttcgttttattatcgtgaaaaaaagataacgtaaatggttagccacacatgcacggcttttccaaattatcataaggatccatatttgtaaaagaaaaaaatacataatccacataattaatcatagtgaggttacatgaataacagagttcctagctagtaaagataaattgttgcgtacaagttgtgctttgattaattatcactatacgtgcttcatataaaaatgtcattttacacttatatatattaagtcatctcatcgccgactatttcccaaaatcatcaattattgttaccaagaataagaaaagtaaaatgagagagcttgcttgcgccattaaatcaacataaagttcaattatagtttgaaatctttatgaatctccattaattaatgtatccatgtcactaaccttgaaatctttgttgaatcccacaagtaatcctttaaccccttttggtacttttcattacatatcgtcatcacaataacctctcaccaatgtatctataatccctatataaacactttctctttagtcctgattaccatcaacaaactcaatcacaatcacaagtaaatacaaaaatcaccatagaaaaat

SEQ ID NO: 2364 - DNA, 3000 bp, Unknown
  misc_feature (1)..( 3000): cDNA_ID_3067283_gDNA_ID_1620526_Annot_ID_159591 3000 nt of promoter + ATG
cagaaccaaggatgcaatggaggtctaatggaccttgcttttgagttcatcaaggagaaaggaggactcacaagtgagctagtgtacccttacaaggcttctgatgaaacttgtgacacaaacaaagaaaatgctccggtagtttcaatcgatggacacgaagatgttcctaagaacagcgaggatgatctaatgaaagctgttgctaatcagcctgtttctgttgctattgatgctggaggctcagactttcaattctactccgaggtaagaactcacaacacatatactaattaagttcaagaacttattaaaaacattttttgtcttaacgcatgcaatggtgtcatagggagtgtttaccgggagatgcggaacagagctaaaccatggagttgcggtagtagggtatggaacaacgatagacggaacaaagtattggattgttaagaattcatggggagaggaatggggagagaaaggatacataagaatgcagagagggattcgtcataaagaaggactttgtggtattgcaatggaagcttcttatcctctcaagaactccaacactaacccttctagactttccttggactcgcttaaggatgaactctaaattaaatctctttatattaagattaaatagacattgacaagtttgtttatgatgattgttttttttttaaatatatttctttttcattaataggttatggttttcaatgtatgaagttgatgggaatcgtttgaattcgttaaatgaataaataaatggttttatgtagtatatttccaatactaaccaatgcgacttcaaacgagttaattagcttcttcttttttttgggtaaaagaagcgtaatgaagagtcatttgattctctcagtggaagttgaaacgatcaaagaattttggaaaattgcaccgctcacatcaattatttaaagaggattttgtggcagtaacaaataatatgttctttttctccgttggacgagaagggtttcaggtctttgccccattctttgaatttgtaagattatcagtctcacttgtttgattccgaagtagttactttaagaatattctttcttggttaaagatgagttggatttcgttttcgtccatttctattttatgggttctatatctcactatggttttgcttacctttcgctgttgctatgccttatttgtttggttcgattttttgatgtttcaggcttagtataaatctcttatggataggataagtgggctgcctgatgagctactcttgagagtattgtcgttactacctaatgtgaaagatgttgttgtcacaatggttttgtctaaacgatggcagtttctttggatgatggtgccaaaacttgtttatgatgatagctatcagaatctcgagtatggaaagttttcacggtttgttgacagatctttgtttatgcgaaaggctccaggtatagaaactttgcatttcaaactaggtcaaaactgtggtaatggagatattcaatggtggattagagctgctagtaaattttgttttcgtgagctgatcatcgaaatcaactgctctactagtgcatctccatccatacttccaaggagtttgtacacagagtgtagaatgcttgtgacgctgaaactaaaaaaagcggttcttgtagatgtttcttcaccgacgtgttttccatccctcaaaaatttgagccttgtatctgtgaagtaccctggtaatgaatttgtcaagagtcttttatcaagttgtcatgttcttgaagacttggttgtggaacaatgtataaatgataatgtgactatcttctccgttaaagttccttctctaaagagtttagtcttgcgtacatcaaaagagagagctccagatggggaaagtgggtttgtggtagaggccccttctttggaatacttggacattgatcaaacgggtgggttttgtgtcattgagaatggaatgcctaatcttgctgaggcatatgttagtgttcttcaccatcatccagtgaagttcctgagttctattacttcagtcaagcgtctctatttatgtttattaccacacaggtaaataataatctgtttaactttactttgtttctatcatttaccgcactaacattgtttattcagtattctgtcttgtatgcaggatatgtatcctattagatgtgtcttccaccgtcttgtacatatcacgctatgcacttgtgacgatgagtggttgaatctacttgcgtgtcttctcaaaggttcccctaaactaatatctctcaaacttgaaaaggtacatatatatattccatcccaattattagatcagtgtctttgatcaggttattttccaattcattcagtgtcttatgtaccgtttatctcagcaccatggccatttgatttgttcaccaagccctttacgggatgatctgagttcagttcctgaatgtgttttatcgagtcttgaaaccgttgaatgggttgactatgaaggaacagaagcagagagacaactggtagagtttatcttgagaaacggaagctgtttaaaaaagttcgttatctcccccgaatccgttaatcccgacaaaaaatatgagatgatttaggagctgacgttgtcgtgtaggcgttcacccacctgtcagcttgcattcgactaaagtcagacatgttcaatagtgaacttgcattttgtttgttagtctttgatattatatggtctttgcttatcgttttgtatcttcactctcttgacatctctctttattaggctaggatttgaggttaaactttcattttctttgaatctttcactaactgggcttctctactgctacttacttatagatgggtttcaactttcaagttaaataccaaacctaattataactttaaagtttgtctcacgtcttttgctcttaaattgtgaattttgagcctttagcttcgctagaaagtggaagctgagccatgtcc

SEQ ID NO: 2365 - DNA, 3000 bp, Unknown
  misc_feature (1)..( 3000): cDNA_ID_2157545_gDNA_ID_1620526_Annot_ID_159588 3000 nt of promoter + ATG
ccataacctattaatgaaaaagaaatatatttaaaaaaaaaacaatcatcataaacaaacttgtcaatgtctatttaatcttaatataaagagatttaatttagagttcatccttaagcgagtccaaggaaagtctagaagggttagtgttggagttcttgagaggataagaagcttccattgcaataccacaaagtccttctttatgacgaatccctctctgcattcttatgtatcctttctctccccattcctctccccatgaattcttaacaatccaatactttgttccgtctatcgttgttccataccctactaccgcaactccatggtttagctctgttccgcatctcccggtaaacactccctatgacaccattgcatgcgttaagacaaaaaatgtttttaataagttcttgaacttaattagtatatgtgttgtgagttcttacctcggagtagaattgaaagtctgagcctccagcatcaatagcaacagaaacaggctgattagcaacagctttcattagatcatcctcgctgttcttaggaacatcttcgtgtccatcgattgaaactaccggagcattttctttgtttgtgtcacaagtttcatcagaagccttgtaagggtacactagctcacttgtgagtcctcctttctccttgatgaactcaaaagcaaggtccattagacctccattgcatccttggttctggtttgtatcacaatctactagctcttgctctgagagtgatgtcagctttttagttcttatttggttgatcccttccaccgcaacaactgttgaaaacgcccaacaactccctgtaataaccacaaaccaaatctgtgttaattctcattttccatatatcttttagattgaaggatcaatgaaaagaagagttttaccgcattggccttggtttttgacaggagtgacggctccattctttctccaatcaacggaggttgggagagtatttacatttgcatacatgaagctctttgtggcctttttttcgccttgaaacatcctatgatgtttgatgtttgaaccagcgtatgttctcctaaattcttcactagtcatgtcaccaaacttgtttagcttgagcttgtaagatttatccttcttgttggtctcatggatgtgcttcacgttgtgcttgaacacgttgaacctcttagctttctcttcaaggctcctagcaacagtgtggtgactcctccaccgttcgtatagctcccacaagctattctctgattccacatctttgttatggaaatctaaaccctttgtggtttcaagaaccataagcatgcaaagcgcaagaacaataaatcgcttcatatttttctatggtgatttttgtatttacttgtgattgtgattgagtttgttgatggtaatcaggactaaagagaaagtgtttatatagggattatagatacattggtgagaggttattgtgatgacgatatgtaatgaaaagtaccaaaaggggttaaaggattacttgtgggattcaacaaagatttcaaggttagtgacatggatacattaattaatggagattcataaagatttcaaactataattgaactttatgttgatttaatggcgcaagcaagctctctcattttacttttcttattcttggtaacaataattgatgattttgggaaatagtcggcgatgagatgacttaatatatataagtgtaaaatgacatttttatatgaagcacgtatagtgataattaatcaaagcacaacttgtacgcaacaatttatctttactagctaggaactctgttattcatgtaacctcactatgattaattatgtggattatgtatttttttcttttacaaatatggatccttatgataatttggaaaagccgtgcatgtgtggctaaccatttacgttatctttttttcacgataataaaacgaagttgtttggtatgtgaacaaagaaatcaatttcaaaattatttttaaaaagtcaatttcttccattgttttcacaataagagaactaaagttatttggtatgtgatgttctatataaaaaaaaaaattccatcgtcgaaactaagattttgtttttctatatatcttttaaaatgtaataaatattaggtaatattatgtttttctattgtatttttttttcaataacctttactattttaaatctatctgcaaatattattttatttgaaaggtaaaaattttggtttagtatttgtcatatgatatctgattatggttttcaggagccgattagatgtcatttttagtcattggttttagctttcatcaacgcttttgaaaattgaactcaaattattttggcctaacttatgtcattcaactaaaagacattacaataactgttgtctaaagactaaagaaagatcttaaatttaagaaagaagatactatttgtcaaaagaggactaaaatgctaaatttcggaaagaaaatgaaggaaggtggtgggaagtgtgtgtgatttaacttgatattgggaaaagcacgtaataacaactaagttaggagaaaagtaacaaaaaaaaaaaagataaacgcggacacacacagctaacacgcacatcacatcactacaaagaggatgcagtgtcatgaattgcgtttgcttctaaaatctgtaaccgataatccatcttgtttcagaaaaataaatgtattcgttcgccggcttgaattcgacgcgataaggccgaggaaagaaatcttgctagaaacggctctttgtgtactatatagtcttaattttggtggagtaggtcggtgtgaataaggaaatataaaagcctattgggtcaagtaaggcccaataatagattactgtttatataagatattagactaaactttagtctaatcagattataacatttttttatttttatctcactcttcttcctcttcacctgtaatctctccaaaatcagaaaaatg

SEQ ID NO: 2366 - DNA, 3000 bp, Unknown
  misc_feature (1)..( 3000): cDNA_ID_2157537_gDNA_ID_1620526_Annot_ID_159586 3000 nt of promoter + ATG
taactcatctcctgttgttactttcgtttcccaaacttcgaattgggctgaggaagaagaaggtgaggatggaagcatcggaggtacttcagtcactgtagatgagagtttcgagtctgaagacggtgttggattcccggagccaccggaagaggctaaattattcgtcggaaacttgccgtacgatgttgatagtcaagctttagctatgctctttgaacaagctggtactgttgagatttcagaggtatatattgctaatttgtgctttttgacatttgaatccaaatggttgagaaaattggaactaaatttttctgtggcattgttacttcttgagaaagttagtttagtgtttcgaattcatagtttgatttgtcttgaaggaatgattgtgtttcatgggtctgctttgaaatctggttttatagtttatttggcttaaaggaatgattatgtttcatgggtctgctttgaaatctggtttttgcaggttatatacaatagggacactgatcaaagtcgtggatttgggtttgtaacaatgagtacagttgaagaagcagagaaagctgttgagaagttcaatagttttgtaagcaatcattttcttgtttctcaatcttctgggtcatttggatagtgattatagatgttgaagttgattggtatacaactgtaggaagtgaatgggaggcgtttgacagtaaacagagcagctccaagaggatcaagacctgaacgacaacctcgtgtatatgatgctgcgtttaggatctatgttgggaacctgccatgggatgtggatagtggtcgtttggaacgattatttagcgagcatgggaaagtagttgatgcccgagtggtttctgatagagagacaggtcgttcacgtgggtttgggtttgttcaaatgtcgaatgagaatgaagttaacgttgccattgctgctcttgatggacaggtaaaagaaatcactcctccatgcgtttatggttatcttcttgtgactttaccatttcttttattcattgctctctgtgtttgcagaatttggaaggcagagcaattaaagtgaacgtggctgaggaacgaacaaggcgttgattttgatagctcagtgagtgttaatattgtgagttatgattagaaatgttctcacttacaattccaatgtagcgagtatgtgaaaccaaacttgagttcaagcttttgtaaacatattttctttattacccatcaaaacatattacaaaacattacacaaccttttatatgtacactaagacgtgggatgtagagttttctctttgttgttgttgtcaaaatcctcctaactgttcgacacggctagtgaggggcacataccggactgaagtttcggtatgtaccttgattgaaccatcctcgtttttgtcgattaccttgagctcttgaaaataggttcctagtggaatcaccattcgtccaccgggttttagctgatccaaaaggggctgagggatttctgatgccgctgctcctacgtgtattgcatcatacggtgcaaactcttgccaaccttttcttccatctgccataagatacaattgagtcaaaagatgccaggcaaggaactcataagggagagcgagtacttacccccaacatgtaaggagagagatcctttcttaagaaaggaagcagcaacactcttttcgatattcttgatagacatatcaaccaattcagggatatgatccacgccaacaacacgtccctcagctccaaccatcaaagcaaaacagccagtcaagtacccggttcctacaaacataagctgattattatcttcacttcccaaactcgactttaacataccaataacatcaagtcaaagacctgagccgacatctaaagcgcgcatcccggggtggagcttatcttccaagagctgcaagcaagtagcatgcatatgcggagcagaaatggtagcattataacctataggtacaggagtatcaacataagctgaagaaccaactggtacaaagagacctctatctaaagcctccataacttgagctactcttttcgacgatatcacaccgtaccgcttcaaattttccaccatccctctcttgccgctcgagccagttccactctggaattgctaacaccatcaacatattaaaaatcgtctataagcacaaaatcagtcacacaacacagagaaacaccaaataacccatttgtataccttatgtgttgagaataaactgaagcagagattcctggcaagagaacatacctccatgtggaagaagagagcaccggagaagcgagagagattgagattcagaaactgagatgatgatgatgatgaattgtagcggtgaagtctacgtggcgcacaatagagacgaccataagctgttattgttggacataataaaacctgagctctcattttcttttttcgctttttaataattttgtcaattctagtttcttctctgatgatctgttgttctgtttgtgtgttcgtgttcattctccagagttggattcattggttgccacgtggaccatgacgtgatctctactctttgcactttgcaggaacagaacacaatgtaaatgggcttttataggcccaataataatattgctttccggctactactaacaaaacttcaggtaaaacggtgcaattaaattctaattaatcaatcattaatacaaaaactgattataatcaattttcaataaactaaatttgtgggggaaaatccccaattcacttgcagcttttgtaatttctctaatttgggtcgtaactcgtaagcggcggtggaattcaagtcgccaccggttccgatcaaagtcttccgttatacgcaaaccctaattcctcactacacgactctttttgatctgaatcgagagatgtaagtcttgatttgatctccttttcttgttgcataagcttttgcgattgttgaaattttgattccgatg

SEQ ID NO: 2367 - DNA, 3000 bp, Unknown
  misc_feature (1)..( 3000): cDNA_ID_1712122_gDNA_ID_1620526_Annot_ID_159579 3000 nt of promoter + ATG
cacttttgacttcacattcacaaagctatggatctttgcaaaagtagagcaacaaccaccattactctctcatgtctcatcttctttgtttcttcattctacacaatctccaccgctaaatctgtcacgaatccgctctatcaactccttctgttcatcggcttcttcctcgctgcagccttgtcgcttgttttactggtggcagcagcacgagccaccatggttgcgtggataacggtcctcgtcttactggccttttcgggtacacgtcgccgtgttttagcgcggagggggaagacgatcacggcggacgtggcgatgagcttgttcagggttctgattagagaagcaaatcctcgtggttagtctcatgaagattgtttgttgttagagagtatttacatatcacttttgtatataacaaaaatatatgtatttttgtgaatgatttttccccttttgtgtatttatttattcgaattttaattttaatatatacataatgtatgtgtgctttaaatgtttattcaatacttctatagttacaattttctatagaattaatctttagatgttaaaaaaatgttttaatctttctaatacgaaaaatatttattgagttatttcatatcataatcggggattctgatcgcaattttgatattaaaaatggttaaggaaataaaaccaaaaatgatcttaatttcctgccactgcatatttcactataaataaatgggatcagaaagtttacagttttcttctctactatactacaaaattagtttagctttctaaaataaaataaggaagaaaaccttaagtaaaaccaattacatgtctaaaatatacttacaaaagatcctcaattataaattttaaaaaggttgttgtaatatctcatatccatttagatgacgtcacatacaatttgctacctcttgtcactcatttaaacatacaatacgttgtactacgttgcgacactttcactagactggtgagatatttagaacaaatacgtcagcccgataagaaatatgttttatattcttttacacaaatctaagaatggatttgttaacttgagatatcttatggtttttgtttatgatttatatcataaacacgcttaagttacatcttcacgaagatacaaatctgaacaatgtagatgatgatatgatgcctcttttctcacgtcatggattgattctgcgattaaacgtaaggtacaacatcttcatgtttgttgtccttcagatggtatttgtaatatccccatgtttttctagctgcaagactcgggtatccttaaatctcgttgatgtgaccatggatgatgccgagttcgtttctttaccttatgctgttatgcatttgtaacgtatttggtctcccagtgaggccacctttgcaagacttgtctcttgctatcctgtattggaagagttaaatattgttgaatgttggaatcttccggaagtcattccggctgaatttttttgtcactgatcaagagactcaaaataaagctatgcgattctacggttgtacaagtacatataaagataaatatggagttgtgactgatgctcctcttttacgcgatttgtttattgatgatgaccaagctggaagttatttaataaacaatttgagttccactgccaagttaaatgtttatctcgcctttggtttggacagttttgatgaagcaacaagggtttcatcgaggagaagtagcatccacaattttctgctcgggatttcaaatgtcggggaaatgatcatatatctaaacactttaaagctatatatgtcatgtcaattccagtataagacatgtacgttctctatcatgattcatgaaagtttatgacctacattacttttctttttggttcgagatcatctatcaatactcaaaattagaaccgcttcctcggtttggttacatgtcccacatgtatgctgatatttatgtacctaattggaaatggttaaaaacatttcttgggagttgcccaaacttgaaaatccctcatcttggtaatgatctgctaaactctagctagtgtgaatcaactagtgttcatgtgttgttgtagcaaagcttctctgatgatgaaatgcaaagaagaagctacagaactaaagaagaacaatggaagcattataggtgtgtatagtactaatgaatctctttgcttttgaccacaaagcaacctacttggttcatgttacacaatcaaatttggttccaaatgtcacatataaataataattaagcataaaaattccctatttatagccaatatttgcttctgaatattactcaaattaaacctaaaactcagaagaatgttttgagaaacaaaagcaagaaattttgaaccatgtgatatgtttcaccaatcaatcatataaacttcttctggtttatctttttattatcctatcattaccactccatactcataactctctctgtctctctatctccctctccacatcaagaagaagtctctgctagttccaaaacagaacaagtgaatccctcaagtttcttattacaaaacccaaaaaccaaagtgaaccagtgttgttgtttgtactcacagatccattctccactgattcatttcttgctctgcttcttctctcttagttttgttaagaatcttctcttatccattgtgttttttctattttataaatacatatataattttagttgggggagagcttgcctggtgtcgccttcttctctctctaagacttgtgcttaatttacggacatgtgaagatacttcgcttttgcctcatcgaagggcatgttagctatttacttatctcttctcttctcttctttgtcttgtgagctctcaaatcttcatagatacaaatcaagaaagtgatcaaacaaaaaaaggacaagtctttttggtatttcagatcgagaaaaaatgtggttgcaaggtttgaagtaatcttgca

SEQ ID NO: 2368 - DNA, 3000 bp, Unknown
  misc_feature (1)..( 3000): cDNA_ID_2157503_gDNA_ID_1620526_Annot_ID_159574 3000 nt of promoter + ATG
tatcttgtgtcttaacaagacaaaacacttcttactatcatgaaaatgccaacgtcactaagacactaattttttcatctttacttttctttcctttttcaataaagaaaaatatcaattaccacatcgaagggaaaaaattataattaattactactatctgtgcattttttttttgttagttacacgaaatattatcttttatataattacaatgatgacatcggtttttaaaaatatgtatgttttagaaaatgctttcaaatttgttttttttttttgatcaaaaatatgtatgttttagaaaatctgtatgtaactaacccacaccaaaaagtaacaaaccaatgatgacatcggtttttaaaattatgtatgttttagaaaatactttctcaatttttttttttttaatatttaaagctgtttcacacatgttaaagaatttttaatttttatttattttaaactaaaaaattatttatctaaatataattcagtcaataaaacaacaatctgcataatataaattgtcaaaaccaatataaaaataataattaattttatgtttaaatattatattttaaaattttcttctaaaacaccaaatgaaaaatatggagggattatattacaaacctcatctgtccaaccgcgacaaaaactgttacttatattaaagaaaattaaagaaagaaataaacatcatctccgtgaatgtcattgcgaaaattggagaaaaaaaagaaaaacaaaattaaagatccgacccaaattccataacaaacaaaaccaaccaaaatttaacccagcccaaaacaaatatgttaaattgaacccaaccacctacataacccaacccgaccctccccaaatgacataaatcaatcagatatattttactcgatgtaattagtaatttcataaggctcacattcattgcatgtatacaaatttaactaaattgaaaggaaaaagaatattcgtgtgcgacaatatggtcatattactcccgactacaataacatatgtaaagtagtcataagatacgaacttgaactctctatttatttttgttcataattaattttattggttttcaattatatatatatatatattttgactagtaatctataggttaattcagtaacgaataaagatagatgaacggatggaccattaatccactacgacgcttagggaccaactttccacaagtgaggaaataggaccgcgactaccacttcctacacacccgtgataatattgtcaacgtcattcatgctttttcacctaaatttctttatcttagtggactaggcaatcaatttgaaaactctactacactgagttccaaagtttaacaaaaccataaatgaagagtgctacaaatatgtcatgtttcgtcgtacaacaagtttcccctttggctatacactaaaaaaaaccaacaattttccctgattatacactaaaaaaaactaacaattttccctgattacggtcaaatgctagctgatacacagtgtattttacacacctcgtcgtaatgatgaaagttagattcttgtttcttgacagtcgacttgtcttcgacgtaaattcgtcaaaaaagtcaatttccaatggatttctaaatgttgtatccgtcaaaactcagaaatgagttcttttattgtaatatatatggttatactatagagttaacaatcgtaaggtgttttattaacatcggaaacttttcaaggagttccacccctctttcatagtccctcatttaaaacacaaataacataaaacttgtcctaaggaaacctaaaatcgataactctatagaaaacacaacacatctttttctgttctttataaactgaaatttttcaattgggaacaagtttgtttacttagtatcatttggtaaaaaaaaaaaaagatgctccaataaacccaccaacatcttgggttggtcatttagatactctttgaattatatcagagaaaaatatcttatggttggtatggcagacgaccgataagaacctgtatagtataaccatatccgacaatgacttctctgttatccgaagacatactagacgatcaccaagaaaaagaatttgaaggtaaaacccataaaacatcataagtttgatgtaacaatcaaatttttttgtctctttcccaagttataaggacaacgagaaaataattcaccgaaaaaaggacaacgagaaaataaaataaacattaacttttttttactcataaatgaagtgtcctggaccatgaagaatgcaagagaatacggggtagggagcatttctagggaaagacgggcgacaacaaaacgtcaaaacctaacctataaaaatattaaacgcgaatcatatatagtgaaccataatgaaacaagaaaaaattaatagtgaagaattcaagataaaaccaagctagctaccaaaaacaaaaaaaaagataaaccaagctaatgatgagtcttttgaaaataacatagtttcacatgtaacttaacacacacaaaaatatgtttataatgaccaagaaataaactgaaataaactgaaataaactaagggaaacttaaatgatttcttaggacatatacatgatgaaaactgaaaacgaacaaatgctaggaagtgcattagcaaacaagagattcttaggaaaacatgaataacttagacattttggtaaagaactaaaactcccaaaagtcattctttttgggcataatctataaagtttaagaacttaagaataaataaataaatcataaaataattgaatacacagtaaaactaaaatctacatctcttgatagttaaaaagagagttgtgataaggtggtggggcctttcatttggccttcttttttttgagtccatatatagagaaattggaagaagttgatcaaaaggttcaaaacaaaaccacttttcaaacattggaactatctaagtattgaacacaaag

SEQ ID NO: 2369 - DNA, 3000 bp, Unknown
  misc_feature (1)..( 3000): cDNA_ID_3067300_gDNA_ID_1620526_Annot_ID_159575 3000 nt of promoter + ATG
tcgctgcaactattctacaacggagacgaaaacataaagaagcaccaagaatgtctaaagaagtagtaattaaaccagaggaaagaaacttcaccgagttaaaaccaattcctattactgaggaacatgagatacatatcggagaaaggccaaaactcgaaggtacttgttaattaaaactactatcttcttgagtaataatgtctataaagtttcatgtatttatttttgtaacacagagataatgtcggagtttgagaagaacttgagaggatggtcgagtgttggagttttagtatgtggaccagagtcagtgaaagaagctgtggcatcaatgtgtcgccaatggcctcagtgttttggagtagaagatttaagaagaagcagaatgaagatgaatctaaattttcattctcttaatttcaacctctaatctaacaacattttctaagtttgtatcgttagtttctcattctcctgtattttttatcttatagttgtataatttttgggtctctatcttattttaatgtttgcagtttgatcttttttctcaaaggagaatttgcataaaatgcatatttgtttttttttctttatctagcattttcttttgaaatttaaatagaacaatgtaaaaatagcttcaaacgttttcatttggaaaagttaaactaacatgtaatagtatagcaaagtagcatgataatttttgaaaatcacttataagaatttttgcatatagatatagtagttgtgtatttagtttgaaaatttatttttgaatatgtgagggtattttaatcctaattttgcatttataacattttttaccataactcatgattaatactgatctcgagatagaaatttttgcttttgtcacaatttatgtatttattataaactgtcaaaatttgatctctcacaatatggttacagtttgattttgtttatgatctctatcttaccattatgtttgcagtttataatcaattttctcaatggagaatttgcaaataagcaatttgtttttttgttcttaatttcgcatttctcatggaatttaaaaacaatgccactaaacctgcagtagtccagtaattaacataacaaagttttaataaccaaataaactgactatgttttagattatttgtgtcaacaagaccaaggcaagataggtttcttccggggaatcaccaggaaaaaaaacgcaatttaagcaaacgttctatcaatccggccaactttaaaaacaaattaaaggttttgtggcccaaaaatacgtgtaagacaaaagactgtgacacatgggccttacttcatgtggaagttttggtgcagttatgtgacttacgtacgtcaagcaaaatattagccgccttgaaatttcaaaatttgtggattaaatctaataatcagaaaccatatactataagatttacgttacatccttaaatttgcaatcgtacgttttgggcaatgtattatgtatacattgaatagaagagtcctgtattaattgagttacgcgaacggtttttttttttttttttctgatctagcggatggaggtattaaaaattcacatgcaaaatgttgagaaacaaatttgcaatataacgtagcataatagatttttaagaatatacctcaaaggaaagcaaaatatttgaaagaataaataaatcctcataaattccgtattttaaacaagattttattaagaaaaaaatcctaataaaatcttatttgaaataaggaaataaacatatcttagaattgttcaaagtacatttacataggaatataaaatagcataatgtatgtacaaaaataattatttacaaatcatttatttccaaatgttgtttaacattgtctaagtaatattaattatggtttaaattaatatttagttatgggagccctatattattattgaattattatatacaattagttgatgtaagtatcaaaaataaataacttaagaagtttccaaaactagtattctttatttgctctattcattatatttttatatttgtaacgtcccgaccgtctttattaggtttcgacaatcacttctcggaaggtcgtccatcctgaaattactctatcctaaacatgtttaactataaaattctctcgaaacttttgtaacgtatataaccacataaattctcttaaacttatttgcatacaccattatatttctgaaatcgatatgttacaatattatttaatatttagattacttttactgaatcgaattaaatatcaaatcgaaacaaatctaatctaccaaaaataattttgttataaacatttcttgcctagttctacctcatatacattttagttaaagaaagaaatcacaacaattcccataattcaataattaaatccacaaaatcttggagtaagtaagagaaataaaaagatagtatcttaacataaacaattcaaagatgctctctcacacaattcacacacacttacaaaacaaaagacagaaacaatgttttcattcaaatcaaaagaagttataacactagtacaaaaaaagctcaaattctaatagtaactctttttatttcccaattacccaaagattctctctcacttcacaaaactagctttgagagtcgtgttccacaaaatccattaaagctgaaacggttttgctcaccattcaaacaaatacaaaattgcaaaaccccaaattataacaaaataatataaaaattaaaccgctaaaaagagtgaaccaacaaaaatcgccgaatgtgtgtgtaatgagaaaaccgacccatcatcccaatcatctcttcccgtgtcactctcttcctctcccacgtttcttctctcttccctttatgggttttaacttctccttcttcttcttcttcaatcttcagttttcaaattcaacaacaattcacattttgatttcttcatcatctctctctctctcgcttctctctcaaatcg

SEQ ID NO: 2370 - DNA, 3000 bp, Unknown
  misc_feature (1)..( 3000): cDNA_ID_3067337_gDNA_ID_1620527_Annot_ID_159601 3000 nt of promoter + ATG
gctaattttaagggattgacttaaagtttgtttggattaaatttgattgataatgtggttgacaatttcaatcaagaatttaaaataaaattaattattttggaaaaaagatttaatgctaatggcattgagttgtaaataagtccaaatccaggatttatttattaaaatggctgaaaaaaatgtatatatagataatagaggtttccacttttgctatgaagaggactagaagaaatgctcatcgataccagaaaattgagaaattggccaagaaaatcacaaacttttaaaattagccaaaaaaatgttcaaacttttccattagaattttaaaaataccaaaaaatttaagaagcagccaaataatgcttacgattttatgacattaacaatgtttaaataaaaaagagttttagttctatgaatatgatacaatggttcttacaaattgattacaagagcttacatattataacataataatttaaattattaacaattaaagattttttattttaattgaataacactacacttttaatgactttataagagtactagattttaatataccgcgagatgatttattttttaaaagtaatatatattaaaacttgcaaattttatttttataaaatatttatatttttacagtttataattattattaagtatttatatatattatttttttattaaaaataataaatcaaagatttaacctgtattgaaacggtggattaattatattttactttttattaatgttgattcaaaaacccgttcctccaaatccgtcttgccaaaaagccatttattttattaatattgattttatttatgatataagtctgaattataatctaaacattttagctaataacataggagtgcaccatatttatttaataggggaatgtaccatatgacccgaatgcacttttacccaaatccaccaaaaaagtcttgcaaaactactatagacccgaatgtaccatatttttttgtgctaatttttatgtgattaagatttaattgatttcgtatataaaatattaaattgttttacgaacttatttgtttataatttggtaacagatagataattgaatattcagtatattttgcttcagtttaggaaatctttaatgacccgtctttaaatccaataagccctataattaagagatgaatattgtcgttaaatgattttggtaatcttaatgatgtcattaaaagattttgtttttgattaaatttttctaatggcattgtcatgtaattaattacaaaaattaaggttacatttaaaatgtacttcccaaataatatagtaggacgatatgcacttttatccaaatccaccaaaaaagtcttgcaaatatactatagagataagaaacgatagtcggttttgataggtatatgattagcaaatatattagttcgcttaaattagttaaagaatacaaattgaaaaggtatattacactttattcgaatatagtatcaaaacttatatagagatttgataaatttttaattgttgaatactttttttttgtgctaattttatgtgattaagatttagttgatttcgtatataaaatattaaattgttttacgaacttatttgtttataatttggtaacagatagatatttgaatattcagtatattttgcttcagtttaggaaatctttgatgagttgtctttagatccaataagccctgtaatctagatattaacttgcagtataccgcaggtaggcttatattttagttcaactaaaaacttttattgtaaagatgatttaaaaatatatgatattattttatttgattttaaatgtatagtaaactgtgagttgtatatattttttgatattatctatattgtttagtgtttaagattatacacttgtagtttgattgttaatttaagagtttcacctgtagtataccatcttgtattaatatcgatctaatcccgtcaattctaggattttccagcttgtattaaaaattgaatcacatctaatatgttattaattattgtagtatataagattataaattttcaatataatatgtatgaaattgaatataaatatttcaaattatgacatgttactcagtagaaagttttcttaaatctatttttcacccgttataatattttttcatgtattgaacagtttatattcgtttttaaaaattcaaattatggcatatgcgaaaaaactctaattatttttctataatgatgatattatttttcggcaaaaatagaatcatataaagatgagaagtaaactataataattaataaaaaattaatatgataatttagatatcaaatctaatttgttgattttaattggttacttttttgggaattaataatgtattttgtttttctaattaaattaaattaattaaaatttagatatcaaatcttatatgttgattttgattggttattatttttggaaattaataatgtatttcgtttttaattaaatttaattaattaaattagtatttgactttttaatcctcaaagagataaattaatttactctttaaaattttatttctaatgacatacctatgtaattacttacaaaaattaaagttatatttaaaatgtacttcccaaataatatagtaggatgaatctaataacccaaaatttataaagatttaaattataatcaacagtttgatcatcttgttcatacaaaatttcgtataagacattaattaacaaagcaaaaaatcatatatcaaaatagacacatattaacaaaggattaataatttaatagttgtgaaaagcctttccagtttcttccacggcctagctcctccgtctttacgctctctcatcaaactcgagaaaaaaaagtggcgcctctgcaatttcaattttcaaatcctaataatttttctctcgcttcccggagaacggaaccctaatttctcgacgcagac

SEQ ID NO: 2371 - DNA, 3000 bp, Unknown
  misc_feature (1)..( 3000): cDNA_ID_2157614_gDNA_ID_1620527_Annot_ID_159609 3000 nt of promoter + ATG
agcaaaactttctcactttcaccagattctgtgataccgctactattcaagagcttgaacatatacgtctgtagaagaaattggagcaaaatcaaaacataaaccctaatggaaatcgaatcaaatgaatcaggggatttgaagcttttcattgtagaaatttgttaccttgggagatatatcatagacgttggagcatctcataccgattaatcgcttcaagcacttgacttcggcggcgacgtccgccgtgttcattcgtaccttcaccatatcttagtctctctcgaaatttcgtgattcagtgtcgaatcgaagaaaggttttaatctgtttgtcaaagttagaaattaaaattcggtctgtgctaagctgtgagaaaagaggaagaaggagaagagaaatttgtgagctattcatgtgtgttgggccgactagaagggcctataagcccaatataaaagacgatcattagttatctaaaccaatcaaaattacatgcttttttaaaaccggttagtctaatacactaattagagaagtttttaatttgtctcagtttgaatattgataattgataaataatccacatataacagttgtatgtattatttatgaacaataaaatctatgcagcaaaaataaagtaactaaaatattcaactcctattcaagaatcaaattgatagagtaagctgcaatttatggtgaaagtagttttaccataaggttttctcctaattattttaagaatatatttatttcccacaattggttaataaaattgtgaatgaatacattttttttgtctacaacttgtattattgggtttagactcgaaaatgacacattgataacatttgcacaaataactagatcatatgtttttgtcatattttgagcacaatttgtgcatatttcaagcaaattttgaacatatatcaaatccgtcataaccaattaatgttattattagtacttgttttcattataataatgacgtcataatcaatactgaacgtaccagcgaaatgatggtacatatcggctttaaaatagtattcaccaaatattgctggaggcttgtaatcttttttgctgaagacaagtcaattagggccatttccatttgactaaatctatttgtgcctaatggaaaaatagagatatatactttaagttgatgaagcttttcgtttgcttttatgttcctaatggcaacggtatcaactcgatgatttagactcttaaggaactttaccatatctttatggagaattaggaagtttgtggtgttggataaagggtagaagggaggaaccgcgaaaaagagtgttcttgtgaatggatacacacagaaatactatggattcgggtttttttcctgctcacaagatgaacagtgaatagaagtggtagagaatgtagatattagttctgttaaagctgaatgtgtacaaaacaatatggaaagttagataaataagatctttaggtcggaccaattgttagaagccaaaaataatctctaaactctctttattaaaactgagaaaatgatagcgtaacaagattagagtaaaactcctcaaagagaaactacgtcctcttctcctcggcctaattcgacagaatcctccaaaactctcaattgcttggatgcttttcaaaaacgagactacatccttatttataagtaaacgtaaacaagcattcaaagaaaataaggaaaaataaaaaattataggcaacttcctaaatctaaacagaaacgttgattgttttccaattcacagattgacttgttcttgattattctttttccacatacgtgaataaacaatccacggtttagacttctagaaacattcatatcagatacttcagttttttttttcactttttttttgttgttgtgcgaaatcagatacttaactatacgacatatgcaactatgcaaatctgaaatgtacttacagtttgttgtgaagacgaaaagcaagatcacgattatgattcttgaactgatcatcattcttttcttttcctctgcttataactaatggctcaagtttcttcattttggtttatgtgtattattttattaaattacgatagaagaaattaggaattaaagtctaactactagaatctgcaaaatcagatcatatattgttttcctaatttagttcaaggccaatctctactagagtctgcaatattagtgtgcaggaggggggaagtaatcatttaaaccagcaaacagtaaaacactgatgtgtcgtttttacaagaactggtaaaagaacatcctgttttgtccaaaacgaaaaagaccacccggttattgggactcttagttaaatgagaattccaaatatcaaattaatcaaccagtttggattaataaccggttttaatccaattattgggactgcttgtaaacctcataataaaactaatatgatcttttaaattaataggggttaaagagcgacggaaaatgctttggtcaatataaaattttcccggtttacgcaataacattatgcattgcttgcttgaaattcaaatcgttgatttgtggtgaagaacgatttcgaatatttgtttaaaactttttatttccaagaaaatttaggggagacagcttcatatcccaatttattgcttctactagtaactttccaaacccaaagttaaaaccattttaggattgatcaaaaaaaaaaaaccattttaggaatgcttttaaacctcatagcttcactcgctaatagacaaaatagtaataaaatgtctattgatttaaatacatttggaacaaaaatttgcaaatatttacataatttataaattaatttgtgaaaaagtgttcacgcaaaaaaaaaaaaaaaaacaataaaaaaactttgggtgggccttgtaacacaagacgccgccgataaaaggaaatctcacgatcgtatcatctccgaaacaaaaactcgtggaggagat

SEQ ID NO: 2372 - DNA, 3000 bp, Unknown
  misc_feature (1)..( 3000): cDNA_ID_2157630_gDNA_ID_1620527_Annot_ID_159612 3000 nt of promoter + ATG
atggtgttgggacagatactcaaagaagctgtcggactgatcgcgctgggcttataagtgctgctccatggtaagaatttcagaacaaggcttgaacattgaatgtctcgctgagttatgttagcaaaaaagtattttctttaatgacctgtcagtgaatacaagtgtggcttagcattttacgcttattaattgtgcaggataagagttccgtggcctttccaatggggagcaccattgtttgatgctggtgaagcatttgccatgatgatggcttcttttgttgctcttgttgaggtttgtttcactcatcttcaccttttttaaatgacattagacaattatttatgatatgcatagattttcatatccatttatatagaaaggctgtccttaatagatgaatttcataggttgcatactcattaacttttaaagtcaatgagactctctcttcattctttcgaattttcttgctctttggtttaatctcatcttgcttactcattatgttgacttgtttgtcaacaaaaaacagtccacaggtgcttttattgccgtctcaagatatgctagtgccacaatgccgccaccttctgttatcagccgcggggttggttggcaggtaaatactcacttcataagcttcattttacaaataccatctcgaggttttctcggggcaagcaagtggccatttatctaacgttgtgcctcaactatgttctcttctggtttagggagttgcaattttaatctcagggttgttcggaactggtatagggtcttcagtttctgtgtaagacctcctatccttttcccaaatctaggacatgagctgattttgaatggtgtggtgagtttgttttcacatgaatgcagcgagaatgcgggtctgctggcactaacaaaaattggtagcaggagagttgttcaaatatctgcaggctttatgatattcttctcaattcttggtaagcttgtctctctcacaaaaattcattaagaattgaagtggactacgttaagtaatcgtcttaaataaaactaatgcagggaagttcggggcagtatttgcatccataccttctcctatcatagctgccttgtactgtctcttctttgcgtatgtaggtaagtattgtttcttttttagcttggtttagattgaagcaatttggttcagattggtttgcttaccaacatatagagctagagacttgttttagctatgagcatctttaatacaaaaactgttgtataggtgctggaggactgagtttgctgcaattctgcaacctgaatagcttcaggacattattcatactgggcttctcaatcttcctaggcctatcaattccacaatatttcaacgagcacacagccatcaaaggctatggtccagttcataccggggcaagatggttcaacgacatggtcaatgtgcccttctcgtccaaggcctttgtgggaggatgtgtggcttacttgttggacacgacgcttcacaagaaagatggttcgatcaggaaagaccgaggtaaacactggtgggacagattctggactttcaagaacgacccgagaacagaagagttctatgctcttccgttcaacctcaacaaatatttcccttctgtctgaaaaaaaatccttccaaactttatggaatgctgttttgctagttttgtgtcccttaggaggacacaccttatctagctaggttttatgtgcatattcggtgaggagactataaaacgcaactagatattataacccaaagtgttaagtaacattttagaaatattaatgtgatgtttcttctatgtttagatgttttgcattaaagatgatactcgttttgccaaatttagaactagagtatgtatgctctgttttaatacaaatgattaaaagagaaaattttgtgagttttggaggcttttcgattctaattctataacaaaaaaaatttcctacaaaaatttgtaatgctagatttgacgttgaaactcttatgatatacttttgaagataagtaggggttcatgtgcttcattctctgtcgtccatttaaacacttctttggttgcatataactagttgataggaagttaacgataactaaaagtctaaaacagatggttagccacaacgatgagtatttgcacacaaaaaacagagcctcaatgatgaatgggttttgtatttagttgtgttatactgtatttgttttgtttgattggtagaataatatgtgcttgtttgtggcacatatataaatacatttttgactgataaaatttaaagacgtcattagctaaatcggttaccacttaccaccttaggttaaggtataagaagttataaactattgtgagttacttaataataatctacggatcaaaaatgttagaatccaaaaaagtgcactagttcgaaatcatttatgcgggtctatacatataattcgtaggaggttacttgaaatgatcccaaccaatttgttcatattatctatgcttagtgatttggtttaagacaaaaaaaattaccctaaccaatatggttaaattctcaacttatctcgaaaaaagggtaggcaagtgtcctacactatagaaatggataatgttgattttattgttttctaattaaaacattgctaaaatagagatctgaagaaaataaagaggacgaaactgtaaagtgtaaaaacattgatggagacaagaaagcagaaaaaaagagttacattttactttctagtaagaaaaaaaaaacatgaatattaattatttttgtacataaatataagaagacaaaacagaaaattaaaaataaaaaataatccccaaataatggagacgaagtggagagagaaagctcccactctctcacaccccaaagcttcttcttcttcttcctcttcttcctcttcctcttctctaatctgaatccaaagcctctctctttatgacacaagatcgctcagaaatg

SEQ ID NO: 2373 - DNA, 3000 bp, Unknown
  misc_feature (1)..( 3000): cDNA_ID_2157618_gDNA_ID_1620527_Annot_ID_159610 3000 nt of promoter + ATG
gttttcattatatcagatagtaacaaatgagtacaagagaaaaagagaaacacaagcatttcggctaagacttaccaacatatcaggcttaattcctccatcttcatggtctccttcttcaacgtgccaaccagagggaatatccacagagacaatgactgggtgtttttgaagagtctgctcatagttctgtaacgatactaatcgccggatgaggtcatcaaaaggaggcctgggagctcctacatgtgcaaaaaatggattttcaaaggccaactgaaacatgatgcaaatgaataaggtgcatctctgagactttgattccaaaacttgctgttcaaaagtttgatgaatttacttcttataattgtttcatgctttgaagaattctaacgattcatgcacaaaaatagttaccatggaatgaaaacccaaacattgcatctacaataacatcaaagtcctttgacaagtcatccggcagatcctcaacggaaacaaaagggactgagagtgaatccaactacaaaaacaggcaaattcagcaggcagtaaagaaacggagaaagctaacaaagatcccccataaattaagcactggttacacaaacctgagtgaccagtccagtataaagtggcttggctgtacgtttgggataacaaataaacggtttatatccaaagtggtgcaaatgcctcgccgccaccaaaccatcaccaccattgttcccaggaccacagatagctagaacccggctatattcttccggtttataaacctggaaaaacattgtagacttcaaatccaatgtacataacaaaaacaaaactctgtaatgctaagataaacagtgatacccaagtttgggttcaataaagtcagattatttcactgaagttcttaacttgtgagactcatccaaggaaaagagagagctttagaggtttatcggttcaaaggttaaagctttgagctttacattcagatacctacaatgaaacgtctcacacatatgtctagatctaaagtgatcgaattacctcagcaattgaagctgccacactaagaccagccaattcctacaatcagaagaagaagagcaaaatcaatcacgaacaggtagcaaaccatgggagagaagaagaaggagaagaagagaaaaatggaggaccatgagctgatcaatggagaaaccaagaggacccatcaaggtctcatcaatctcagcggcttctcgctgagtaagataagagagtggtggtgatcctgaatcttgcatgtttggtatgatgactttggtacacaaagtccgtagacgagagccctggcttggagtgatgaatcgctgcgtttttgataaaggagaagaggaaagagagaattgaggaggagatggagaaattgggagtggtggtgattggagaaggaaggtgaatgtcattgttgtgactctgcgtatcacattcctcatttagcccaatgacttcccacaccacaacaacaacaattaattggtagtctctttatgacccaaaaactctcaaaaataagccaccaactttgtttggttatttatatccatgtagcctatgacatagttcattttgattactagagtctagatataatatatacaattctttagatgatttaaactgtagctatagtttgaaatggaatagtttctgtaactttttaatttatatgtaagaaaaaatcgattagaacatgaattcatgtgttacactgttatataagtgtaaacatatatatatatatatatataaatacgacattatcctactttattaagtatacacaaccagaactcaaagaattagcaaaaaaaaaaaaaaccgaattgattatcaaattacttttaaatattatcgaatatcctaagataaaatgaggattttttttttttatttgctttcaactattttaattcttaattgtatcatcatctaattttaatttttgtttatgtaaatttataaaaaatttgttgatataatataggtgtatcaaaatcttattcggaagagacaacattgattttgaaatcctattcttatcatatgcaatctcgagcatcgatccctccaattgattttgaaatagaagttgaaatattaccagatgaacattgtttcagatagaaacaaattgcataaattgcattatctacttttagtcgcttatggcctctaaaacggtaggaacggctctgcagatactccattttatttgatatataatttagtttgcttattgtttttcatttctgatcatatgactggtggcatgaaactgtagtcttcattatgctcatcttgaatatgtatatataagtagacctggcagtaacaccatgcacactatcatatcaaaatcgcatcgtttgaatttttgactcgggataccatgatatagttatcgtcggttttagcaaactaatttctgaagttgttgacagtcatcgcataaataaaagaatttcatatccatgaacaagaccagcttttgattcacttcacactctctctatgtatataaactcttcctcttaacatttttgctccggcaatagaattttaacatgggacttattaaaggctcgcttgggacattcattgtggcggtaaaatgatttgcaatgtaaattttacacaaaccatgttttgttaagttttatataataggattgtatataaaaatagaaaaattactaatttacgtatcatttcaaatgaaatataataaatttgatagaagaaagatactttctaaattgggtatcaaaaagctttctccctccatttacttttttggcatttgtttattcaaaaactgtaacaaaaagagacagagagctaaacaaacagtggactgacgaagaagctctctctaactctcagatctctcttcttccatgttccaaatttcaatcattgtaactgatctctgtttctcaatttacttacttcaacccgatg

SEQ ID NO: 2374 - DNA, 3000 bp, Unknown
  misc_feature (1)..( 3000): cDNA_ID_3067325_gDNA_ID_1620527_Annot_ID_159606 3000 nt of promoter + ATG
aagtggattacaaggcctagctacaagaccaagagcgcgttgggagctcaaaatctgccaaaagaattcggagcagagacatcgatacaatgagtaaacataaacaaataagcgtgtgaagaacaaagaacgagattaaaaatcgaaggaggagaaaaagtcaaaaatcacctgaggaaaaggaagaagaagactcgaggatgaggaagggtctatggcttgcggcggcgtcctggaaatggccgccggatttagcgtcagcaattgcatatctcctccacgagtttttgtttcggagatgatacgatcgtgagatttccttttatcggcggcgtcttgtgttacaaggcccacccaaagtttttttattgtttttttttttttttttgcgtgaacactttttcacaaattaatttataaattatgtaaatatttgcaaatttttgttccaaatgtatttaaatcaatagacattttattactattttgtctattagcgagtgaagctatgaggtttaaaagcattcctaaaatggttttttttttttgatcaatcctaaaatggttttaactttgggtttggaaagttactagtagaagcaataaattgggatatgaagctgtctcccctaaattttcttggaaataaaaagttttaaacaaatattcgaaatcgttcttcaccacaaatcaacgatttgaatttcaagcaagcaatgcataatgttattgcgtaaaccgggaaaattttatattgaccaaagcattttccgtcgctctttaacccctattaatttaaaagatcatattagttttattatgaggtttacaagcagtcccaataattggattaaaaccggttattaatccaaactggttgattaatttgatatttggaattctcatttaactaagagtcccaataaccgggtggtctttttcgttttggacaaaacaggatgttcttttaccagttcttgtaaaaacgacacatcagtgttttactgtttgctggtttaaatgattacttcccccctcctgcacactaatattgcagactctagtagagattggccttgaactaaattaggaaaacaatatatgatctgattttgcagattctagtagttagactttaattcctaatttcttctatcgtaatttaataaaataatacacataaaccaaaatgaagaaacttgagccattagttataagcagaggaaaagaaaagaatgatgatcagttcaagaatcataatcgtgatcttgcttttcgtcttcacaacaaactgtaagtacatttcagatttgcatagttgcatatgtcgtatagttaagtatctgatttcgcacaacaacaaaaaaaaagtgaaaaaaaaaactgaagtatctgatatgaatgtttctagaagtctaaaccgtggattgtttattcacgtatgtggaaaaagaataatcaagaacaagtcaatctgtgaattggaaaacaatcaacgtttctgtttagatttaggaagttgcctataattttttatttttccttattttctttgaatgcttgtttacgtttacttataaataaggatgtagtctcgtttttgaaaagcatccaagcaattgagagttttggaggattctgtcgaattaggccgaggagaagaggacgtagtttctctttgaggagttttactctaatcttgttacgctatcattttctcagttttaataaagagagtttagagattatttttggcttctaacaattggtccgacctaaagatcttatttatctaactttccatattgttttgtacacattcagctttaacagaactaatatctacattctctaccacttctattcactgttcatcttgtgagcaggaaaaaaacccgaatccatagtatttctgtgtgtatccattcacaagaacactctttttcgcggttcctcccttctaccctttatccaacaccacaaacttcctaattctccataaagatatggtaaagttccttaagagtctaaatcatcgagttgataccgttgccattaggaacataaaagcaaacgaaaagcttcatcaacttaaagtatatatctctatttttccattaggcacaaatagatttagtcaaatggaaatggccctaattgacttgtcttcagcaaaaaagattacaagcctccagcaatatttggtgaatactattttaaagccgatatgtaccatcatttcgctggtacgttcagtattgattatgacgtcattattataatgaaaacaagtactaataataacattaattggttatgacggatttgatatatgttcaaaatttgcttgaaatatgcacaaattgtgctcaaaatatgacaaaaacatatgatctagttatttgtgcaaatgttatcaatgtgtcattttcgagtctaaacccaataatacaagttgtagacaaaaaaaatgtattcattcacaattttattaaccaattgtgggaaataaatatattcttaaaataattaggagaaaaccttatggtaaaactactttcaccataaattgcagcttactctatcaatttgattcttgaataggagttgaatattttagttactttatttttgctgcatagattttattgttcataaataatacatacaactgttatatgtggattatttatcaattatcaatattcaaactgagacaaattaaaaacttctctaattagtgtattagactaaccggttttaaaaaagcatgtaattttgattggtttagataactaatgatcgtcttttatattgggcttataggcccttctagtcggcccaacacacatgaatagctcacaaatttctcttctccttcttcctcttttctcacagcttagcacagaccgaattttaatttctaactttgacaaacagattaaaacctttcttcgattcgacactgaatcacgaaatttcgagagagactaagatatg

SEQ ID NO: 2375 - DNA, 3000 bp, Unknown
  misc_feature (1)..( 3000): cDNA_ID_2157589_gDNA_ID_1620527_Annot_ID_159603 3000 nt of promoter + ATG
cctgaccctagaagtttgaatgcagagaaacaaaacttaggcacacatggtgaatcaaacagcaaccatgttttacatggcaggttctgatctcatccatataaacaataactgaaatatacctgtcgagtaagtcagagcacaattcttcaaacttgcccctggtgagagtggtttcaatgtgcttaggcccatcagccgttgcagtgataaaaggcaaactggatacagaatcgaaatcagttaatatcctacataccaatgggaacgaggtaaatagatttgagagggaaaagtgaacctcatgtttgtctgagtcagtgaggaaagctcaattttagctttttcagctgcctccgtcaacctctgaagcgcttgcttgtctttgagaagatctataccttcatccttcttgaaggttgaagcaagccaatcaacgactctctgcattgcaaaagtcgtatctaccagtgagtaagatgatttataaagcatttcagacagacaaagtctgtgttttgactcaccttgtcaaagtcatcacctcccaaatgtgtatcaccagaagtcgaaagcacttcaaaaacaccgtcaccaacctcaaggactacattccaagaaacaaaaacccagtaataattagaatactccaatacctaaaaagaaactaaaagccaaggactttgcgatcccaagtagaactctagtaaaaatacctgagacatcaaaagtaccaccaccaagatcaaaaacaagaatagtttcattgcttttcctctcaaacccataagccaaagaagcagcagtaggctcattaataatcctaagaacttccaatccagcaatacgaccagcatctttagtagccgtcctttgtgaatcattgaagtaagcaggcacagtgatgacagctttcgttactttatcattcaaaaatctcgaagcatcatccacaagcttcctcaaaacctacaacacaaccacatatcaaagctccattcacccaaaactcaaaatgaaaactttaagaaaaaatcaacacaaacctgagcagaaatctcctcagcagcaaattgtttaccaatagcaggacaatcaagcttaacattaccattctcatctttaataactctataagaaacctgcttagactcttcagcaacttcattcattcttctaccaataaacctcttaacagagaagaaagtattctccggattaacaacagcttgacgtttagcaatctgaccaacaagtctatctttactcttagtataagccacaacagaaggtgtagttctttgaccttcagcgttagtcacaatcgttggtttacctccttccatagcagcaacagctgaattcgtcgtgcctaaatcgattccgacgactttctcgttaaccacacggactggaccaacggtgtatcgggaagcgttgttgtttcttcgtcccatacgaaggaaggcggaggttggagtagtgaaaggacttgttctgttgccgaagaagacgcttcgtggaatggaattggttttgttgtcgaggtttttggtggaggaggaagaagacgaagtagggaatccgattccgccgaggatgtgaatttgggcggcggaggaagccatggttggaaatgagagattgataaaacctaagttaggtagatgaagaagaagaagataagaagaaggaaggagaagaaaactatgtgggaagctaagtaagaagaagtggaaggttctagaaaatggttggtggtggtaacatatacctttcgatttgcatttatttataattatttgggcttcgtataattgagcccaacattctcatataaaataacttggcccatcataaaccattcggaacacggttcaaacacaaattaattcgaaccggagattcaaaagcaagaaactgtcaaacacacgtttggaatagagttcgtttcgtgatgcttgctctattcaaagtcatgtcggtatgttttgttaaggacattaattgatttgcgtcttatttaatcactttactaattaaaaacaaagatgcaatcgtgcaaggcccaagttcttctaataggtccacatatcaagcatgatgatgcaaagttgcaaacacaagtaacgtgtcagacattgtttcactactttgttacttgttgtcctaaataacaccattgtgtaattgcgtcatgagtttaatgattactctcagttttcattagtattaataattacttctttatttttgtcagtaaatcttagttttacattgcttgaaagtaaagttttgagatcaaaaaggtagttaagatgttttggccatactgtattaataaaaagatttttggtcagggaatctctttaataaaaagatttttggtagttacaaatagtgtgttacattaaatattaaaattgctttaaagtaaagttttaaaatcagaaaaacacgttttgacccaaattaataagacgattttgatctttaaatagttgtttgtgcctttgtggtggcgactggcgaccatatctggttagtacaaataattcaggagatattttattaaattctaatctcaaacacaaaaaattcataagtcacaaatacacacacacaaaaaaaaaagctttgttgaaaaagtcacgacttttcaaattcactttacgaaagtttatatatctatcttcttcggcttgatcgttcttctctgccacaacaattctcacggttttattcttgtttaccatatttttctgatccaatccaaccaataaccaatcacgattcagagcaattgctttcaggtactctcatcatgagagtctcatgttttctatatttgttaatttctttcgtcttcatgaatgatcgcaatgctgaattattgtgtacggtaattgttagtgtgattaacttattctctactttgccattaactatgtttactttctcattaccagtttttgtattccttaaattaacctcttcatg

SEQ ID NO: 2376 - DNA, 3000 bp, Unknown
  misc_feature (1)..( 3000): cDNA_ID_3067333_gDNA_ID_1620527_Annot_ID_159604 3000 nt of promoter + ATG
tataaagggtgaaacttgacgacaaacaatcctaagctctggatcaggttcacctatagaccatcaaatattaaagtttcaggctcctaccatagacacatcaatacttacaagtgtgaagctgtattcaaaagcatatatattaccctcatacattgtccaagacctcggatataaagcatggtatgtagacttgtctcctttcagattccagtcccaagaaccaatacctgattccgaatcttgtctgttcgaatatataaacttcaatcatctcaaaaaagaatattcactgcaagctaacaaacaagagagagtactgcagtggcttacttgtcaagctttgggttcctaggacataacacactcgagtactttttaccattagcacgtgaaacaaatgcctgcatcaaacaaatccaccaacttagtagagaccatggagagaaatttcaaacagagcataaccatcctgaaactctcttctatcatcttcctcctgcaaagtctatatttgtaacttactgagaattgatttgctaacactggttcatcttcacattttggagggaatagctgccatctctggaattcacctttaaaactccttcctatgcttccagctctgcatgtaaccatagctaaataagtattaagagaacttaccaatatctttacagtaagttctgtatgacaggttacaaatatgatcagagagatggatttctccgaacggttgtttcaatgaaacagttattacataccaatgtggtaaagttgattggatataaaggaaacatacccaatacctccaagtggaacaccatgggaagacgttacagagtgcttggagaatggatctatgaaggccaactgtaatcaatagattattacaatataactgtgtaccaaaaagaaaaagcatatttcaaagactctttggtaaaactgaactaggaaaatgtgtttacccttcctttagcagcttcttctctgcaaagaaaccataaccgaatgccaacaggagcctaccggaacaaaagcaagtctcaaaaacatagttttgacaatcctatcaaacatcctacagaattttaataacagttatatcaaaaacgttttgttttccataggtgtaccagctggaaaatctctttaacactcagattgaattcccgtggagcttttacgtcactatctatctttctttgccatgtcaaagatgcaggtactgccggatcaacctgatttgataagtgggaacaatataagacatcaagccacctttacttgaagattcaggtatcaagttgacataaaataagttacaagtattgtttgatgcagatttaaggactcgaaagatgatggatacgagactaaaacagaacccagaagtttaagctatccaaattagtctaatatatctcaatgaagtccctcaaaacatgaaccacatataagaaatatggaaaaaagcttactttagtatcagaagagtttaaaggttttacatcttcaccaatatccatgatcttttcctcaaacattggtcctaaaaaaaacacagaaacaattcagtgtacaagtcaacaatttcaagtacttatccatctccagttgtcagccatgaagaggttaatttaaggaatacaaaaactggtaatgagaaagtaaacatagttaatggcaaagtagagaataagttaatcacactaacaattaccgtacacaataattcagcattgcgatcattcatgaagacgaaagaaattaacaaatatagaaaacatgagactctcatgatgagagtacctgaaagcaattgctctgaatcgtgattggttattggttggattggatcagaaaaatatggtaaacaagaataaaaccgtgagaattgttgtggcagagaagaacgatcaagccgaagaagatagatatataaactttcgtaaagtgaatttgaaaagtcgtgactttttcaacaaagcttttttttttgtgtgtgtgtatttgtgacttatgaattttttgtgtttgagattagaatttaataaaatatctcctgaattatttgtactaaccagatatggtcgccagtcgccaccacaaaggcacaaacaactatttaaagatcaaaatcgtcttattaatttgggtcaaaacgtgtttttctgattttaaaactttactttaaagcaattttaatatttaatgtaacacactatttgtaactaccaaaaatctttttattaaagagattccctgaccaaaaatctttttattaatacagtatggccaaaacatcttaactacctttttgatctcaaaactttactttcaagcaatgtaaaactaagatttactgacaaaaataaagaagtaattattaatactaatgaaaactgagagtaatcattaaactcatgacgcaattacacaatggtgttatttaggacaacaagtaacaaagtagtgaaacaatgtctgacacgttacttgtgtttgcaactttgcatcatcatgcttgatatgtggacctattagaagaacttgggccttgcacgattgcatctttgtttttaattagtaaagtgattaaataagacgcaaatcaattaatgtccttaacaaaacataccgacatgactttgaatagagcaagcatcacgaaacgaactctattccaaacgtgtgtttgacagtttcttgcttttgaatctccggttcgaattaatttgtgtttgaaccgtgttccgaatggtttatgatgggccaagttattttatatgagaatgttgggctcaattatacgaagcccaaataattataaataaatgcaaatcgaaaggtatatgttaccaccaccaaccattttctagaaccttccacttcttcttacttagcttcccacatagttttcttctccttccttcttcttatcttcttcttcttcatctacctaacttaggttttatcaatctctcatttccaacc

SEQ ID NO: 2377 - DNA, 3000 bp, Unknown
  misc_feature (1)..( 3000): cDNA_ID_3067329_gDNA_ID_1620527_Annot_ID_159605 3000 nt of promoter + ATG
acaggagaagactgtttctgcccatgaaaaggcttttagagcagctgagaaaaagacccgccaccaactttctcaggtaagcttccaacctcgtcgctgttaatcttgtttaatgtttcttcctcgcagtcaactaatcatttgcatttttctggctgaaaggaaaaagtggttgcaacgatttcacacatgagaaaagtccactggtttgagaaatttaattggttcattagcagtgaaaactacttggtcatcagtggtcgtgatgctcagcaaaatgagatgatagttaaacgttacatgtcaaaaggagatctgtaagttttaatatatagaactatttatctagtctttgtgttagtattaaatattcaaagatgatgataagtttttaaccatgctttcttaggtatgtacacgcagagcttcatggagcatctagtactgtgataaagaatcataaacctgaacaaaatgtaccgcctctcactttaaaccaagctggatgttttacggtaagcaatttcatctactattttggttgtttgaattatgtgaatatggtgcaatgtcttgatggcagacttttggatataatatgatgcaggtttgtcatagtcaggcctgggattccaagattgttactagtgcatggtgggtttatcctcatcaggtcactaaaacagctcctactggggaataccttacagttggaagtttcatgatacgaggtaagaaaaactttcttccaccacacccactcatcatgggttttggattattgtttcgtttggacgagagctccttgggagctcatttgaatgagagaagggtaagaggggaagaggaaggaatgaatgatgtagtcatggaaacacatgctcctgatgagcattcagatactgagtcagagaacgaagcagtgaatgaagtggtttctgcctcaggagaagttgatttgcaggaatcaagtacggcattgagccaagatacttcttctttagacatgagttcatctggtattactgaagaaaatgttgcatcagccacctcacagcttgaagatcttcttgatagaacccttggtcttggtgctgcaacggtggcaggcaagaaagatacaatagagacatcaaaagatgatatggaagagaagatgaaacaggaagagaagaatgcagtagtgagagataagccttatatgtcaaaagctgaaagaagaaagcttaagatgggccaaagcggcaacacagctgctgatggtaacactgggcaagaaaagcagcaacgaaaggaaaaagacgtttcttctttaagccaagctaccaagagcatacctgataacaagccagctggggaaaaagttagccgtgggcaaaggggtaaacttaagaaaatgaaggagaagtatgctgatcaagatgaagacgaaagaaaaatacggatggcattgttggcagtaagtacttcccttggattctccattttttgtcatagaccatcattgttctcttatcagtacttcataactggtaaattaatttgtctcccctttgcagtcgtctggaaagccacagaagactgatgttgaatcacagaatgcaaaaaccgcggtcactgaagtgaagaaaccttctgaaggtaaaaaatttcaattttgtcttttttcttctgaaattgtttccgggcatacactttccattagactggaaccatatgatactgatagttgctttgggttgctgtgcagagacagacgatgctgtgaaaatatgttacaggtgtaagaaggttggacatcttgctagggattgtcatgggaaagaaacttcagacatggacaaagtggtgatggaagaagacgatattcatgaagttggggacgaagagaaagaaaaactgattgatgtcgattaccttactggtaacccgttaccaaccgacatccttttatatgcggtccccgtgtgcggcccctacaatgctctccagtcatataaatacagagtcaaagcgattccaggcagcatgaagaaaggaaaaggtaacaacacattctcttccaagtagttgtaaatgtagagcttttggactgtattgatgttgacttttgtgtttggacagctgcaaaaactgcaatgaatctgttcacacatatgtcggaggcgtcagtaagggagaaagagttgatgaaagcttgtacggatccggagctgatggctgctcttgtcgggaatgtgaagatcacagcagcaggtttgacgcagttgaagcagaaacagaagaagggcaagaaaagcgggaaacaacaacatagctaggttttaggtaactgctgcgttgcagcgaagaaggcttttacaaacatatagcagattggttcatatctttgtatgttcactcttgcaaaaacgaaacatcatgttacagcccaaatattatcagaatcaaagtgatttgaaaatttagtaaattttggctaaagagagctctagttatgaactaatacatttcattatcagtaaaatccataaatagctgaaaacaatctcaaaataagcttttaaatcctacggcatggattcttctactcctgttttttttgcttttaaaaccttttctgcttcattttttcttgttttgtagagaactcagaaataatttgcgaattacaatttgatcaaacctctcttcttctcctctttcttcttccttcttcatcaaaactattacatttctacattatctcaaacatctccaaatcattatcttacacgaagaaggaagagataagagcatcaatttttaagtatcggggtttcaatttgcattcgatcttttattccatattttactatttgatttgattttaccaaaacctaaaaaaaaaatctgcaattttgggagggaaaattgtccttcaaactattcttgatttcgtctctgtcccctccaaacaataaccaaaagccaaaagagaagtgctacaaaacatcaatg

SEQ ID NO: 2378 - DNA, 3000 bp, Unknown
  misc_feature (1)..( 3000): cDNA_ID_2157585_gDNA_ID_1620527_Annot_ID_159602 3000 nt of promoter + ATG
tcaagtgagaaactctgagaaacccataaaaacacttgtatatcatttattggtcaaatattattttattgttaaaatttaattatataactaatatttattaaaatactaatatctttcttttttgagaaaccaagaaaatatctcactgatggagatgcccttaataattctcactaattcaagaatcacatgcataactttttgctcaaaaactctgcacgaacaaattagattacatatgacatatctacaatttgttcctccatttaagaaatcgaaatgagaaatctagttaaattcaaattttgtaattattactattaagttgaaaccattttatggcattggaccaatactctagaaataaaccatcattagttagtcattgctaatttatttatggcaatgatatcatccactatattatctaagtacggctagcttcaaccatccctaattttcttaacatatatttgatgattacaagtataggactaaattatatggattgcattatagtgtaatctgctcaattctttattttctaatggataaaagaatcatttttttttcttgtttcttttcttttgtgcaaaggataatgaatccttctttagttctttatgtttgggataaagttgacgcaaacgttcattctcatgcgtacacgtttatccgatgcataaaaaataattccgacgatgtatcatttaattaaacatgcttaattttatattgatgatgtttctgttctatatattgttgcgtttaagacttcactacactatattaataatctagaaaactattttttatatagtaaatgcacgttgtagttgataaataatggtagtctgacaataagtcgacgaagattgattcaaaattctatcctagaaccttgatgtccacgttattaatgcaactaccctaaaagtttaaatcctagatccttcagatctgcaaccatgtatatggtatggcctttggaatattcaggatattcccacggtgctcttgcagttgtgcccgtcgcttgctctcacccgcgaacggcccttaaatccaaactcatatgatttgatttcaaaagcattccataaaactgttttcttgtatacaaagatataggttatggcttgtaccactagcatccatattccgcaacatgtcaacgaagatttctatagttttaacacaatcattttttttgtagatatcttagggtgtcttcaactccacttaaattttccctctatatttattagagtaaaatcatttttaattccacactctatacatcattctaaaacacagtaaaggatatgattactctatatatatgtggagtaactctaatgtttactctattctttttagaataaaatataataaaatgatacatttgagaaaacccctactctattttagaattactatattctagagtaaaaaacatacattggagatgatggtcttttagctagataggatttaggagcttccgcttgatcaaaaaaaaaaaaaacagagagttaggagcttccaaacaaagttcaactatcgtgagtacattaactcattgcggatgttaatatatcttagttgtggctttcaccattatactcaaaataaaagaagtggagacactaagatgtcgactggcctatcaaatgttgaaaaaccatcaaaacaaagatcgagttgattaataattatacagttgtggcagattttaaaactaaccccacaatctattaaaacttgagagtgttccttggaatgaattcaacatgtgtattacaacacaatcaagaaattaattcggtaggaaaccatgattttgatgagacaataaacgattggatccgatcaatttccccataaatttttgcaataataaaatatgtcaaggtcaggttccataactaaaggaaaacaatatctgcatttctttatcgtgtttctccatcttgcatgaataagaagaattgttaaaaagtgaatgcataccttgttgatctaataactaaaaaaaaaaaaaaaagagaaggatcaactgatttacaccaaagacatcttaatttgattggatctagccagtagccacctctcataaaagtttaaaagactttctaaccaatagatgttgttttttgttttggttttaatgttaaatccaatagattttgttcttctcttgaattgtgtgatgtttcaacaagtctggcaaatacacagtggttcgtataattggacgatgtctaccctagtttgggctcatttggtttcttgttgaaatccagttttgggaactaaaaatcattataaaattttaacaacaaaattttcatatctagaaactaaataaacacacatgagaagtaagatttcaaaaatatctgtaattgagttagaatcaaaacaaactttacaagatcatgtgaaaaaaatatacatatattatttttatataagtatatcggacacagttgtaaaatttgagagaaattatttatgaaaaatcaattcaaaataatatatataaaaaacaaatagttttttcccccataaaatatcacgattgtatacaaatttgttgggcaaaaacaatactatgaaaattttcataattagataatttatttatgcaagtttttttttgttattgacttttttatttatttagaagaatatatccttatgaaaatcataacaaagaaagagagtttagttttgcctaaattaggatcaaataaaaaaacaaaattcctgacccataccactctacgacctccctcaaaaaaaaacaaaaaagaaaaaaaaacaataaaaaaatcgactttttagcatctgcttgagcgcgagaggttcatgattccaggaatctcgtgcccaattatatagctttccatttctgtggctttgtaatctgatcggaaatcgaaaacaaacaattttattttcttaaaaaaacaagatcgtggaggagagatg

SEQ ID NO: 2379 - DNA, 3000 bp, Unknown
  misc_feature (1)..( 3000): cDNA_ID_4255192_gDNA_ID_1620528_Annot_ID_159621 3000 nt of promoter + ATG
gcaggcccttttgcatgcttctgttgcatgtcacaagaagcttgtcatagagtgggttgcagctagtgaccttgaagagataactgcacaagaggtgagcctggcactctggtttttgtttctctcagggtacgaaaaaatgtatttactctcatgagcttttgtatgacgtacccttgcagacgccagatgtccataaggctgcatgggatcttttgaaggtacgtgaattttaatggagcctggcacaccaatttggtaaatatgtttgactcaacacttcggttgttgcagggtgctgatggtatcctagtaccaggagggtttggtgatagaggagtgcaagggaagatacttgctacaaagtacgcccgtgaaaatcaagtccctttccttggcatatgcctgggaatgcagctggctgttgttgaatttgcccgctccattcttggttttcacgatgcaaacagcacagagtttgaaccagaaacttcaagcccttgcatcatatttatgccagaagtactaaacaatctggctctctcatttgattgattacatggttttcatgtattaagtatctacttatacttgttcaatctctcaatagggatccacaactcatatggggggcacaatgcgcttagggtcaaggaagacttacttccaggttgctgattgcaagtctgccaagctgtaagcacataatacagtagcacatgataactcgtaggattcatttccaaaatctatataacttctaatctctacattcaggtacggtaatgcaaagtttgtagatgagcgacacaggcacagatatgaggtaatatttcagcttcttctattatacatgttattttccttgagatttcttgtgagttgttgacagtgaaatatatatttttggcaggtaaatccagatatgatatcagaaattgagaaggctggcctctcctttgttgggaaagatgagactgggcgtcgtatggaggtaatatgcttgtggaaaacatgtttaatgtgtgactctgtctgggattggaacaataattgaatgcttttgtgatgttatgcttcattattctactggtttggtgtgcagattgttgaactaccaagtcatccatactttgtgggtgctcagttccatcctgaattcaagtccagacctgggaaaccttctgcattgtttctaggtaaagtctaggttatagtttgatagcttttttgagcaagaatctgtggtaatgtggtggcttactaagaaacactttgattcaacaggtcttatcgcagcagcgtctgggtgtctagaatcagtattgcaaacaggtggcaaggtgaacatagtttcgaaaaatggagtagccaatggatctgcaatggggaaagttcatcagaacggcaatgtctatagcaatggaaacgggcttcaccactgactcgagaaaggaacaattttactgcactttttaagcttttttgcttttaatcaaagctttctttaagcaagtcgacatgtatagtccctgagttttgtttccttgtcttgaaaacttgtttggtttcgttgttagggtttggggagagacatggatatgaatgtgcttcctgttcttgggttactttttacctttcatagctaaaaactaataaagatctatattctagtttcttctggctcgttgaataataacaaaaatttgcagtttgtgttttgtaactaataggtgctttcaacaacttaagtaaagataatatccaagaactttgaatgttacatttttctgtctttattgtatcgctcaatttatttttcccatagaacttgtcaagctaaatcttttcgtactttttagtgttcatgtttttgcagccatccgagctgcgtctgttttatcttttttttttggctttccttacaaaaacctgaactgatctgtttagttctttgcacactgtttctcatcgaagtcgagccatgaaccaccaaatgaatgacatcaacagcgtaaacgcgaaagcgggctgagaatcgtttcttgaaactccattagctgagccggcgttttcggaaggttcatcagcagcagcaccaggagcagaggatggtggctcgtcaaaatcttgaccatcatcattaggtgattctgcagggcgtggtggagatgataccggtgacaaaggagaagcagtaggtgcattatcacctttaacatcaatcattatagcactactaatatgaagcacagagatgttaaacggtagtgctgctacagtgtcttgaagctgagcatcaaggctagacccaggaaccgcagaaccaaacgccacgtctccgtttttcataacggttgcgttcaagaacccttgttggcctctggctagaccgctagattggaaaagagtggtgaggagtactgttttcttgctcagattcttgagtttcttctggtcgtagtaatctaaaacaatgtgaaggctaaggattttcttgatgacggaggttggttggccagagagagaggagagtgcaccgttggaaaccacaaggacggttatggtttgacgtttgttgatggtagaagcgagctgagtttcggagagaagctggttgaaatttgagaaatcatcgtgctcgtttaagatgttagtgatgttgaatgaatttgatgaagtgtagaggaatgtggaagcaaaaaagaagaagaagattgtaagtgaagaagacattgttgtgacttgtgaatcgcttgatgagtttatttaaaaaatttggtggcatttggcttttatattgaataggcatgaggaagagagtgtgtttctccaaactttgtgggaacttggtgttttgtcttggattaagagcacttgtaggtaccgattatattgctcaattcactttagagtaagccacttgttgcacatcgagttctatgcattgggatatacgagtaatctcatagagcgatgatgataatgtaaatggtcatg

SEQ ID NO: 2380 - DNA, 3000 bp, Unknown
  misc_feature (1)..( 3000): cDNA_ID_2157699_gDNA_ID_1620528_Annot_ID_159638 3000 nt of promoter + ATG
ggccttccctgaaagatcaaagtgttcaactttagttcaggtgatggaggaatcaaacgtaaggagtgtgtgggaataatattaccagatgagtggagaggataactttagcaccattttcaatcaaatacttgatcgttggaatggcggcacggattctggtatcgtcagtgatagtctgattatcatcgagaggtacattgagatcagctctcacgaaaaccttcttccccttcaaatcagctgaggtcagatctccgacgctcttcttcgccatagaaaccactcctctgcttcccttcccacgcaccgattcaactttggaagcaacgtggagagagaaacgacgggaatctagagtggcggagaagcctagaggacgcgcggaaacagaggtagagggaattggcagaagggaggcacgtgcgcgagttccggcggaggaagcaacagcgccggtggacttaaggagtgaaaaggcggaacttgcggcagcggaagccatgtggatcaatcaaagaagataaaaagatgaggagatgagaaacagagagagtgactcacaatgttcttatttattagccatttgagattttatgagtttggaatatttctctcttatcactgatgagaggttcaaaagcgattatctttttgatcatatattcgttactgttttgcctcttttgcaaagaaagctactttattgtgcataagatagtttgatctacataatcttaataccattttctcagtctccaatgtaattcaataaaccaaaacattttttcaatgtgcacttatttgatatctgaaattcaaatgatctacagcttgctggttgggagaccaacaggcttggccctagacctcttctccaccgcacgagagagttgcttcaccgcttctttaggcaagtggcgaggtttgctaagccacagtcctccatctaccaccattgttagtccgctcacatatttccctgttaaacaaatcaagcaatgagttacatcatctaaccatgtatatatgttttatattaaagagtgtgctttatttaactcagcataccagaatcacagctgaggtagagtgcagccatagcgatatcccacttctctccaactttataaagaggcatgtactctctggttttgttttcaatctcctcaggtacaagtttactcattccaggtgtacctccaataggacctggagcaatcccgttcactctaatatcatagtcagttccccactccaatgccaagtttcttgtggtagcatcaactgcagcctgtttcaagtttcaaactcctaagatcacatttttgctacatcttttgttcctattacttagttcttgattctctaaccaaaactcaagacattgaatgactctatcagactaatcaaattaccttggctgcagagacatgtatttggtaccaagaagccgtgtagtgcaaagtcgcgctaatgttaataatcgaacctccaccgcttgatgagtctcttccaggcgctcctttcttaagatacttgagagctgcgtgacacatgttgaatgttcctaccgcatcaatgtctaagactgcacatgcacaacaaaaaaacgtttccttgagctaaattgacaaactttcaggcataattcttctcagatcatgatcaaattaatgagaaaacgaaaaaggaacctgttctgaagccattaggagacaaatcctcagcagcagccagaaaattgccagcagcggcgttaacaagaatatcaagtttaccaaaatgctgaaaagttgcttccacaactcttctcgcatcttcttgcttacgaacatcaccttccaatccaatagccttcaaacgaaacagaaatcagacagattcaaacacatatccaacaaacaaagtcctcaaaacaaaaatcgctgattacctggattccaagagatcgaagagcagagacggcgtcatcgaggacttgttttcgtcgtcccatgatagcgatagaagctccatgtttgccaaactgagaagagatctcaaaaccgataccggatccaccaccggtgatgagagccacttgacctctgacgacatcaggtttgaacggagagtccataaccacacactcacacacaagcaaactcgccaaaagctttaagacaaaataaaataaaataaaaggagccagtcgcgtgtctgtctcttcttcttattacttggacctcttcacctactaaccaaactttactttaaatatctccctatttttagtgccaaattacaaattcattatctttctactaattacaatatttgttaccatatgacttcgattgatagtcagcgttttcgttatttaccaaatattaataaccacaaaaactttttttttttttttttaattaattacgaaagcttctttttttgggtgaatattaatacgtaagttttatctaaatccgaatttggtatataatcctagatattttaaaggaatttaataaaaataatttatttttttacaaataaaaaaaaaagggtatcgagttggaattttctacatctgtttgcgccgcgagctcgggtttctttctctctgaagcagaggctcttctagattaaaaaaaaaaaaaatctcaaaaccaaagcttcttcctttttttaccaattcgtatctcccatttttagttttcttcgatctcaaatcacaccatcttagtaagaatgaagtgaagagatttgagaagaaaaaaaacactaatcttgttcccgttcgattcttgaggaaaacaaatttcagctagatttaagatttggaatcgaatattactgtaatgttttgggtgacgggaacctagtgatgaaatcgttgcttgggtttttttgcgctgaagtggaaaccctaatttcttgggctttgtgcagtcacacagtttgcactctgcagtcactaaccatcttcttcttggaagattttgcttaaaggcgttagta

SEQ ID NO: 2381 - DNA, 3000 bp, Unknown
  misc_feature (1)..( 3000): cDNA_ID_3067364_gDNA_ID_1620528_Annot_ID_159637 3000 nt of promoter + ATG
atttcgatgacaaatcagacaatgggattttaaaaagacatacaacttacagaacgacgaacacttgggttcccttcagtttcttcagaagctgcaagattgttcttgtctgctacaaatgtaaaatgggacgaggaagtcaaagagcagttgtattgctttcaatacattataggaacttgacaccactcaccctctccatgatcttgacctactgaggccagattgtcctgattttcatcttttactgggctggttactcggctaactgaggtcagattgtcctcattttcatcttttactgggctggtttctcggctaactgagggatcaaaataaaactcttacacaaaagaggatgcaattcaaatagttgatatttcttaagaatacagcttgtataattcaaagtaaaaattgataacgtgagcaaaaaggtcaatcaatagcgagtgtagatttatgccaacctcttccagaggtataacgtctgagcagctcctcaactggtagatccacttcattttgcaaagcttccaactcttcctgtctttcacgtttggtgaagtgtttttcatcctcctcaatagtatcttcatcatcttcctaagtgtaatcgtgggtttaaaatgagatatggaaaatataactccccaaaagatcagaggtaaataactaataaataaacaataaccaattcaatctccacaaaaactattcaaaactagagtatagcctgtatattggggtgcagggtggtgtcatgacaaagaaaacgatttccttaacaaaaaaatcaagctattctccatctacctttgatgtgcagctagattcaaggagtgatacacagtaactgccgataagtggtaaaataaaaattaaaagatgataaagtgaaactcacggtctcatcctcagattttagatcataatcctcatcgagttcaggacttcctgattcaagacctgcagctaccgcatcaagagaattgttaggattcagctcacttgcttacagtaaacactaatgctgtgttaggtaataaggtgctcacaagaatttatctctggaggtatctgttctgccctctcctcatcactttttgattcgatagttagtagaggttttgaaggagtattttggccctgtttataaggctccactaaattttctgccaacatggttgagtacctgacataaacaaacaggtcaaattctttaaaatctgttctagaataacaaaactatgaaagaaccattcaatagtaacctctcagtttggcctaacagaaattcaagttgcttgtccatagccttcttcttcttctcattgcgtaccaactgatgcttgtaaagcacctacaaagttgccagaccatacataagaacaagtgtcaatacaaagaagttatgccaaaccttaaatttcaaggcccgggaagaaaagtaaaaaaactaccagcttctcaactttcatccaaaactttttcatgtctttcgagatattgagggctactttccgaagtcgctgttcttcttcctgtgatcgacaataaggtcacttaaaaactaatgctggaatgtgtaagtactctgaaagagaaaagaaaggaagaagagagaacctttagcttcctttcttccctagatgcctgatctagcattcctttgctggctctcaaagcaaccttcttcgcctgcgccagcttccatttcctctcagactcaaagtcctacaaaaacatcaacaattagcatagaaacgtcatgcatgcataacaattcttgcagaatgatccaaatagccacccttcaattacctttgacagccaagccatctcctccaatacatggtcccagtgagttttaggacgacgtggttctttaggagcttcgagcgtcttaaaagaaaaaaaaaaacagaaaccgttaacactttcaaatagtgatcagctcaaactagaatctaccgtaagaagatgaactcagacgtaaaaatgaaaacttggagctaaccttctgacgcttagctctggattcattatcaggtttagatttcccactcttggacgccattactatatcaggtttagatttaccacctttagacgccattactaacgcctttaagcaaaatcttccaagaagaagatggttagtgactgcagagtgcaaactgtgtgactgcacaaagcccaagaaattagggtttccacttcagcgcaaaaaaacccaagcaacgatttcatcactaggttcccgtcacccaaaacattacagtaatattcgattccaaatcttaaatctagctgaaatttgttttcctcaagaatcgaacgggaacaagattagtgttttttttcttctcaaatctcttcacttcattcttactaagatggtgtgatttgagatcgaagaaaactaaaaatgggagatacgaattggtaaaaaaaggaagaagctttggttttgagattttttttttttttaatctagaagagcctctgcttcagagagaaagaaacccgagctcgcggcgcaaacagatgtagaaaattccaactcgatacccttttttttttatttgtaaaaaaataaattatttttattaaattcctttaaaatatctaggattatataccaaattcggatttagataaaacttacgtattaatattcacccaaaaaaagaagctttcgtaattaattaaaaaaaaaaaaaaaaagtttttgtggttattaatatttggtaaataacgaaaacgctgactatcaatcgaagtcatatggtaacaaatattgtaattagtagaaagataatgaatttgtaatttggcactaaaaatagggagatatttaaagtaaagtttggttagtaggtgaagaggtccaagtaataagaagaagagacagacacgcgactggctccttttattttattttattttgtcttaaagcttttggcgagtttgcttgtgtgtgagtgtgtggttatg

SEQ ID NO: 2382 - DNA, 3000 bp, Unknown
  misc_feature (1)..( 3000): cDNA_ID_3067377_gDNA_ID_1620528_Annot_ID_159624 3000 nt of promoter + ATG
tctaaattatatattcaacacgtaatgtttaaagaacagatactcccggatgatttcacttttttctttcgtctttttagttagttcattcaacaagaaaacaaaagtaaacctttgaaatgtagctaatggtcaacaatgacagatatactgagaaagatctgttctcaaattattgaatttctcacttcatttcaatagaatttttactgttgaatcctcctcgagttatttgttttacaactcaaaaactgaaattgcattcaatgttatttcgttgttctttttgtttaatttaagattaataaaaatgaaaagcccccctaattaagggttagtagtagtaactagtacgtagacttttttttgtttgacatcatagactaagtagtaacaaaactagagtttgcatccaacaaattaagtcggtttttattttactcatttaagacaactaggaagaaaccgaaggtatgcaaacgtattttttttgcgcgttatgcaaacgtaattaagggtaacacttacggcaataattaattataagaaacagacaaattaacgaccaaaatacgtttgatatgattgagggtaggtataatactatatggttggatggattatacgtggtgaggacaagaggggcagagagtcaaagtcacaatggcgagagtaagatgtatagctgtcataatcttattggctgtcatttgcgtccttggattcttctaaaatttcttagattttataatcgtcggttcaaattaaaaacttaaaaaactgtattttagaagatagagagacacaaaacatgacaaatatatataacttggattagccaaatcgaaagagatgcgtgtacactgtgttgcgttgaattccaatccaagctacaaagtgtctcttgtcttctttaaactcaaatttataaacaaatttatctcattaaatcatatccgtaacactgtcgtgtactcgtagtgtcacggattaacaccatctcccatcacttcgtctacgcgtgtgtatatattgaacaatcagtgatatgtttgttattttattcctttgtaatatagttgctaatttagtcggtatcaccgaacttctaaattaagactataaaagtaaaagtaatatctagtagaaaatcctaactgctcgagaaatatgtaacgaacgacaaagacataggaggaggaaaggagattaattcaaactgccagtttgcacccaataattttagttatatgattataacaatctcaacgtgacgacaaaaaaaatattataacaaccctaaaggacttcatggacagccttacaaaatttttcttacattgtcttgattcattaatatagcaattgcaaaaaagtgagaaaataacctataattatgtaattagcatggtccacctcgacccctattttattaccaatgtaaattgtgcactgtgattcaaacagcaatatgttgttacatggcggcgttctactattttttatatataataattgtcataataactcgacagagttgaataatacagggaggcattatttggtttaatcacgggtcttttcggtgtttaaataaatcatacactagctaacaagtaacagggctttatcaggaagaaaaaaagaagtaacaaggctctgcggattcagtaaaatccaaccgttgatactaatactgaacctggttttattttaatgtgagaaggccaaatgtaatgagaagttggtaaaggataaaggcatgaaaggccggtgttgattctatgccgcaagtgtagaaaaacgacttaccttaataattatgagcaagtagccacatgacgatatttattttgttcgctagtcattaataaccatttatatggtaaacgtgaaaatgaacaggccagagaaacacatgaaaccagatatgatacgtaaaaccaaattgaatatttcgaaattaaagaaaatgtattcgttttttctaggatcacatgagggggtaccatcgttgttgtggatgtactctaattttggttggttgaatgaaaagtctcacaatccatgttattaccaaacgcctcattgtttggatcccacgtatgtatgtcatcacacaactcacccctagagatgtaggaataggccaaacggttcgtattggactaggcttagtctgatttatatgatttttatttagtcatgtttgtttttgtctggttttagatccaatattgatttggtccgcaaatcacggatcggtccacactaaagtagaagaaaaaacagctaatagcattcgtgtgacaagtgaatatacaaatgatcacttgattagtgtatattttgctagactaagtaattatgcattttggtttatagacgtgtgggagataaacacacgtcaaaagaagaatgaccgtagttatactcgcaccttcgttaactaggtctaattaagagtgtagacgacgtatggtacaaggaacgatggagatggtgtgtaaattgtaatgtcaagtgtgtatcaatgacatcatccatgccccgccattgcttaatttccggatcatctatcttataattgatttttgtacttatctcattgacttatacacaaacacaactcatatttccctcatcatctaattacgaaaacggtccaattattcaccttttttcttttacaaaaatgtcaatgcaatgttcccccatcatcagaaaatagtatacatctttatttatattaaaaaaatgttaacaagtaaaaaaaaatgaagaagaaactgttttaaaaaaaaaaaaaaaaaaacatacaaatatgggcctaaattttgtacggcgaatgctgaatattactaaaatgggccttcttaaacagggccatgattcgttgaagtacaagtaaacgtaaagcccaatcataaattcgccggtcggtggtggtatctcctcctctccccgtttttctgggttactgttattcgtgagccaatg

SEQ ID NO: 2383 - DNA, 3000 bp, Unknown
  misc_feature (1)..( 3000): cDNA_ID_2104905_gDNA_ID_1620528_Annot_ID_159626 3000 nt of promoter + ATG
taggggtgagttgtgtgatgacatacatacgtgggatccaaacaatgaggcgtttggtaataacatggattgtgagacttttcattcaaccaaccaaaattagagtacatccacaacaacgatggtaccccctcatgtgatcctagaaaaaacgaatacattttctttaatttcgaaatattcaatttggttttacgtatcatatctggtttcatgtgtttctctggcctgttcattttcacgtttaccatataaatggttattaatgactagcgaacaaaataaatatcgtcatgtggctacttgctcataattattaaggtaagtcgtttttctacacttgcggcatagaatcaacaccggcctttcatgcctttatcctttaccaacttctcattacatttggccttctcacattaaaataaaaccaggttcagtattagtatcaacggttggattttactgaatccgcagagccttgttacttctttttttcttcctgataaagccctgttacttgttagctagtgtatgatttatttaaacaccgaaaagacccgtgattaaaccaaataatgcctccctgtattattcaactctgtcgagttattatgacaattattatatataaaaaatagtagaacgccgccatgtaacaacatattgctgtttgaatcacagtgcacaatttacattggtaataaaataggggtcgaggtggaccatgctaattacataattataggttattttctcacttttttgcaattgctatattaatgaatcaagacaatgtaagaaaaattttgtaaggctgtccatgaagtcctttagggttgttataatattttttttgtcgtcacgttgagattgttataatcatataactaaaattattgggtgcaaactggcagtttgaattaatctcctttcctcctcctatgtctttgtcgttcgttacatatttctcgagcagttaggattttctactagatattacttttacttttatagtcttaatttagaagttcggtgataccgactaaattagcaactatattacaaaggaataaaataacaaacatatcactgattgttcaatatatacacacgcgtagacgaagtgatgggagatggtgttaatccgtgacactacgagtacacgacagtgttacggatatgatttaatgagataaatttgtttataaatttgagtttaaagaagacaagagacactttgtagcttggattggaattcaacgcaacacagtgtacacgcatctctttcgatttggctaatccaagttatatatatttgtcatgttttgtgtctctctatcttctaaaatacagttttttaagtttttaatttgaaccgacgattataaaatctaagaaattttagaagaatccaaggacgcaaatgacagccaataagattatgacagctatacatcttactctcgccattgtgactttgactctctgcccctcttgtcctcaccacgtataatccatccaaccatatagtattatacctaccctcaatcatatcaaacgtattttggtcgttaatttgtctgtttcttataattaattattgccgtaagtgttacccttaattacgtttgcataacgcgcaaaaaaaatacgtttgcataccttcggtttcttcctagttgtcttaaatgagtaaaataaaaaccgacttaatttgttggatgcaaactctagttttgttactacttagtctatgatgtcaaacaaaaaaaagtctacgtactagttactactactaacccttaattaggggggcttttcatttttattaatcttaaattaaacaaaaagaacaacgaaataacattgaatgcaatttcagtttttgagttgtaaaacaaataactcgaggaggattcaacagtaaaaattctattgaaatgaagtgagaaattcaataatttgagaacagatctttctcagtatatctgtcattgttgaccattagctacatttcaaaggtttacttttgttttcttgttgaatgaactaactaaaaagacgaaagaaaaaagtgaaatcatccgggagtatctgttctttaaacattacgtgttgaatatataatttagacgaagaacagtagtactttttattttagaatattagaggaaataaacaaatttaagagaatgttttggtttaatactgtgttctgtttagccgttttatgaataatcgccataatgcatgtggaattcaaacgtgggcgtgtttcttttcgtcttaagtaacactttaagcgtctcgtaaatggttagtatttacgattaaattagaacaaagttaactaagtatttgtcgttaatttactagataatgatttttaaaatataagtttcgagttaatacaaagggaagtaaataatatggcttatacatttagattacgttattttagttttggatctaaatttgtaaagaaattagctaaattaaaggggaaaagggatatgttttttttttttttgttaaagggatatgtaatatttagtcaacgagaattggttaattgggaaacaaaagttattggaagagatcaaaaattttaaatattaatttttgagtttatacaaagggaaagaaatcttatgatttaaacatttagattacattattttaattttcggatttaaatttgtaaagaaattagctacattaaaggggaaaattggagagattaattgccccccataaccagaattggttaattgggaaacaaacaattttagagggggcaagagagaatctttttatggggtgcaattaatttaattccttaaaatgcttaagaaaattcaaaaatttagggagggacaactgccccatattaattaacaaagatcatccccatgagagaaaggcgtttcatcaatgtatataaatactctgttttggaaacagaacccaacaggggacaaaaaaaatcaagaagaaaaa

SEQ ID NO: 2384 - DNA, 3000 bp, Unknown
  misc_feature (1)..( 3000): cDNA_ID_3067368_gDNA_ID_1620528_Annot_ID_159633 3000 nt of promoter + ATG
tgctcattaccttttctctttttctcccaaaaagcagtccctcgaatcaatgaatgcggattattagctggcctctctgcctttaactattgtttgtatctatcaaaggcagtcattgtgttcaagatagaatagtattgattctgagattagaaacaccattacagattcgagaaaaagagcggcatttggtttgtttgtttgttagtttcagatcaagaatcaggcccagatggcgaggagagacatggaacctgcgcctaggacgagagagagataagcagccaagtgaagccagagattggattgcaatcttggattcataaaatcagtagcaagaagatcaacaagtgacatgtatatgagtatcccagcagatgcagcattcaacattccttccaccattattgcctctttgctctctttcctgtagcctaaaccacttgacatccccaaccctattcctatcccaagtggcgccgtcaccgagaaaaatgtcgccattagcactgtcgatttcgacttcatatccgcctattcatatacacacaacatgatcatcatgctatcatcaatcaattgaattttgaacaatgaagaaaaaatgattgttgtgacacgattcgtctaagctaagctacctatgaccataaacgatttggaagagactaaccagggagatgcatccaccgaggccaagaccttcaaagaactgatggaaagatagtgcagccatgagtggctttatggtgtctatgctctgtgaagctccaagtgatatccctataataaccgaatgcacaactatcccaatctcaagcacctgcgacactatacgtcttctgatcaactcggtcgaaccatgtgtgtgtccgtgactagcgtgcgtgtgaatgtgaacatgacccgcatgctcttcttcatctactactacgttcacttgcttgctcccatggttattgctaaaatgttgcctcttgtaataccctgtcgcgaatgtgtcgatcataagagtccccatcgccgacagcatcgctacaaaaccagcaaacgggaacttcccagctgtagtgtcctcaagacatggagagctcaatctctcgaacgcgtctggtaagatatgaacgaaacctgtgcagaggatcactcctgcagcaaaagctttcaccatgaagaagatatcattttccggttgtaacgccggaatccttttcccgatcaacggtagactcacgccgactcctccggctacaagaagtaaagctatcgaaccaagctttagcttcgtcgctttctctgcttcgtcttgagacacaggatcatcgtgacttgtacaatcactcgaggcacaacacatatgcaaacatattatcaatactacacaaattctcaacatagttgttgccgaaaaacatccacattcagacatgagtttaagatatttatgttcttgttctgtaagaaagtaaagtttgaagagttatggtgaagaaagaggagctttttatagagagaaagcgagagagaacctcacttttgaagcgagtggtccataaatgttagtagcagaatctctagttacgtagagttgaccactatacacatttctttgtttgtcgcacacaaaaaaataattaaattctgttattactcttattgtataccattaagtctttaacaatgactagataaaataggatggaacatttacggaaaaaggctgcgaaagaattcattggttagtataagaaattctgcaagcatcttagattgtagtctatggatggttcaagtaagacgccctttcgatctcttctaatcattacttatctatttatacatttttgagatatacaaacaataataaaacaaagacgacaattcaaagatagatgattagggaaagatcatagagactaaaagtgagtttggaacattattggtcttaaactttaggggcgtagaatagggtggaaaagagattagctgtgaatgctaatccttgtaattattaggttagtacatatcttttcactttaccaaaagcaaaatatatgtgtattatgaattgaaaatttgaagacttttttactagaaagtaaaatgtgaagacagaatgtcgtcatgttactatgtgagccgtgaggagagtggttttggtttgatttgttaaatctacttttggattcaagaaacgtaagatggtctcatcgtcctctcaaggtgggatgggtgggtaatgctggcccaatcaaaccacgtgtttcaaattcagatttcaccatcgccacttgagtgtgatggttacctgaacctaatgattttggccttttatatcttgttttcgaaaactctgaactataaataagatatagaggtttgagaaaacaatggttgaattttcataagcaaagaaattggaaagaatccaagtttgatcacacttgactatcatttcactttttttttgtttttaattcctaaaattgatctaatagattatatataaacatatatgtacctaattaatctctggtatatgtaagacattcactttttatttttggttggtaattttatatcgctgcagtatatgatttaacgatttaataattacgaatcataataactatatcaaagcgataccaaaaacgatatagttaaattttataccattattgtctactattttttttaccatttcaagataattttatatcgtttaccgttttttcttcccgcgaaaaaattcataccacattctagctccaattgaattaaaatgtatcaaattctctatcaaatcaggattttataaactataaggtacaatttatatcccagctgattaactctagtccaaagcttaaagacagaacagtataccggactaaatttccggtccattttgtatagggagacattttactaaacaaaccggtttggcgaaccggagtatttgcataactgaaacaacatttataagaaagaaaagtagaa

SEQ ID NO: 2385 - DNA, 3000 bp, Unknown
  misc_feature (1)..( 3000): cDNA_ID_2157664_gDNA_ID_1620528_Annot_ID_159628 3000 nt of promoter + ATG
ctaaactgataattataggattttaagcatgcaatgtatgacaataactagaaacacaagttaacgagatacatagatgattttgttaaggaaagtgacgtgaactactggtgtctctaatcaggcttccatttgaagacacacagagaaaaaaagagaaacgacacaagtttggttaatcatatatagtagattaattctcccaagaaagatattagtactgatcagggaaaatacatcaaatagtgaccaccctgctggttaatcaacaccaagagaccttgtaatatataagttaggaagatgagagagaagtgggaaatgaaaagagatgaaatgggacatcgatgttgtggaaaacacaaagtgaagagaggtctttggtctccagaggaagacgagaagcttcttcgttatatcaccactcatggtcatcctagttggagttccgttccaaagcttgccggttttgtatcttctatctctacttcccttttctttttactattttttgttcatgagtctaaacatacaacatgtgaaaaaataatagtctttcaattcaaaactaattagcaatgagtgaattagcctatgttttttatatactatatgctcgatgtggattaatcctaacagtatctatatgtgtgtatagggttgcagagatgtgggaagagttgcagattaaggtggataaactatctaaggcctgatctgaggagaggttcgtttaatgaggaagaagagcagattatcatcgacgtacatcgtattcttggtaacaaatgggctcagattgctaagcacttacctggacgcactgataatgaagtcaagaacttttggaactcatgcattaagaagaaacttctttctcaaggcttagatccttctacacataatcttatgccttcacacaaaagatcttcttcttcaaacaataataatatccccaagccaaacaaaacgacgtccatcatgaagaaccctactgatcttgatcaatcaaccactgctttttcaatcacaaacatcaatccacccacttccactaaaccaaacaaacttaaatctcctaaccagactacaatcccatctcaaaccgtgatccctatcaatgataacatgtcaagtactcaaaccatgatccctatcaatgatcccatgtcaagtcttttagatgatgagaatatgattcctcactggtcagatgttgatggaatggcgatccacgaagctccgatgttgcctagtgataaggcagtagtgggagtggatgatgatgatctcaacatggacattttgtttaacactccttcttcttctgcttttgatcctgattttgcttccattttctcctctgcaatgtctatcgatttcaatcccatggatgatcttggcagctggaccttttagcttttactctacaatattttcattttctcaagtgtatatatatgaataattgccactttctgcttttcactagttttgaaaagctgagaattttccaaatcagtgtctcatttttttctccatcaatcccactaagactttgttatgtgcaaattgaaattttcaccatctaataaaggctttttggctaatctatacttgcaccgcccatattaacatgcgcctaaatgggctatgttaattgtaaatatgggtgtgagattcaaccaataaagaaagtagcccactagaggcccaatagattcaataagtgtcttgcgttcgcgcgctatgattgatgagagactacacggcggtattccattgaaataataatgctagtttttaatgaaacttcgtgggaagagcgaaggcaaagagggaacatgttacattgccacaccacattcttctaattaaattgcgggcgtacacttgtacatgaatatgcatacaggtgttgaaaaggtcaaattatagtaatcagaagaaaagattcacaaaatgggaatccaattattacgtcccgcgtttgattgaaatgaacaatacggatgaagcaaacataataatctcatgaatattgaaatgattgaggagcaagcaacacgaagaccgacaccgaggcacagtagatcgagaataaaggacatgtattaagtagtgtttattattatagtattggtaataatgtatatacaagataagtggaaccacatggtctgtctccttatcttcatcgtaaacactttagttacttaggatttggtcctttaatttcatcaagttcaccacaatttctcttctacttctttcgacctacatgtataaataatgttaacatttgcatttcatagaaaatctaattgtacatgaagagatagattatatatggaaagtaaatgaaacgagaacgacagtagatgcggtgacatacaattgaaagaaaaatacttgaataagttgttgactaaaatactaatatacagttattcttgtatataacagaattgcctttggaaaatatgggtttaatgtttgattaaaaatctcacaaaacaaaaaaattgctgctaaaaaaatcacataatatcggataccaaccataatttttaaatatgacaaatataagaaagcagcctaaaatgatacaagaaagaatatcgaagtaccaaaagaaaagtaaacacaaatagttaggggaagacttaaaggtcacatgggatgatttggtggcatcattgcatcaaatcctgcacatgctctgcttcttctcttttctatattccttctctctttttattttgttgttacttgttgtcaatactaatacaaaatttatccacacggttttatttttagaataatgttcacatattattattacgagtatataactacctttcaattctctctgcctctcatagttaatatatatacgttcacaatcacttctcttctctatttcttattcattatctcaaccctctctctctctctctcagtacaacttatcatccatcaccatatatagagaatatg

SEQ ID NO: 2386 - DNA, 3000 bp, Unknown
  misc_feature (1)..( 3000): cDNA_ID_3067381_gDNA_ID_1620528_Annot_ID_159623 3000 nt of promoter + ATG
tatctttcttttattttcactgttatccagtactatataaaaacacaacgctgcaaatatggttcaaagtgcaaatttaatcatccaagagaagaggctgcagtaagtgaattttccttttccaaataaaattatccctcgggttgtgtatttgcctgcagacactcgcataaaatcttgtgcttgtaatatgtactgctttagttttttcttgggctgtgcatgcacctagaagcttgatgctcttctttatttcaggttagtgttgaaactcaagattcattgcctgagaggccttctgaacctatgtgcacagtaagatataaacataattgattgacctatcctatttttataaatgctcttacatatgaaactaatatcgattattaatttggcatttctactctgcatcagttctacatgaagactggaaaatgtaaatttggtttgtcatgcaaattccaccatccaaaggatatccagctaccatcatcgagtcaagatattggtagcagtgtggggttaaccagtgagcctgatgccacaaacaatccgcatgtcacatttaccccagcattgtatcacaactcaaaaggactacctgttagatcggtaatgaattcatcttcactttgcataagactgacttataatcatataggcacaatttgtgactttctactatcttattggcactatacttagaactgattatggtttgctagcattgtatgctgacctgttctgacgtctgagaatgaagtttcactaattagattgtagctttttcagggtgaagtggactgcccattctatctcaaaacgggaaggtgaatatctcttgtataatactattttgttgtttagaacattgaaacaaagaacgtgacattaacgttctaacttgttttccttttccataatcagctgcaagtatggagccacttgtcgctacaatcatcctgagaggactggtttgtgatcatgccaaaattttgtggtttttagaacctttaacgtattacttttatccctaaattctcataatgtgcgatgttttgattctgtgcacagcattcattccccaagctgctggggtaaactattctctagtttcatcgaacactgcgaatttgaaccttgggctggttacaccagctacctctttctatcagactcttactcaacccacggtaaaagcctttattcatgttgtgagaaatattcaagagcgcttctttagttgataggggtttaattagagtggaaattgtttcagcttggagtgatttcagcaacttatccccaaagacctggacaatcagaatgtgacgttagtatccttgtttcttttagagattgctgagctttttctcccacatgttagttgaaattttataccaaaagctctgtctttcaatattacagtactacatgaagacaggggagtgcaagtttggagagagatgcaaattccatcacccagcagataggttaagtgcaatgaccaaacaagctcctcaacaaccaaatgtaaagctgagtcttgcagggtatcccagaagagaggtacctataaagtggtattattagaagcctgcatgttgtgagtttgtgtggtaatctcatagacaaaacaaaaactgttgcagggtgcgcttaattgcccttattacatgaagacaggaacttgcaaatacggggcaacatgcaagtttgaccatcctcctccaggtgaggtgatggctaagaccacttcagaagccgatgctgctggagcaaccaacaccgacactactcaatgagtttcccagctttgtgtaacataagatgatatcttgttgtaatcctagtttacttcctatgtactgcatctgtttcgtttcgaaatgcttatcgctcgtgagttctctacttctctttatcatcctaaaacaaaaaagatatcgttgagtgagtcttcttttactcagttgagctcataaaagcaaaattgttcatcaccactcttctctcctcaatgatccaattgagcatttatctgccgttgattcggttctcttggataaatatcgtttccattgtgattttgtttatagcaattgtcagtaaactccaactaatctccacaataagatgaaacaacacgtaacaacaagatgtgacagagtgacgacagagagccagtgcatgaaacatgcttcttcagcaagacacatgtcggtgctaactgctaaatcaaaagtgggtccaatgttttgttcttaagagtcgaagaagaggacatgacatgagaaacagaggcaaaggaagaaaacatggactagttgtctccgtgtctctgattttaagttttgatgaaacatgtggaaggcctctattaatggtataacgacaaatgatgaaagtagcaaaggaggactcaaaaagtttgatgcctttttgattggatcttttaaaaatatgagcacacttccctataatacttctataatccaaaatactcttttgggcctatcttaccaaaattatgcaaacttccacaacacaaacacgagtgtcacaaaccctaaatctaatctcaagagtctggagcagaaaaataaatttaccatggttttgaaatttaccgtttcagtccctttttattttattttcttactcaagcccaatgttgatgtattattttgagattaaaaaacttttgaccaaataaaaaaactattttgatttgctttcaatttgggtttaaataagagtgagggtctcgcaggttagcttataagccgccgccttgaaaatccagaaggccatttttgttggtgaaaggtagaattcgtaaatttcttctgctcactttattgtttcgactcatacccgataatctcttctatgtttggtagagatatcttctcaaagtcttatctttccttaccgtgttctgtgttttttgatgatttaggtgaagaagaagaagcagagacaaaaacgattatg

SEQ ID NO: 2387 - DNA, 3000 bp, Unknown
  misc_feature (1)..( 3000): cDNA_ID_3067445_gDNA_ID_1620529_Annot_ID_159657 3000 nt of promoter + ATG
cggtggggagtcgaggcgggagaatgaggtggtgatcgaaacatctctgtcgggtcctagcgatccagagatgtggatcacggtggacggtgtgccggcgattaggatcatgaatttgaattggagatttagagggaatgaggttgtgactgtgagtgatggtgtttctttggagatcttttgggacgttcatgattggctgtttgaaccctctggttcgtctagtgggttgtttgttttcaagcctaaagctggatttgaatctaaatgtcttagttttaatggtggctatggtgatggtgaaggtgaggatcatgatgtggaagatgacgattcgtcgcccaagtattgtcatgtcctatatgccgtcaaagaactagaatttccatgtcaaaaaaattagttttgtcaggtagttaattatttagcataacctttgtatttttccttaatttcatattgtaatatctgtgatggatatgtttctggttagcgcaaccagcggtaattgataatttgtcatgcatgtgacaaaacgtgaattcggtttttcttgaattgaaaatattgaattttgatgcgttttggagaacaaaatataaggttgaaactagttaaaattgatggactgttttttccgaccatctctagttactctatgagattagtttggactcgttcctatattccggtttgttatgttgatatggctttagcaacaaaaaaacgaactttgttaatttctagtccgaagcattaaggattacaaaaattatctaaagaatatgttgccggttaacactagcctttgttgtagaaggattaaaaaaaaccagaaaatctcgcaatattctgtaaaaaaaaactagaaaaatctcgtaaattgttctatcatatatttaagaaacctagttcatcattgatcttcttcgcgtggcaactcgtaacgacacaatggacaaaagtgattggtctcaaaccactttacggcacactcatcgtcaaagtcatgtccacaaggtaaagccacaagtattcctccagcgttaaactcttccaaacaaattgtgcatctttcgcctgtataattaatcttgtcatatattttcctggttaaggacttgaccacgagtttgcttgcgggtcccaaacagaaattagtggtctcgtcaaacgagacttgaactgcttcttcgatatcagtctcgtcgtgaggaaaaagatacaacgacacttgtaaagcacacccgggagaatgcccattacttgcagaagaagttattttaataacatataaaatatgataaatcacaactggaatattttggtcgctgatccctgcttccttcatgaaattacaccagtctacgagacaaaaatcttggttgaggaattcgttgacaaacgtcaaagtcgtgaaagtcaagatatcattttcattcttgatcactgcattgactctgattgtgccgccggaatcttttggttcaggatcctgtttgatttcgtaatctaacgagactttaaccgctgcctcaatatgactcacatcgagaagaagaagacaccacgacacttctaaagcagaccctggagaatacccttcacttggggaagacattatttcagcaacatggggaataaagtgatacatcatatgtgcagtatcgtagtcgctgagccctgctaccttcaagatattaatcaaatccattttgatttgacactcgttgccatcatcgctgatgagttcgtcggcagacgacgacgtcgtcaaagtcaaggtatcagtttcacggtagatcattgcattgactataattatgcccgcttcttctggtttaggatcgtctttgattttgtgactgaaatccacgcgtagaactgtaaacatgattacaaaccaaaaacaaaaacaatcaaatctggtggcttctgattttttttctttctctttgtagttgtggtcacttgaaaaagaaattgaatcgatgaatgattttagggtttaggctgaataaactcatatatttatagtagagagactctttgtcggtccctaaattttaatgggatttctttgactttttcttttaatctgattaatttccatttattatcttttaaaaattaaaattacataaaagataagggtaaaattatttctaagagatctttttgagatatcagtttccattttttttttcgttttaagaaaatccactataatttgattaaagattttttgtttttgtttttgtctgataatttttttctgtgtttatgacggttaaaatttttgacggttaaaatccattgtttatgacagttaaaatttttgtttccactagaaaaacaagtgatcacatataaccaaagaggatttgatataggtcagtagttagaaaattaggtgaaacctctgttgtagataaatttattggttcgtttcatgagagtaaatcagtaaataaatacaaattttcttctaatctacacaatattactctaattataaactctaattactcttatcacccgccgcaatggtggtcccaaagagtcacgcgcactctagcagctaaatgtctcacgcgcactctagcagctacaaacttccaatgtttgtaacaaacttatctagggtttgtaccagaagagctgggagatttcaattgggaaatgctgaaactagggtttcggttagcgattggcattcaacatcatcgcctcttccgtattccatggttagtttataattttagttcaattcgtaatacaaaatcgccgaaatcaaactaaaatcccataaatctgtttttttttcttcttcgttgaaatcttcattgtattgtcacatttgaattttacatatgcttcaaagttttatctctttgagagaatttaattatttggctgttgaggaagttctaagtggctatcttcttcacttttgttactgattgttttgtatttgttatgtgatcttctactttcatg

SEQ ID NO: 2388 - DNA, 3000 bp, Unknown
  misc_feature (1)..( 3000): cDNA_ID_3067413_gDNA_ID_1620529_Annot_ID_159674 3000 nt of promoter + ATG
gaatgaaaaatttgtaagccaatttccacgagttcactaacatcttccacggacaattcacttttcgctctaacaaagctgcaaaaagaaaaacaaaggtcatcagacacggaatagccaaatgcagcataataagaatcatgtatgcccaacttacataagtgagaaaactacaagacggaaattactacacaatcaatcacaggtacatagtggctactggataaccagtggaaccagtctgtaaaatgatttcagactactagactgcatggtttaagtataaaatctgaacctaactacaattttcacgcaaattccaactgtttattgaactctatcctagtcatgtatcgcgaacacccaaaacccccagcagtttatttcgatatactgactcgattgtaaactgagctaatcgtctctcaaattcatcatcctcgtctacaaatcccaataagaagcagccaattcgaacgagaaaaaataaaaaaatcaacgaggtttatgcaatcaaaatcgaggactcacagttcgataacggagatccatttaagagtggcgtaaacagactctggatcatcgggtcggtgcaactctttgacgcatctcacgacacgcgcgaaggactctttctccttcttcgtctcctccgctacaggcggcggtaaccattcattgtacagatgcatcgcttcttctcagtctccgtctttcgtcgtcttcaattttatgcagattgatgtagtctctcctctctcagacgctgaatttataagctgcgtttgctttttcagtttattttctcttgttttctttccaagcaagaaaaatcatatccgaggaaaaggacaatgaacataccatagaaatgaaaacaacttgaggaaaaaaaaattattgtattgactttaccgttgactggctaccggcaacgggagcggcaggtacaccacttaccgaaaccgactaaataggatttcaaattagccccttaagttttacttataatacaatttacccttaaacatttgacttgtgctatattgtttagatggaacgcatactgtccacaagtaattccggccaataaattgtgaatttaagtctgaccgtacggtggagacacatacgcatagatggatatttttgttgtcaacaggtggaaatttaagcagctattatttgttcatcgaattaacttacgtacgtatatgatgacgacattaacattgcagtttattctgtgttaggtcggggtttgtgataggaccaacgttctaaatgagtgattaaaaattactaaatcatagataaactatcactaaactaattgctaactgaggtttagcagaaattcaatgaattaataataattattttggttttaacaatcaacaaagtcgttgtagtatagtggtaagtattcccgcctgtcacgcgggtgacccgggttcgatccccggcaacggcgtttatttttatttcccttttttgtaatgggccgtttctgtacctgaaaagaagtctttataagcccataaagacgaactaataggcccaaatttgtgatcttaatatattatggactctgttttctttttcgtaagctcttcaattcttaactgtttacacgcaaaagtgccatagtggttaacacttaaaccaaataaagacacctgaaatgttggaaaatatatgactctcagcagtcagcatcacgtaatcgtcgttgagccgcgctatctattttgtgcatttttctttaatatgtactcataagggttttttttttgcatgagcataagcagcgataagttgatacatgagaatgtttacgtgtggacggaagtaaattgttttgcacttgaaaagataaattttatgagtcaatgccattaaacattcttattacaagtttattttctcgaagttgcatctgaataacattgtagtattgattacgagattgaatttatctcgaatagtgagtctaatgagtgtacacatatcggattttggatgggaccataaaacacgacgtggtatttgataattataatttattaagtactgtactgtctgtctgtgttccgaagataatgttaaacaaataacaccacaatctcctatagaaagacaaacctgtcctcataacctaaaccaaaattttcattcaccttagggtgaatatgtcatataaggtaataaagccaatcttgtaataacatatagaattatagatatgattctataattaattaacccaaacaataagtagatatctatattaaaaatcaaatcaaatctagtaatcggaaaaaaaacgaaccgtccctttctccactcaagtagttaaattggttctgtgaaggaagataaatccgctgttcctctcctctctctctctcttcccgttttcacttttgttcgttctctggcggccgatcccgtcgctcgctaccttttaagatattttttttatctaatgaacctgaaattgtaattaggcatataattggggattatttgctgaaattctcatttctagatcgaaaaaagcgaataattcgttttcatttgattcttgcctaatcttagggtatgtcctcccccttgatctgtatagtttttttgatgttgtgatttgttagggtttgtgaattaattgtttcagattgggttttgctcctttttccatttttgtctgctttagtttataggttaggtttccggattttgtgttggagtttctaattttgctttgaattggattattagcccattacgtttcctaggcatagacattgatcaattgcacggtgaatgttttaactttttaagctgttttgatttccttaaactgttcactgattactatttatgtgcagtttatgcccccatttttgagtagggatgtagaatttcttgatttaaaagctttaataatatggtttgtgtgtttgtatatgcaggtgtctttatttatctaccaaaaga

SEQ ID NO: 2389 - DNA, 3000 bp, Unknown
  misc_feature (1)..( 3000): cDNA_ID_2157796_gDNA_ID_1620529_Annot_ID_159673 3000 nt of promoter + ATG
aatcacgccaaacacaataaataaatccaatcagaaagagaaagactatcaactagtccaagttagtgagctctcaatattaaaaaaaaaaaacctggaaatgtagtatagtagacttaatagatcgtgaattccgccagaagtcataaaatagtcctcctttctgtgtgaccttgcaaacctgaatccatacaaaatgatgtattaggtgactgagctaacctgaacactaatacaaatagaggatcagaggatataacccttaccttttctgatgattctccagaattagggacattttcataattcttatactgttctaatctagtttgtctgtatttctctctagaaatattaagtctgtcccacggaatcccctggatatctttccctttccgagcttgctcagccgtggtatcagctactttattgttctgaaaccatataacacgaaattaaaacatagtttaaaaaaaaaaaaagctgtaaaatgagattagaaagtagcatagccaacaaaacatgttccatctcatcatactaaccgaatagtcaaattcttcaacgtcagaatctgaagcaccaagatcatcaccacgaaactcctcatccatatcatcttcaacatcttccatctcatcatctacgtcttccatgtactcagcatcatctcctcgataattagacattcttttggtagataaataaagacacctgcatatacaaacacacaaaccatattattaaagcttttaaatcaagaaattctacatccctactcaaaaatgggggcataaactgcacataaatagtaatcagtgaacagtttaaggaaatcaaaacagcttaaaaagttaaaacattcaccgtgcaattgatcaatgtctatgcctaggaaacgtaatgggctaataatccaattcaaagcaaaattagaaactccaacacaaaatccggaaacctaacctataaactaaagcagacaaaaatggaaaaaggagcaaaacccaatctgaaacaattaattcacaaaccctaacaaatcacaacatcaaaaaaactatacagatcaagggggaggacataccctaagattaggcaagaatcaaatgaaaacgaattattcgcttttttcgatctagaaatgagaatttcagcaaataatccccaattatatgcctaattacaatttcaggttcattagataaaaaaaatatcttaaaaggtagcgagcgacgggatcggccgccagagaacgaacaaaagtgaaaacgggaagagagagagagaggagaggaacagcggatttatcttccttcacagaaccaatttaactacttgagtggagaaagggacggttcgttttttttccgattactagatttgatttgatttttaatatagatatctacttattgtttgggttaattaattatagaatcatatctataattctatatgttattacaagattggctttattaccttatatgacatattcaccctaaggtgaatgaaaattttggtttaggttatgaggacaggtttgtctttctataggagattgtggtgttatttgtttaacattatcttcggaacacagacagacagtacagtacttaataaattataattatcaaataccacgtcgtgttttatggtcccatccaaaatccgatatgtgtacactcattagactcactattcgagataaattcaatctcgtaatcaatactacaatgttattcagatgcaacttcgagaaaataaacttgtaataagaatgtttaatggcattgactcataaaatttatcttttcaagtgcaaaacaatttacttccgtccacacgtaaacattctcatgtatcaacttatcgctgcttatgctcatgcaaaaaaaaaacccttatgagtacatattaaagaaaaatgcacaaaatagatagcgcggctcaacgacgattacgtgatgctgactgctgagagtcatatattttccaacatttcaggtgtctttatttggtttaagtgttaaccactatggcacttttgcgtgtaaacagttaagaattgaagagcttacgaaaaagaaaacagagtccataatatattaagatcacaaatttgggcctattagttcgtctttatgggcttataaagacttcttttcaggtacagaaacggcccattacaaaaaagggaaataaaaataaacgccgttgccggggatcgaacccgggtcacccgcgtgacaggcgggaatacttaccactatactacaacgactttgttgattgttaaaaccaaaataattattattaattcattgaatttctgctaaacctcagttagcaattagtttagtgatagtttatctatgatttagtaatttttaatcactcatttagaacgttggtcctatcacaaaccccgacctaacacagaataaactgcaatgttaatgtcgtcatcatatacgtacgtaagttaattcgatgaacaaataatagctgcttaaatttccacctgttgacaacaaaaatatccatctatgcgtatgtgtctccaccgtacggtcagacttaaattcacaatttattggccggaattacttgtggacagtatgcgttccatctaaacaatatagcacaagtcaaatgtttaagggtaaattgtattataagtaaaacttaaggggctaatttgaaatcctatttagtcggtttcggtaagtggtgtacctgccgctcccgttgccggtagccagtcaacggtaaagtcaatacaataatttttttttcctcaagttgttttcatttctatggtatgttcattgtccttttcctcggatatgatttttcttgcttggaaagaaaacaagagaaaataaactgaaaaagcaaacgcagcttataaattcagcgtctgagagaggagagactacatcaatctgcataaaattgaagacgacgaaagacggagactgagaagaagcgatg

SEQ ID NO: 2390 - DNA, 3000 bp, Unknown
  misc_feature (1)..( 3000): cDNA_ID_2106031_gDNA_ID_1620529_Annot_ID_159666 3000 nt of promoter + ATG
caactgaaggtaattcggtaggcttcattccagatgtttctaacgtgctttcaacaaggtttgcctcccgtgacacagtagaatctgacttctcaaaacccacattctctcttggaggtggcatgcacaagaataagtctaatgtatactgctggattgctagagtctgaacacaatacactttaacaaatggttcttctgggtgatcatttgtcccaataaaactcaatataggcatagtgactgtaaactcggacaagtaatccatcagcgtttccactggagatgagccatagtccaaatgcacggaatatatggcgttccttctcgcatttgcaagcaaaagcaggcctgcttcagacaatgctatgacttggttgaaaaatgccttttcagcttgtggctcagttgaacttttcaaatcaagtgtctgggtacatctccacgattcagtatcagcgggtagaagccacccttcttccccagcggagacccaaatcttgatttctcgatttagaggaccctacgagaagaacattgccaacagtgtatgcgttagcaacttagcagaaacaaaagcaacaattctaaaatgtgaattcaacaaagcagggccaaataacattatatagcaatgagaaaagtaagtaataatttgagcaaactaacccccgtgataagtatgatgtgatcaggtctttccggggatgtcacaaatatggcagaattgactggaagtccatcatgaggtctcaatactacaagtggttgtgtcttacgatcttgccatatcttaacctgttggtattaagaaaaagtaagcctcacacacaaaaatactagctgttgcaaattattcctggttgtgaagagaatctacagtgagacggaatttagaaaatctcttcaattttggatgagctagcataaccaaactaaagctaacgagtctcaatcaattaaacttcaacgttacacccagttagcagcgaaaacagttaaaattttagttcgtcaggtaaattcaacttcagaaatgttatgaaaaggagtagacgtatattccaagagtatagtgaaggaaattataagaacaaacacaaaccgtgccatcaactgaagaagaaaccaggcgcgtggtcatccattggcacattgacaaatctgtcacttctccatcatgcttacccacaatctgaacaccatcaattagtttatcaagatgacactggagaggtgcctcggcagagaacacttcacctctgccaacttttgtagtatcgattcgcagcacatgtttaccaattgaaactaccaaaatttcctgaaagaatggactttacacaatcagaagtatagacacaacagagcgagctcatgttcacaacagaaaaatatgcaacttcccgtagcaaaagaaatatgttgaaatacctgtttgtggcagtgccaacagacacgtggatgtttggtgtcttcctctccaagtatctgaagagcaacaactatctttccagttatctgggattgttcatctccctcagatccttcggaaattttccacacaaaaacttttccatctagactaacactgttttgaagaaatagacaagtagacggtatgaaataaaatgtaaaacgacaaagtagaagaagcttatagttccagaaccattacctagctaagagatgaacatcttcggcaaagaaagccatgtccgttactctctggagacaaacatgtagttagaatgacgatgatacctgatggatactcgaataagtaactgagaaacaacgaacctgagaatggccacggaacagagacctcaatgctgtgttgatattgagaacacgaatgcttcctcctttcaatccatagcaaatgtagaccttattcacagcaatttgcctaccgagtacaagctgaggatccgagccgtacttggtaatcggagtcacctccagctgcggttgaatctctccctgtaatctcacatcaacatcatacaccgcatgttcaccaaccaatcgccttcccttgggcattttaccgcttggaacatgaataggacccgaaccgccgggaaaagctcgagcgatctcgttgtgatgcgacggctcttggttcgccacggcacctccgttgttgaggagagcgaggatgtgcgttcccggattgtgattgacacggggagattggggattgagaggtggcgtgggataagatagcgttctctgtggttgcaagttagtagcggaggaagaggaagacacatcctgttgcgtttgattcaccggagatggttgggcggcgataccaggcggcgcgtatagttgctgattgtactggttgttaagaaacggacctgtagggggaggataagggttggatgagggtttgaagatagtaccgagatcgaacggcggaggattgtgagggttagtgttaccaggtgaagacgccattgatttacgatcgccgaatctagggtttgcgatatcgatcaatagacaagtgtaatttgaatgtgaaggttcgtgaatatatttcagaaaaagaagactcggcggatctgaagaagaaatcaaaagtcacgtagagaggggaagcgcgaaaagcgagtagagatagacgatgatgacttgaaaggagtgagagaacagctaaagaagttttgtagacttgcgttttcgatagtggggcgtaaatctgatgactaaaagtgatggggtgataatcgcgcaacaaattaaacttgggtttaaaggaattcacaagtaattattattatatgggccacgcgcatcggcccatagaaaccaaccgcaagtatctctctccctccacaacatttatatgaaccctaaaaaaactgatcgaaagttaccatcgttctttccttttggtcttctctgtgcgtataggattcaaggtgtcttttaggtcgaagaataatgaacaaacatttcgagaaaacgttggtgttgtggaacatg

SEQ ID NO: 2391 - DNA, 3000 bp, Unknown
  misc_feature (1)..( 3000): cDNA_ID_3067430_gDNA_ID_1620529_Annot_ID_159667 3000 nt of promoter + ATG
ctcgacactaaaacagagatagtgaacaattacagagcaaaatcttgatatttattgtttggttaagttcctcaagaacctagtgtggttcttatttgctttttcaggtttccaaaagaggccatttccatctttgcgataaccagagataccattttcttcagattatctctgcattgatggtgatcactagatataattcaagatatccatgctgcattctctcttcgatggtgaatgtaaagaaataagtcagatgtagaacaagtaaatatgcaccaatcatatttaaagcagaaagaattattcgtgcttccgtggactgtttattaagttatagggcttaaaaagaccattaaggcccaaactaatgttttcgtgtctgaatttgtgcggaagcgtcctcacattttattgcgattatcaccccataacttttttagtcatagaatttacgcccgcactatcaaaaaagcaagtctactacaaaacttctatagctgttctcactttcaaggcatcatcgtctctctattcttgcttttcgcgcttctctctctacgtgactttcgatttcttcttacttttttctgaaatctattcaagaacctccacattcaattacacttgtctattgatcgatatcgcaaaacctaaatttggcgatcctgaatgcgtctttgaaagtagagagatttaaagatagtgtataaaggagactgaaatgttttccatcttatttctctctttaattaatcctattacattgagttcttatatatagtgtgaggattaggtttacattttatcctcatcctctaaacatttgagcctattagttaagatcgtatcttgacttgaacagctggagatgcttttccttgacgctctcttagccacagaactaactggtttgtcttcttgttctgttgcagatgaccgttgcacttggatggactgaatgggcttctcggggttctcctcttctacagcagcttcctcagtctttaactttctcatcatcatcatgcattcttcctagaatgttttaggattacccaaagtcagtaaatccaaattcaattgttattatatatatatatatatatatatatatatatatatttagaaatgagagatgttaaggttgactattcaccatggtaacagacgtaaaacaggggtttccctcctctggtcgaatcttcaccatggtagaaccgtttcccttgttgcatgttttaccatcaaattccaacatcttgcagagttccttgaatgttttagcatcaaccaaagtcagtaaatccaaagtcaatgctatatatgtacttcacacaatagcacgtaaatacacaaatattagaaatgagagatgttaaaacttgcctttagtgttagaggagaagaagtatgatacgctatatcttgagtaaccagcaagtcccactcctgcttcatgagaatggcaaattaggtaaagtcgtgaaagggtaactgtaagtcccagaaatcagaaatctctcaacttgagatgagatattaaaacttgcctttgatcgacccagcaccatgttagcagggtctagtcgatccacattgttatgactagcctccctgtcccattcctgcgtggagatgagaggcattatgtacttttgaaagggaaacttgtggtaagagaatgatggtttagaatcagagagctagtgagctgcttacagaatacgcatgtttttcactcttgagatgcgtggtgaaatcttcaaagctttgggcaccaaaatcgcattctgagcaaaacaagggagtttcaccggtttcactgcgcttgtagtcctgaagaacaagtcttgttgctcctgtttgttatcctccatagcagcatctgtggattcaaaacagcttaatttgcttgttatcagatgcatgttatgagagagaggccataaaaaatacctgccattaagctatcccagaacaactcttcaggaacatctttaagaatgcttagccggagagctagagctcgtggaggatatgcgagaagaattctgtatcccttcttctctatgtcgtaaagtgtactagctaaagttttcaggtccttagaactggttatgagcattatagtagccggagcaagattctcatcagtccactcaaacaaatccctttgaatatctgtctcagtaagtaaaggaaactaacgtttaatctaaaccctaattaacaaaaaaagagatgaaagaagatttttaactaaccgtgggcatgtttaagagcgattccagtggaagaaagcgttcgcagggattcgtcaccaccagggatctgcgttaggttgccaacggcagtgataaagagaggaccccggcggcagcgccactggcctgacttttccaacgccgattctatcctcggacccaccagacgaggatcatgaccatcgggaagcggacaggtggtcatgttccacaacaccaacgttttctcgaaatgtttgttcattattcttcgacctaaaagacaccttgaatcctatacgcacagagaagaccaaaaggaaagaacgatggtaactttcgatcagtttttttagggttcatataaatgttgtggagggagagagatacttgcggttggtttctatgggccgatgcgcgtggcccatataataataattacttgtgaattcctttaaacccaagtttaatttgttgcgcgattatcaccccatcacttttagtcatcagatttacgccccactatcgaaaacgcaagtctacaaaacttctttagctgttctctcactcctttcaagtcatcatcgtctatctctactcgcttttcgcgcttcccctctctacgtgacttttgatttcttcttcagatccgccgagtcttctttttctgaaatatattcacgaaccttcacattcaaattacacttgtctattgatcgatatcgcaaaccctagattcggcgatcgtaaatca

SEQ ID NO: 2392 - DNA, 3000 bp, Unknown
  misc_feature (1)..( 3000): cDNA_ID_3067417_gDNA_ID_1620529_Annot_ID_159672 3000 nt of promoter + ATG
cagaaaaaaaaaacgattttgtgcgtaacacactccattttttagtgtttaacaaacggtggtagtccattgttttcatcatttacaatatcaacgcaaaagagattgtattttgacagtaaacattggaagaaaaatatatggcttgtaaattgtggcttatagtagtaagcacatattaatatttgattggtaactggatggatgaaaactaactttgttaattatcgctcgcaataagcttctagacttgtcgtttcatattaacaatcggccggtaagcttgggtcatatgttttattactaatgtatcggatgaatgaaattgaactttgttaggtacttactttaaaatgagtgtctcgcaataagcttctagactgtggttgatactagtagtaataactgataactatataagcatgtaatcaatattttattaggatgaatgagatttacctttgttggttattttataatgagtgtgtctagcaataattaaagtttattatactgtgatttaatgaattgtgtagttaaaggtggggactactactttggttgagggaacttggtgggggagtcatgtttttgtgtgtactccaagttccacaaatactaactcttctttgcttccctttttaatatgcaaatcaaccaattatatttctgttattacgaccatctactaatatttaagtctttcttgctatctattttctaaagcatccacttagtaattaaaaaaggagacacttgtaaacttcattatcatcataaaaagcaccaccacaaaaaaaaaattataaccacagcccacaggtccacaagtaaccagcgtcaaacaaaaatcttggttgtttttttttgttgtctaattgaaatagttacttgtcttttgttcatatatgtggatattttgtttggctctatagcaactctcattatttcgcaacctaatcattatggtctcgcgaagtcactcgatctgagccaaaatcagatacttagtggtttgcttgttacatcttatatcatttcgatatttgtcaagaaagaaagaaagaaaaactaatatcatttcgataaaaagaattaaacaacaaggtagtagatgaacaaactaatgacagacaatacacgtatataatagaagcgacaagtcggtggtatgaagatacctggccatgtgcttaactgcaaagaaaagtacttctcaacttcttcttatcaaaattattttttaatgatcgaattatacgaatctgtatagatttataattagaggggtattgggctaattgctagtgagtctagttatactgggtccatactttgagaacatgaaccttacggcccattaaactactcataggcctagatcgctctctactctttttataaaatttcaaacgaatagtataagactataagttttgtgataattgcaaaaatatactcaatctacaattaatttttaaaaaaattttaggggtaaaattattaaaaaatgagtaaacaagttcaacactgaataagtgttaaaaacattatttgcttcgataccataaagtttaaacccaaattcagaatataatcctaataaataaggtgtatgcataaaaagctagtggtggaaactcgagcaccagtctcgattgaaagttgagaagaattatcaactcatggagcatcacaaatagccaattggtcgtaacatagatagtggctacaagtaatatttaactactgaatcgaatttgtagtgatttgttcaaataattcgaaacctattgtaccatttttatacttttttgtaacatcagctaaagtaccaaattaaatgataaaaatgttgttggttaaataatttattgcaatatatactgaaattaggacaaagaggctagatttcttgagggaaataaatgcgggaactgtcgtaaatggggtgtgaaacggcgccgttatttgggtgtctccatgtcttcttccacattctaagaaagaaagaaagaaaattaaataatttattttcatcaactgatgaaacatcaattcaaccaagaacgaaacttcctctcgctcgcgctctactgacaatctgagatccagggattctattccagatcactctcaattctctcctccatatactatcgagcaaacggattcatcatcatactctgcgttgtctccagcagatcagaagaagaataagtagagaagaaacctcaatcaaagtcgttgttctttcttatttcggttatgcttgatttggtttctcctacttgttcaccaattcttcttctctgacccttcgttgactgcaaggtaaagttgccttctttcttttgcccttttgttcttaacctcaaagtctcgattttgttgtgaaatcattccatctctttccgattcatggctcttctgcgttaagttctctggattaggtttagcaattttatacgaatgagtaaagtttgactcaacaaattcttaatttggcgttattcagatacttttgattttgattcgcgactcttttctccttttccctaaggaatgaggtttataactctgtgcagtgctacttgtagttgttgctcctgtaatatgaagctgttcaattaatataaaagtgtctgtttccctataatgttaagcgttttagattaatttgtggtgtaaaaatcatccatacgactcctcaaagtgttttcatctagtgtcactgtggttataacttggatctcatacaagaagctttcctctgtatccaggttgctgcagaagcggacgctgtagttttatccttggtccatgtgttggtagcacaagggtatgagttgttgtaaagtgccagttcttattgaagcacaagttgaagtaagttagttcacggcatactctttggtttctggatagccagagattttgtacgtatctgagttcatcggcttgttgtgggattaatgaaaaagatgtttgctgtaacag

SEQ ID NO: 2393 - DNA, 3000 bp, Unknown
  misc_feature (1)..( 3000): cDNA_ID_3067426_gDNA_ID_1620529_Annot_ID_159669 3000 nt of promoter + ATG
ttctcttaacaatatttgtttttatactcttgcatcgttcactgagatacactattaagcttggtgttaccttgatttggcacatgagatcctttgttacattcgttttgaaacgaaaatcagatttggtatataactggcatttatcgatgatcagtttttgcttttcataccttggtaattttgtttgatttttatttgttgacctgaaacgttattacccttccaggtaatggcttcgcagaaggagatgcagagacaactatcaaatgctgtcactggccctatcgtaaaagaaggtaaaaaactagaagttgccttagggagaatgattgagaaatccagcaagtcaaatgctgatgctctatgggcccacttccaagaggaggctgttaagaatgaaaaggcattacgtgaccatggccagcaaattatgaatgaaacgacaaacttcacgagtaaagagttaaatgccatgtttgagaaaacgatgaagaaggaatttgcttcagttggtccaaccctagcacgtgtagtaactccagttattgaaaaaactgtatcttctgcaatcacagagtccttccaggttagtaatttaagagaaatttagagctgatttatgagaaggtccattgatgaaaaagaaaactgatttctctttatacagagaggaattggtgacaaagcagtcaatcagcttgaaaaatctgttaattcaaagcttgaaacaaccgtagccaggcagattcaagcccaatttcagacatctggcagacaagtcctgcaggtaaaaattcgagtttaaactagtttttttatgccttactgtctcttgtatatatattttttatgcttttcagacagttatgactgattgactggttatatatacaagtcttgtgcatacattctcaactgcatcgttgtttatcgtaaaagcagttgtctcttatatatatttgctgccatttgtcaacttcaggaaggtcttaggtcaagtatggagtcctcagtcataccttcctttgagaggtcatgcaaaaccatgtttgagcaagtagactcaaccttacagaaaggaattggtaagcacacgagcgcaacacagcaacggattgactctggacaatctcagcttgctcatactctgagggtatgatagaaaatcgtccttcttccagattttttggctctttcttctagttatggtagcaaaatccttttttaatcctcatgttaaacatgcttttatacaggaaaccattagttctgcatcatcagttactcaagccctaaatcgtgaattagccgagagtcaaaggaatcgcttagctctcacagctgctggatcaaatcccttggttactcaactaagtaacgggcctttaggtgctcttcttgaaaaggtttgcacatctctggatcaaatttcttaccatgaatattttgtcattttctgcgtgtttgacatgtatatacgttaactgcaatgcatcattgttgtttcaggttgaagcacctatggacccaacaacagagctatcaaggttgatatctgaacgcaagtacgaagaatctttcacatcagctctacaaagaagcgatgtctctatagtatcatggctttgctcacaggtgaattcttttttggatttcctgcatcataagatctcataaccatcagttttgcgtaacatcccatgacactggtgttgtgccaattcaggtggatcttcgtggactactggcgatgaatccgcttccgctgagccaaggtgtgcttctttcactgctgcagcagttagcttgtgacataagcacggacacatcccgtaagctaggttggatgactgatgtggttacagccataaacccatcagatcagatgatagcggtccatgctcgcccaatctttgaacaagtttatcagattttgcaccatcaccgtaacgcaccaggcagcgacgtctctgccgtcagactaataatgcacgtcatcaactctttacttatgagctgcaaatgacatctcgctctctctgtttcttcttgttagttacatgcataaaacataggaaacctctcttctctgtatttctctctctactctagttagattttttttggttacccattagttcaatttcctttaactgtaaacatctggttggttctacgtctataatgttccctttttcttctccgagagaatgagtttgctaggatctggaaaaccctgagaaaacatgaagatcatgtatgggcagggtatactgattttctaatgaaattggttttgaagtaactacaagttacctgcagaatagacagatgagtttgaagacattatgggaatctggtgtggcagtaagcagagaatttgtcaaaattgagcaattgcaataaaaaatctttttctttacttttgagttcagttgatcagtttttggattgaagggtatttgctgttgggttcggttgcctttacttgcatgtgagctcagctgaccatgaattcagaatccttgtcatcttcttctcttttgttggaggttccgatgaagagcaagaagttggaaacaaatgatgggtgaatctctggaaatgtaaatagggcccaataattgaaattaaaggcccaaacgagtaaaatctgaaaattgttttacagaagcggtctcatattttagatataaacacgatcatcaccccaaaacttttcgtgatctgggacatgcccaatttaatattttcattaaagaagaagaaaaaatagctaagtctccaaaagttctctacctgttctcactttcaagtcatcatcgtctctctctctctattgttgctctctctctcgctttttatgtgactttcagatccgccgagtcttctttttgtggaatcttttcaaggagctcagtattctatatacacctctctttgtttgatcgatttcacaaaccctagcttcggcgatcttaaatctgcaaaaaatct

SEQ ID NO: 2394 - DNA, 3000 bp, Unknown
  misc_feature (1)..( 3000): cDNA_ID_2157760_gDNA_ID_1620529_Annot_ID_159663 3000 nt of promoter + ATG
ctccctgatgcactaaagaatctgtatggtaagactttccttttcttggtgtctattgagaaagaaaacatttgggacgggaaggaaatctacaaggttacaaaagtccttctcaagaatgggttacttgaggaagaattgttggaggattcaactgatgtggtcaatccagcctctattgtctctggtgaccaggtaatatcatcagaaataaatagtttagttgttttcatactttaactctctctctcgctaaaccatatttgtgttttactgtagattccactgatgcttgagtatagtcaagagacaaccgacactgttactcctgtttctaaacgtgtgtatgctgataatccaaacgggtctgatcaagcatctgcttcaaagaaggtgtgcattgagcccgtcgacttatatcagtctaatgatggattcggtgaacagattccttcaactaagattgaagattatgagcctaaagaagcagtgacttcaaatgatttgaagtcaagcattgctgagtctgattccacagctgttggtcacccggctcatgtccgtaacggtagtgttgcaccaatcatagtgaaaaaggaatgggtgggcaagaagggacctgtgaggatcaaggttgagaagaagtagaggtggtgaatcgtggattgatgtgttggtttcctgctttctgttttcatgtttcttttttttctctagcactttggttaggttttcttctattttattagaattcagcacttttgttttgctttcaataagttttatctaaacacttaataataaaattttgcttatttaaactttgattctatatctttcctctgagcttatgtttatctatagtttatgtctaacttatttacattttatgagctataacttaagtgaacaaaggttgataatgagtcctaagagcataccattaatttttagtaacctataacccgtatgactaaactctaatctattttaaatttataataattttcaagattcagtaattaaaccataaaaaaattgacgattcacttttactttttttgtacctattatacaaaccctgcgccgtttcactctttttataaaaacttaaacccaaaacacacgttactttgtctctcttcctctctaacttcttttctgagaaactaaaaatctagaagttctggcttattcaatggagacaatgcaccatctttcagacttacatgttcactctactaactggagggtttatgttaagattttggcgctatacaaccataatccaacccttaatggtgatgagacgactatgctattggttgatgaaaaggttcccttagatcctacttctattattagttttctgttattataaagtctatatctttgttgttaaacagagtgacaatctattgattgttctgttttgtagagtagccgtatagatgccaaaattccagagggctcatatctttacaagtttcgagatgttctgagaattggtgtgtggtactacatgtctgattttcaagttgttttgtctcaaagtgaagtcaaatacgccctcagaccaattcacatcaaatgtctgttccatacccaaatgtggcctgttccatctagatcatcaagaaggttttttgactttgcggctcccgatgaagttaagtatgctacagatgatcaatttaattgcgtgacaggtaactgtttttatcttaggtataggtcagactgattttattttggagtttttgatatcaatatttgcttgactttaaatttcagacgctattggtgtgatagtaaaagtttatcctattagaagttttccctttgtttgtcgtcaaggcgagacagactacgagtcaagatatgtcgccttcaagataaaggataatatgtaaggcctatacactctatcttttattctataaacctaaatatattggtttttatatgttcttctttaggggcaatgcaataaaatgtgtagcaattggcaagtattgtgaagagtttgttaacaagtggtttacgagaaccagtttgatcacttttaattatgagcccattgttgctgtgttgaacttttggagaatcactaattatcatggtaacacaactaacacccttaaatttaatttaaatttatggaatcaataaggacttatgtatgtgagagtttactttttttggtgtagggtctaatgtcttaatgactgttgatggaatttctcggctttttattgatcccaagttcaatgatatcaatataccatcctatatgtaagtgtaaatcaactcctattatgttttgtatacgtttgtgcacttatcttgagttaagatgtaactatacattgtttgcagtcgtggctttagtgatctcaatgaagcagataatgatttgatgatggaggttgttgacgagaactgaaattctctatgtacttgatgttatatttgtgtcaaatcctaaatgaacttatgctttatttcttttgttaatctatatattaaagatcctaaaatttgtgtactctattttaatacataaatttcctattttttgaaaaagtcgttccttatgtatctatagcttcctttaagttattgatttgtttgctccacataaaatgcattcattacttcactatattgtcaacacaacatgagtacacattttatactaaatgagatagttgtacatacctcttaatatgtgctagcatcgatgatgaagatattcttcttgacaaacttatttgaacaatgtccttagctacacaaaaaaatatacaagataaacatcaatccattttgaagattatagaattggttattatatagaatcttataatatagaaactacatagattctatcttccatttatcacttatcaacagattataaaaaaaaggtcagccgctatgtactttacaagtctcttcacaccatcatcatagatgctaatttgagactcaatcatg

SEQ ID NO: 2395 - DNA, 3000 bp, Unknown
  misc_feature (1)..( 3000): cDNA_ID_3067513_gDNA_ID_1620530_Annot_ID_159687 3000 nt of promoter + ATG
gtggtttatctaattcataaagcatgggagacggtggctgcacttcaacagcttcaatctcttcatctgtgggcttgagcctgaatataaaagtgtgaaagttttgtccgcgacgccacacatgtgcttgatagattttagactgtggaggggaagaggccatatctgtagcccaaaatgttaaccagcaggtaagacctctggtcaattggtaatttgcctcaacatgctccacaaacacaagtttggttccatgagcttcgttgtgtttgtcgatagcagtgagtgtcatctcacggatcaatacggcattgctttttctctcgctgatttcatttggagacttatccattgatctactacgaaaattgtaatcaaattgctcccatttaatcgagaaaccctaattttcaacaaaacagattccataatcagatttcaaatctcaaccctaactacagagaaatctaggggttttttcttacctgagttttctggaattgatagtgaaacaacaaatactgtcgcaagtattcatcatcttccgctgttccccacttgaccacgcgctgtttcgacgaagattccgatccttcacaatcttcgtccaacttcggaatcttttcaggccggcgatagttaacctccatcaaaagagagtccgccatgattagatcggaaccctaacgcaccttcgagaagagaagacaattgtcgtgttttcttttctctttttttctttctgaagaagaagattcgagagaaagtatctacgtattctcaatgcatgctgcagctaagggcatttccatctattccatccatgagaaacccacaaagtttctcaaacaaaaaaatattaatattatattataatttgattatttgattaaaaaagtattttagttaaaaaattaaaccaatagtaaaatgagaattgtcatgatgggttgtacagagtatctcaaagtttctcaagtggaaactttctacactctctctccttcatttttattatttttatatttttaattgtgagaaactcctatgagatacccccaatgaagatggtctaacatataaataaagaaaaaatacaccgtcaaagtaaaaacgcaaaaagtctgctacgagtctagtgggccgctacaagctcattttcctctttgtatcaggctgaatgtgacatcaagaaaggaaaacggaaataagctaaatttttgggtgagatttcttccctcgtgagatttttttctctttagatatatttttgataacctcttcaaaatgcagaaagcttatatgtctatattaaaattggtgaattttatttttgtttcactaagttggttttcatgaactcattgtttttttccttttaagatatggatagaagaaaaagaaaacaaatttatgaagatccaccaccaccaaaaaaggtaaattaaagttacattcttttctcaaacaaatggatttttgaatatcaattctatttgtgttcatagatctctagaagagaagctagtacatttagagagatagaagaagttgaaaattcagagggtataatattaatacaagcctaatttgatttttcagtcagtgactaacatcatatctctttgtcaccaaaggaatggtatatatactttttccttacaaaccagaccgatagagatcataaagagctccagttcgatcaaagacgaaagggacaccatcttcaggagcagctcgaacaaagacaaccggtggtttatctacatgacaacaaaacacaattaatgaatactagcattgattagaaaagcaaaggtaaaggtggtttagtttgatcagaaaagtaaaacacctagtaaactaatctaaggtcacaaaaggtaaaccaagagaaagtagcagtaccatagtcatcataaggcatgggagagggtggtttcacttcaacatcatccatctctgcatcgcataaacacacacgagttaaacatcagaataggtagcagccaaagaataaaaagaagaaaccaatagagttaaaacgaaatttgtcaccttcgtccttaggcttgaccctgaagatgggaatttcaaactgttttccgcgacgccaaagttcgacttgatagatctgcgatgtaggagcggatgaggccatatcggtagcccagaatgttaaccagcagaggagaccattggcaaatttgaaattagctgagacatgctcgacaaacacaagtttagatccatgagcttcattgtgtttctcaatggcaaagagtgtcacatcacggatcacatcagcattggttcgtatatcgctgataggtggtgaattttccaacggccttatatggaacatgtagtcatatttctcccaatcaaccgtgaaaccctaattaagccaaaaaagacttcttatcagattccgattttcgaattaaccctaattttgaaggaaaggaagcttaaaaattaaagttgaatagtacctcggatttatggaattcgtagtgaaacaaacaatactgtcgaagatactcatcatcttccacgtttcctagcttgagatgtttccaggacgatttcgatccttcgcaagctttgtccaacttcgggatcttttcaggccggccacagttaacctccttcaaaacagagtccgccatgattagatcggaaccctaacggctaacgcacacttagcgagaggtgaatgagagagaggtaatagaagacaattatcgtgtttgttttcttttttgaaatatagatggatgaatgatgatgatgatttgagaaaaaaaaagctcatgagaagcccatttagtagtgaaagagaaggctcaaatattagatgaatggctcatgagaagcccacttaactgggctcattagaagcccattaagagtgaaagaaaagtctcaaatagtcgtctccgtcattgtcgttgctttcctcctccttctcctccgtccagtgtcatcactgtcatg

SEQ ID NO: 2396 - DNA, 3000 bp, Unknown
  misc_feature (1)..( 3000): cDNA_ID_2990809_gDNA_ID_1620530_Annot_ID_159707 3000 nt of promoter + ATG
tgccgaaccggcgccggtttaagaaactctccggtagttacaacgccggaagggaagagatcttcttccaccagaaaacattacgattctgctatcaaaggcattgagactctccaagtctccgacgaaaggtttcaccaccactgatacatcatccatccatcgcttagcaaagttgtcgtatttgttcagagctttttatttgctttcgactctatattggagaaacgagaaaatttgctgatttttttttgtttgctttggttttttctaatttttattcatctggttcttttactgcggagggaaattaaattcagtgtttggaattggaacatcgtatatatagttttttagtaatactgaaaatgtcttcttcagtagaaattgttcatgttattttcgttcactgcatagtgatggaatgaaaaaacggggtcaaattaatagaagaagtaatataaagggggcaaaatgcaatacacatgaagtattaagattttatccattacttcacacatgacgcccttcgtctttttccttattctttctcctctcagaagagtttacttgttctggaaccctaaatctcgaatctggtaactcggatccgataaatcgttccagagatctgttacttctctattcaaggatctgttatcggtgcgaggatctacggattcttctgttcgcgcataatcggtgagtcttaagaatcttcagcttttcgtttgattttgatttatcgtaagatctgatcggtccttagtgtaatcactttatttttcccctgttaagttcacgcgtaacctaagaacttgaatttgatctgtaagctagatttaaccttggttttgtgtattgagttcgttctcggtggaaattggcttatggtgatttatggatgtgacattttggaagtgtttacaaagacgtatttagaaatgcatttggcgatttgctcgatgttgatctgttgttttctcgaacttagctctataagttttgtaattgtaggaaatggcagataacaattcaccacctggctctgtagaacagaaagcagatcaaattgttgaagctaatccattggtgaaggatgatacttcgctggaaaccatagttcgaaggttccaggattcaatgtcagaggcaaagactcataagttctgggagactcaacctgttgggcagtttaaggatattggggatacgagtttgcctgaaggtccgattgagcctgcaactccattatctgaggttaagcaagagccgtacaaccttccttctgtttacgagtggacgacatgtgatatgaactctgatgatatgtgttcagaggtatacaaccttctcaagaacaactatgttgaggatgatgagaatatgttcaggttcaattactccaaggagtttctaaggtgggcactacgtccaccgggttattaccagagctggcatattggagttcgagccaagacttcgaagaaactcgttgctttcatcagcggcgtgccagcaagaatcagggtgcgtgatgaggttgttaaaatggcagagatcaatttcttgtgtgttcacaagaagctcaggtctaagaggctcgctcctgtcatgatcaaggaggtgactagaagggttcacttggagaacatatggcaagcagcttatactgcaggagttatccttcctacaccaatcaccacctgtcaatactggcacaggtcattgaacccgaagaagctaattgatgttgggttttcaaggcttggtgcgagaatgacaatgagcagaaccatcaaactctacaagttaccagatgcaccgatcactcctggattcaggaaaatggaaccacgcgatgtccctgctgttacacggttgcttaggaactacctcagccagtttggagtcgcgactgactttgatgagaatgatgtcgagcattggctactcccaagagaagatgtcgtggacagttacctagtagaaagccctgaaactcacgatgtcactgacttctgcagcttctacactctcccttcaaccatcctcggtaacccgaactacactacattgaaagctgcgtattcttactacaatgtggccacacagacctcgtttcttcagctgatgaatgatgcgctaattgtctcaaagcaaaagggtttcgatgtgttcaacgcgttggatgtgatgcacaatgagagtttcttgaaagaactgaagtttgggccaggagatggacaacttcattactatctctacaattaccgtttgaaaagtgccttgaagccagcggaactcgggcttgttctcttataagctcaacaacttgatttgatggtatcaacaaacttgaaatttgtctctctttttttttcttcagtctgaactacttctcccatggtttactgaaactgagtttaattattttggcaatgcaattttggattttgcttttagtttcacttgtgttctctgagagagttgaccctgagaagtaaagtcaacactagacgtgtgcgagtttcaatggactgcatttttaggtccaagaagtagctacggcccatctatcgtagaagttgttttttgtactaaagcctgttatagccgaactaggtcgctacgtttcctaacttgtcgtttattaggctacttttaaatcgcacgcaccaatccagttcttacacgcgttttcacaaaaaggaccttacatgggttgttcccccaataagaaaattacacgttgcagaatcgaagcagtggtctatccttgttatcgtcctctcgtctttatggctcttccaagtcattttgagaaattttcgattttgagatttttttccaaatattacaaaaggaaataattagattcctctttctgcttgctataccttgatagaacaatataacaatggtgtaagtcttctcgctgtattcgaaattatttggaggaggaaaatggagtgtgttggggctaggaatttcgcagca

SEQ ID NO: 2397 - DNA, 3000 bp, Unknown
  misc_feature (1)..( 3000): cDNA_ID_1009364_gDNA_ID_1620530_Annot_ID_159709 3000 nt of promoter + ATG
tcgttgagacagaatcttccatctctggtcgtctaccacaaatcgaagtcactccatataaaggaacacacttgaactcaaacagacttctactctctgttctactaagtactttcttctcactctgattcatcgatctcggatcaaactcatctgaaccgttgatttcatctccggcggagatatccacacctgccatagcagatgatgatgatgtcaatgaatcttgtcttgtattgatctcaaaggaagaatctttcatagctccgtcgccagaacaagaactttccggtaaagtaaccctagattcaccgttgcaatagcctctaagtccggcgtgagggtcagtgaatggtctgaatggaacagcgactgcaggagaaacttcgtccattaaaggaggaaaaaaaaagaaaaaagaactttcttgaactttaacaaaaacccaaatcaggaatcaaagttgggaagagaaaggagagaaattgaagttggatatctaagtattcaaagagacagatgttagattgttaaaacgcttgggtgtaagagaaaagaacgaaaagtcagacagatttgaacataataaaaattgatgagagtgttgttaactttattagatgaagatgaagacaagaaactcatgactcattagaggaaagtgaagacaaccttagctagcacatgaaacagatagagagagatttgtcaattaaagaaccaaacacacacaaaaaagaaaaagcaaacgttttcccgaggaaaaaaggactaaaatcagagtttcctggattctgggcaattcgtttcagccatttagagattctgaactctctctctccctcaattaatttccaaccaaaaaaacttttttttctctttctttctcacaaacaaatagtttaggggataatcagttttaaagagagaggtctttatttattaaaaaaaatagcacaatgtgagatgttttagtgaacaacaaagtaattagaaagacttaaggaattgtggaaacaaaaacaaagggtatttattttattttgacttgattaaattttatttcttattctatttactatcgtgtcacccctccattattattgggtatctttatagaagttttgaatacagatgttttatacgtttcctattttaccaaaatatcttgcattaaacgttatgaaattagatttaagataaatccaaactttttacataatgagtaatttacttatttcacataaaaataatatctcttaggaattgctcttttcttttgagctttaatcaaaattggtcgacaaaaaacgtaatttacttattttatacaaaaacaaatttcttttattttattttttgtttagtgtaacatgccatatgtcacaaaaatatattttatagtaaaagatgaaaacaccaaaaaatatacaaattatgatacaatttttattagtttagtagaaaatatattcatctacactgaccacactagtacattaatgctactaataaaaatgaggtactataataattacaaaatttactgactagagagcttgctctgatatttttggttctagagttcaaaataaaataatgacaatcgggtggataccaaaaacagaaaggaggagaatcaaactcgagaaggcaagaagtgttgtgttgtcaacagatgattctttttacttccaaaacaatattgaagaaaaaaacaatattgaagaaaaataaaatcattttcgaaataacaatcaaatgggtcccattattgtcggaaaacagaccggatgatcgccacgtagacagagagaaagtcattagatttggtgaagaggatggcgtgtacggtgagagatctgttagttgggatggcgggaaaagatgagccgaagaggttcattgcactgacatagacaacacctctcttttaacttccgtaaatatctttgtgtttccttttttatttggtgtctgttttatttatttacttgtttttaaacaaaaataataatacgtgttccataatcattggaccatgtaatgatatgtgaagtgaaagtagctttggttgggcaacaaatacactgaaccaatcgtatagttatataactaaaaacgtatatatgaatttctgtttttatttatttatttacgatttcatgaatattttttattcactggatatgagtcatgtgaccttgattttatttttatttttgagatatacgtagatagatagacgcatgcaatttctttaaagttaattcattttttttaggatctctcgcagctgtcagataaagtaaaatatctttcgatataaaataaaaaacaaaaccagctcatattgtatagtatactatgtgtcacatattttgagatgatcagttgctacacggatctgttaaaacttaaaaggtagtattgaataaagtggcggtcacatagaagtacaactaatatctatttgttaaattttgtcaatatgatatcaaatacaaaatgataataagaaaattatataaaattagaccatattcttaaatttttatacataaagctaaaacatctaaacttcattacaaggtaagagaaatttgacgaatctggaagttattactgagttattttcgctcgaaatagtaagttaccaacttaccatttttgtgaagctgcaaaaatagtgagacgtgaatcacctattggactgggctaggcccatcgattctctgataaactttcattaaataaacgtttgacttttgccaccacaccgcatgtttgattttttgttgtcgttgaaacaattatatttttcgagacaatacgaaattgattttcccagtgattatgtggctgagtggctcaggttttgtttttctccttaattttcttggccaataaagaaaataaaaaacatgaaatcattactttaaagacaaaaaaaaactcttgctcctgtgttgagagcctaatccaagattctcttccatg

SEQ ID NO: 2398 - DNA, 3000 bp, Unknown
  misc_feature (1)..( 3000): cDNA_ID_2048212_gDNA_ID_1620530_Annot_ID_159708 3000 nt of promoter + ATG
ttatggatttgattgtggatttttgtagttgcctcctatatcaattggtgatggtgctttggatctagtggttattggttgtggtcctgctggtttagccttggctgcagaatcagctaagcttggattaaaagttggactcattggtccagatcttccttttactaacaattacggtgtttgggaagatgaattcaatggtaaaaatctcaatgatccattgttttagtcactatcttcatggtctgtgtttaacatgttgtttattgttactgttgaagatcttgggctgcaaaaatgtattgagcatgtttggagagagactattgtgtatctggatgatgacaagcctattaccattggccgtgcttatggaagagttagtcgacgtttgctccatgaggagcttttgaggaggtaaagtatggttccactatgcatatcttgagaggctttttctctagttatttttgcatgactttgaactgttttaaatacataatttgttattaatgtcttctaggtgtgtcgagtcaggtgtctcgtaccttagctcgaaagttgacagcataacagaagcttctgatggccttagacttgttgcttgtgacgacaataacgtcattccctgcaggtaacaagtcagctagtactattctggttttaccactacgaaaaggttctgacttctagcaaatgcaggcttgccactgttgcttctggagcagcttcgggaaagctcttgcaatacgaagttggtggacctagagtctgtgtgcaaactgcatacggcgtggaggttgaggtataatttgaatatgatattccacagcaataactatatggaggaatcattgttcattgagactgtttttctatttgaaatcttcaggtggaaaatagtccatatgatccagatcaaatggttttcatggattacagagattatactaacgagaaagttcggagcttagaagctgagtatccaacgtttctgtacgccatgcctatgacaaagtcaagactcttcttcgaggttctctttggtgtttctctctccttctagttaaatcgttattgtgataagtctgttgctcatcagctggaaatcctttcaggagacatgtttggcctcaaaagatgtcatgccctttgatttgctaaaaacgaagctcatgttaagattagatacactcggaattcgaattctaaagacttacgaagaggtaagaattggtggtcctatatcaacatagaaacttcttatttgcttttttaattcgtttaatataaaactgtaggagtggtcctatatcccagttggtggttccttgccaaacaccgaacaaaagaatctcgcctttggtgctgccgctagcatggtacatcccgcaacaggtagtaagagcaagaagccttgacccgatgtacttttattcacatcttgaatctgtaccatctctgacttagctttcccccaattaaacaggctattcagttgtgagatctttgtctgaagctccaaaatatgcatcagtcatcgcagagatactaagagaagagactaccaaacagatcaacagtaatatttcaagacaaggtgagctctatataaaccacaaagttaactatgctgttctttcacacaatgagaaacttttaaaacttgtgattttctattttttggcagcttgggatactttatggccaccagaaaggaaaagacagagagcattctttctctttggtcttgcactcatagttcaattcgataccgaaggcattagaagcttcttccgtactttcttccgccttccaaaatggtaagcaagacactgattcgtgattcataacaatgttactgtaaacaagaaaattgattcttcttttcacttactcaggatgtggcaagggtttctaggatcaacattaacatcaggagatctcgttctctttgctttatacatgttcgtcatttcaccaaacaatttgagaaaaggtctcatcaatcatctcatctctgatccaaccggagcaaccatgataaaaacctatctcaaagtatgatttacttatcaactcttaggtttgtgtatatatatgttgatttatctgaataatcgatcaaagaatggtatgtgggttactaggaagttggaaacaaacatgtatagaatctaaggagtgatcgaaatggagatggaaacgaaaagaaaaaaatcagtctttgttttgtggttagtgaccgagaaatgtttaaatcaacaagagtaaaaatgttcaacacatgcttttaatttttatcaatttatttcgcttatattgtttacgattgccatttattttaaatatgatcactttcgtgttcctaagtgcaaattactcaataatctatacacattatttataaacaagaaactgctaattttggattagtgaaactacaagtggttagtgtgccgtctttaatcattaatctaatattaacaagaacagagaacaagtatatgttcgttgcatcacatacagaatctaagaacaagcaccacataattatcaattaaattaatcaatccaatgaaacttcttcttaaccctttaaaaaaacaattactagtcaataaaatcacttctaaattcgctatttgcacattttattcaaaatgaattatatatctttattaatgtcaaccccttgaaataatatagaacattctttctaatatttttctcacaattatatcaattaaaaccttcaaaattatcaataaaacgaccatatcttaaatttcacaaaaatataagtcccaacataacaattttttcgaaaaagacttttctaataaagtaggcgctttcaattttcacaacagtcaataaatacatcacccactttttctatccaagtcaactaaaaacgcgggtcttcttctccaaaacccatttcctcacaaaatccatctgagaaaaagagcaacaagtttcattttcatggtggtg

SEQ ID NO: 2399 - DNA, 3000 bp, Unknown
  misc_feature (1)..( 3000): cDNA_ID_3067475_gDNA_ID_1620530_Annot_ID_159711 3000 nt of promoter + ATG
tgggtttttgttaaagttcaagaaagttcttttttctttttttttcctcctttaatggacgaagtttctcctgcagtcgctgttccattcagaccattcactgaccctcacgccggacttagaggctattgcaacggtgaatctagggttactttaccggaaagttcttgttctggcgacggagctatgaaagattcttcctttgagatcaatacaagacaagattcattgacatcatcatcatctgctatggcaggtgtggatatctccgccggagatgaaatcaacggttcagatgagtttgatccgagatcgatgaatcagagtgagaagaaagtacttagtagaacagagagtagaagtctgtttgagttcaagtgtgttcctttatatggagtgacttcgatttgtggtagacgaccagagatggaagattctgtctcaacgattcctagattccttcaagtttcttctagttcgttgcttgatggtcgagtcactaatggatttaatcctcacttgagtgctcatttctttggtgtttacgatggccatggcggttctcaggtaatgaatcgatttggtttcgatatgatatgatcggaaactgcaaaaacttggtttttgacatttgtttttgtgtgtttaggtagcgaattattgtcgtgagaggatgcatctggctttgacggaggagatagtgaaggagaaaccggagttttgtgacggtgacacgtggcaagagaagtggaagaaggctttgttcaactcttttatgagagttgactcggagattgaaactgtggctcatgctccggaaactgttgggtctacctcggtggttgcggttgtctttccgactcacatctttgtcgcgaattgcggcgactctagggcggttttgtgtcgcggcaaaacgccactcgcgttgtcggttgatcacaaagtaagtatagatgtttctatgaatgaattagtacaatcatatattcattaggacttgcggttttttgttatggtgttaccaatcatagcatgtttctatagattagttaatgtacttatagcgtttgggtctacatttatgtgtagccggatagggatgatgaagcggcgaggatagaagctgccggtgggaaagtaatccggtggaacggggctcgtgtatttggtgttctcgcaatgtcaagatccattggtaattatttaactttctcttgataatgatccatgaatttggttcttttagttgtttccttacattacaacccgtcgcgaacaggcgatagataccttaaaccgtcagtaattccggatccagaagtgacttcagtgcggcgagtaaaagaagatgattgtctcatcttagcaagtgatggtctttgggatgtaatgacaaacgaagaagtgtgcgatttggctcggaaacggattttactatggcataagaagaacgcgatggccggagaggctttgcttccggcggagaaaagaggagaaggaaaagatcctgcagcaatgtccgcggcagagtatttgtcgaagatggctttgcaaaaaggaagcaaagacaatataagtgtggtagtggttgatttgaagggaataaggaaattcaagagcaaatccttgaattgaaaaagaaggtttggaagaaaagtgaaaaaaaaagttttgatggtgggtaaaaattctctttagtgaaaaaagaaagataaaacaacaggtaataattacattgtaatattaatttcctgcttaaatttgttatttactttcttagtcttcccaccattatttaatctttttatatttattttactaacatgatatatataatgtacatgggaatagtgtaacttccaaacaaaaagcccccttgtatttttttttatcttggggttagttgtaataacactacattcgtctacgtaaatatttagtgttattatttgatgtttcataacttctctttgtgtgtgtgttttcgttagagtgatatagtttcaatagtattgacatcattttttcattaccaaaaattacattagtcttcatcaccataattttttcattttgtttaaatctactaaaccaaccagaatatgggatggttgaataaacgtcacaataatttgtaaatccatgtgaatgtttagattgtaggtgattgaagacaaaataatacatacttatatcacaagttaattgtaaagtggtgtgtaaggcagcttttatccccaagaaaaatcatctttttatcacatcaacattattcaacaattacacaaaaaggtaaatatcatatttaaatgtgaaagaatataaataaaattagtcttgtgaaaaatttaatctcttcgaataacattgttttattattcttatttcataaaaaaggaaagaagtaagcgttggttagtaaaagagtgttttttactttctcaagagtttcaatttcttcttcttcagctttatacgcatttaaagcgccgacgaagttgaacactgaagaagaaaaagaggagacgacacgatttttgtctgaattatcagattcagatttcgtttaatcgccagattcatttcgaaaaatcttgcactagattctcttatcttcggtgagctctctctgcgatctttgtttttttttccgagcaatttccggtatttaatgaaacgatggatcgacgaattgatttatttgtaaagctaatcctgtagacaactgagctcaaaacattcaatttttgttaaagagacgagtcgtatctcgagtttgaagttttcgcggttgctgattgatttgatggggatttgaaatttatagtgtgagttttggttagttgctgctagggttttcgaatcacactttgtattgttggtcttgtgttgattgaaatgtatctctagtctttgattactgcttgtgaaattctgatgtttttattatgattgcagggaaattgaagatctgggtcataagcaatagcttaaagc

SEQ ID NO: 2400 - DNA, 3000 bp, Unknown
  misc_feature (1)..( 3000): cDNA_ID_2048208_gDNA_ID_1620530_Annot_ID_159710 3000 nt of promoter + ATG
acctaacattgatcctttctttcctcacactcttcttctgaaactcaaaccgctctttcgtagagagattcgtgcaaataaccttccaaataccaaaaaagattcatcatcaatgatcaatccaaggtaaagtaatcgattttgaatgatactcacaatcctaatttctccttttaactcaattacttgaaaactaaagaaaagaagcccttaattgccaaatttacaagattagcgtctaggactatctcaagatcatccaaaaggtaagaaccctaaacaacaatttctggaaatcgagtaacctaacgctaggagtgaataaagaagcttatttgtttgatacctttggtcgtaaatcaagtgaagctgaagaaggtctgaaaatagaagccatggaagagaatcttggattaggctctcaacacaggagcaagagtttttttttgtctttaaagtaatgatttcatgttttttattttctttattggccaagaaaattaaggagaaaaacaaaacctgagccactcagccacataatcactgggaaaatcaatttcgtattgtctcgaaaaatataattgtttcaacgacaacaaaaaatcaaacatgcggtgtggtggcaaaagtcaaacgtttatttaatgaaagtttatcagagaatcgatgggcctagcccagtccaataggtgattcacgtctcactatttttgcagcttcacaaaaatggtaagttggtaacttactatttcgagcgaaaataactcagtaataacttccagattcgtcaaatttctcttaccttgtaatgaagtttagatgttttagctttatgtataaaaatttaagaatatggtctaattttatataattttcttattatcattttgtatttgatatcatattgacaaaatttaacaaatagatattagttgtacttctatgtgaccgccactttattcaatactaccttttaagttttaacagatccgtgtagcaactgatcatctcaaaatatgtgacacatagtatactatacaatatgagctggttttgttttttattttatatcgaaagatattttactttatctgacagctgcgagagatcctaaaaaaaatgaattaactttaaagaaattgcatgcgtctatctatctacgtatatctcaaaaataaaaataaaatcaaggtcacatgactcatatccagtgaataaaaaatattcatgaaatcgtaaataaataaataaaaacagaaattcatatatacgtttttagttatataactatacgattggttcagtgtatttgttgcccaaccaaagctactttcacttcacatatcattacatggtccaatgattatggaacacgtattattatttttgtttaaaaacaagtaaataaataaaacagacaccaaataaaaaaggaaacacaaagatatttacggaagttaaaagagaggtgttgtctatgtcagtgcaatgaacctcttcggctcatcttttcccgccatcccaactaacagatctctcaccgtacacgccatcctcttcaccaaatctaatgactttctctctgtctacgtggcgatcatccggtctgttttccgacaataatgggacccatttgattgttatttcgaaaatgattttatttttcttcaatattgtttttttcttcaatattgttttggaagtaaaaagaatcatctgttgacaacacaacacttcttgccttctcgagtttgattctcctcctttctgtttttggtatccacccgattgtcattattttattttgaactctagaaccaaaaatatcagagcaagctctctagtcagtaaattttgtaattattatagtacctcatttttattagtagcattaatgtactagtgtggtcagtgtagatgaatatattttctactaaactaataaaaattgtatcataatttgtatattttttggtgttttcatcttttactataaaatatatttttgtgacatatggcatgttacactaaacaaaaaataaaataaaagaaatttgtttttgtataaaataagtaaattacgttttttgtcgaccaattttgattaaagctcaaaagaaaagagcaattcctaagagatattatttttatgtgaaataagtaaattactcattatgtaaaaagtttggatttatcttaaatctaatttcataacgtttaatgcaagatattttggtaaaataggaaacgtataaaacatctgtattcaaaacttctataaagatacccaataataatggaggggtgacacgatagtaaatagaataagaaataaaatttaatcaagtcaaaataaaataaataccctttgtttttgtttccacaattccttaagtctttctaattactttgttgttcactaaaacatctcacattgtgctattttttttaataaataaagacctctctctttaaaactgattatcccctaaactatttgtttgtgagaaagaaagagaaaaaaaagtttttttggttggaaattaattgagggagagagagagttcagaatctctaaatggctgaaacgaattgcccagaatccaggaaactctgattttagtccttttttcctcgggaaaacgtttgctttttcttttttgtgtgtgtttggttctttaattgacaaatctctctctatctgtttcatgtgctagctaaggttgtcttcactttcctctaatgagtcatgagtttcttgtcttcatcttcatctaataaagttaacaacactctcatcaatttttattatgttcaaatctgtctgacttttcgttcttttctcttacacccaagcgttttaacaatctaacatctgtctctttgaatacttagatatccaacttcaatttctctcctttctcttcccaactttgattcctgatttgggtttttgttaaagttcaagaaagttcttttttctttttttttcctccttta

SEQ ID NO: 2401 - DNA, 3000 bp, Unknown
  misc_feature (1)..( 3000): cDNA_ID_2048225_gDNA_ID_1620530_Annot_ID_159705 3000 nt of promoter + ATG
cgtctccgaaacgaaggaacaggggtaacttaacggcgttaagtttaccagcaccgacgccattttggtctccgagaccgtccacggagctagacgctgccgccgttacgttacaaaaggtttacaagagttatcgaacgcgtagaaatcttgctgactgtgcagttgttgttgaagaattatggtacgtttgaatttcagttttatacattttaacccaatgttgatatgaaaattatacttaagtggtgtgtttggtttaggtggaaagaattggaattggcaaagttagaaccgaacaaaaccaatgataaaccagagtctgctgtatcaaggtgggcaagagctggaacaaaagcagcaaaggtaataattaattattcactagtcatacattatcatcattaattcttactttggttaataaaatagtttgatatgcttgataggtggggaaaggattgttgaaagatgataaagcacaaaaattagcattgcgacattggttagaagccgtaagtttaggcttttatttattttactttaatgtatacatattcctttgatttatagtaatgattttaaaaaattattattacagattgatccacgacataggtacgggcataacttacacttatactatgatgtctggtcagaaagtgagagtactcagccatttttcttctggtaaattttacacaaacttagtcaaattttgatttcgaatgttccttagtaaatggagctgattttgatagcaaaccttctgaatgatactaaaggttagacattggagatggcaaggaagtaaatctcaacaaatgttcaagaactcttcttcagcgtcaatgcatcacttaccttggtccggtatgtacacatggtcttcggttatttccggttggtaaaagaaaaccgattttagttctggtttttgactaacagaaagagagacaagcttacgaagtggtcgtggaagatgggaagttagtcagcagacaaaccaagagccttgtggagactactgaaggaaccaaatggatctttgtgttgagcacgacaagaaaactgtacattggtcagaaacagaaaggtcggtttcaacactcgagctttctctccggcgccgcgattaccgccgccggtagaattgtttcacacgatggagttgtaaaagctgtgtggccgtacagtggtcattatcttccgacggaagagaatttcagagaatttatctgtttcttaagagaaaaccacgtgaatctcactaatgtcaaggtgattaagctaattaaatctctaatcccgcattttattatttatttctttgctatattttaataaactttcgtaattaattgtgttgtagatgaatgcgattgacgacgatgatcatctggtcaataatgatggaagcactaagccgtcgatgatggtggcgaaatcggacggttcagatgaacagaaacgattttcatgcaagtggagtacaggaaacggtccaaggatcgggtgtgtgcgggactacccaatggatctgcagacgcgggcgcttgaacaagtcaacctttctcctcgtgtagtcaacggaacaatgggattatttggcccaataccatcgccaagacccagcccaaagattcgtgtctctcctagactatcttgcatgggtcttccaagcccaaggcactaattttaccaattttcctaatctgatcaattaaattatttcaaaatttttgaatattccttttttttttcactcccctaatagtattgggcgattctttatttagagtataacttgtactcatttttatttaaaataatttaattttacatgtatttttatgtttttgaggtttgtaaccttttatttactttgtaccttcgatatcattattttcttcaatcaattataataaaatccacttaaaataatgaatgactatttcataatagaaaacagttatttatttcgactgtccaaagttacaaatatttaattttcctcctcgtacaatttatgattaagaatttagactagtaaagtcaaaataccgagacaaaactaaaagaatgaagtcacgtggggattacgtttgagtatatttgactcataatgatggatggaagtcacgtgccaaacgatctttaccgctcaccaacggcacgcgtagctctcacgcttggtgacgcatttcttactcgtagccaatcccaattttctcacatttttttaacttttaaaaataatttaaaactctacgcgtgttataagtccaaattccaaaataccgaactaaaccggaaaattaaaaaatcgttatgatacgtaattaatatgagttgatgaaatttaagtatggtgataataagtgattgatattgggtttaagtttaacataacgtattagtttgaaaatttgaaacgatttatagttatttatttaaccggatttcggtttaataaaaccgggatatgtggaaccgtgtaagctgaggaataatagttacctgtaaggaaagagaaaaaaggaaagaggagagaagaaagaaaaggaaaagacccaaactttgagaaacaccttcattctcttccttccttcatcaaagcttaaccttttttaatttttatcctcgttttttcaattcgcgtgaagagacagagagagagaaagataaagctagaagagaatcgacattacgaatcttttgttccagatcgtgagagaggaggagttggaagaatgaagatgactattgggtctttgttccaaccctaattttgcagattaatttcgtttttgttgatttctgttttgggtttgcgttgctgattccggtggattaaagggttctttttggagagcacaaatttgttgggtttttttttggggaaagagaattaaaattttctcctttagagtcggcgtttgggttgagagagattattatagtttttagggttttggatttctgaattggtgattatcg

SEQ ID NO: 2402 - DNA, 3000 bp, Unknown
  misc_feature (1)..( 3000): cDNA_ID_2994131_gDNA_ID_1620530_Annot_ID_159693 3000 nt of promoter + ATG
agtgagatggctattaccagttccatcttgtgagacctgatactcctcatgtctttcgactgtttcatcatcttctacaagcatatcatcattatcatcccctgatatctctccttcttctacatcatcacctccaactatccgagacacagaatctaccaaaaccggactattatcaacaggtttctctaattccatctctctttgaactgttccattacaagcttccaaaactccagaacttataacctcattagattcaacagatttaggaacctcctctgcctttttctcactttcaactggatctacttgaacttgagttgcaatattaggcttctccaggacattttggacaatgtcatagtcattcacatccaatgcctcaaagagattcacacaactttctggaacagaatcttgagtttcattaatcataagctcaaagctatcgaaaaaatctgtgtgtctactaacaacagatgcatcttgcaagtcaattccatcacaaatatctccaagcatcaaactcttttcctgtgaaattgtttccaccttctcaccacttgaatcaccagacactccattgagttttgattccgtaattgataaattctccggcggttcgcaagtttctcccggagactcttgagcaatttctatgtaagaaaacacaaatagcatcagaaatagtttcaggcaatttcaagcaacagatgaactttgaattttgattactagaagatgaattaatcattcctaagaactttgacttcgaatcgaacactgacctgttcgtaagaccagctcctggagaactgccggtgtggcaagagaaatttgaggctcccgatcgaaactcgagcaaaagtgataaagcaaagagcgataatttcgattcggcagatgcgtgcgtcggtgaggaaacggagcgacggaagattccattgtctccgccggagaataatctcaaccagtaccgataggctcaacttcggcttgtctttcgccggagaaaggccgtcttgtggcggtggacgatttaaaaatctttattgggcttgtatcatctttgatgttaatgggcttcctgattttgtaggcccaatgaatccttcaacaaacggcgtcgtaataaggatccaaaccctaaaagatttatggattcagagttttcgaaattggaatttctcactctctctatctctcttagccagctctgatcatttcgatttttttccggtgaaaagggaggagaaacatggttgtacgtatcagactgtcgagatttggatgcaaaaatcggccattttttagggttatggctgctgatagcagatctccaagagacgggaagcatcttgaggtcttaggttacttcaatcctttgccaggtgattgacaaaacaaaatgtattccaattggtgttgttcgtagagttttcgattaaaatacacgatctcttggtctatgtgttcaggccaggacggtggtaagaggatgggtctcaagttcgatcgaattaagtatgtttcttctcatctaattctctagtttcttatgtttttttcggtaaaatcaggtaggttttgggttgaatttactcagaaagaggtctctgaatgcttcactagatgattaaggcttttctgcatttgaagtgttttggttaattgctaaagttagcttctagccgcctctagatatcttaatgcattgttgtatagtcaacattgtgttatagttaactatctttcgatctgatacaaaggagctgagttcagtctttgaatggtttttgttatcgaaaggcgaatgaatctacatgtttcccatggttggttttgatcactttctttctcttcatggtattgaaccattagttgaagcaattttctacctcatttaatcactaacttatgaaaggaaaaactgaaatatttgtggaaattcatcaacaagttttgttatataacaaatgaaacttctccgccagtcttgagtctttctatggaacttctgctctgagttctggaattgtttcttattagtgtaagatgaagaacctgttgattatctattcgtatacacacttacttacattcttaattgttcaccatatacaacctcttttgcataattgtatggtcatgtagctttagaatcttgtcatgctctttatcatcatctaaaattaagattataatgtccggatattagaagaacacatgtcaagactacttaaaagttagatcctggtctgtctttcttttgttctgaatgactagtttcaacagaggatgcatatagtttgattaatggacattttgtttgattctcttgttctgtacaggtactggttatctgttggtgctcagccatcagacccggttcaacgtctcctattcagatccggtttacttcctcctcctccaatggtggctatgggacgtaaaggtggagcacgagacacacgcccagttgatccgatgactggtcgctatgtggatgcagagaataaaacagttaatgccaatgataaccagcctaaggaagaggatacagaagccaagagtgcatgattcattagccttctgtcatcgtagcttttcaagttcactttgttgtcgattatattgtgtaatgcagcattagacaactgacttgtttcctttgtttggcgataaacggcaaggtgtttggcactttttgcagaaacggcacatattttgcattgggatattttagattttaaaaaatgaaaaagtaaataaaaatgccagcgagggaattaaaaaaaaaagaatggcagttgttaggtttaaattttataaaggaggaagccacgttttgcgtttagtcgccacccagaaaaaaccctcaagtcttcttcttcttcctcaatctctccacctcttttcaaaccttcttcacactctctctcaatcaatcctttttcttctcaaatctttcagttttgatctctaaatttccagaaa

SEQ ID NO: 2403 - DNA, 3000 bp, Unknown
  misc_feature (1)..( 3000): cDNA_ID_3067492_gDNA_ID_1620530_Annot_ID_159697 3000 nt of promoter + ATG
aagaaaaacaatcgagtgaagatcttctaaattgtcaagttccaattacggggccaccttattggggggtcataatgaatgtcatttttatttataaatactttgtttagcaccgttaatcaatggtcgttttgttcatagtctatactctattttctcaagttatcgttcttaaattattatttttcgcgacatgaagttataaagatgggaaaatgacaactacacgtgcgtttagcacggttttgctgtccgggtacaacgtcttattgtttatcttatacatacaacatttaatccataaaattattcattcaatcagaaagaaggatttggcaaaagaataaattattttctataatagtagtttatgaatatcaatttttttttttttttttttttgttaaattataaatatccaattttgttagataatagattaattttagaattgctaaatccccctaattttatacctatgatcaggcctggctatgatgtatttttttggacgtgaatttttatagttagataatagatttatttgtaggatctacatatacatttttatatccattttatgaaataaatcttaaagttagaacttatttacaatggctgccaatggatttaaattatttgattttttttaattaatggtttgaatttttatacgacaattaattgtgtaacaaaccaaaaagattctaaatatatggcaatcccatatgtcacgcaaaacacaataatttaacttttccttattttacctacaatatttactaaatcttaaaacaaccaaaatttgaactatttgaattatttgtattaaatttcggcaataaattaaaacaaatgtgaaacaaaccaaaaaatacatttacgatcccggaaaatgagcaaacccaattatatgtgcacctaaaaacattctttattttggtttgaatattccatagaattaatagtccataactttttcggtataaaatcataatcaaaattaattccacaactaatatttaaacttataaaaaaaaaaatatcatgagacgaaaaatatagcatgacggatttggattgatatgaaatatagcaggactgttttagaaacacagattcaatatttattttattattttatcatcaccaaattttttaattataatattaatataaattatataattttaatattaaactaaaatcttaaaatttaataatattatttataaaaataaaatatttgccctgtggtataccacgagttaaattccagttgcttaataatattctgtctaaattctaatttttgttatagcaaatggaattggagtgttttttttttataattgcttaagttcaattcattagtaaaagataaaaaaaaattgcagcgacaacaagttaacatgtggcaaaagaagcaaacagaacaaaatcttgaggatattccatgtcttgctttttatcgtttatttacggcacaatgattaattacgaatctacaaagtttggcctacgattgttaatttattagaattatcggcacttttcgatagtcgcgaggaaggaaattaaataaattattcagacctcagaagaagcagatcttgtagattcttttgatgatgacctaattgtgacaaggaaacatcatctagtagggatattaatgagaaatattcttcaaaaagaacattaatatatgtaaagtattataggtccgattgtttacaacaagatcgtaaaatatattcaacaggtaggaagaagaaaataaaactagctgatgttgttgaagtttacatactatatgtgtattaagtttttgattagataaacccagaaattatttaaaaaattgtaaactcaaatttcttcttgttattattttaaaaacatcatttactcttatttacatgcagatggaagaattcgagtcaagtttaactctcacaaaaaacctagccaagttctaatataagtgtgatcaatccaagggtcaagatttattgtccgtggggaaatatcgtatatggtgatctaaggccaatctccaatccccatgatgattatggtacatgctcattttttttttttgctatttcacaactaatcacggttacagtgatgattatggtggtggtgggaatgatgatacattacaacattatgttagttttagctattatatcagttaatcaattaattagtttcatctataatattgatagacttatatacatttgattactctatatagtttgtgaaacattaacatggatatctattcataggatccaaactgcataatctgaatatcaaaagaagctacatttttttttgcttaacctcaactgcaaaacctctttgagtcacaatatgagaaattactacaatactacagaaactattaatgtagtaatgtacaaaatggaccgtggaatatttatgcagaaccatttaactagtgagcgacaccgtgcgtgttcagacagttacaactattgcttttgtggtctattgaaagtttgaaaccagtggtttgctaattagattctcacgtgactttgatcattcattgtaaatttttgtaataaattaacaaaaacatgaacgcgtatcgtgtcatacagaacttatatcatacatactcttttaaatacggaattgtataattattatatcagctatctactttactcgggtcaactgaatttttttattataggaatatacagaaaataaaatttagttaaaacaaaataatttgtttcaaataatctaaactcttcaataattagtagttactagttatatacagagaagatactagcttgctcactgatttttcatttttttttacacaaacaaaaaacaaaaaatccgtacaatacatgtgtctgcatgcgtgtctatatatatacagctactactcttcattgataagaatcaagctattcataaaataaaaagacttatttctcaaaaaaaatg

SEQ ID NO: 2404 - DNA, 3000 bp, Unknown
  misc_feature (1)..( 3000): cDNA_ID_2048229_gDNA_ID_1620530_Annot_ID_159704 3000 nt of promoter + ATG
cgtcttgctttagacgagaatgagcaaattcgatggaatttagggattttgtaggggttttattgtgagagtctgaatttgggaaaaatccgttgagaggtaaaaattataattgcatgattcccacaaggcaacactggaattggtcctaatttgaaacatcgccagactgttttagcttaatattgggtcccacttttatatgttttatgctaattaagtcattaaatccttctcttttctttgtttagaccgccacgttaactattttataatgggcccttacaaatattatggcccatgggtcttacgttataatggtcatctttgttttttttttggttcagtctaactttaacatgcggagaacactattggatagatttttactcaagagtcgacttttatgaaatcgatccattcatattttgagttgccatttctttcttatatgaataaaatatatttttaataactatggaaaaataacgaaaataaaaatcattatagaatagtattttttttatacaaaactacataaatgatatggatacacgtctagcaaaatagcccgttatttatttacactcttcctttaaagttgcaagtcatatcgtgtctctgacttatcggtgcaattttagacaatacagtttcaaactttgacctcttggtcttaggtcaagccaatacaaaagagaagaatgatcattttataaaatttaattactcataatatgaaatcgacattgagaaatgtggccagctcgtcgacataaatagaagaatataaatgaacatatatatcagagtaactcataatatgaaatcgatatccaaaatgtggctgtaatattttagacttaacgacaacgcattatgtagttattttcacctatgcgagaactttaacatcacaacgacacgaaaaaagtaaacaaaaatattcaagtcgaaatactcgtggtacggtcttatttgttgaccaaagttattagttttaaaattttaatccattatctgggaggggatggatgttttacttggtaaaagggtatgcataaatttatatccaaaacccttttcttacggctcaagtagagtcttctaaaaaaaagaagaagaactagagtcttctcaatgcccacgaagaaatcaaattgtatatgtgtagttctctaactataacgtacatacagtattgttattttagctattcaaaatatattggtaattaaaaaattatttgattgtttttcttgaatataacaatcactaattaattattctcgaatcaaaaacgttcaaactaacatattctttttagttttaatagtattgattagtattaatatgtacaaatttgtgaaacgtttttagtccatttgtgacgactgcggtattagcattccgattatatattttgggttaaagataaactttaacgatcatatgacaactagttaacaaaaaatgttgattttgtataagtgtaatcttggtagtaatatattaacacaaacgtgtcattttgtgtcgtgtaaaaggagaacaagtgagacaaatagaccaacagctttgaactaacacgtacgctgcacaatttagtagaaaacaagaagaagaaactcttttgagaaaacccaaaagtaaaaagacttgaccacaattggttgactccgcatttacacaattacacctcaacaccccgaaccggttttggtgctctttaatatgatgtcttaatcacatacatatatggttgctttctttgaccatcataaatcatgctagtaatatttatgtttttaattgaatttaaaaatatgtatggaccactgaatatcaatttaatcaaaccttttcagcttttcttaatcatattggctttgcactatcataatcgtgaggatattatttaaattttagtgacccgcactcaccaaactcgaatgttatatatctgatttgatgtgaaaccctctaaccaagccgagatttattttacaagtttttgtttactagtaacaatgttatatactttggacataaaatgatatatatatatatatatatatatatatactcattaacttattgtataggacatgaaatcaatatactttggtattaccgtcacatatttagctgtattcttaacatatgattgtgttgttcttgtaaatttgataggtttcttgattcaataagaaaagcgcacaacccaagagaatttgattatactagtactcgttatcgaagatagatatagaatgaatccgttgaccgaataataaaaacctaaataatcatcgggattaaaaatatgaaatgcatataagctagtaataaaaaacgacgacgtatgcaatgatgtccccacacgctccggacgtaacgccgtgcgtagatcaacaacacggtcacacacatatgtacagtgagattgtatatatgtgtatgcaactcctaatagtgttatcaaaacttaaataagtaatgagtaccgataatataattcctacgacgacgtattcaaagttgccccacacgctagtatgtattggaaaaattaacaaataaatctaaacattgaaatatgaaaatcaagagctcgtgtggtttgattttttatggttttaaatccgaggaaaacgtaaaacctttgaatcaacaagactcgaagaaaaatcttcactgcgtatcttaaggtccaatcccaattttgttctcacggaaaaaaaaatctaaaaaacattcataaatatattctcattaatatatatatagagacgacagatgagcaaagaagagacataaccataaccataattcttcttattgtctttaataagtgtttctgttttcctaaaacattcgacgaaacttcttcagatcgtaatcagtgtaagtaccttcctcaatctttggatttaaaaccatttttctttcttcatcccatgtctgaatcttttctttttaattttaaaggtagcttta

SEQ ID NO: 2405 - DNA, 3000 bp, Unknown
  misc_feature (1)..( 3000): cDNA_ID_2048243_gDNA_ID_1620530_Annot_ID_159700 3000 nt of promoter + ATG
tacctctcaacggatttttcccaaattcagactctcacaataaaacccctacaaaatccctaaattccatcgaatttgctcattctcgtctaaagcaagacgaagatgacgactgctgtcaacacagtttctggtaattccatcgaattctctcatcctcgatttgatttttttctcgttcttaaattgattttgtgtttattctgattttgagatgatatttttcttcttctggggtttaatgatgatttattagttttactgaagttatttaaggatcaatcaaattattgttttctcttctgcgattgattggtttatggtgaatgtatgaatctaatcattgagattcttagaaggcaatttgtatattatcattgagttcattgcagatatttttttttgggggttttactggtgatttattgagcttaatcaacgatgatttatggttatgttctaggaaattagtgttttttgggatgtgttatattgtaatgttgaacaacactgtggatttgttgtgtgtctcatgttataagatttttggcttttgtttgtttgtttaggtgatgaagatcgttcggacaaaaagattcagggtgatattgatgagagtaaggtcaaagcaccaaacatgttcgaacgagctaaagaagagcttgatgctgttatcggagctattcatcaacgcaagagttcaaagtttgtttgtttctttcttctgatacacttttgtaactagtcttgaatcttctctgtctctaatgttatgaataaggagagttcaaacattggagtttgctaatgtgttataaattcgctttcagggataaaatggaattcaaatcagataaaccaggtaccagtttttctcccatcattgcatcaaatcgtttaattttttttctcggatcgattgttagtctcgagacttacagggtttggtagtaacataactacagagtttgtctattttatgatttgaacatggatacaaatgtgatgttttgtgttcattcttgtttcttgttcaagactcacttcgtttcacatggtttacattgacagaagatggaaagaaaaaaccgaatatgttgaaaaaggcgagggaagacctcaaatctttattcctgaaggaaaaacctcctcgccatcttcatcatcatcacaaagaaactcatggaaggagtgatgatatcagtgagaacacaccggtggatgaagtgaaggctcctaatgttttggagagagccaaggaagaaatcgaagccgtcatcgacaccatccattccaagaagaaggagaaagacggttctggttcaccttcgcgttctcggtctctctcaccggaaaaggagagagctggattcgcatgctctattggaaaggggttggaaaagatatgttctccttggagtgatgataaaaaggattaatttattcttatgattgatgatcataaaacttgtttgttaattgtcatgatagacttgcttttaagcttcaatcagtttgttgattattattaggtacaaagttgttaaattcgtaagcttattttatggattctatgggtattgggtactattactaaatctcacacattttcatatttcagaatcgggtgggccttattggatatgaatcttttagatggcctataatcaggtaggccttgtagattatgaacccatttttctttagaatgggccaatggacctggtcgtgagaaaataagtacaaattacggtttatgctttttatagtgttattggattagtggagtttaatataatctaactctaacctaataataatcaacaaaatgaaagtttaagcttaattttgtatgaattttatatgaattttttaatcttttaaaaaatagtaaaataactcctaatattaataaaataaacaaattagcgaccaaagagagtttatgaactgattctcttgaagcaagtgtatcttcaaaagagctgatactctcctcaccaaagcgatagcccaacatatacctctagatgtatgttgacgttacagatgaatttgtttgtgaacatgtgcatcttacacaagcaagcaagacaaagtgtaatttaattacatcattgttcataaaacaattcttactatatttcatactacataagcaaaaataaaataaaatatgtggatttgtagcaagtgtgaatttattttcattaatgttcataaactttgtattttattaattatgttttttttgtcataacaaagcataaaaagaggaaaacaaaagcaaaaaaatcttggattaatgatcaagaataatttgaatggcaaactatcagaaaaataaaatatgaaaaagtaaatgaacaatgaaaaaaaaagagaggtacaaatgagctgaaaaaggtttttcattagactttctaagttgatggggttttctattaaaaattaagttgaaggttttaaaatggatcagctaaaacttgaggtttttttcaaaaagttttcttctctacaacgaaaaggtgaaaaacaatagttgggaatttgttgctttatacaaaaacaaacaacttagcaatgaaaattgtttgtacgatgccttaatataatgatgatatcaattatcgaagaaaaattgttacgaacaacccacaatatattgatgatttagttaaagaagttcatcgtgagatgctttagctcagaacttagggtattatttgaaaagtcataaagaattaattggaatagtagggaaattaggaaagacacaaagaactagaactcaattgggataagataagacgaacgcacatcaacaagagtacacaatgggtttacaaatataagcaggcccatgaaaggcccagtatatgatacgccactctgacacgtgttaaggcagcattccttttcctgaaagaaaaaaaaaacttcttggctcactttgtctcttgttctcgctgagaagcagaatttagggttccgaccatg

SEQ ID NO: 2406 - DNA, 3000 bp, Unknown
  misc_feature (1)..( 3000): cDNA_ID_2048275_gDNA_ID_1620530_Annot_ID_159691 3000 nt of promoter + ATG
acaaaggcaaagagagagagagagtaccttctgcagttttctcgtctccttggtccatcttagcatcctctggagccccttcaacttcagtagctccattcacaatctcataacgctgcacattccaaatgtcaagccagtgtcaagagaaattcgaagctaactaaagccaacacagctggaaataaagaaaatacaggataactaaatttttcaaaatagtttaatcttgctacaaccaaattaccttgttatacaaaggctgatataacttttgatacttggcttcaagagcagctctctcctcgcggaattttgtctctatttcatcatgtttgccctaaaaaacgaaaaggattctcagataatcatcaaaagaatgcacagcattctcatataatcaaaagcatacaaatatacatttcaacatcatactcacaagataccatatcaatctacaccaatctattgaacaaaagcttatataggaaacgttaatcacaacataagcatagagctcataaaaagtgaatggaagttttcccaaacctgaatctcccgcaaaacctcaacacgccttctaattttaggagtcagattctcgagcacatcagaatgttgtccagctagattctggagcttgttctgtgaatcaaacacataacagttacaaaaaaatctccacagaaactataaaatgacgaaacgcccaaattacatgttcctcttcaagtataatgcaaatcgatataagaagagatagagaaactcaccttaagagcgttgacaagaccagctcgatcctcatctttaagagctgcaaacaaacaaaaaagcttctaaaactttgactaagaagaagcaaagccgcagaaacaaaatcggagatatagatttaccagaagtgagatcgctgacattgaaactgtccttatcgttgctcattttctggaaatttagagatcaaaactgaaagatttgagaagaaaaaggattgattgagagagagtgtgaagaaggtttgaaaagaggtggagagattgaggaagaagaagaagacttgagggttttttctgggtggcgactaaacgcaaaacgtggcttcctcctttataaaatttaaacctaacaactgccattcttttttttttaattccctcgctggcatttttatttactttttcattttttaaaatctaaaatatcccaatgcaaaatatgtgccgtttctgcaaaaagtgccaaacaccttgccgtttatcgccaaacaaaggaaacaagtcagttgtctaatgctgcattacacaatataatcgacaacaaagtgaacttgaaaagctacgatgacagaaggctaatgaatcatgcactcttggcttctgtatcctcttccttaggctggttatcattggcattaactgttttattctctgcatccacatagcgaccagtcatcggatcaactgggcgtgtgtctcgtgctccacctttacgtcccatagccaccattggaggaggaggaagtaaaccggatctgaataggagacgttgaaccgggtctgatggctgagcaccaacagataaccagtacctgtacagaacaagagaatcaaacaaaatgtccattaatcaaactatatgcatcctctgttgaaactagtcattcagaacaaaagaaagacagaccaggatctaacttttaagtagtcttgacatgtgttcttctaatatccggacattataatcttaattttagatgatgataaagagcatgacaagattctaaagctacatgaccatacaattatgcaaaagaggttgtatatggtgaacaattaagaatgtaagtaagtgtgtatacgaatagataatcaacaggttcttcatcttacactaataagaaacaattccagaactcagagcagaagttccatagaaagactcaagactggcggagaagtttcatttgttatataacaaaacttgttgatgaatttccacaaatatttcagtttttcctttcataagttagtgattaaatgaggtagaaaattgcttcaactaatggttcaataccatgaagagaaagaaagtgatcaaaaccaaccatgggaaacatgtagattcattcgcctttcgataacaaaaaccattcaaagactgaactcagctcctttgtatcagatcgaaagatagttaactataacacaatgttgactatacaacaatgcattaagatatctagaggcggctagaagctaactttagcaattaaccaaaacacttcaaatgcagaaaagccttaatcatctagtgaagcattcagagacctctttctgagtaaattcaacccaaaacctacctgattttaccgaaaaaaacataagaaactagagaattagatgagaagaaacatacttaattcgatcgaacttgagacccatcctcttaccaccgtcctggcctgaacacatagaccaagagatcgtgtattttaatcgaaaactctacgaacaacaccaattggaatacattttgttttgtcaatcacctggcaaaggattgaagtaacctaagacctcaagatgcttcccgtctcttggagatctgctatcagcagccataaccctaaaaaatggccgatttttgcatccaaatctcgacagtctgatacgtacaaccatgtttctcctcccttttcaccggaaaaaaatcgaaatgatcagagctggctaagagagatagagagagtgagaaattccaatttcgaaaactctgaatccataaatcttttagggtttggatccttattacgacgccgtttgttgaaggattcattgggcctacaaaatcaggaagcccattaacatcaaagatgatacaagcccaataaagatttttaaatcgtccaccgccacaagacggcctttctccggcgaaagacaagccgaagttgagcctatcggtactggttgagattattctccggcggagacaatg

SEQ ID NO: 2407 - DNA, 3000 bp, Unknown
  misc_feature (1)..( 3000): cDNA_ID_2048382_gDNA_ID_1620531_Annot_ID_159724 3000 nt of promoter + ATG
ctaagtttagtagcctaaccaaacataaggtatggtttgaaacttatttttggcaattcctattaagtcgcagtactctgaatgatcaagcaagtcacggaaatctacaaacagtttctcgaacaccttccactgcactttgattggtcttgaatatggatatggaagaaagccctgcatctcttagatagttagtttctactagaaaagaatttgaaaactttatggacactgttatcctttcttacatcatattcttgtgcgattgatttcagcacggtaaatgtatgttttgtgtcctctaaattgtcaagaagagccagccaaatctttgttgcaagctcaccagcttcttctttcgattggccacaaacaatcaattggtctgccaccagaatataagatgaatgccgtcattagcaatgattcattaagcagagtcaaatgcatataccaaactagcttaccgataagggttccatgcaaaatgcctgaagcaggcatagtggaaagttgaagctgatcattcaagaacacgtaaatatgtccaagcatctcatctatgtctgtatcatccacacctaatatgtttctgctgatgtataaagccacatatctcctgcagctaaaaggctgttaagttccttgaatctaactaagacattattaagctagcttttttcatagaaatcaagtgtgtttccagtcaccgtttgcttaatccttgacgaattggtccaatccagctcttagttttgctagcaagtggatacgcccgattaagagcagccagccataagcattctccgcggaataaattagcccactgctttctaacacacgatacttgttcccaatttgttattggaattctgataaatatctctatcaagagatcctctgtaagctttccaaatggactatcatctttcattgtcggagcaacgttctcttctttacttcggttcattactatcctgcaacacatgttttacacatagatcaccaataatacataagcgacataaaagcaacatcagtcacactaaattattccatcgaaatcaaacagaacattattgaatagcactcatttagtagctttttaagtatgtttaagagtaacaaacacaacactaacttagaactttaaaaaaacatatctataagcctaaagcttattaaacaaaaacatattacttacagattcttaatcccagtgaagcttcattcccataatccggaaacaagcaaactaaaaaaaatcaattgcttaatggcaaagcaaaaagcatagaatcaaatgttcatacgatttgtaaccaataaaaggataagcttttgtctacagttataagattaaaaaagtaacaaaatttgagtaaaattcatatgagaatcccatttgatcactataggctcaaactcaacaacacaagtccctatatcaacaagaaaattctattcagaggatcatagcaatctgattgattggaacccaaaaaaaattctcttgaagaagtcaaaattttataactagaaagagtagaaaacgaaacggctaagatgataacaagcgtttcatcagctgaaacagaattcaagcaaaaatagaatcgaatgagaacttacaagaggtagtaagtaatccctgagaagaagaactggtgtgagagacatgccaaatgaagccatggatcataacctcaagctctccaattcggtttcatccaatccactagaccggaatcgtaaccaaagtaaattcaaaaaccataccaatataaccaaagtaaaagacgacgtcgtttcatagcagtatacataaatttggtaaagaaaaagcccattttaagagaagcccaaattgtcatcagaaacaaagataagacccgtagatgtatgagacggaggagggtaaagatgtaattttaaaagagagaagtgagcaaatggaaggagaacagatagcgcggcttttctgacaatattctctgtacgatgcttttctttctatctctccccccactgacctacctaccagttgttacttgttactgcttcttctccttttcattcattcatacatctctctccttctctaatcaaacaccaaaacaaaaccaaaaattaaccaatagaaaatgaagtatcagaaaaagtaaagtaagaaaccaaacagtaaaagacaatttcgacccattaggaaataaacaaaaagtcaaattgactcagaaacctctttgtgagggttttgactgcaaatggaaatttttgaggaaagggttttaagaaaggaagaaaatttctagtttttttttggaatttgaaatcacaaagtttaattattgaatttaatgacatctgtttaagaatcaataatacttgctctcctttcctctctcacatttatattgtgctctctctgtccatttactgaaaaaacttgaattgagacattattatactttgctttctctctctctctcttgcaagtggttagaaacatttctccttctttaatctcctcctcctcctgtctttgtctttcgattttgttttgcttttatttgggtttctctttctttcttaaattttgaatctttttctttctttttgttttttttctcacactctttgctcagtgtagtagtagtttcagtggagtgttgatttatcagggaatgctagtgttcttatcagctagagattagtgaatcgaatctaaagtttcagacaaatgctgttgttgctactgatctacttatgcattcttaatcttctgtcggtgttcctaattctctagggtttgctcatgattctctgagatcttactagattcatgcattttcctcattctctggtttggttgattctttgattaagttcgttgtggcagaagagaaacgcttttactcatgcaaagagactagtctcagtttagatcttatgatttaacaaaaaacactcactctcctaagtgtgtttgaggaggcaatg

SEQ ID NO: 2408 - DNA, 3000 bp, Unknown
  misc_feature (1)..( 3000): cDNA_ID_3067553_gDNA_ID_1620531_Annot_ID_159727 3000 nt of promoter + ATG
taatccacaatgttactttttacttttacaacctttcgagaattcggttgttcggctttgaaatgatagtttctctccaaatgattctacattgctattaaatgagaacaacttggtctaatctttagttattgaagataattctagaattaaggagaaaattaatataaaaaactgttgagacaaatggattcattaacaagacaatggataatgaatggcttggacattacacttgaactaaggagaaaaagaagtgtatgagcaattaacaaggcaaatggctaaaggttaactagacaaatggagaaaggttagagagtattatacaaaataacctggccatcagccaatcactggtctaaataggagtgcattgttacaattgtaaaatcatcagtctaagaagaaaataataagttcacaaatagctagtcttgttttattcgcttccaaaagagtttggctagcttgtcgtcgtagttgtcttattttcatcttaatcacacaatatattaattgtcggaaaacgagactttgaagttataatagacgcctggaaaactcatttaaattaattgattagaagtagattaccggtttgcgtattactaactcaacgtgtttatctttatcagcccacaaaagcttgtactggttactaattttctacgaatttaatacaacaattcaatattcacaagacaaccacttcaaccaaacccctcactttgcattttgtttttctttatagagtataagttatgaatcttgtgtgtctataaacgttttgagatttggagacacgtacgccgagtgaatttattctaaaatttactatattgtttatttttagagattatttgaaatgtaatcgttaaagtttttgatttgttatctcattatacattctctattattttatcacagcttttcaaaatttctgatccatcaagttaattatagcaatctaatttacattttacatatgggatttaaataaaaagttaagaaaaagaaagataacgaaagaatatatttccaggtttgaccaaatcaggaaagctgtggttctatagttcttgaaactctttatatatgtgggggctaataaagaatgatcaaaatcttgaatttcaaactgggtgaatacacgttgctgatacttaaacgtgtaaagacgtgaatcactttttatgtactactactaaattcaaaggctacatacattagaaataagcaaaatcaatcaaatgttgcaaaccaattactactatcaactatgatgaatcctgaataccattttactatgaaacttttaacacgattaaacataatgttgctctttaaatgatatttttttttctttatcttatgtggtctatactctttagcaaagaaaatcaagcattgtgagatgttcgtttctacttctaactttctaagggtaaaatgcatatttttcacgtatttgtataacatagagattgaaaatcttcaaaaaactaaaagaaggagtattaaatcacaagaaagaaggtttaaatcaaaagtatagttgcgtgtaaatttaaatacagcaaacaacagaaaatatttttggtctgcggtttcgattcttcaacaaacaaacaaacaaaaaataaaataaaataaaaaaataatcaaacgactcaacatttgattaagagatgtaacaacatttatcgtatagtaattggaataatgaaatattctcaaagtcatgagggcatataaaaacgaatgcatagacagccactcataagatcacaagtaataaaaccaaacccatgattcattcgaataattgacaattaatatactttatactataaagtatatgatattcctcattttgataattcgattaatcttcaaaacctttaaactttatatactcatccttccaataaactcaagacatgccgccgggtatttaaaattctaagtaatcctttactagtttagctgatctaaataatatcttatgtttttgtttttttataagaagacatcaaaatcaaaataatggtacttataattatattagcaacatacgtggcgccgtaagtacggagatatgcgtaatctacggcctaaattttacacatcacatgtcaacgtgggacccattctacagcctgtgttcacttcaccagcatcttttcatttgtttttatttttgcctctttcagtgtttacagtataatattttgtcactgccacgtaaacctatttccgccgaaatatggaaatatatcaatatgcaaattttgtttttttaaagaaaagaataattagtatttagtgtatttaatctgtaatatacttagtaaaacctttttaatagataaattccatgaatttcaaactaaaaaaaaaaattcatccgagatacactaatttacatgttacagtactaaggtatataaacagaaataaaaatctatgatctaatgatgataatactttattagcaagtagatagaccccgtgattgtgaaatcatggttgtcgcatgaacacaaaatctactttcctttttcgtttttatcgtgaatcagaaaaaatctttcttacaatggaagtgcacaatttcgtctctacttaatccccaaattctaaactgtttgttcaaatatcccctcatgaatcatagagcagaaaaaccccaagtcactagtattattgaaaatgtaaatattcgaataaaacagagccaataagatacaaaacatgtacatcttaatacgaaatattgtagtaatttgttttacgatactaaattacaatttaaatacggttgtcaaatccacctaaacatcgatcctttataaataaccataagacaattttagccattcctgattctgtcttctccttcttccaaccgcgtcatcaatttatatttagacaacaaaaaaaaaaaaagccagagcctctccggtaatttctcattttcccgagcgatcgtccatg

SEQ ID NO: 2409 - DNA, 3000 bp, Unknown
  misc_feature (1)..( 3000): cDNA_ID_1028371_gDNA_ID_1620531_Annot_ID_159729 3000 nt of promoter + ATG
aacgtcttgaattcatcattactagtttcctttccttagtaaaaccctacatttctccgcccgcctttgatttctccccggccgttcccgccgccggtctccgatttaaccaggattgagtctaattccttctttttgtgctcattgctgtcggattctctaccggcgttacatcgaccagccagactcttccccatttgactgctttactgattcaatcgctcttttaggtctgtgtaggttttgaaattctgcggatcagattctgaatttttttctttttcgatttttgatttacgattgattgaaattgaaatttgttatagtttcggattatggtaactactttctcataattttattataattgagattaaggatcatttccatagagtacccaaggttttgattctccctctatccatctaagacaattgaattcaggattcaagtaatgtttagattcttatatgaaagcaagtggatatgtaagagaggttaccaatataatccgcaacaagtatcgttggcactagcttgatggagtgtggatacttgtaatcatctttagagtttataaaatttgcagtttttttctcatagtctcgaaaacttagttgctttcgattattcttaaactaacggcatcatatattgttgtctgttattttagcagattctggaagttgtgactcagtatctccccttcaacgaattagcatcctgcgcaagaatgtctattgcatcatcacttacttcagccacactttgcggcgcctcagtttttcctaaagcattagcctgcagctctgagttccctatcaatcttcccagcccttttgaaagttcaaagatttgtttgacttcgtttcctgcctctagggatctcaagaaaaatgctactttgaatctgactcgaaatgttggtccagtcaggtgtcatgctatgcaagctgggacgagggagttgaagaaatttgaacttagtgatgtgattgaagggaaacagtttgatagagagatgctaagcgctatattcgatgttgcacgcgaaatggaaaagatagaaaagagctcttcacaaagtgaaatcctcaagggttatttaatggctaccctcttttatgagccttctacccgtaccaggctttcatttgaatctgctatgaaacgccttggaggtgaagtcttaactactgagaacgctagagagttttcgtctgccgcgaaaggggaaacacttgaaggtaccatcttagctagtatctcattattgctgtgaaacatgttgagtgttagattatttacggaaatttttggggcatttttcagacacaataagaacagtggagggttattcagatataattgtgatgcgacattttgaaagcggtgctgcaagaaaagctgcagctactgccaatatacctgtcattaatgcaggtgatggtcctggagagcatcctactcaggtatgttgtgttcttaacctttagtttttttcaattgtcttaaacaaacattactttacatccttgtttcttatttctggttctgttactgttgtgaaggctctattggacgtctataccatccaaagtgaaattggaaaattagatggcatcagtgtagccttagttggagaccttgccaacggaaggactgtgcggtctcttgcatacttgcttgccaagttcaaagacgtgaagatctactttgtttcccctgaaattgtgaaaatgaaggttagtagcactaaacttgccaccctccatgagagaacctgaagaagatggtttggtttactcgagaacatcattgtgtatgttccttaccattttcagtgtgttcttttaatggtaggatgatataaaagactatttgacatcaagcggggttgaatgggaagaaagttcagatttaatggaagtagcatccaagtgtgatgtagtttatcaaacacgaatccaaagagagaggtttggagaaaggctggacctttacgaagcagctcgtgggaagtatatcgtagacaaggatctgttaggagtgatgcagaaaaaagctattatcatgcatcctttaccgagattggatgaagtaagttaagaaaacctctatttttcatatatgtaccgtgacacaatcctcactctttgtatttcttattgtgtagatcaccgcagatgttgatgctgatccaagagctgcctacttcagacaagcaaagaacggtttgttcattagaatggctcttctaaagctactgcttgtcggttggtgattggatagttcatggtcgttaagttaaatcctttaatggactgattctcaagcctaccatgagctcaaggaatctgcaataataaaatccgaagctttagtgatttttgagtgttaagcacaaaagctgtgatcttgatgttaattaaaagaaggatctgttggtttgttggttaaaagactgatatgaggaagagttgttgaacttaatgaataaattgatttgagctatttttcacagtttggcctaccacttctccaaaggacgaaacattacagtgaacagagaaaagttcactttcgctgtatatttttctgattatcacggaaatgcccttgcttccttccaaattggcttaagattaactgattaagcctttacattttcgaaattaggtgattaataaattacttaattaattatgattaatgataatcacatgggattttccgtcttttctctttaccgtctaaatcccaacaacaaagcctttggagaagctattctcagattcacgacaccagttcgtcacaagcttcgagcccaggtattctctctttcgctcaaaaaccctaatctcgacttataattcgatcgataaagtagaagcttcacgcaattcacatgttctctatcttctttctaactacagctcggaaaacaaaattggaacttgctgcataaagtttagtttttttattgaatttggaaggatg

SEQ ID NO: 2410 - DNA, 3000 bp, Unknown
  misc_feature (1)..( 3000): cDNA_ID_2048337_gDNA_ID_1620531_Annot_ID_159735 3000 nt of promoter + ATG
ctatgacggagccacgaatttcatttataagagtcacaaaacatttatttttctaaacctaaaataaaactaaatattttattttcttatatatatacattttaacctaaaatgtttcatatttcatctttcaaaataaacatactctcaacttatctttttttagttgtatcatcaaattccctttctcatcaacactctttttgttaatatattgtggagattgagtagttgttgtgtttatcttgattcatgatttttagaatatatattttagattttttttttgaaaagaatgtagaaactaaaactggatatctaaaaagaagaaaaaagtattgatttgttaatgaatattacagggtttttaataagatattatagtttttataattagccaaacaaaaatgcaaaaaggcattaagattaaatgacaaaatgaatatgcatggggtcaaagacaagcataaatcacataacatgaggtcattgtgagtactttaacccaaaacatataattatcttagaagatataccctatattttttttttaaactataaattttatgggggtcgactgagcccccttcttgtatgttgcctccggcacacgtatgattggattttatcatctccatgatacttcagagttctgacaatctcgaatataatgccactttgtttttttgctttgtaatggacatcatcgatgcttcaatcttcgaaaactgaaaataacgtccgtctgttttcttccaaggtcgtgtggtagacatgacatcttttcggattatgaacatgagaacagcccttatcaattgtttgaaaacaaatcgaagatactcatatttcggatgatgtctattgatcgtccagaatagattctaaacctctgcttccaatacgacgagaaggatctccgatcgaatatggaaacgtactaccaacgatgatcccgaataattcatgttgcaccacaaagcatgaaacatcttctttatttaattcgtacgacaacattctattagtgacagaaaacaacaattaactttgtagctgttaaaaatactggtaaaagataaaaaaaagattgagccgagtttatctgttgtatatactattctttttgatagatacatacacccaagatattttatcttgacatgtgatgaagagatacggattatcctctgaacaataattttctaaaaaaaaagaagcaaatttttgataacttaacttataaatccacctttttccctaattagaagatggattctggctgattttcttggattagtgttagacagggatactactatttcttaacaatgagatgaggcaatctatcaaggaaagtaaaaaaaaaacgaaacttaaccctctttttttctttttttttttatgttagaccaatcacttcttgaaaagattccgtaactagacgatttttatatatatttttttattttttaatttttaatatttccacttcaaatataaaaagaaagtatatttatttgttatagaattatgattagaatatgaatacaaatgtaaaaaaaaaatgatatagaattctatagaaaaaagaaaaaaccttataagctagtcataccatttcatttcattatattgacaattaaaaaaaactgatcatactatgatcatagtatgatggcggttgagcaagtatgcccccatcgtctagtggttcaggacatctctctttcaaggaggcagcagggattcgacttcccctgggggtagggtactacgaaaggaagttgatcatggattatccataaagttagaatagattcttcctgggtcgatgcccgagcggttaatggggacggactgtaaattcgttggcaatatgtctacgctggttcaaatccagctcggcccaataattagctgtctacataaccattttttttttttgcataaatgacagagaaggggtaagaaaaaaaggtcaaatttcagggtatagggtatagttcgactttacttttttttttatttcttatgtttagttacttttttttccataaaaaattccgatcttgatcttgctaaggattccgatatggatcctttaaagagaaactttaatgaacagagtcgataaaataatctatttgcttctgttcaatatataatgactgaagctaactttggttggttaatccgatcagttcatcgatggtcgtatagtttagttatttaggcaataaaaggtaggggttagaaattcagatgatggtacaaaaattaaaaatagatgccaatacgtatatttttcttattaaaaatattatatcaaataataattaaaaaaaaatatatatatatatatataaatatacatagcacgcaaataagaaaatgcattattgaatattgaagaaactatgattactctttgacaacaaagagaaactataatcaattaaaaactttaattagaataaacttgaaagaaaatatgagtaatacgttttcttagcagaaaaattcgttttggaagagttgagtgtgaatatgaggttttttttgggtgtatttactatttacagtaattgttagaagtcatgcttatcttttgagaatttgtatatacataattcattcataaacgttaaaaaaaatgtgtttatatgatagcttttaatcaattgatgtacaatgaggtaatgaaactcagatgagtcaccaactaagttgagaacttgagatggattcaatagtcaatgatgctaggtgaaataacgtaatcaaccaaaaatattattcaatttttaattcgcattcgcaaacacgaggcacataaaataatattatcagtctcaataaaatcttgattcttgatcttgagcatcccaaagcattattaactaagcatgtatctcccactaaggcacaaattactaaccatataagtctcagtactctctgttctgcaaacttcatacacaaaaccaacattaagag

SEQ ID NO: 2411 - DNA, 3000 bp, Unknown
  misc_feature (1)..( 3000): cDNA_ID_3409188_gDNA_ID_1620531_Annot_ID_159737 3000 nt of promoter + ATG
ggaacataagaggacacaagtggtttgagatctctgtttcgaacttctccaagatccacttctttcaaggatccatcctgtccaatgatgaaagctgtgttgtgcttcctgtctttgctttgattaaaaaccacagcgattttcttctcttcatcaatgaagaaacttgtagccataaacgaaaacataaaatcgttgccagtgagtggtgtcatatccactgataagaagaccttgctgccccacgacaacatgttgggctcaatcttagttgtaacccagatctccatttctaatgtatgctagtcttcttactatacaagtctgtgtcatagcctatatgaaacataaatctagttgagctaacaaacaaatgcggtaaaaattagtctatccaaactcattgataaacattggttaatgaagagcttctttttgctagattaagaatccaagattggaagtttactgctaccactataatgactagaatgtaaatggcaataaacaactcattcagatcgtagtggaatgtaaattggatatatttcaatctcaagcttatcccatcccttcccattttcatatttcaaaactgcattaatttctccattcaattttcttgcttttattttattttataaaacatttagattcttctgtgggcgcaagttcatgcatgcgccaatagagtcgccaatgcaatgtagattagaggtatgggtagttcagcttcttaaatgcaactcctcctcctttctctcttttttcctttataaattgctcttttctcacactccacaccactctccaattcaagctctcaccccataaatagacaaattcaaaatatcttataagagaaagaaaaaaaatcaattagtcttccatcttttcttcatgggcatttctaagatgattcttctgaaattcacatatgttgtttctttctggattacttgcgtgatcttcaaaatgtcaagaacgataaaacgagctttgttgggctcattcatcttcattcttgcttccggtaaatttacaagttatcttcattttcttatcatttaatgctgtttgttcccctttttttttttgaattctatagatgcttgctaaactaacgtacttttaaagatgaaacttgagacgccatctcattggttttggatatatgtacttcattgacatgtacttacctctcatatatgaatccacacatatgtatactatatatagttgacaacttgacatgagtgtttgataaaagaactaaaacatattaacaaaaagataaagagaaaattcttgaatggatgcgatgtgtcaagcaacttctacttaccataagagtctgatgtgggatcttcttttccattttcttagttttttcctttaacctgaattacttgttgtctatgcattccttaattgaatttaataacttatcttatgtatggattctctacccttaaattctcattctttaagaaaagtatatctttttgtcaacaatatcttcatccaaattcttagaaaaatatactttctttttggtatgtatcattttaacatatcacattgcattgttttcattccacattccatgttaaacaattttataagatcacgaaatgtcattaattttgaatgtagctagtgttgtggtagccgccattgtaggagccatcgaaggtcacaccactgacatcggatttcttcaaggtagtgtgcttggagtggtggctggagttatcactgcggtccaactctttggaccggtgctacatagtgatcaacctttgtctaaggtgattgtgactctacatataaccctagaatctaaaaaataaatcactaaacaaccatatgtttctagttaaatagtgggagtggtcctgtaattaagaaagctagctaaaaatgaatggtattctagtaactagttatctgaataaaagatgatgttatggtaacaatagtttggtgacaaaaatatgaaaagagtggcaggtggctttactcaggagagtagtgaatgggaaagccattatgggattggttagaccttttgttctcaaagcatatcaatggcaagtaagtactctccattctttttgttcttctgactttttttcaactacgtctttttatttgacaagaacacgatattttctaacgtaaaatcagaaccataacaaaaagcgttaaactaagtatattttacaaaattttaactccggtaatattataatacaaaatgcagataatagcattggatacaagttacatggagagttcaaacttatacgatttcaatcatgaaaaaaagggactatcgaagagctctattcagaacatcccgatgttctacaaccgttcagaacatcaaacaaaatcgagttgctcgatttgcttacaggtgataaaaatgtaattaattagaatcatctaggaatcagattttaatatatgataataatgacttaaatcatatatatttctaatgttcatttttggggtgtgtaggattgggaagaaggggaagtaggaagaaagctagcaagatgtggccacacatttcatatgaattgcatagatgagtggttgcttagacaagaaacttgccccatttgtagagaccatctttcacataacacaacttctacataacaatatgttgtggataaacttcacaaagctatggaccgacatgacccaacgggtccaaatttttaaaatttgcaatccaactaaactacacaaaaataaaaattaaattctcagtaatatatgtacctaactaagggtaaagtgggaaatacaaaaaaacatttcgaagagaaggaagaagacaaaagaagaagcacgagaatcatctgcttaaaatccaatcgcatcgactcagtcttcttcttcttcttcacctacctttctctctctctctcgtggtccattcgctattctatacttcttgtcggcgccggagagagtgagatg

SEQ ID NO: 2412 - DNA, 3000 bp, Unknown
  misc_feature (1)..( 3000): cDNA_ID_2048320_gDNA_ID_1620531_Annot_ID_159741 3000 nt of promoter + ATG
tgttatagtatcctacttagcaaagatataaggatgttatctgttcatcattttgaaccgaatccacatttgtgcagaattgatggtcaaagaaattgcttagaggtgtttttgcctagccggactgcccaagtcagctctctctctctctctccttcttttgctctctctctatgctatctactgccatgagaattgattcatagatgcattcaacctgtcatatgttgattcaaactccatttttatattctcaggtttacaagttgacccggatcctccgaatatgatcctctctctttgtatgccacatacaaacaccaagcatgtttgtctgagaggctaggtatgaacccaaggtcactacaagaggtgatgtaatattaacatggctcgtccaagcgatgatggcagttaagaagattatcaatcacgccttcacagaggtgcaataaaagaacaagcagttcataaagagaatcccaggaagaccaattcatctcgtggtgtagttcaagcaaacaaatgttttgtatcaaatcagctgcatcatgtaacgagaagttaacacatgaacctcttaatggtgtaggccgactgatgttatgtagtaaatttctaggaggtgctcaagtttgtgtatttaagaaatctttggtagttggtatatatagttttgttaatgcatttctcgacaaaatcaatgctttccatttctcgacaaaacaattgctttccacaagagaagtcatccagtagcttagatatattgtttacctagttaaaaaaagtccaaggtaaacggtgtataaatgagcttaagcagaaggatgatgtgctagtgaatcatccaaaggtgcatctctgaaaaggtcatcatatgaaacaggtaccctgatcctctcatgaacagatttcctttccttttccggtttggattcagtttgctcagctaccggcataacacacatctcgctcaccagagcttcatcagcagatacatttccagaggcaagtccttcggaggagctaccctgatctcttttaggccctgattttggtctcgtgtttggttgcctaaattgtttctgcaaagtttgaaagcgtaagacaaagagcaagagagaaagaggtgtaagatagaaaacagtgatataacatcttcatgactgctatttcacatttaagctaagaaagcaggatatatttacgaatgttgtgatatgataggcaagtacaaacctcaaactccttggtctttttcattatctctctataagcttcaggctgtctcgctttgatgatgttccacaatacaccaccacttgtccgtttcctagtgccatcagcagtcacctgacctccacaggtctcaattgctaccacctaagaaaaaatatttcttgccatcatcaatcatatctttggcaagaatcttgcgaagtggaatagaaatattcttaaccaacttaaaagcatacagtgggagtaacagaaggatcaatccacaaagcagtagtgaatatgtggacagtcatttctcgatcatgaaaataaggttgacactgttggtctcactcaaaccacttatggtctcgatcatgaaaatatggttgacactgttgatcataaaaacttcatctatccacttatggtttcatacaaattgtctagatcaataaaaacagagaaaagacagatgtgcacaagagaagggaaaaaaaaatcaacctaaaatatgaagttttaccatctacatctcagcaaaaggcacaagcagcaaaaaaggctccactaggaatatcttgaactgcaggtgaaacaatacagctaaacaagattgccactgctggtcacacacagatcaaacaaggttttaactggaataacacagaaaacatcttgaagtagtgtatacctcattgacaagatcacttaaggcagcaattccgagacacccaacagctgtgtatatcatgtaagacttcttctccttaaggcgtctacaagtatccctaacaaacctgccataacaaaacatcaaacaatgagcaacgtttcaaccatagccaagatcaggcagctataccaagaatttacacaacaatattagcatatagaaaaagaacacttaccagtctacactcatgggtttgtccatcacagggccttttctctttttcttcttcttcttcctcttgttcttgtttgtctgttgcagtccattcttctcacccaaaatcgcctctttatctttgactccatcaccatcatcattttgcctctctccagaatctaaatcatgatccacaacaatctccccttcttcaacatcaaccatttcaacatcctccaagttttcaaatccgtcttcttcatttatagcatccaacaaactctcttctccctccatgagatcaaaaacctaaaatcccaaccaaaaaccaaacacaacttcaaaatgtaacacataacaaaacaacactcgcacaaaaatcccaatccattcaaacaaaaacttcgaaaccatttacatttacaacgataatctcacaagaacatccaataacacgatttcaaaaacatgaatctctcaaaaaattgctcaatacaaagtagatcaattagaatcgcgaaataaacaaaataagaagctaaccttgggacttcctttgctcttcgatcacccacactcgagattatcaacaaaacacacacttcatcgtcatcgacccaatactgagcaagaaaaatctcagctttagggtttaggcaatttttgccctttaagaaaaaagcttaatccatttcctttatataaaagtttttaattatattttgccccaatataataaattatatatatatactttccttatttgtcctgaggactatagtcaatgaaaaagtcaaaactaatagaattaggaaaacaaaaagaattaaaaggaaaattgaaacagagaagacttggcgtctctttagattctctctaccatg

SEQ ID NO: 2413 - DNA, 3000 bp, Unknown
  misc_feature (1)..( 3000): cDNA_ID_2048295_gDNA_ID_1620531_Annot_ID_159748 3000 nt of promoter + ATG
ttcataagactttggtacgtaaaacccattgccatgcattccattccatggtttaacgtcaagatcttatagcttctcatcaatgatgtccaccaccgaaaccacctccggcaccggctcccccaccgaaaccaccaccaataccgcttccgcctcctcctccaaacccaccaccgccaccagctccacctcctcctccgagtccacccccagcaccagctcctcctccaaaccctccacctgaaccaccaccagccccaccgccaaatcctccaccagcaccaccacccccaccaagaccaccaccgctcccagctcctccaccaaatcctcctccagctccaccaccagctcctcctcctaaaccgccaccgcctccagctcctccgccaagaccgcctcctccaccaaagccgcctcctccaccaagaccactgcctccaccaataccgcctcctccaccgagacctccgcctggatggtggaagaatgtcttttggtcctcgagaccactcttcagcttcctgttagcgacactggcaaatgaagtgaaagcaaaagagccgacaagtaaggcaacaagaaagagtgacttggaagccatgtcgatttttgtgttttgcgtatgtgatgatgaggaactctatcagccaataaggtgtttatatagaccatttggcatgagctgaagaatcaaacaattgaataaaaagagggagagagtaaagttttagagtgagtaattatcattaattcatctgcccatctaattcatgttggcaaatttaatgcaatccctaactaccagtgttgacaaacatgttactcatccacatgtagtagaccccttctttattctttgtgttagtactacttaatagtactcattttcttgcctttcacatttaaatttggctgcagtatttgatgaatctgagattttagattattcttatgtccggagaccggagttatttaatgtttttgttaatgtgttttttagtacattttggtgtccaccattattaaagaaaacaacaacaaggtatctatattttcatgtttacgataaataaactttacacattacattggaagagaataataagtatgaaataatttgttttcactacatttcttgacttggacaaggttaatttaaattcgggatctgcctcgcactggcccatggtataaacaatctcgttgtttaatgcatttacgcgagtaaaatattcatcatggtgactgtttgtgatttttataggaaagagaataattatgcaacaagccgatatgttttcaaaacttggttctcttcttggattgaatgctctcttcttaattacgttctcatccataatttgaacatctaattaataataaaattgtcaaagttccgtggtcccagtagactattggcaataagttaatatatgaaaataacttaaaaccaactttaagtcaaaatttgatcttaatacgatttaattagatgtctgaaaaaagtttgcgtaatcaatagattgtaaatctagctatgattagaattgttaacacattgttctataactcaaattactaatataaagtaatcgaatgttacctattacttaagataaaattttacggggttaaaagtctgaaaagttatcatttaaatgtggctaatagttatacatgaagacatgatacatggtacaatactacaattacaatgaccttggatctatataccatagtttgtctcttgaaaccaaaattatggagatttttattggtgatctcatgtgttttactaatcatccttttttcttacacaaatcaattatccgaatatttacttacgatataaaaaaagtcacgatttcaaataagttttagttaggatatttaatatctatggatgttttaaattatcgaataacaaagaaattatttaataatgattgattttccatattgtatatatatatatatatatatatatatatatatatcaatattggttatgtatgatatatacataattttattaacgacttcattttatacagatatttatgcattttttcctttaggacatactccacatgtaaattttatatttcacaattatttgaaatttagtgaatttaccaatcgaatgaatatattctgtaaaattggttgctgatggaaattcgaagaaaacaaggccgttcaaaattgattgaaagtgttaattaaaggatgtttcatattggtcacaaatgattgtacaatcaaattattagtcttcatgatataatagaaattctataaattaatatttttaaaattaataatttttgtcggtcccaaatcagaacaatgtaaaaattaaccaaaatcgataagataataaaataataattttttttcaaatctctatataaaattatggtctaaataatatcataaatattaaacatacattctaagacaatttaatataatataaatctagtgttgtttgtctccgcttaagtgtttacggtaatgtcgtagatataaagacataatatcttgcaaaaagaaagttaataaagtaaaaaataaaaatttagtattgtgtcttccataaatatttttaaaattaatattttataggataatataactataaattaataaattttatgatcgaacattattaatttatagagcttccactatataaatatattcgatgaaaagaaaataaataaatagaaattctaatttctgcaatcggacggtgagaaaacgtggaaatttaattcgacggtgacaacgtttgttcgataattagtttttttttttttgtcgattgtttttctttttcttaaacgcgatatttaacttatctatataaaaaacaaattcccatcaaattcggagactttggattctctgtttcgcgcgcttcgcagttcatcttccccaacgactctgctccttccccttctctccatctctctctcgttctaatcttcgaca

SEQ ID NO: 2414 - DNA, 3000 bp, Unknown
  misc_feature (1)..( 3000): cDNA_ID_2048304_gDNA_ID_1620531_Annot_ID_159745 3000 nt of promoter + ATG
taaaaagcttaatctcaaatatttagaccatcatcttcattagttccatcaaaaatcatatgaagcatatgaaatttgattcgtcgggagaaaaatcttaaaactcgcgtctcccaaaattaattaaatcttgatattttcaaactttttaattattaagttttcaaagtaaaaagacaagatttttcgacgtgagtttccattgagtttccgagagttttcgtttccgaaacatttcagaaacgagaaacgcattgtggagagagtttccatgcaacatagtgtccaagtatattcaaattaaaaatacaaagataaactttattattctaaatacatttttaataaaaatcgaaatcgacaagatcgattttgaaatcagtgaattctacgacactaagatttgaaatctatgtagattttttaaattaaaatagaaaaactattaaaccttctttacttttgttttttctccatatatactacaaactaataatataaacaaaaatactagctgtgaaattgaatgtttctggtgtgtcatgagtttctcattcaacgatcacttgatcaaagaatacaaaattttgttaatgccaatgatttgcgtaatctatatattaaattctatttgaacattcaaacaatcgctgtatatagattccattgataagatgcaaacatatatgacattgacattttatctgtctgtgatgttgatccggtcatcttcatgctgttcagggatcttatgacacatatgtatgtacatgaacatcgatctgatttagcatattaatatatataattacaaaatactaaaattatgaaatcatcaaatactcaattaacaaaaaatatatttttcaacaaaatcaactagttgtgattataactttattttatgtttataaaaagactataagcagatatatatataaaaaaaaaaatgataaatcacactatatatgaatttactgcggatatatcaatccacctaagaattaatgaattatgatctccaaaactttgttagaaaaaaatatattatggaaaaggaacgtgcaccatctttatcagttacaaatcaaattccaaattttagctaaaaataattgattttcttttaatattccattcgtattatgtggaaacgtaatgtgtctatatggactccatgtctagcatgattaaatgaaatgaacttttgccattttaagtcgtgtctcccaaattgtctttctttgtttgcttttttatatgcatcgttcttccacaaatcctacgcaaaagtttgattgaatgcaattctaacaaattcagttgtttgttacaaataaatgaaataagaacaatcaatatttgttgacaaatattgattgtttactgaaagtattcaagtaaatcaaataaacagtaaattataaaaacacgttattcatgtgggttcactttttttttttaatcttttttaagtttggtcaactaggggtgttaccgtgttatttatatgtttttcagtgggatatcccacactaaaatttattgtcatttttataagttttcaacagctatagaaatttggcaatagcaaaaaatgaaagggattattgtttgaaatgcattttttgggaaacaagcttaccaaaataccattttgaatagtttatggattttttcatttttatacatttaacaatatacttatttacaatttttccctgcaaaaacatgtactttatatcaaatactaatttttaaaaattaaaaaaaaaaacgaataaactcaaaaataacgagtaaaaatgtatgttaaattataattttttttgcctgataaatgataaaattcacaaaatagtttaagaaggggcaaatttaacgaatgtcactctacaaagaggcatacccgcaaaagtcgatcattggtcaatactcaaacataaaaaattacaactagatgttgacagcaagaaaattactcactagcttaacgtcatcgaagtagtttttccataccactgactcaaatgtgaaccggtttcttaactggtgtatatatatctagaatttttctttcttatttttcgaccgaaaattgtaagtgctatgtttttatgtaacatatattggctttcacttgccgatttttttatttatcttttacttctgtaaaacctagtttacgtttcttgcttaaatcttttatttattttaaacatatttctcatttaaatcactggaattgatgcgtcaaaaatcactataattaattgaaatcacataatcgcttagtcaaacttgagtatcattcaaaagccttatattatatttagctttatatacaatttgttccaggctcttgtcacccatgtaaaaagcttcatatacaactgtatgtatatatatatatatacacatataacaaaatgtatatattatatagtatatgtctcttcgttcacatgtacgatattgttttttagaaataatgtaaggttaacgtatatataaaaaatggaatcaagtgatgaggcaccagttaagaaaatacggtaaaaaaccaattgacgatttttatcatgaactgtttgaaaaaaacaatacaaaaacctagcctaaaataattccaaattgtttgctccaacagtccaactgtttgaaattaattaattacacacagttagactactgtctaaaataatttattactaatcaatcttgtaaaataaatttaaatatttccctaggcattctaaacctgacaaattggctgtagaaaataccataaataagaatggttcaaatgaaaaagtattaaatgtttaaacaaacaaaaaaatcttttttgttgagacttgcacgtcatactctgttgtttcttaatctttatcccacatataatggaattagccccacgaaacttagtctatctcattaatctttctttccttcaatctgtctgttgctctctctctctctcacacacactgatcagcc

SEQ ID NO: 2415 - DNA, 3000 bp, Unknown
  misc_feature (1)..( 3000): cDNA_ID_1692421_gDNA_ID_1620531_Annot_ID_159740 3000 nt of promoter + ATG
ttttctctttatctttttgttaatatgttttagttcttttatcaaacactcatgtcaagttgtcaactatatatagtatacatatgtgtggattcatatatgagaggtaagtacatgtcaatgaagtacatatatccaaaaccaatgagatggcgtctcaagtttcatctttaaaagtacgttagtttagcaagcatctatagaattcaaaaaaaaaaaggggaacaaacagcattaaatgataagaaaatgaagataacttgtaaatttaccggaagcaagaatgaagatgaatgagcccaacaaagctcgttttatcgttcttgacattttgaagatcacgcaagtaatccagaaagaaacaacatatgtgaatttcagaagaatcatcttagaaatgcccatgaagaaaagatggaagactaattgattttttttctttctcttataagatattttgaatttgtctatttatggggtgagagcttgaattggagagtggtgtggagtgtgagaaaagagcaatttataaaggaaaaaagagagaaaggaggaggagttgcatttaagaagctgaactacccatacctctaatctacattgcattggcgactctattggcgcatgcatgaacttgcgcccacagaagaatctaaatgttttataaaataaaataaaagcaagaaaattgaatggagaaattaatgcagttttgaaatatgaaaatgggaagggatgggataagcttgagattgaaatatatccaatttacattccactacgatctgaatgagttgtttattgccatttacattctagtcattatagtggtagcagtaaacttccaatcttggattcttaatctagcaaaaagaagctcttcattaaccaatgtttatcaatgagtttggatagactaatttttaccgcatttgtttgttagctcaactagatttatgtttcatataggctatgacacagacttgtatagtaagaagactagcatacattagaaatggagatctgggttacaactaagattgagcccaacatgttgtcgtggggcagcaaggtcttcttatcagtggatatgacaccactcactggcaacgattttatgttttcgtttatggctacaagtttcttcattgatgaagagaagaaaatcgctgtggtttttaatcaaagcaaagacaggaagcacaacacagctttcatcattggacaggatggatccttgaaagaagtggatcttggagaagttcgaaacagagatctcaaaccacttgtgtcctcttatgttccaagttcaatgcaacttgaatagtgcattttacaaaacccataatctatttcttgcacttttacttgtttctttttctcttttgtcatcttcttctttgaacaatatatagaaatttaattcgtctctcatacttctttttgtttgccatatttgacttcgttttgttgcctttagttgtttaatttacttcttctgttgtagtagactcattgctaaatctctgtttctcttctaacatttgttatgtttgtgttcttgcaaataggcagctctgctgttgtaatttatgtagaacagacaacagagtaagctgcgtttaactttgaaatttgcaagtacgcatgcttagatttgagtttcccattttaacttttgtccttgtcagttttacaaagtgcaagtggctgctaggctgacacgtagaagattgaatgatttctcggagttaagttttgtcctttgatactccctggtcttaaagcatacttacagagtaaccgtagctgaatatcaacctcaagcaagtcatggaaccatacaccttccttcaatccaccagttttgggctggttagcgctctcctagatttatgtttcatataagctaaccattaaaagtttaagagaagcttgtgtagtaagaagacaagctaaatgagttctcagtagccttaattcttcttctttttttgactaaatatgagcacttatagatgaagactagtaatgcattgattatgagaatactaaaaagttaagatgaataatcaaaaaaattatttggttagtattaaaatcttcaaatgaaacttagtcttaagatttgttgagatctttcatactatcgaagtcatgtagagtggaggtacgtagccaggcctaggagaagagaagagaagagaaggagaagcaagctaagaaactgaaagcctaaaaacttttgaatgttgatgattaaaaaagaatagatacatgctaacagcttatgcatttttgaaatagtttttgttaactgtcgtgtagcttgtgtgtaaatatgtcgacgacaagtcaatgatgtcacacacactacacaaaacaaaacactgcttcaaactaccttcaacttcgagtccattactataagcaaaagtcccaaatcaaaacatcaattttcttgttcttgtcagctactcaaacctcaacatgttacatatattttttcagataaaacaaatcattctcatcgttcttatctgaccaggaataattcaatggaagtatgagtttgactcggtttccttttgatattagtcgtacttttcaacattttacctagatagagccgtcctcttataattattcatcatttcatgcttctcatgttacatttctgcaatttttcaactctttgattttatataatcatttgtttcctttcttaatcaaatccatctggctaacattatttagcttgatgcaattaaggtatattatctaatgaggtgatgcttccacgtctttatattattataatccctcaacaattttaaaaaaagatcctgactttcaattttctctcttgtttcttcttttgatcatcttcaacaaaaaaaagttacgatctttctctccgggtcatcggaatttgagctagcttagctaaagttccgatctttcctctctgggtcgtcggaatttgagctttttaaaatc

SEQ ID NO: 2416 - DNA, 3000 bp, Unknown
  misc_feature (1)..( 3000): cDNA_ID_3067544_gDNA_ID_1620531_Annot_ID_159736 3000 nt of promoter + ATG
atgaaactcagatgagtcaccaactaagttgagaacttgagatggattcaatagtcaatgatgctaggtgaaataacgtaatcaaccaaaaatattattcaatttttaattcgcattcgcaaacacgaggcacataaaataatattatcagtctcaataaaatcttgattcttgatcttgagcatcccaaagcattattaactaagcatgtatctcccactaaggcacaaattactaaccatataagtctcagtactctctgttctgcaaacttcatacacaaaaccaacattaagagatggcgagccactacagaaacacaagcgctattgcttatctattgctttgtctcttcattacatctgccactgcacattccttcatacgacaaatcactgatgacctcaaaacaaatctgcagcgtatgccaattttctatgttcttttagttgttataaatggaaaacagatcctttgtttttatttctcaaatgctctgtttttgtctggaaacagaggaggtaggagcagaaccaatccaaaacctggacgtaggacattacttacaagaaaataaggagatctcatcacgtgattataaagtatcagcttcaaacgcagtgaaaggtttgagagatcgtcctccatcgtcttactctctcaagatggagtctttcaacacgctccttaagtcaacttacacggagaaatatgtatctcgtcccttttcagttggtggatacaactggtatgttggtcatctgatctttatttgcttgaatctataatcttacataccaaatatattttgatgaatctcaatatatacaggacacttgttgtgttcccaaatggtaacaagaaggatagtggttcagggtacctttctctttacgtagccatagacaactcaactctcggacagcaagagatttacgcagatctaaggttttacatctttaacaagaatgagaggaagtacttcactatccaaggttcttataattttcaatcaagaaatgtagtgttttagcaagaaagatactttgtgcatgatagtaatatgtatctatatatcgactggtctttgttatataatctgtagataccgatgtgtggaagtttagtgtcttcaaaacgatgtggggattctctcaggtcctccccattgatacattcaaagatccgacaaaaggatatctctacgatggagatcactgcgagtttggtgttgatgtaaccatgccttctctctacgaaaaatcggaacttttctctgtcacagagaattttctaaatccgagattcacctggaccattcggggattctctacgctgctaaaaaacagttacctatcagaagtgttctccatcggaggaagaagttggtgagtcaacattatttcaaaataaaaactctggtggagtagtaaaatggtggtaagtagtaacaagtattttatatgttgattaggaatatacaaatcaatccaagtggtcttggtacgggagagggaaaagctttgtcgatgtatcttggccttaatgtgaatgagatattcagaccatatgagaagatttatgttcgagccaagcttcgagctcttaaccaactcaatctcagtaacatcgaaagggaacgtaagtaaatgatatgtgttcattgatgggtatacataacatctcatcgcaatgactaatgagatttacttcttttttttgggcagtcgatatttggtacaatggtccgggatatggagaatatagctggggtttccctgagtttatctatttcccttatctcacagattcatcaaagggtttcgttaagaacgatgtgttgatggttcaagttgaaatggaggccatttcttcaaccaagtacttcccgagttagattttctctaagcaaagaacttgtacctacctccatgtgtttgatttgttatcaaatactaataagaatttgattatgcatttcaaatacaattgtttctttttcttcagcatatcattatcaaattatcatatatcttcttgaaagatcaaatagtcttcacccaaaaaaaaatccgccaatccaacattcggctcagttttgtttgttttgatacctaagaattaaagaattaatggataatttatgatggaggttagagtctactgctaaattactatcactaatgtattgccataaacaataaaataatataattgctaatcttaaatctcaacttgactataaagataaagactaaatcgatcaaaaaccaatacactagatgaagcctggcttttggtgggggattttaatgaaattcaatgtgaaaatttaataagaacttttgtgaaaagaaaattggaaaatataagtaaaagaaaaaggttaaataaaactatctaacatcataaaaagttaaagaatagagcaattggatctagtgtattggtttttgatcgatttagtctttatctttataatcaagtggagatttaagattagcaattataatattgtttattgtttatggcaatacattaatgatagtactttagcagtagactccaacctccatagaaaaaaatccattgattcttttattcataggtatcaaaacttacaatgcatttgaacctattttataatttaattcaaactactgtattcagttccaatcatatgtttttgaatgtttttttaagaaaattgaagttcatataggatttataaaaatttattcatctgatgtagaattattttatggtcaagttaatgaaaacttcaagtgagggcactcccaaacttgagatggattcaaaagtcaacgatgctaaatgaaaccatcgaatcatgttttgtttttgaaacaacattattacgtaagaatctaactaatattcgaagactccatcctaaagcatttctctatctctttaatatataagttccactaacctctcttctcttcacttcattcacataagtcataaccttgaaag

SEQ ID NO: 2417 - DNA, 3000 bp, Unknown
  misc_feature (1)..( 3000): cDNA_ID_3067546_gDNA_ID_1620531_Annot_ID_159730 3000 nt of promoter + ATG
agagagagtgatgatgaaggaggtactggggtgtctctgactaatttgattagtttcaccaaatctctttttttctttttgggtgcttcagattctttaagtatcatcgaagcccaacaacaaatatacaaataaagcccatatacatacaaggataaattatttaagggctagattagaggtggtcaaaaccttaattatgagattgtagtcgatcattagtacttttagtaagttttaatatagatgggcttcttccactcccattcccttcacatggattctgcattctttgtcttttttctcattttatattttattacatagaaactgttacatcatattttatttgattcgttagtttgtttcttgttattgtgataatgatctcacttctcagtgaataaaaaaaaagatgtatacaatacgatcttactatctaaatgtgtactatatgctatgcatgtttatttttttttatttaatgtctttctggtttgtttaattacagaagaaaattggatggaaagctcaaagatcatggtttccaatatacgagtatataattttgtatcatttgtgttttaaacacctgatcttgattgcgttaactctttgtctttgaaataatcactatatataggtgtctcaatggcatcttctttagatcttttttttttgcatcttcttagctctgctttttttttcctttaatgtttcttatagttatgcgtctgtgtttatgcgtggaacttcaaaaacttgttgattaaatgtcaaaaaacaaaaacaaatgttgttgattactttaaattattatatttacgctacgcatatcgagtagcaggaaccaggaagtggtcttttttattctttgactgtcatttttattaggcaaaacttcttgacggtctaaagtcttaacctacgcaatttaacaaaaagtcttcgggtggtacttaaacacaaactcaatagagctcattaataacaaaagaatctcagtttaatttcgtttcaatataatgattgaacaattgtacaaaatgaaaaaaaaaagagaaaaaaaaacaaaaaaaaaattgtacaaaatggtgagtgttgtatcacatagcagccgaaaataattaataattaatatatgtttgtgtaacatgtaacacaaaaagttgataatagacacattttattgatcgacccattgtattgattcgttaatgtataatattcaactataaaaaatgaataaagagataggtatataaagcatatttaacttaattatgatgagatgattagatttttcgtctctacagtggtatgaacaccaagattctataacttttacttatttactaatcggttcgaattaacaaataatgagagcaataggtgagagagatcgatagatcaaccaatgttatacagatcagtttcatttataaaaataaagttcggggtatgtgggtcaagtgatcgatactacttaaataaaaatgctatatactagtagtggaataattcgatgtaacaccaacctcaggcttttgacttatatgaataataatggtatattggttgttgaattgcatttgaatatatcatataaagcatttgtagagtaaattgggtaattgatgttaataagatcagatgatgatagtagaacaaactatgcaaacaacggcaaatggacagataaaaaaaaagtgattaatgtagaacatgagtttgaatagtgatttttaatggtataataactaacaaattcaaaatatttacttaaattccaaatacccaaaaccttgtaactatttttaacaggaaaacaaaaaccttagaaatatttaaaactttaaaaaaaaaaaaaaaaaaaaggtgatggcaatggaaaattatggaaaggtgggagacgtgagtgtgtgtaacatgagatggcctaaacgagtaattgaaaattgggtagggcatctttggttcagagattctgttccctttggttgcgttcacactttgaagatcccttccccaatgccgtgttcacactacttcacttcactcggcttcttctgcctagctcggctccatccacactttttttttttggttatatacatttctaattgttctactttacgttttatttacttacataagctgagaaaatatatttttttactgttaaggttatgatcgatatatcttgaaattgatcataatttgttgtcaatgaccatttcgtagatttacacgttaaacatttgttgtataacactttaaaaattggtaaatatatattaattttcagtggtagatagtctagctaataaatgtgtatttcttaaaagaaaaagaagaagaaaaaatgggacatctcattatcaaaggtattattacacgcacaagataaatgacttcttttttggtatacgtttacgtacctcaacgttatacgttttatttgtctacaacaaaacatagcatcagagtattggacctttgagacttccttctcattattcatatttcacatgttttcctttagccacatatgaactagaatctttcgtgctgagttctgttttcgttagacgtcacgttaggcaattattatacttcttcttctttttttttctcttatttcatgggcattttatttccaccggaaaacaaagataaaaaatattataatcagcaaaaatatccaagccgagctgacgagccaataaggacacgtggaacgttggaaattgaaaaggacaaaagctggtgacggtgagttcaacaaacacatgtccacgtaggactaaagtactctgaaatctgacgtggcatattgtatatgttcttatcattgatcctaatttttttttaatatattcactgctcctgatctttatctccttttatgattataatatctcaccagcttctacctacgttatatatatataagctcttttacgggttacctccaaagaaaaatagaaacaaaaaatg

SEQ ID NO: 2418 - DNA, 3000 bp, Unknown
  misc_feature (1)..( 3000): cDNA_ID_3067557_gDNA_ID_1620531_Annot_ID_159725 3000 nt of promoter + ATG
ggaacaacacacacaatttcttctttgatttgtctgcaaaagaaaaatccccaaaccggatcttaaagatcgtataaaaagggaacagttgatgctacagtatttgaaatcattgtgtgttcatcactttattatatcaacaagggaaaagaattggagatgggtgtctttgaagcttcccagctgaaaagttgagctttttcatcttttcttcacaccatagaagttgctctttactgattttcgacatcctcaaaacccgtgttgcgagtttgatgtcaatggctgcaaacaagagttgaacaccttcccatgtttgaggccatgatttctttctcagcccttttgtcttctttgaaagctcctttgctttcacccttttctgcaaaagttcctctcttatgagacaccaaagaagcatacgatagtaataacatttgagtacagagaaatcgtaccttatcaatggatgactgaaccagtagtaaaggagttgtagaattcacatggttgttgttgtggttcccaaacaagtgaatacccccatttggtttcttcttatccattttcaagaagacgttgaaagtaaggatcgagctctctatgactttgatgagatcatcagcgaggaccatgaagcctgtatctttctccatctcctttttatctgaccctgatatgttttgaacataaccaacttcaagtgttactactacacataaggttttaagtcgcgcaatgtatgagagctgagaaatcaccttgaatcttaggagcttgaagtagcttaggcattgcatttctagcacgagcataaagttccgatcttgagccttgctcaaacggttcattctctatatacctctgcaacaagactaggaattgctgaaacagttgggcagtatggttgtagcaagtcggggtttcgggttggcatgagattaagtggctcagctgcgtgtattgacagtgaagtgcctcccaagtgaggcagagttgagcaacataggccgtctctagatcttgataagggtcgtcaacttctgtcggctgcaaatgctcgatatcttcctccggaacatcaaactttttgagagaaagacatcggaaaggcgatgacagcttcttagatgcagatcttggcgatggagttgaaggacttggagcaattccaatgcctaagagattgaaaagtaaccaacaaatccatgatcagtccaatctatcacaatgaaaaacagttcaaagcaagaagcttttaccagtttccttgagctgctgagagcttaaacgatcaaagaagagcatacgctcgcaatacttttcatagacagcatcaaaacctccccaccattgaagtccttcagcaaccacatctctccactcacttgaacacttgtcttctccgtcatcatcatcttcatctagatacgattcctcttcttcttcttcttcttcctcaggtatcaacaccatgaaactgtttctcctcaactccttgagccttctcttaacctcattggtaatgaaatcatcatcgtcatcttcgatctcatctcctttccccgaatctatcacaccagcttcagtgttctcactccttgcctgttcttgctgagccaatatcttgtcttctttctccttttcaaggtttggcttccgagactttcgaaattttctaactttcaagaaatccattgcctcctcaaacacacttaggagagtgagtgttttttgttaaatcataagatctaaactgagactagtctctttgcatgagtaaaagcgtttctcttctgccacaacgaacttaatcaaagaatcaaccaaaccagagaatgaggaaaatgcatgaatctagtaagatctcagagaatcatgagcaaaccctagagaattaggaacaccgacagaagattaagaatgcataagtagatcagtagcaacaacagcatttgtctgaaactttagattcgattcactaatctctagctgataagaacactagcattccctgataaatcaacactccactgaaactactactacactgagcaaagagtgtgagaaaaaaaacaaaaagaaagaaaaagattcaaaatttaagaaagaaagagaaacccaaataaaagcaaaacaaaatcgaaagacaaagacaggaggaggaggagattaaagaaggagaaatgtttctaaccacttgcaagagagagagagagaaagcaaagtataataatgtctcaattcaagttttttcagtaaatggacagagagagcacaatataaatgtgagagaggaaaggagagcaagtattattgattcttaaacagatgtcattaaattcaataattaaactttgtgatttcaaattccaaaaaaaaactagaaattttcttcctttcttaaaaccctttcctcaaaaatttccatttgcagtcaaaaccctcacaaagaggtttctgagtcaatttgactttttgtttatttcctaatgggtcgaaattgtcttttactgtttggtttcttactttactttttctgatacttcattttctattggttaatttttggttttgttttggtgtttgattagagaaggagagagatgtatgaatgaatgaaaaggagaagaagcagtaacaagtaacaactggtaggtaggtcagtggggggagagatagaaagaaaagcatcgtacagagaatattgtcagaaaagccgcgctatctgttctccttccatttgctcacttctctcttttaaaattacatctttaccctcctccgtctcatacatctacgggtcttatctttgtttctgatgacaatttgggcttctcttaaaatgggctttttctttaccaaatttatgtatactgctatgaaacgacgtcgtcttttactttggttatattggtatggtttttgaatttactttggttacgattccggtctagtggattggatgaaaccgaattggagagcttgaggttatgatcc

SEQ ID NO: 2419 - DNA, 3000 bp, Unknown
  misc_feature (1)..( 3000): cDNA_ID_2048370_gDNA_ID_1620531_Annot_ID_159726 3000 nt of promoter + ATG
tgaaatcaatcgcacaagaatatgatgtaagaaaggataacagtgtccataaagttttcaaattcttttctagtagaaactaactatctaagagatgcagggctttcttccatatccatattcaagaccaatcaaagtgcagtggaaggtgttcgagaaactgtttgtagatttccgtgacttgcttgatcattcagagtactgcgacttaataggaattgccaaaaataagtttcaaaccataccttatgtttggttaggctactaaacttagcctgcttcttccagtttccacagccctgtaaagtaatttgaggtccaattctacaacatacttgtacataagacattcaaagtctgcatcttgtaagaaagaaagacgtgtaaaatgcagattcttggccatgtataattcgtggttcgttttaaagcaaaagtcaaacattttgttgactattttaacttcttcgttacttgctaagttcagttatccatccactttattcttcttcttggaaatggctctcatgaaagtaatgacgattctggttctcttcgtctcggtgtcatcgaccttggcgcaatccaacaatggcggtcacatttcgataatcgtctcggaaacaggtcttgaatttgctaaagattacctcatcaagaaagtgatcactacgacgcttccacttcagctaccagacattgagaataaggttaagatccctctaatcgggaaagttcgaatgggtctatcgaatattcagattgatgcagttcatgtccagtcttcgaagatggagactcgaaaagatggaatcattttgagtgttttaggtgctacagcaaatttgagtatggactggtcttatacttacagagcttccttctttgagatttctgatcatggagatgcttctgttgaggtaaaactctgaaattatcgaaaaccaaattgggtctttttagttttgttgtttgtgttcagaacattgtttcatcatcagaagaaaaagcttaacaggtgaatgattatgacgatgaaggttaaaggaatgaatgtgagaatcactgccactttggttaatgataatggaagtctaaagattgcctcacgggaaaatgattgtacagtaaagaacattgatattcatatcaatggtggtgcttcttggctatatcaagggtattattaaatgttccataagttttcgtatctctaaaatctcttattccaagattataatatttgttttcctttttgcagggtggttgatgcatttcaaaaaatgattatatctactgttgaaaaaactgtctctactaaaattgtagaaaaaatgaagaagcttgattctttcttgcaatcacttccaaaacagagaaagattgatgactctgctgcagtgaatctcacttttacaggcaaccctgtcttagggaattcgtcggttgaagttgacatcaatggtttattcatgccaaagggtgatgatattaaagttgcagggtctcgttcttcttccttctttggtggggttaataagagaatggtgacaatttcagtagaagaaggagttttcaactctgcaacacttgtctacttcaacgtaagttctcaaatcttgattagagtatggtggaacaaaacaatttgtaagcttattggattggttttgattcaggctaaggtgatgcatttagttatggaggaaacaaagaacgggtccattctaagcacatctgactggaaactcatccttccagagctgtacaaacattatccagataataaaatggtgcttaacatgtcagtaacatctcctcctgctgttaaaatcacagagaatggaattgatgcgacgattcagctagatatagcgttcgatgttcaagactctggagaaaatctatctgtagcacgcctatcaacagtaagactaatagtaatccaccaaacaatctaacttaagaagcatcttttgatcactaaagttagaatcttgttcttgtttgcagattctgagtgttgcgtgttctacagaaatcgtaaagaataatctaatcggtagcctcagattaaatgatttcaatgcaacaatgaagtggagtaaaattggagagtttcaaacaaactatgttcaggtaagtcaagttaattatcttgagtttaagatttatcttgattagcatcaaactggtggatatgtgttcttgttgttaggctgctacgtctaggattcttgaagccttgtttttgccgtacgtaaacacacgtctcaagagaggattccctttgccgattcccggcgatttcacgatcaaaaacataaagattgtttatgttaatagtggcattttggtatgtaccgatatcggcactagcacaaaccagtaagcaagtattatatagcttcttagattgcatgtacgtaagcctgaagaaatataatgacaaccataattgtgatttgaaccgtttggaacttcccctctaagaagcgttttgacgagatctctttatttctttggctacttgcattatatctggaacttccccccctaagaccaatgcatctttctgagaggttaaggaaaacttccattaggcaattgcaagacacggcccaatgatttatattacaggcctgttaaatatgggcccaacttcgtaaacaatcaaaatattattcatatgtacgcaaaacaacaatagaaaaggataaaattgttattctattatatctctctaggacaaaaaaaagtaaagtcaaaagatcctctctcatcgatctctctctaacatctccgtcttctgcttcgtgtaatttgggtattgttggctccctactctgattcctcaaattccttatttttattaacccgcgaaaataaattataaagagggctttcaaaattttgaacctttctctaacaatggagatctccctccttccctttttcttctttcgcgtttaaggtttctcctcgtctcttctcttttca

SEQ ID NO: 2420 - DNA, 3000 bp, Unknown
  misc_feature (1)..( 3000): cDNA_ID_3067650_gDNA_ID_1620533_Annot_ID_159787 3000 nt of promoter + ATG
aacatggtgatcaaggaaacattcagattacacccagtagctcctcttctgctcccaagggaaacaatgactcacatcaaggttcaaggctatgatattcctccaaagagacggatcttagtcaacacttgggcgataggaagagatcctacactctggataaatccggaagagtttaaccccgagaggtttatcaacaaccctgtagattatagaggacaacatttcgagctcttaccgttcgggtctggtcgaaggatatgtcccgggatggggttggggatcactatagtggaattgggactcttgaacttactatacttcttcgattggagagcacctgatgggatgacacataaagacatcgatacagaagaagctggtatacttacagtagtcaagaaagtacctctcaaacttgtcccagttcgagttcagtgattgcaccaaactccagttccagactttttacaagttttgaataaactttctctgtacatatggaaacgtataatgcgagtatatatgtatgtaagatgatgttagaaagaacatgatcctgctttgctatgaatagaaaagtttccatggcaaaggaaatagttgataaagctgtatatagagagtctcatgatggctctttgatatgcctctataaattcaagtttgtgcatgggtaagagaagcaacaatggtttcatcatcttttcaaaaacggtttagacaattctgtgatatgcaatgattaggagattgtgtaagaattaagatgaaacaacaaaaagagagatatgtaacctaacggtggagacatcttatgaaaacattggtcttgaagactaagctaaaaataaaacctgtttatttcaccgccgccgtcgaaacattcaagcggcttacggcggagagagaagagttccgatgggacgagaggaaaagagatcgacgcggcgtcaccaaaagtccaaaacaacaaattagctagagagaaattgcaagatcaaccttgatctaaaagaaattgcaaaataaacatgttgtttttaaaaactaccaatttaatcctccattcccaaattaaaatgtaatttttttcttattaacttacacaactaattaattacgctgctgaaatttcttaatattagattgttagaacataattatatatttctagccaataaatttttgaggcagaaaaatgatttatcatgtagaacatgtattaatttatcatgtccagatgacgtgaaccaatcaaatatggtattctatatttttttaaaaaaaattcttgaataaaaactatattcaattacttgaatcgaataacttatgtgcatctttaaaattttcaatcatgacatatacaaaaatatgttttttttttctacatatgatgagatattcaatcattctaggatgaaaaaactaaaaatgattatctcaaagtcacgtaaaattttgaagaaaaaaaggaatgcaaaagggagagaaagccacgtaaggagacatgtctcaaagtctcacaagtggtgtttttgtcctaacacatcacaatgtatcattttgtcccaatatgtgttagttgactaattaatgcactattctaagattttttcacccaatttctcaaaattcaatagacaggtgaagtttccaaagtcaaatttccgttgatatccacatcttccagacgtaccaataaaagagattttaactcatactatccctgtcttatagaaatggaaaagaaaaaaaaagttactagtaatcatcctcttgcttttgcacgatagtcgatagaatatcaatctggttttcagtttggttgtgaatagtctattaatctccacatgtgagtcaatgacttggatccaatataactactgagctaacttttattacaagagttattatagcgttgacgtcattgttaggtcattaacataaagcgaatccgtaaagttaataactttatctcatgattccaatcatgttttcctcccaaatcacgaaacagcttattagtctagcggggtgtattcaatcttacattttgaatgatttgagttattttgagtttttatatgattttaaagaatttaggtgaatttaagaaagttgttatgatttattgttaaatcatctcaaattccacctaaaaccatgagatttaaaattctgtatttttaactaaagaaatccactaaaagggtgtattaaatattatattttaagtgatttgatttattttaagtttttatatgattttgaagaatttgggtaaatttaagaaagttgttatgatttattgtaaaatcctctcaaattctaccaaaaaccatgaaatttacaattctgtatttttaactaaaggaatccactaaaattcacttaagtctcttaaagtcactaaaaatccaatctttaaaatattttcaataaaaggggatttttaagtagattttagaatcactacttcaataacattagatttcatgagacttttaaaaatccattattgaataacataggatttgttattttaacacaaatcacttgacgtgtttgattgaatacaccaccctaaaattcacttaagtcactaaaaattcagtcattaaaatgttttcaataactgggaatttttaagtagattttagaatcactagttcaataacataagatttcatgaaacttttaaaaagctatgattgagtaacataggatttgttattttaacacaaatcacttaaaatatttgattgaatacacccctaagtaccagaaatgatttcaacttcacttctaaatcatttctctatatatataagtctcttcgaaatgattcaccaacaccaaacaaaaataaccaaaaagaaaacaaaaccccaaaaaattctaaatacatttaacatgaagacaacaaaagagctaagacgcatgttttgctttatcatcttcttctcattcttctccttcatcacaaagaacatg

SEQ ID NO: 2421 - DNA, 3000 bp, Unknown
  misc_feature (1)..( 3000): cDNA_ID_2158136_gDNA_ID_1620533_Annot_ID_159798 3000 nt of promoter + ATG
aaagaaaagagaaatgctcaacattagacgaagtcctatataagaataaaaaacttatgaagaaaaattacattttctacagtcaagagaaaataatggtttgtatcatagtgtatatcttctatctgtttttcctctatatatttttgtatacttctgtttaatctttctcttatctaagttgttattgtgagcaatgtttgacctctcgaagcttatcctcacacggacaataaatgacatgtgaatttatatctattgaccctgacttattttgccgtggtaaagacgtctttaactctgtttttttatagtctgaatgttactcttatcaccaaaaacagaacacaaaacagaggaaaacaaaaactatgtcgattcttctgtatttcttctttctccccgttattttatcgttaatattcatgaagaaattcaaagactcgaaacgaaatcttcctccgagcccaccgaagctaccaattatcggaaacttacaccagcttcgaggattgtttcatagatgtcttcatgatctctccaagaaacacggtccggtgttacttctccgtctaggttttatcgatatggttgtgatctcatcaaaagaagcagcggaagaagttctcaaagtacatgaccttgagtgttgtactagacctaagaccaacgcctcatcaaaattctcgcgtgatggtaaagacatcgcctttgcgccatacggggaggtttcgagagagttgcggaagctttccttaatcaactttttcagcacgcaaaaggttcgatcttttaggtacatcagagaggaagaaaatgatttgatggtcaagaaactaaaggaatcagctaagaagaagaatacagtggatttgagccaaacacttttctatctagttgggagtatcatattcagggctacctttgggcagcgtttagaccagaacaagcatgtcaataaggaaaagatcgaagaactcatgtttgaggtccagaaagttgggtctctaagcagctctgatattttccctgctggtgtgggatggtttatggactttgtgtcaggacgacataagacacttcacaaagttttcgtcgaggttgatactttgctaaatcatgtaattgatggtcacttgaagaatcctgaagacaaaacaaatcaagatcgccctgatatcatcgactcgatcttagagactatttataaacaagaacaagatgaatctttcaaactcaccattgatcatctcaaaggaattatccaagtaagcataaaatctagttcacagttctgtcaaaactcagggacttttatctctaaagtatcttatctcttaagttaaatatgttcttaaccatcttgtgtcattgttgacctagaatatatatcttgctggagtagacacaagtgccatcaccatgatttgggcaatggcagagcttgttaagaacccacgggtaatgaagaaagctcaagaagagatccgaacatgcattggaatcaaacagaaggagagaatcgaagaagaagatgtcgataagcttcagtacttgaagcttgtgatcaaagaaaccttaagactacacccaccagcacctcttttacttccaagagagacaatggctgatatcaagattcaaggctacgacattcctcggaaaaccattcttttggttaatgcatggtcgataggacgaaaccctgaactctgggaaaaccctgaggaatttaacccggagagatttatcgattgtcctatggattacaaaggaaatagttttgagatgttaccatttggttctggtcggaagatatgtccagggatagcttttggaatagcgaccgttgaactgggactattgaacttgctttactactttgattggagattggctgaggaggataaagatattgacatggaagaggctggtgatgccacaattgttaagaaagttcctcttgaacttgtcccaattattcatcattgaatgatgttccaactctataaataaaaatgaagttatatatttgcttgtcgaaacagaaaaatgttatgtaacatatatttttattacaagaccagcaggacaattgtaatgcctggaatgcttgtgaacgttagtctataagactataacctaaattgttattgtcgtcttttggtatttatatcaagggccaaaaatccttgacgactcaagtcacgtttgaagtctctacgagacaattgggcttaacttgaacaatggcccacaacccacgtggctttttagcttctacgttacgtcaagaaagacttattctcgatctcatctgttgttccaacagcttcagtactgttcaaacaacatctacactttcattaagatgaacatctctactattttagattttttgggatgaatggcttgactattaccctgttcttttgttgatcgctgcgacaagcaccggcggcacaaaatataaaagaaaaaagaatgagagatgaaggtgagatgaatgaaagagtcgcagcgatagatctgaagagataggagaaagggaatttgagacgttgaaaatttcagcgtctatagaatggccgaattacagtcgctgcggcagagatgaaagagagaagaaatgaaagtgaaagagagatgaaagctttttttagatcgcaggtagctgacgtagcgatcaatcaaagaacagggcccacatatcccccagataaattttatatatataaacctcgaataatttatcgaaaattcatcattgactttgcactattgaaactgacccatgaaatagagagttgccgtgcaaaaatcatcctctgaagtctactaaagactccaaagtcttcgagactgaaaagtctagttgatccaaaaaaataaaaatattaaaaagtctaatttcatttctctttaaatttatattcttcttcacttagtaaatagagaaggaaaaaaaaaaaaaaaaaacagagcaagaaaaaaaaaatg

SEQ ID NO: 2422 - DNA, 3000 bp, Unknown
  misc_feature (1)..( 3000): cDNA_ID_2158140_gDNA_ID_1620533_Annot_ID_159799 3000 nt of promoter + ATG
gagcggcaatttttgtatctcttatgacctgatacataactggtaacaacaacaaaatgatgcattgaatacgtaaatgtatatacataagacttatgcaaatagaccgtttgaccgtttgaagagtgtttcttcaattaaaccaaaccaattttactaaaccaatttctaaactcattctattggttctcattaaaccgagtccatcaaaaaaaaatccgttttttaaatttggcttggtttaattgaaggacacatgtcattactaattagtaattgtttcatttgacgaattcttattcagtagtatatctcaggtgatgattgtggactacaaacttacgtatcctagtggaaccactacatcgatgttgattaacagtttccacaacaacactagagctgagcttgcaaggtaattgtcagagattcatcttcaaatctctcacttccctgtaaaccatagcttgagtttcattacatgagccttggcttagtttggagtatactaacaattcatccttgactattactagcaatccatctatagcatttgctagtaatagtcaagttattaataaaggtgtctctcttgaccatactaacaatgcgggagaagaaaaaaaagagatgacatcattcagataaattgttttcgttcttttttgtttgctaccggtttgaatagtttcgaacgtagatttaggattagtgtcctagtagtttttgaaaggtagattggtgttcacatattttgaagtcaattttcgaagcttatcctcagaaatactagatgacatatgactttttctattgactctgacttatgttgccatggtaaagacgttgttaactctatttgttttatagtctgaatactatgtttctctatcaccaaaaaacagaacacataaacataagaaaacgaaaacaatgtcgattcttctgtacttcatcgctcttttatcgttaataatcataaagaaaatcaaagactcgaaccgaaatcttcctccgagcccactgaagctaccggttatcggaaacctataccagcttcgaggattgtttcacaaatgtcttcacgatctctccaagaaacacggacccgtgttgcttctccgtctaggttttctcgatatggttgtgatctcatcgaccgaagcagctgaagaagctcttaaagtacatgaccttgagtgttgtaccagacctataactaacgtcacatcaaaactctggcgtgacggtcaagatatcggcttagccccatatggtgagtctttgagagagttgcggaagctttcctttctcaagtttttcagcacgacaaaggttcgatcttttaggtacatcagagaggaagagaatgatttgatggtcaagaaactgaaggaagcggctctgaagaaatcttccgtagatttgagccaaacacttttcggtctagttgggagtatcatattcagatccgcctttggacagcgtttcgacgagggcaatcatgtgaatgctgaaaagatcgaagacctcatgtttgaggtccagaaactcggagcactcagtaattctgatcttttccctggtggtttgggatggtttgttgactttgtgtcgggacataataagaaacttcacaaagtcttcgtcgaggttgatactctgctgaatcatattattgatgatcacttgaaaaactctatagaagaaataactcatgatcgtcctgatatcatcgactcgctcctagatatgatacgaaaacaagaacaaggggattctttcaagctcaccattgataatctcaaaggaattatccaagtaagcatagttcaaaacttttatcgatatgttccctaacattttcttgaacgcaaactttgatagtacattagtatgttaaaattcataggatctatagataaacgtgagatcttctatactcgttgttatggaattcttaacaaatcttgagtcaaaatatgtcattgactattttgtgacgttcttgacctaggatatatatcttgctggagtagatacaagtgccatcaccatgatttgggcaatggcagagcttgttaaaaacccgcgggtgatgaagaaagttcaagatgagatccgaacatgcattggaatcaaacaaaatgaaaaaatcgaggaagatgatgtcgataagcttcagtacttgaagcttgtggtgaaagaaaccttaagactacatccagcagctcctcttttacttccaagagaaacaatgtctcaaatcaagattcaaggctacaacattccctcaaaaaccattcttttggttaacgtgtggtcaataggacgagatcctaaacactggaaaaaccctgaggagtttaacccggagaggtttattgactgtcctattgactacaaaggaaatagctttgagatgttaccatttggttctggtcggaggatatgtccagggatagcttttgcgattgctaccgttgaattgggactattgaacttgctttaccactttgattggagattacctgaggaggataaagatcttgacatggaagaggctggtgatgtcactattattaagaaagttcctcttaaacttgtcccagttcttcatcactaaaaagaaaagagaaatgctcaacattagacgaagtcctatataagaataaaaaacttatgaagaaaaattacattttctacagtcaagagaaaataatggtttgtatcatagtgtatatcttctatctgtttttcctctatatatttttgtatacttctgtttaatctttctcttatctaagttgttattgtgagcaatgtttgacctctcgaagcttatcctcacacggacaataaatgacatgtgaatttatatctattgaccctgacttattttgccgtggtaaagacgtctttaactctgtttttttatagtctgaatgttactcttatcaccaaaaacagaacacaaaacagaggaaaacaaaaactatg

SEQ ID NO: 2423 - DNA, 3000 bp, Unknown
  misc_feature (1)..( 3000): cDNA_ID_3067624_gDNA_ID_1620533_Annot_ID_159810 3000 nt of promoter + ATG
gggctttctcttaaagtatcaatatgtcaatggccttttgagtttggagatttgttttaactcctaacatatcctagatttgtcatagatttgccttatcacattagcatcttagaatattatatatataatctatatagtttttttttttttttttggtataagtatgaacttttgagttttgatatttgaaattatcgaatttgaatatttccaattcaaagtttttatcttgtacggatgtttttggtagcggataaactaatagtggatcggcaaaccccgaccacaacaaacaaatcaagacagagacgacaaaataatcttttacaagagacatgtaagaagctgctatccataagactattgtgagaagaaatatagattcatctcattttaacgttaattctaattgataactatgtacgttcaaagttgaattcaagaaagcagaatgaaaataacgtcaaggtggtatcattaaagaacaaatgatcacgttaatgacttgttttaatagtaaatatatgttttaaaataaaacttcacgttaatgacttgttttaatagtaaatatatgttttaaaataaaacttcaaaaatcagaactgacttcttaagaagtttgaaaaataatcactattagttaactctttcaaaaatttgataaatgaatgatggcaaaccatgtttcatatatggtttctaatattaattttggttcaaatcatcaatttctaatcctaacaattcgtgttgtgtttttttcaacatgcacaaacaattttattcaaacgttttaaaacttccaaataatctatcaattctctattggtgcgtaaaaccacagttaatcaaccgttactatagtttaaaaacaacattattgtcatttagctatttttttttgtcatatcacctaaatacaataatcatttttaatactttatgataagaaacaagtggggataaacaaaaattaagccgttgatattttttagcggtctatgttaactgtcatattagttgtcatgactttttctttcgattgaaagaacagtttatattaatgacctgttttgatagtaaatatatgttttaaaataaaacttaaaaaatcagaactgacttcttatgaagtttgaaaaatattagttaactatttcaaagaattgataaatgaataatggaaaaccgtgtttcatatatggttttataacattaattttggttcgaactatcaattcttatcctaacaattcgtgttgtgttttttcaacatgtacaaacaattttattcaaacatattaaaacttcgaataatctctcagttctctatttgtgcgtaaaaccactattaatcaaccgttactatagtttaaaaacaacttttttatcatttactttttttatttttttgtcatatcacctaaatactataaaaatactattatgataaaaaaacaaatggggataaacaaaaattaaccgcttgatattttttagggtaatattagcgaataacgtaattcgacagcaatattaagaaaatgactttcatgcagaaaagttgggtaactaacgtttttgggccatgcgaaataacgaatataacctcggtcattgggcgccaaatctctatttccgacagtagggttctcggtataggaacaactagggtagtagagatatgattacaccgatacgtaatgaaaatgcatgcattatagaaagcgatatttttaaatgtaacatgttacctcaatatgcaattgaacctagttcgagctattggttactacaggctgaatcaccggattttgaatacgacacatgtcgtatataattaccttcggatgatgcatgtaagaaaataaaagagatggatgactttcctcaaacctgcaagaaatgattatgggaaaggagatgtggcgtttacatgaataccaaaatactataaatatcccacaaatagcaaacttcataacgtaacccgcgttatgtataaaaaaaacgatgtacaaattttccttagcagcatgtattaatgtaaagcaaatgaagtagaagttttatttggaaggcctaaatggaaatgtactggactggattacctaaagtataatgggcttttgagaagaagctccagaaattatatttccgaaacagcataagtacaacgaaaacaacatgttttgttacaaaaaacgcaacaatcattgttctcccacttgcaaagataacatagtggaagaagtataaaaagtaacagatgtgacagtgaaaagcgcgtgcaaagaggagagtagatacgtatccatagcattaaatgcggcgtcagagagtttcagctttcaaggtattaaactgttaaaaaatgaaaactttttcttatgtgtaccaatcttaacacacgctatatatgtgcttctcacgtacgctacatcttatcgactcaagtaggtgacacgtctcaaatgacgtcagcgttacgacagagcaagttgagcacgaagatatagtgtatcttacctcgggacaagttgatgtgtaaaaacatgagtatatggtaaatcacttggttctacttccgataacatgcaatacaaataaagaacaagtacatgtttgatgcgacattcgtgaagagatcttctcgccgccctcgggtgttgggagggaaatcataaccttttaaaattcacgtcgttgtaaatgggtcagcaactgttgcccaaaatatctagactactgtagccctaaaaagttcaactattctatataagataatagatggcaagatatcatctctcacacctcttcttctatctaaaaaacacaaacgaagtatccaacaacatctcagaggtcgatcgttgctgttttggtatgcaattaatgattgttctttttgtctactttgatgttatattaataaatcgcatggtgattttatatggtatttaatgcaaccctattgatgtgtaggtaccaatg

SEQ ID NO: 2424 - DNA, 3000 bp, Unknown
  misc_feature (1)..( 3000): cDNA_ID_2158115_gDNA_ID_1620533_Annot_ID_159791 3000 nt of promoter + ATG
gtactttggtttgaaacaagaagaaatcaagggtagaaccatttattctcttgtaaattttatgaaaagtttttacatttatttataacatccagtgattattttcttttgagtataatttaacatcgtattaaaaaaaatgaatttatttgattaaaataatgaatatatataatagtaagtaggaagcaaatataagggttattattgcctcatgtttttgttaaaagaattgtattacaagagtaaacagaaaatcgaaaatcattgtgagcctttcatttcatttataaagaagatagcaaaaacgtgaggggcgagatcattgtggctccaccattctccaaacttcgtcgagttatccaaatatgcgacaaaatatgcacatgatattgttgagtaaatcttgaatgtggtcaatcgtattcgtatccatacgccagccaatctgcaaatatcttcgcagagacagaatggcctaaacgtttgtttgtttttttattggaaaagttgaaaatagtttcttttttcagaaggaaaagtggtaacttatactattcataattgataaaataatcattttcattatttgtttcatacacttagatttgtataatatttataatgtctaaatatacataaatatacatactgtaaatttagatttgtatattaattgtattgtacgaatttttttatacaaatcaaatagtgaaaaatggctacttttaaaattataaataataaaataactactttttaaattatattttgaaaaataactattttactaacatactcttttattttttatttaaattatttatttaatataactgaaacaaaatcgcatgccaaatggcctacatgttatacggctagccattatccaaccacttaaacgtttagcgacaaacataaaaaagaataatagtgtgatacatcataatatgttatcgattatataatcttacatatgaaatcagaagatatttatttgatgacatcactttttatatcaacttgatgacatcaccttttctagaataatatagttttgacgtcactttttctatgaatattaatatgaaaagtcaattcgagttttatcttaaatccaaatatagcattccaaggcaatggtattaataatttataccgtttaatactaccaaaagaaagtcagacattttttcccagagtttgaaatattttttttttttgtcaacaatttgaatatatgtgttcgttaaatcagtttttatatatttcgataaatggttttatcgattaaatcactgatttcaaagatactattcacactattagcaagcgaatataaaatatcatgcaaatagaagtttagtcattaacaaaaataaaagaggtcttgttttaatcttcatatttgtacctcaaaatgcatcatttagatgaaactactaaacttatatgaaactattagaaatcaacctgcgatataccacatgataatattttatacaaaaaattgagttatatttattttgtcactattgtttatttgaagtgtttaagtataatatttgaacttaatacaaaaaatgacactaatgtttaatttcagggaatatggttatatggtgagataagtttaagtcgttattaatacgagatgatatacaataggtgaaatcatagatttaacaagcaaaatacaattatcgaccgaaacttcgtaattctatttttattgttatatctaggatctcactcgtaatataccgtctcgtattaattttattttataaatatttgtaatacttaaacttcgtataaattttaaatatttctaatatttgaaacttcataaaaattgaatatcataaatgtttaaaatgttttataaagtttagttataaagtttgattgtttttagcttttcatctttagtatatcctgcattacgtctccagctgtggttggtcctgggtttccatgtgaagccccgtccgtggacaccttaacctagccttcacccggccttttccaaccgatcaacctctcaacccgacatcccctgtttgtgctgcttcttgtaacattaaaagcttttttgacctccgctgctatatctttgacgaactgaattctatcacggtatttccctattttcccaaaaacgtttctatatctccattttcaaccccacctagttgtcatactcaatagtgttggccaactttctcttcccgaatcttggttattcccaaatcgactttgctaaaaaaaagtggctttatatactaataaaaaactctcaattctaagtatatctttattaacactaaaatattacgcattttaatgatattgaatatacaatataatatgtaagaaaaatgataataatattatataatttaaaatggtgataacccaatgtaaagtttcttatttgatagatccacgactcatgtatttttaatgtggtttctatttaatttttacaaattctaaattttattacctttattccaatacaccaatttgatagtttatatattcctcttttgtatttttttataaatcataaaataaaattatctttatatttaactccattatgtataagtttaaattatatattaacattattttagtatatattaattaaagtaaatgcaaaatattaaataaatattgttttaattgttatttgatatgtttaaaactaaataacataataaaatgataattatatttaagatgttaatgaaaaagttaataaatatattaataaaagttaatgaaaataatattaaaatataaatactatactgatgagatgttttgctcttaaccactagaccattggctttttctaataattgaagtgttggttttttaaccgagacttgtatgggatacttctagatctcgagttgccgtgttgaactattaatggaaaataaacagagcaatatcattttcagtttatcgataaccaaataaaaaatg

SEQ ID NO: 2425 - DNA, 3000 bp, Unknown
  misc_feature (1)..( 3000): cDNA_ID_3067676_gDNA_ID_1620534_Annot_ID_159819 3000 nt of promoter + ATG
aaccgtataacgcatccgttactaagaaaagactcaaccgtataaaataattttatagagaaaaagtaaaattaaaatagtatacaaaagttaaaagaaagtatttgacgattggtgattccgagcaggttttaggaaattaaaattacagttttacctgtaacattcttatcgatgagatagctggaagcttgcaattagttgacgattggtgattccgagtaggtttggggaaaatcgatgaagtttcatgttgatgttgatgaactggatgcaaaagattggcttttgtaacgtgaatggtgaatttatctattatgacacgtatcaagtctatgaattctaagattttgacaaatgtgaaaagaaaaattatgtaaataaaaaggaaattgtataagatattacaaataattaaagttaaagcattgtaattacttctgaaaaagcatataaaaatatatcaatcttgaaaattatacaataaattacaaattttaaaagaaaatggactataattattttctaagaagatatataaacaaggaaaataatatagtaaaatactaattttgaaaagaaatgaatcacatgtaatatttattaaagtatataatctaattgtataagctagatttttcaaagttagtaattaaattgtttctgacacctatgtcaatcaattcactagattccgacacgtataaacaagttattctaattaaacttggatttatggaacattattgattgtggtaaagtagatacatttctaaatagatgtggattttgtggtagtctcctaagtaaattttattctattttaaaaatataaaacccgcataaatctgacgggtccaaatctaataacaaataaagttaaagtcaattgagtagcaacttctcaaaagcatgtaatattcctgtcccagcccatcaaacccaatcaatttgttttgggaaaaaaaaccttaaacttatgaaaaatcctaaatttttgaaagtcccacaaagcccactaaacccagtaaaccgaaatgctaagcaaaaattatgaagatgtataaataaggatcctagggtttctttcgttaattttgtgcgcctcccttaagagagagagatcgtgagagaaagcggaagagtcgttgacgatagagttgtcaagcgagccgctagcccgcgggctttgtccaagtagcccatggcggagcgggcttagacgttgatttttttgtccacaaattagcgggcctcgcgggcaggcccattacggactgcggattctagcagacaagcccgttgcggattgcgggtatgcgggtagcccacgaaagaaaaaccaactcttttaaaacccttcacttctcatagaggctttcaaaccttttctctctattaaagtttcttgtgcagttcaaaacctagaagtagcagttcacgctcaattgcttaacaaggaaactgaaaagtcattctctatctcttcaagtttttttttttacgatcattgaagctttttagattcagatttcagatcaaacagagcatctaacacttgtaatggtatgttatttgtgactacacataaacaatttgctagtcttgactagtttttgtattttgttaatgataggatccgttggattctgttgatgctgagtatttgagatcattagatgtgaaatcttggagagtcattgagttggaacaagctagatatgaacaacaacaagctaatgatgaagcaggaggatctaaaaagctgaaaagaaaactgagagatgaaacaggaacacctatgacatagaagaaaaaagtgtgtgaactagaagcatcaaaaacccaaaaaagaggcaagggtgatgaagcttctgcctctaaaacagagagaagaaaaaagtctgaagctgaagcatctaaaaaaccaaaaaaagtgtttgagattagtgatgaagacgaagatgatgatgatgaagaagatgacgatggggacaatggagctgatgatgttgatgatgatgaggacaatggaaagtcatcgaaaccaaagaagagaaggcaatactcaaaagtctggaacgatttcatagtgattaaaaaggttaatcatttgggaaaaagtgaagaaagagctatgtgcaagcattgcaaatcagattatgcgtacaatgcacacaaaaatggtacgaatacatatcgacgtcatttgcaaatatgtaagctcgtgcctagaaatggtgatattagtcagatgatggtgaatgcagaagcaaaattgcaagctagaaagatagatcaatctgttttccgggaattggtagctaagacaattatccaacatgatcttccattttcttatgtggagtatgagagagttagagaaacgtggaagtatttaaatgcggatgtcaagttttttagtcgaaacacagctgctgcagatgtttataagttttatgagattgagacggataagctgaagagagagttagctcaacttcctggaaggattagtttaactacagatttgtggtctgcgctcactcatgaaggttatatgtgtcttacagcacattacattgacagaaattggaagctcaataacaagatcctagttttttgtgcattccctccaccgcaaacaggaatgaacttagcgatggagatacttgggaaattgaaggactggggaattgagaagaaagttttttccattacggtagacattcaagatgcttgatagggctctgaagtatcgagctgcatttggtaatctcaaagtcattgatgccaaaaaactacaaatttcatcctacagatgctgaatggcatcgactacagcaaatgagtgattttttagagccgtttgatcaaataaccaatcttatatcaggtttgacatatccaacttcgaatttgtattttatgcaagtttggaatatccaaaactggttaacagtgaatgagtccagccaagatgaagttatcagaaacatg

SEQ ID NO: 2426 - DNA, 415 bp, Unknown
  misc_feature (1)..( 415): cDNA_ID_2161867_gDNA_ID_1620534_Annot_ID_159833 3000 nt of promoter + ATG
agattaaaagaatacttcaaacgagaccaaaaaagtttagaatcttacatttataatataactgcacgtaaagtaaaaaaaaacattgatatagaattgggtttatatcgggttataaggtttagtatgttcatgaaaaattaaatcaatggtagactatattattttaactctcagattttagaaaatatggtgtttattaagtaggcgagctttttactaaaaacgctcctcgtcacggaaatcgagacactctcaccattcatgccttctgacgccggtggagcttccgttcgccagcgtctggatctatcaactctattcagcctctctttgttctgtataagcttggtctcgtttgattcttcttccatgatttcaattctctccaaacatccaaattccctttcccatg

SEQ ID NO: 2427 - DNA, 2081 bp, Unknown
  misc_feature (1)..( 2081): cDNA_ID_3067662_gDNA_ID_1620534_Annot_ID_159832 3000 nt of promoter + ATG
agattaaaagaatacttcaaacgagaccaaaaaagtttagaatcttacatttataatataactgcacgtaaagtaaaaaaaaacattgatatagaattgggtttatatcgggttataaggtttagtatgttcatgaaaaattaaatcaatggtagactatattattttaactctcagattttagaaaatatggtgtttattaagtaggcgagctttttactaaaaacgctcctcgtcacggaaatcgagacactctcaccattcatgccttctgacgccggtggagcttccgttcgccagcgtctggatctatcaactctattcagcctctctttgttctgtataagcttggtctcgtttgattcttcttccatgatttcaattctctccaaacatccaaattccctttcccatgtgttcttcttccctgagggttttctttggctccgatctgtctcagaccttggatccatctctgtccctgaaaccaaaatcagaagatccacaacagttcagcggctctttacctcaaacatcagagcaagtcttcatcgatttatctttaggctctagatctggactagcaacgccaccattagttccttctcaccggatttcgttgatggcaggagtatctcttggaccatcagatgtgcattttccggtgagaacgtcgacggcacacgacgagctcaaaagctggctggtggtctccctctacgcctcaccgccgaccatcactccaatctttcagaacttcaaccctagggtttggctggatgggcctcatcttttgttgcggcccaataagtcatctatggcccatttccaggtctgatttttctgtctttaagcttagtcgctctctgcaattttgcttctcaatagtggatggtcgtggactccatccaactgtaggaacaaattcgttagaggagacttgcttattcatttatcgaaacctgatggatagtgttgattgtttttcaccggatgcaactctaattgtgaagcttagtggattagtatttttctcaaaccttatttgttgtgatgcgatctttgcacctgttcctatttgtgtttgtatcttgaggatctatattcccactagcaagcctaaccatgtcaccccaagcctaatgggcgaagcatcccaaccttctcaaactttttggataaaaccgcctcaaagaaaactccatccgagctccgctgcattctttgtgtattggacttgtgaattcccttggcgaatccagcaaacttactcctctatggagataccatctttggaaccttactttggcagcgaggaaaagcctccgcccgcaacctcctccatggaacaccttttcgaaagctctttggcgttaatcgtacgagcttattatgatcacaagctgatccgagatttcgtgaagctagtcttcaaatttgaatccttgaaggctccaacagatcttccaacctttgctatcttcttgaagctttgcatcttggaaaactcatggaacctctacccttatctttcatgtagtgttttaaatttcagttgtatgaactcacctcttacgaggttttagttgaatgaaagttttcctttgacaaaaaaaaaatggtgtttattaagctataaagtagaataagtctcctttagcttatctattatatatatgaatgtaatgtcacatttgaggtttaatgagaaattcacaatctgttaatatggtatcagagcaaaacaaactttttctcattcactttctctctcactttctcggggaagtttaacaaccaaattttccaggaaaattcatcttcttccatcaatcttcttcgtttatcttcgatttattcaattcatcaccatctaaatcgattgcacacatcatcttctccattcatcatcgtttctcagctcaaattgctgatttcttgaagtcgaaaagcaacatcaagctttcgatctttctttttcatcatcgcttcattgattcacattgaatcttccattatcatcacttcatttcattcgtttctggatttggttgtttctttactcatcttcttcaacaatg

SEQ ID NO: 2428 - DNA, 3000 bp, Unknown
  misc_feature (1)..( 3000): cDNA_ID_3067668_gDNA_ID_1620534_Annot_ID_159825 3000 nt of promoter + ATG
acttcaacttcactaaccaataataccaccttagtttagtggaggatctttgagacacatgcggttgctaaaaataactacaaaaactttgaatcttttgaatacgaattttatttaaaatttaaatgaaaattaattatagatttttgggttgttcaaaatgtgtttgtagtttctaagagaacgttgaatcatattattcatcactttatttcatgacaatatgggtatgcaatgtatgaattgtttatttttaccagcgtctatcttctataagacaagagtttcaacgtgagatatgctaacaacgttaaaactaaagataatacaaaattaaataattttaaaaagattattatttattggtacgacaagagcacaaactcactaagatatgaacacttataattgtgacatattatgaacacctatattttatctttatcatcactctattattctacatatctttgggtatgcaatgaacaaatttcacacatttactttaatggtgtattggatcatgcatgtggaaactaaaaatagtctgacaactcttgaatcacccgaatatatattaattttgtttgatttcaaataaaaagtgaatgataaatttttgggttgttcatattttccagctaattagtgaaggaaagtggtaaatatatatatatgattgtataagacaatgtatatatggttgtataagacaatgttaaatatattgttttcaacacatccatttcctggcacatgcctttctacttccacaagttttcaaaaaaatcaagtatgttcctatacgatgagatggaaccagtatcggcgcaccttccattgaggcggttgttcgaacattttttgttttttttttgtctatttgtggttaatcagtattcggagactctcaaatttcacagttaaactctttacaaatttctctaggtgtgccattttctttagtgtacaaaaaaaacttttttgttcgaatcttcatcacagatatgtctttttggagctctttcatcctatccaaagattctcggaaccgaaaaaatgcacaaagagaccatgcaaatgaaagatactctactttcctattatgtatgagtttgggacaactaactaaatcaaacgacacgtaagcccaacaaaacaattggtagaagttgtagatttaattaatgaccacgggcaattaagatttattgaaaccatgtagattataaattataataatagtcgaatcaaggccgtgaaaaaaaaaagtcgaatcaaggcctttgtaaaaaagcccatgggcttttttaaagaaaactaaatgtagaaacgtcctgaagcgaccttagaaaccctaaacactcttacgatcgtttctggttattacgttttcgagccgctgtttcttcttctctggttcgcgtaaatcagtatggatcagaatctggatccagcttttgggataattttcctctgggatatcgagaactgtcgtctcgagtttaaaatggtaccaaaaatgatgaacaacattcgtaggtctctgagaagggctgacaacaggtatcatatagtcaaaaaggttttggtcggaaaccagaaccttaggttcatcaaagataatctggtctatctacatgtagaaggattcgagttctatgacataccgcttagggaacacacctgccctgaaccctgcggttttgtggttcaacattcaccgttcaaaaggttatcttaccaaaactactttaacaaaaagaaattttacaaatccctctacattaaaagttcttaaatcaaaaactgtccagtaagtagtattgttcaaaacggtgtgttttaaagttatttgttaacaaaaaaaaattccgatatcaatccataaatttgtgtaaatgattataaacgactaaatttgggctcaaaacattattttgatgaagagcactaatggataaaaataacatttcttaaatatttgtttaaaggactagtacaataacatttttaactattttaaaaatatatttatagttggtctgagtaggaaataaccgaaatcttagttttatggaaaaatattataacgttctatgtaattaaaatagtgtttaagcatcagtgtttaaactctgtaaaactgtgtaaatgattatatgttttcttcttattttgacatttaacattaaaatatttcatgttgagtcgaactggatcttcttaaaatcacaatatacagaaaattagtttaactatctttatttaactttttttttggtcaactatttaattagtattactactgtagtatcatagttgctccaaaaaaaagaaaaagtacaatagttttctattttattcaatatttgtctaagccacaaagaaagtaactctagactgacaagcgtgaaaggaggttaattagcttagtctcgtactcacacatcatttcaaaagtagagagcaacatcacatgacaacaacaagtgatcccttgtttctgaatacaaagaacagagaccacaagtcgtttggagcggctctccccagccaacaaatcttgatttggtaggcaatcggtccaggtttgctatccacatgttaaaagtatgtttaggcgtggccgctttacattaaaccaaaccgaatctgacgagtctaccaaatcagctcttggtcttagaacagaccacgttcttgatgatgagaagcctttgcaacttatatgttctccaccacccaaccataagaggccatacctcgagaatccttttgcaacttatttttctttccaacatttaaagcacatttattttcaacagattacagttagacacaagcattgttccattgccgtttcatggctataaatagcttattcctcattgtttcaacagaattcaaataatttctacaaattgagattaaaaaatgttcgacgactctacctcaatgcttgcgtttatcctaggtttgcttctcctatcattaaca

SEQ ID NO: 2429 - DNA, 3000 bp, Unknown
  misc_feature (1)..( 3000): cDNA_ID_2161851_gDNA_ID_1620534_Annot_ID_159829 3000 nt of promoter + ATG
tatacaaaaaaaaaattctttaattttttcaaccacaaaaattatgttctacaagaaaaatcattagaatcaaacccaatacaataaaaattttctgcttttagtttaaattttaatatcttaaaatgtttagaattatttttattatttagttttgaaattgaaaacctaactattagaagaattaatgcattaagtgtttttgattatacaacaccatagaaaattattttatattttatttttatattaaaataaatattagtgtttttttaaatattttttttgatcaataccagtcaatgcttgtcttcaccggactaaatttatcggtgtaccataattttatgtatatgatgttaaccacatgaaatcgtatagctcaaatatgtgaccatgcaaaacatctacttcgtgtagctaaggataaaataatatacttgggatgtatgatcatacattctctgatacttagtgtagttagaaatattttttccttagatttatttgttcaattgtgactataacaattagaagatattttctattatatatattgaaaaacgaccacgtttaatcgtatcgtcgatatgttttcaattaattatctaatttttaattaaaaatgtactaaacacagtgacaagcaaaataataataaaacagttaaaaatatgaaaatatgaatgagtctatggtgcagttttgagaaaaaagttttgataatacttttcttttagaaattatataaaaaacattaatgtaagaaattattatgattcctatagacaatttttttgcctccaccactagcacctctatgagtctcttactaatataactattagtgtttttaatgtaattaaatgttttaattaaattcgaaactataaaaaaatttaaccaatcataagaggaaaaatgtaatttagaatttttagagtttgttatttaagagagtcttcctactctccctccttactttttataattttccatactcttattgatgagtctctaattaagaagaccatcaataaaatacactttaactgtcatagtataatttataaactaaaattagtgaaactcttctataaaaatactatttggtttctttatattttgaaaaagtgggtgattggttcgtctatatcggtagatttattgcaatagaaacgttgttctaggtgtgatgattggttgtagaaataaaatttgggtttataatgtattttaaaacaaaacatataattggtaaataatagttatgtgttatataatattattctcaaatatcaattttataaattatgatatacataacatatatatatgatgtatttaagaaacaatgtaaattatatatatatatatatatatataacccaataaaaagagttatatatatatatatatatatatttcataaagtagttattttaaagattacttatatccacaaaaataattttttcataatatatatggatgaaaactataatattttttttttttaaataaaaaaaaaaaaaagtggaaagaggaaaaaaaattgtacatcccacctaaataccataaaatcgtactctaaaaaattgtacttaaaattattattttggctgtgagaaaaaataagaaagctacaataggggttgtagcttttttgttggctttatacatcttctaatgccctaccaattatacccaaaacattttttttttaaatgttaaatacattgctcaacaaaaaatattatatacaatagaaaaatgaaatttgcaagattatccataacatgggacatgaaaaatatcatggatctgagtttcgatacaattccggaaataggtgttcaaagcttatggatccaaattcagatatttaaatattttatatgatattttctgttagtctttttatttattgaaataatagttaatattattttaaaattttcatctattttttgcagatatgggtagttgcatatattggtggatccagatcttgatatttgttttatggatctaacggatccagatccagataggtggtttacggatccagcagatccggatagctgtttcacggatcatgcggttctagatctgggtatcccaaaatttcacagaaactaatttcatgttcatctttctatctacaaccggagaaacaaaaacaacatgagaaattgaaggagttcgatgatatgagattattacctttttgagtaaagcacggaatatctcgtctcgagattactaaggactttctttgaaccttgtcgtcatgtgctttggttgttttgaaaagtaagggaaaaaataggaggcggagcaaatagattatgttatagaattcagagagatgcatatttatataagaggagcaatattttgtgaattctagggttttcagaagatttatttcctaaatgtaatacgtttttagtaaagatatttgtttgataaaacttggaaaaataataataatgacgaccaactatattgttaacaatatcttactgaaaaaattgagataatcgcctataagatgtttaaagtaaaatatttcaaataaagttccatagaaatattgtaaaaatatgttactatataaatttctaaaataaatatcagttcaattaaactaaaataaactttctctaactttgacacatcaacctttttatgtgatgagaagctgacacatccttaaaacaagaaaccaatcaaaacattacaaatactacacatcaaattaatatctgccacatcagattaaatggatgatttcagcttgttggaaatgaaaacaaaataaaaagcttgaaaaacttgtcaattcctctttgatctttccgtctttactttctaattctcgtgtatctattttgaatagttgtaatacttgtatcagtttttaaatttaattttaggttaggttttgtaattaagttcgttaaagaaaaattaggaattagcagaggggaagat

SEQ ID NO: 2430 - DNA, 3000 bp, Unknown
  misc_feature (1)..( 3000): cDNA_ID_2161950_gDNA_ID_1620535_Annot_ID_159844 3000 nt of promoter + ATG
tatacaagcttgacacccgtgaaagttataagcacgattgcgaaacattgatttcctttgaagtggccaagagagatcgtcgtttaacgattattggtttataattaagtaccttttaatcaaaatataaaaggactagtcatatcttgatttttgcatctcccaacaatttatttataataaacatatttagctttttcttgagagcttgtatcaatttaaaagtttcttatagaacacatgttgaatttgtgtaaagaataaattgtgatgatactatatatggatatcacatcatatcaaaatcttaaatgtattataaatataataattaaaatccagagaaaatcaattttcttaattgaatgtttgtatatagtaatataataatttcatatgtaaatattccatttaatttggattatagttttatagaaagaaagtattttgatacctttttaaattttatctcaaataaatttgttttttaataaatatattgtgatttcagtggataagttttatctttcatcacttttagtttgttaataataaatatgaatccagttagatctcctctgatcactggctttcatctagaaaccaactaagagttttgcttctcattgcattggaatggtggtaatctacaattatgggctgactcaatttaatttgcaatgtcaccaccactgctcctcttctatctagcaaacaaatacttaattgcatttcgaaaaatcaactagtctgtctccattatcatatacataaatacaaattaacatcagaaaaaatatacatacaatctttgcacagagtcacattttcttaaaatgtataagttatttcatccggttcttatagtgaataccatatgtatatccatgtatataaattgatatttcaattaacattaaggaatcacaagcatgcatattctctcgctcccacgcaaacaaaaagtgcatgcagcctaacgtgatctctatcgttaggtagctcacaaatgacgaacctaaaccctcttcaccataaatcaaatcctcctccgctctatataaacaacaaaaaaaacactaaacacttaaataaatcaaacaaacactccacattctcaaaatcatattttcatataacttataaaagataaaagaaagaagaagatggcagcttcgtccaagtactcttccatgtcattcatgaaggtggcaatgatggtggcgctggtcttggtggtggcagccactgtggtggatggacaaagctgcaatgcgcagctgagtacactgaacgtgtgtggtgagtttgtggttcccggagctgacaggaccaacccaagtgccgaatgttgcaatgctcttgaggcagtgccaaacgaatgcctttgcaacacgtttcgcattgcctctaggcttccctctcgctgcaacattcctacactttcatgcagttgatatggatcctcatattaattctagacgctatatctttgtaagaacatacaatataacgtttcaaatacatccatatatagtttcatatgtttaataaatgtatctaaaagcttttttttttggtatttaacaggagaagcatgtatgggaagtaaaggagatggatatctaagaataaaaactcaaagtttgagttttttttttttttttttttttggtttttgttcttcactgcaaaaccaatgggtttcgaataataatgaataacaccgaattgaaattataaatggtttgagttatattatcaatttataatttgtatacatgcaaatatatcttatatcacgcctttcaaagtagtatgcatgtttaattaattggttattggtgtgaccaaacgaaccttttggttcttatacattcgtttgataattcaaaaattagggcctaggggtaacgtactgtaaaattcgcattataaattccccacacatcagatttgaaagaatttcgtccaaacacacaactgaagaaacatgtagtatctaaatttttaacatgtcgaattagagaaatcaaggtgatgttttgccatctcaaatattctccaagaattttgcttaaatgccaagaaaatttgtaaaaaaaaaatatatatatgaagaccagagccagcggtaaattgaccaaaacatccctagtagtctacctcaaagcgtgtggaggttgaaacgctcggcggatatcacgagctcgggccacacgctcatctctagtctcttttacattggctttacaaattttaaaatgaaacacgaattttatcgatctacaaaagttttgttttatattctatggtacagttacctataatgaaaaaattaaaataatataaattggtgaagagtcaaaatgtagatcttttaggctttttagctcaaggcttgtttttctctgttagaaaaagttgctgttattgttttattgtttctccctaattagtcaaaatcttgagggaaaatgacaaaagaagaaacccatgtggtcaaaatcgaagcttttttgtgttttggtccgagtaaactagggtttcgtttgtcttttttaacctttctaaaataattattcgaaaaatttggcttaaaaggtcaaaggtacaacttgagattttggggccatttgagttattaaaaaaaaaaaaaaggggagaggacaaaaacagagtattgaacaaaaaggggacaagtcatatgatataacaaaggaaagatctttctctttcatttgctgatctcactcgtactatagactaaggaaagatctcatttggtcgtcagtaaattttctgatttgattgaaaggtatgaaacttgatgaacaagcaacgtaaacactgagaaaatagtaaaagcagtgacaatacaaatatatgttgtcttgcattatgttcttctctccattgttggttttgtctttcttgttttttttttgtttctctataacttagattattgactatttaatttggttgcagagagggaaa

SEQ ID NO: 2431 - DNA, 3000 bp, Unknown
  misc_feature (1)..( 3000): cDNA_ID_3067684_gDNA_ID_1620535_Annot_ID_159851 3000 nt of promoter + ATG
gtttctccgtttacttcttctgacatcatctatcgttttctctttttccaatacatcatctgcagatctcttgtccacatactccagacgaagctaaaatcagacagagaaaagttaagagttaaaagattaacagaaaattcaatcattcagctatagtgctttccattaaactaactataacaaaaaaggagaaaggaactcacaacagtctttccatttccggaatcatcatcttcgatatcactttctttcaatttacgtgcataatgtccaatattgccagtctcaacataccgtgatgcgtctttgaaggattgaaagatatactcacttttagggtcaatgaagaactgcaaaatcaaaaacaagacatgtccaagaagaatcacataagagattttctaaagtgagcttatgtggaaaagacacaaaatgtacttttgatcaaagatgatgttatcacaaagagagtagagggtacaaactggatctcttctggttttacggcctgatctatttgttatttcaagtttcttgatccatccttcaggtaaaccttgagcagcagatttctcaactataacctgtatcacttaaacataaagagtttttcattttaagagacgtataaatgtcaaatctttttagggatcacaaagaacaaagtaacattgtcttcaaacatataaacaacacaaaactctcagatattctgtgcttatgaactttccatgaacaacctaataccagacccttgccaatataaatgtgattcatctcaaaactttccctttgcatacgcgagaggtacaaagttttagtgcttacgaatattacagtattctctcgaagatggttacttaacaatccaaattcattttcacaagatctattactcttaatgtctaaccatctcagtaaagtaaccatataattccttttcacacgaagtaaactaagagacaaacttttaaaaattcaagaaaaacttaaaaaaaataaacatctccaatcatgcacacaagtaataagagctttctaagccacagtggaaccaagtaaaatcaattgagttcaaaatgtagctacataacaaagctttgatcaaactacatcatctataacaaaacaaaaagtcaggtcaagaccattttcagacacttaatcaactagacctcttctcttttgatcacatgtcatctttccctaaaagctaagcattgcatgcaagagaaaatcactcaaacgtcacaaaagacttcacctttttccatcattacaaaatcatacaatcagaaactaagagtgaatcaaagtatttggcacttcaataaagataactacaatttccacaaaaggagctaacaagaaccaaacatgcaaaagacaatcaaaattaagaaaagggtttaaaactcataaatcaccttatcctttctcccattcttcctcactctaatttccactttcctctcagccgacaaaccatcagagatcccttctccgttcatctctccggtcaccgtaaaaccactttcctctctctcttgtatccctgattcacaactcagaatggtttatcaactcaaaacgccaaaacccatcaagaattgtcggattcagataatggacaccgtcggaagttataaagaaggaacctttttattttgtctgattgtgtgatttggttctgtctccactaaggtaaataagaaaaatagtaggatttaatggggaagaagaagaaagggtttacacgtgtagtgtggaggagtttcaatggagattccccgatttgagaggttcaagaaaactcagtccaccagcacgcgagtcttctggcccaacgcttctcttctctgattgcaatttagctcattttctccattttattctcttgtactgtttgttgtttacttccattgttattgtcccaattttaaaaaaacttacactgtatattaaaaaacatttgcttgatttggttataaaatctaattgcaaatctatttatgatgatattttttgggaaacatttaagactttgttatcattttttgacccaaaagaaaaaaaaaatgttattattgtaaatgttaggattggaagatttatcatgagaagaaaagtgaaaaatactaatatagtcaattatgaattttcataaatctgaattaaatataatttatttttacttaatatatagttttaattactttttgtttaaatttatgttattaaatttggtatttgtatatcatgtttaaaagatttagaagtatgattttattctatttctagtgatttaattattgaaactttgatttttaaaaaagtttatgtattaataaattatttggattgaaggttatatcaatgttataaaatgtgttttaaaatctgaaaagtggttgattttttctttttaaattctgcatccacgaaacttatttttcttaaaacttatttttcttttcgaggttatgattctttttagttttttttatcaaatttcatgatgaaaataactgaattgaacatcaaagattttcagaaaatactctactgcttttttcttaactatattctagccatttacatatctaagcttgatgtcttttctatttcgtcgaaaatctatctattttacggcagagacttgaaacccgaattttgacatatcaaaaacactaacacaatcccatgtactacattatcatttgtattttacttatagaagaaaataactttttatttaaaaattgtatggtaaaaataaagattagttccctaataactatataaaaaatcttattcggtcgttttagctgtatttaacttttaaacccaagaaagaaaaaaatcaatcaaccaaggaagtagtacaacaacaagagtcaaaacccaacaactctctatctagcacaaaagcctgacttttacaaagacaagccttttcaacacactactgatcttgagaatcctctcttcaaagcc

SEQ ID NO: 2432 - DNA, 3000 bp, Unknown
  misc_feature (1)..( 3000): cDNA_ID_2161987_gDNA_ID_1620535_Annot_ID_159856 3000 nt of promoter + ATG
ccgtagagttgacgaatcatgccacttaatgtgttacaggctcaaatatccaacctatatgagcccagcccacttatttataacaaagaccttaggccaagagtccgtccaaataacaaaaacgacaaacaaaaataggcgtcaagtaaattaagaatctttcaacattattgagagcctcattttttatttatattttttatattattaagaagcactacataattgaaaaaacgaaaatcttttaactaatttttgcttttctaaaataggacaaatggatttttaagttacatattttctaaatctactatttagcttcgagtatggtgtaatcgacaaacgtttatttatccaacaattaccatttgttgaaataattattttattttgaacacaaaaacaaaaacaaagtcaaaattagagatgatatattctttttttaattaaatttctctgatatgatattttaaagttttcaattactaatacaaccatcttttacgatataatactcgaaattaaacacaaaaatcaaatattctatattagacaaactatttagattgcacttagaaacacaattatgtaaatagcacttggcagatttactcacatttggcaagcagaataccagtcaggttagaaccgcatgcttcaaaaaatttgacatcaaaataatcatcaatgttttcaacttctgcaactaaaatgtatttgaagttttaaacaccttcttctgtagtctcagttaaagatccaactccattgttaaacactaagttttaaacggttaaaagaatattagaagtgaaatttttttagaaactatgttatgatatattcatgtggaagagagagagcacatatttatattggtcaagaatttgtatttggttatttaatgagagatttcataagttgattttggaagccttcaatgtcaaggcctcttagagtggatccataggtattttgataagaatcatcggcacatgttatgtcagtatagatgtgagtacagagcactatgagagaactaatattttcaaatacttgttcatccgaatactttatacctaaattattccaaattattcgaaaatactttaaaaaatctaaatttatttgaataaaaaagataagtaaaaatttatcatataatatttgggttggttactttgtaccgaaatcactacattaatcatctaactataagttagaggggtataaaatttattagatgggcttcaaatatattttaacattcgttccgttctcgtgtaatatccgatctaaaccgatatccgaaatacttaaaaaagattcagacaaatgggtaaaatattattttaacctactataataatcttgtctaatcggtaaatgttatttattcaacaatcgccattactataatcaattacttatgatagtaatgacgattaaaaactactatatacttattatagtaaagtcattattcatttggatcaatcaacaaaataatatggatgattagaaaataattaggattatttgggattttttcttttgaggagtaaatttgactatttgagtaactttctcttaaaacattaaacaaatcttacattaatataccagcttaacaaaattatcagaacgcctagcaacttagtggcccaagaaaaatatgtcttttagtgaaccagatttcttcatagataaaaagtttagtcataatccccaaaaatttatgaccaaattatggagagagtagctgagtaggggatatagaaaacttgttagacaaaaaattaagagatgagatgtctaaataacatttaaaataaaaataaaaatttaggagacaaagaagatgagtgcatttaagagagggacagcacatgttttcatgtgcttccaatacttacgccatttttttatccgtatgattcagcttctaatcattttataatcagctataaacaattttaatactttgtcattattagaaaatcaaaatcattaattctgatgagttggtttggtttaaagtatttcaggaaaatagtttaagattgcgaaaaaaatgaagagaaatgttgaaattatcaaaccaataatatctactgatactagaaaatagtgtatataaaattctgaaataaatgtgttatcattaatataacacacgcaacatacatatattctatggtgtgtacagctgtatgtacataaacataatgcatgatggatcatgacgactatgtggcatgcagataaaggcatttctggtttttcttgggtccaccaatactatcaataatggtgttatgtgcgatgtgtttcattcaagtacaataaaaacaaaatataacttattcccttcaaatttaatttcacaactagaaggtagaagccactaaacctcttcacactcactcatgtaactattaatttaaattaatttgaataaaccctacaaaaaagaaaaagcgtaacctactactctttaacctgacaaaaaatggaagctaattttccatacaaagttcactttatattatacaagtttaattacatacaatcttagacttttttgtaagtcacaccaagcaataaaaagggaggttggggtgtctattaaatttaaggacccataaaatcaaccacatttatatgccttactgcaataaaaagaaaagcacttttcaattcaattaataaactattaaaagttaatttcctactcaatcaaacccattaaagcagtaagaaaaaaaagggtttagatggaatctactaataactcactgattaagttttaatattaaaaaagttgtacgaatcaacctttatattgtacaaggaaagtgatcatcgcagactgtaaatcaggttttgttgttttgttttagtttcctcctacattctttggaagaaactaatacaaatcagagaatttgagaatccaaattttgggttgaagaagtttttgtttctgtagagaaaaca

SEQ ID NO: 2433 - DNA, 3000 bp, Unknown
  misc_feature (1)..( 3000): cDNA_ID_3067701_gDNA_ID_1620535_Annot_ID_159849 3000 nt of promoter + ATG
acctgaaggatggatcaagaaacttgaaataacaaatagatcaggccgtaaaaccagaagagatccagtttgtaccctctactctctttgtgataacatcatctttgatcaaaagtacattttgtgtcttttccacataagctcactttagaaaatctcttatgtgattcttcttggacatgtcttgtttttgattttgcagttcttcattgaccctaaaagtgagtatatctttcaatccttcaaagacgcatcacggtatgttgagactggcaatattggacattatgcacgtaaattgaaagaaagtgatatcgaagatgatgattccggaaatggaaagactgttgtgagttcctttctccttttttgttatagttagtttaatggaaagcactatagctgaatgattgaattttctgttaatcttttaactcttaacttttctctgtctgattttagcttcgtctggagtatgtggacaagagatctgcagatgatgtattggaaaaagagaaaacgatagatgatgtcagaagaagtaaacggagaaacttatcttcttctgatgaacattccaagaattgtaagtacaaagtcttttgggttctgattttgccacttgccagggtataatcatacttatgccgtgagttacgttaagtaagtgtcaacattcgattatatatgcaggtaaaatgacttctgacttgagcattgtaacctcacaagttcttgaggatttggggaagaaggaagaggtgaaagatcctatcgaaaagcagctcatagcgaaacgggttactagaagccaaactaaagccagtacgactgaggaagtcgtcgtagatttaaaaagaaatctgtcttcatcaaatgcaaaatcagaaaaaggtgtgcagatacctgacttaatatttccacctgagtagtggctgagataacaaaaagatttgaggacaccaattttttctatgttctctatatttgtagattctgtaaactccagtgtaaggtcacaaaaaccaaagaaggaagctgttatgaaggaagaagaggaacaagattcttctgagaaacggatcacaaggagtaaagttgaagagaagaagaatgagctaagtaatagtgtagcccgacgaacatcaaaacggttagctggtattgagcttgaaccaacgcctgaactgaagacaagagccaaagttcaacgaatagtaccgcttgatgatgaaccgacgcctgaactgaagacaagaaccaaagttcaacgagtagtaccgcctgatgatgaaccgacgcctgaactgaagacaagaaccaaaattcaacgaatagtacctcctgatgatgaaccgacgcttgaactgaagacaagaaccaaagttcaacgaatattacctcctgatgatgaactgacgcccgaactgaagtcaagaaccaaagttcaacgaatagtacctcctgatgatgaactgacgcctgaatttaagacgagaaccaaagtacaacaaagaatacctcctgatgatggcagagccggaaagtgcaagcaacctgtgaatcatgttactaccagcggatcaaaaaagacggaaataccgctcaacaaggaagtagcccaaagctgtaatgaacaatcctctcagaaaccacatgctgctgctgcaacaagcaacaatcgtgtgagtgcagattcggcagtgggaatacaaaatatcggtaaagcagtaggcaggaagccttctaaagacaagaagacgctgaaatcaccactgatagtatatgaactgaatccagtttttcatcttgacggttacaagcagaaggaagaaatgtcacctgtgtcaccgttgtcttgccaaacttctgcaacaaagtgtgagaagacagcagcaggcaaaagagtgggaaggtctagcccaaaggctaaccttactaccagtgtgaaaccaactcagatctcgcctctgagatcaccaaataaaggaaagcaaccacatccttctgacagtggttctgccattcaaaggagaaataaactagctaatgagtattctaactcatccgttgtaagaggcacatgctcagaagtgatggagaagagtaccaacagcttctcctctgcatttgactcgactcttgcagatctttgtaaagatccttgcattgcctttgctatcaaaactctaaccggagaatctctgtgtcttctcaacactccagcgatctcttctaatcccattaacaaccacaccaagcagaaaggagtctcctttaccccagagactccaggaaatgttaacacatgctctgaaaaactggtatttccgagtccacccccgggtgcaaatatctggcaagacccgtgtatcgactttgctataaaaactctaacaggcgcaatcccgatcgggttagatgaaccagatacgaagtcaaagtcacaggggatgacgtctactacagcagcaacacaagaagctaaaggtaggcaaaacaactgtgattatatgacgaacaagactgtaggtaaacctgatgatctaaggtttacacaatctttctctaaggactaacaagaacaaaataaagcctactgtacttttaggtgttttcgtatattagggtttttgataatgccattggtatcgtgtaagatccatgtgcaatgccttagctttattttctttcgggccatgttctgttgtaaatacatatgtattagtgttgtgtatcgacagaaccttgaaaaactcataaaaactcttcctttaaccacccccaatgatcttgtttcttcttcttaaagatggatcttttctagttttctttctcaaattttgaatgcatctttgagaagatgatggtgacgtcatcttaaacgaaaaaagcccgcgaaagatctctaattttccgccaaaatttatatacatacatatatataaagtgaatatatagaattcgaagaaaacggagaagaagaagaagaagaagatg

SEQ ID NO: 2434 - DNA, 3000 bp, Unknown
  misc_feature (1)..( 3000): cDNA_ID_3067703_gDNA_ID_1620535_Annot_ID_159848 3000 nt of promoter + ATG
atgtcatatcaaacaaaaatacaatgacaaatttggaatatgatgtaagaacatagaacatggaagaacagaggtgacagtaagaaattgcattcaaaatgctataaaagacaatcacataattgatgggagtttttgtttccttcttaaatttctggaagattcaaattgataaaaaccaagattagttgagattgagagctctctgtgaaacatggagcagagtacacatttgattgaacagaaaggttttatattaactcaggggatgaagatgacgacgtccctgataccgttttggttgcatctaactctttgtttccgcctttagtgtgtcgtgagtttgttgttgtctctgatttactaccttttgcaccatcatcctcttcctcttcttcttcatagaatgaccctgaggatctcagttccttcaccttccgaaactcgtcgtaatgtgcttttctgtgtgcgttgaaacgttcatttttaccacttccagaacctgtggttttgcacacaaaaaaaatagatatatcgggatgacctaacaaaagaacctatatatgacagtagatttgtttggttttagaggaggaccttcttcatcttgatccattggatctgcttcttcttcttcttcatcagacgagctccagccaccaccaccagaaccctggctactatttctactggaagaagctgctgcatcattcagaacattcctcagttcttcagctcgttgcatatcatcaacacattcatcaaacgctcttcctctaggagacaaagaacctggcacaatcaatcacggattagaacagatcagaactgattcaagttaaccttacatctagagtgacaaatttccaaatcaaccaaccaattgcaggtacaagatttcccccaaaaagataagtaatcgtccaactttgtagatgaattaaaaagcagataattttcacatacaatttgctcttgctttctgtctgacatacattccatttttacatatatgtttagatgatgacaagtatgtatcaacaataaaatgcaaaaacgtcataagcatataaacgtgtatcgaaagttctgtgcatatactaagagaaaccaaataaagaaaaatagacaaaccatcatcatccatcatcgggtggtatggtgtctttggttcagtaatcttctgcctaacaggtttgttcgattcaatctccactatattagcttcatcccattgaacacgccccctgccataataacaaacatacttagtgacaattccatgagaaactatactagattatacaaaagatcacctctctttacaaaagaatgacgatgtctaagccttaaactaaagacaataaagttcacagaatcttacagttaaacaattctgctggaatatgaaaatccatgaacattaacacaataagacctccctcttccatttcctttttcaatgggtgtagtagaaaatatatctgttttacgattccttcataaaaagaccgccatataaggcttagaacttcatatctatgaatatacatccctccacaaaaatgacataacacagcccattgacttcacaattgatcttatttgaacacattgaaaaggtaccgttctgatgcagcaagcattctcaaatctaatagaaactaaagacacaagcgaaagtaaaaatttgaaaaggagaaacatacttcaaagaaatccatcaaaatcaatccaatctgctaactttccaaacaaaagaacacaatggtataactgaccactcaaaatcacaaacctttaaatacgaagaagcaggaatcagtatctacctctctcatgatcattgagctaaagtatcctaaaatctataaagcaaaaacctcctaaatttctcaaatttgctgagtaatggtttcaatcagaaagggtttaacctaaataaccaattgatatcaaaagcttatcactttcctcaatcattcacccataacatatcccgaaagacactgtaagaaaccctagcctatgtttggttctacaaagaccaaaactaaaatcaaagatagatctttcgtgacaatcatcaaagattcaaactaagagaaaacaatcaaaacaataaaatttatttacctctttggttcggtcatcttcaaaatctccagcaacttttttctttgtctcgatcgcaagtttttaagacctgttgtgttcttgattaaagaagatacgagggtcaactaaagatgcaacagaaaccgtccgtttgtttgacttttatcactgttgcatccagattccgccacgtggattacttcaaacccgttcgattgatcaagcgcgtgaagacttgagtaagggtagtttcggaaatacactttagaagtttttttttttttcctttttcctgagaacgatcgaatcgaagacggagtgtgcaaaagccaaagctttgatctttcattaattcttctcaagatcttcagagtctgtaagtatttttggaatcttatttttcttgtttctcaatcgatgtaaaataaaattcagttgttgatgattttaccatgtttcgggagcttgtgttgatctagttcttcgctctcactaggctaattttgatcttcctgatgtgcacaatgtgaatgggtcttaggtattagtgatttatcggctttttatttgatccattatctatccaaagatctaattttttctgttttgctgaagttgtaaattggaacccttttgtgaattgtgtggtttttttagtttggtattgcatagtggtttctctgaaactgtgaattagatctgagaatggagtcttgtgatctccaattacttgtgtgatgcttttgttatgcttactcaaattatgataaggaagcaaagttatgttgatgctgatgataataagctcttctcttatttttggttcatgtgaaagacaagggaagatcaaagtaattaaataagctgaagtaagaggaagtg

SEQ ID NO: 2435 - DNA, 3000 bp, Unknown
  misc_feature (1)..( 3000): cDNA_ID_3067787_gDNA_ID_1620536_Annot_ID_159872 3000 nt of promoter + ATG
ggtagttcggcatgtgttttacccacgatatatggcgtcggcctggtttatggaggagatccgtttgactcagggcttgtctatagcagtcagttgtcatcttctgtgcctattttgtcaaagtttaatggcatcctcctctccgtgctagggcctgcttttggatatccgattgcatcttctgcaggtaccttaatgcaaacacgattttacctataatctggtaatagctagcatttgcttctactgagataataatgctgtttgcagtaagagtacttaaagggttatggagaaatgacttaacggctctaaaaggagactgcccgaattgcggggaagaggtgatttctttacttgtagttcttttgcagcaacaaacaaaattgttgttgttttcagttctcgtcacatttgagtttgatgaacttgtgtaggttttcgcatttgtgagatccgatcaatcgaaccgatcagctcacaaagccgactgtcatgtctgtgagtgcaccttggagttccgtaccaaagtagaggtagatgttagtgtttttttcccgtgtgttgcttcatcgtgaccttgtttatttgaacaatctctgtggtttaaatgtgaaccagtcactgccttagattaatccttctgtagctttctaacaacaaagattatttgtttggttgtctatctgcttcagaaatctgcctcacgattggggagaaaatgggtttacggtaggatataccttgtttcacggccaaggagagatcggcgttcaaagtttacataattctaacaaaagaagaaagatttttttgggatggtttctactcaattgtgtattgtaaaaatgatactatagaaagcttttgtaacattcaaaagattcataaaaattgttactataacgttttgtctcttgtagccttatcttcagacagtttacaaaaacaaacaaaagaacaaaaagattcgttccaaagttccaatgcctttgctgctgagtgaaaagaatgttgctcagcttttttttcagaagtgtgccaagctatagacaagaatccatgcgagctgaagacagaacattaaacagattctgttagaccttataattactgttaaagaaagagtctgtactgttgagatgaaaacaaacttaccaaaaagagagtaagtgacgcaaagagaccctcttggagtaaagctgcgtggcctccgaaatcttcttcatcaaccttgagaatcattgcgtagtaaccataaactatcccagaggatatcgccaaaaacctgcaaaatcccatcattagttcattacatcacaaagttttgccaaacttaagaggtttcaaagaactgtgatccatgaatctacggctttgggtcgatgcaaaatgaaactaaaacacgaagaaactgatagaaacgaagctggaacatgatccaaaactaaagactgttcctttgcgttttcatcaaccattataacatgaaaacacaaatgtggaaagaaacattagtggccaaagttaatgaaaacttacagaatgatccaaatgcctccaacaagtggaatagagccccataacaatccagagatcaatcccaccacttgtcgaatccaatgtaacacatctcctaattgatcctgcatcatcattaacaaaacaaaatccaattcataccaataactcaaatttacttgagcttaaaattcacaaattgaacagtagagaacagcttgatcggatcaattattcatttccttactgattcagtaagatcgactacgacgattcattaatcaaatctccatgtaaaaaaagtcaaagactcaaagagattgccgaaaactagggaggaagaagagagtgttgagtaccttgtcccaagaagcatcgggatcgaacaatttcgctaatttcgatggagacaagtgagcattctggtgattctcttgttgttgtagctgattcagcttggctgatttcgattctttcatcctcgctttcaaacaaaaaacaaaacaaaactttggatacggagagaatctgaaaccttgggaagaagaaaccccctttgtggagtattgaattagggttcttagatttaaagcactgttaattggtgaactagtggctgagtcgtgagattattattaaactgtgagtgtagttcatgttctgtatcgaagtgattcggactgtgatcgagtttcttttttttcttcttggtaaattaaaagataaatccattagttctagtaattaattatcccttaattataatatattgggattagcttttggatattttggatctgatgcctcaaaatactgcaattatgtaccttgtttatatagtgaaacaaaattatctatactgatgttttgtttttgtctgcaatatattaaaaaaaaaaactattttcgagttctgactttggtcaaagtttgacttttatttgtaaagtactcttcctcaaattcggtcagtttaaaactttagttaatgttgctattaatattaattaatgtagtcatatagtttttaaactaacaatatgagtaatatttatatattattaaaaaaacaatattagtaatagcctaatatttgtcatactgtaatttaaaaaatttatatagttttgaattctcataaaaatttgtgcaaagatattataatttttttttgtgtaaaactgattttatcctttggtaagcttaacaaataaaataaagttatcgttgatggcaaaaaataaaaaaataataattatcctatgcaatttgcatctctagtcctcgttatttaaataaactacagatcgaacccatttctcgttccttttttttagtctccctccgcgtagaagcttctccgagacttgtctctgctttgattgaagaagacgcttgatcgaaaattcccttagatttcgtaaatagggttttacagaaggtgagattacacagagatcggatttgcgaaaaaaaaaa

SEQ ID NO: 2436 - DNA, 3000 bp, Unknown
  misc_feature (1)..( 3000): cDNA_ID_3067768_gDNA_ID_1620536_Annot_ID_159885 3000 nt of promoter + ATG
tgggttaggtcacacggtacactcgaatcggatagtaacggtactggctcaggttccggctccggtggaagattgaggaggatggttcgtggaatggtgtcgttaatgaggagagtgagaccaaaccgtagctcttcttcttcatcagctgcgatatcaacttcttctgataatctggatttgaacattgaagtagaatctagggttttggataggtcaaattcagtgatgagaagatacttcagaagaaacagaagtaacagggattcttcgtcttcagttcttcattgattcagaaatatatatatattattttttggtttgttcattcaacaatgtaaatataagattcagaagaaaaagattggtgcttcgttttctattatcaattcgattaattcttccttatgttgttacatcaaaatgtataatgttcatatagaagtgttcatcttttgtcttggacccagatgctttgaaacttttcccaagaatttggctttctttggtttccgagaaaatccgagaaagtaaaagaatgtgtgcccgaaccctttaaccttttttgagtttttccttggattcttagagaaaacaaaaagaaaagaagaaaagttgcgagaattgatggtgaagttgccaaatttgaatttgaattcaattccaagtttttcttattcgtacgtaccgttacatacttacatttatggttggaaatggttgaccaggtcaaaactgtctagtccaaatattgaactatgagttaataacaacacatcacatatactcaacactcaaaatcctctcctcagtttcagaactcaaatttcggtgattcaagtggtatcaaagatggctaaatgcataataatttagtacaattagtcctcactaaaagaaaacaaggaaaaatcaagcacgacaagtctgagtgtgtatggtgtgagagagagaccacattcatgtaatcattacctacattcagatattccacaaaaatggacaaacataaatcggacccacacaccatcaacccaacccctaccattcattctcaatctttccttttttatcttcatttcctgtttcttcatatatagcagaaacctttgggaattagacaggaagagcacataatgatgaccaaaaactctatcgaattcgatccttacatcgagcgtaaagctttcgacgaaacaaaacaaggtgtgaaaggcctcgtcgacgctaaaatcactgaagttcctcgtatcttccaccaccgtcaagatatcttaaccaacaagaaaccttctgcttcggtatcagacctagagatccctatcatcgactttgcaagcgtccacgcggacacagcctcacgtgaagccatcgtagagaaagtcaaatatgcggtggagaattggggattcttccaggttatcaatcatagtattcctttaaacgttcttgaagagattaaagatggggttcgtaggtttcacgaggaagatcctgaggtcaagaaatcattcttctcgcgtgatgccggcaacaaaaaatttgtatacaacagtaacttcgatctatacagttcttcgccgtctgttaattggagagattctttctcttgttacatagctccagatcctccagctcctgaggagatccctgagacttgcaggtaacgggaatattctttaactttttcttaaaaacttagaagtgagattagttaacaacttaattaggtcgtttaatagatttctaaattgtttattgactcagggatgctatgtttgaatactcaaagcatgtgttgagtttcggtggtttactatttgagcttctctcagaagcacttggtttgaaatctcagacccttgagagcatggattgcgtgaagactttgcttatgatctgccattattacccaccttgtccacaacctgacctaacgttagggataacgaaacactcagataactccttcctcacgcttcttctccaagacaacattggtggtcttcaaattcttcatcaagactcttgggttgatgtctctcctatccatggagctcttgtcgtcaacattggagattttttgcaggtaaagtaacaatctgtagaaccaaataccttaaacttaaatgtcttgtttaaataattttaggtttgatttgatgcagctgataacgaacgataagtttgtaagtgtggagcatagagtgcttgcaaatagacaaggaccaaggatttcagtagctagctttttcagctcaagtatgcgtccaaattccagagtttacggaccgatgaaagagcttgtgtctgaagaaaaccctccaaaatacagagacataaccataaaagagtattcaaaaatattttttgagaaaggtctcgatggaacgtcgcatctctcgaatatcaggatatgaaaaacgaaaacgacagaaatttcttaatgagtttctttgcatcaattatactgtttgtttatgtctcttcaataatcaaaccaatgcatgtaccaaatataagaaataattgtgtgtgtcgttgtgtgtaaactatgtatatctgtatattcgttgagctactgtgtatttaaatcttatcacttgtaaaatgttatcaagtgatattgaccgcaaagccaccgcaccaatcacccatactgttcctcaacacccctccagctgaagctgaccctgggttcccacgcgaggcgccgtctgtgttcagtttaaaccagccccccaaaggagccgtccagcaaatttgtttctccactgttatcactatttacagggttatatgcgtaattaaaaactaatcagtccttaataaaacaaaagtggcgaagaaaaattcaattacgacaactcattaaagtcagtgtgaaagagagaaagagacaacattagttccggtcagaatcaacaaccgtctattctcagtcgtcctttttatcttcattttgctgttccttagaaggaggtaagaaacagtaaaatg

SEQ ID NO: 2437 - DNA, 3000 bp, Unknown
  misc_feature (1)..( 3000): cDNA_ID_3067760_gDNA_ID_1620536_Annot_ID_159890 3000 nt of promoter + ATG
aagagtaggctttaaagcttccctacgagcttgctcattcacagatagaacactgcatcccaaagattctaggtaactagattcagttgcagagagaactgggtcaaacacttcaatgttatcaccaacccaatcaaactctctcttcatcaagattgcaatgctcagctgaaacctcggagattcataagactcaatgctacctataccgtacatcaccatctgcaactgtgtttcagaccctaacacgaggcgaatctgattcgaaacctcaggagacttaagctgctccaagaatgctgtgtaaaaactcgagctttcgattttcttcagagagatttccatcttctgctttagtcttgcttgtctctgtggatcaatttcaagatcatctgatttccatggttgctcttcttcttctgcttgacctttaggtttcggttttcttcttcttccttgtcttcctttactaggtaagactactttccactcaccatcactgcttgagtttttaacagtcgtttccattgaagcttccacaagaaactggttttcctgatctacttactccacagtcccccaaaattagggtttctactcaatgcaatgattccattggttccgattacctaacatcacaataaatttcgattcctaaacctaattatcaatctctttgcttaactctgatctatctactttgagattgacaaaaatcttcgataccgagcaaaattaaacttacgattagagacgaaaacacaggaggaagatcgaagaagcttgcttgaaatacagaggaagcaaagaacgcttcgaatatgtggtgaccgagtggactcagtgagacatttgtgagtttggtgcgccgagtcgcgcggcgataaagtgaatcagatgatttgtacgcgaagatttggtaaacaggtattgggctagaggaaatggaatgggtctagatacggcccaataaaggcgcgagatagagacaactgaagtcttgtttcctgttatttcttttgattttgttttactaatctaaatatactaaatcagcagtcaattttccaataactgatgcattcagtgattgacacatcagcttagtactacttttttattttttcatttttacgcatagtatgtgtcgtttttatttaactttgtttcattctcaaacgattttctctttcatccccacgatctccacatctccactttctctcttccaaaaactccatgactactgtgtaaaatctcaaagatgggtttctcaacatcattaatcgattactcagaaatcaggtactttgttcatctcaatgaaccaatttaccatcttctatttttgtttgtaattttgttttatatatatagaattctccatagatccgaaaatcatatatccttcttctagatttctatggcttttttttttttttgctttgtttctgctttatttgactgaattcgatttctctcatacatctccatttttccataggattattctttaatacaatcaatgcctatgattctcccgtctcacaaacactcaaagaacaacgacaaattttggcttctcatctgaacagttgccttaaaacaagggtgagtttaatatcttaatcgaagctcaagtgtttttttaatggtaaattaattctcatactttttactattcttctttcatctcttattttacttctttatatttgcaatttcttttttgtattaaaccgcaattgtattttcacgcaagatttttgtattaatacaaatacttcaattttaaagtcatctcttattttacttctttatatctgcaatatctttgatattgtttcaaaggcagcgtctgcgttatgtagttacttacttgtgcacattttacatttttttttagacttccaagctttgggtgtcaacgaatgtttgtaaactgaattactgatgatgagaagaagaacacattacaattggttggagctaatgatgaaataagcggacatgtatatacccagcataattttcgtacttatactctcttatatttctaaactcttgatttgttagttactgtctatcgcaattgattcattgggtagaaaagttgtaccttctttatatctttttcttaatctttgtatattcttcagtcaatgataataaatttgttgtatatttatgctgtctgctttattttaaaaatcttagttaagagttgtagcagatataatttaaaacaatgttgtccctgcatagtaggggccaaatgctagtagtagtttaaaagtaaagtacgtaaaataaaataacgtgtatttttcattataggaaatgtagtttaggccgttattgttctttttcattataaaataacgtgtattttatgtgttgctgtttaaccctaaactcagacagcgaatgttgagttccgatgcagtggtgtatggtttgcggatacagtaaaacttttataaattaataatattagaattgcgaaattttgttaatttaaacaaatattaatttatagagaaattttttaaatttaataattgttttaaaaattgaactcttttcgtagcccaaacccaccggtattgaactctttttggcccacttagccacgttaaagggtcacttgttactagttgtaattgcaactatctgcctaaaccgtcgtgccttttgtctacattctagaaccatgcactaatgacgtggctggagataagttggttgattacacacgtgtcacttagacagagcgagtagactttgatgcgggtaaaagatattttagattatctagctcgctaggccacgttggcggatatttgcactttttctttttttaaaaagaaaaaaaactaggctctacgaattttccggtcaccttctccgatctctgatccgatatttttccacatgttgttgagctttaaaggatttgaaaccgttatgaaagttatgaaaacgaagagtgtgtgaaac

SEQ ID NO: 2438 - DNA, 1071 bp, Unknown
  misc_feature (1)..( 1071): cDNA_ID_2162090_gDNA_ID_1620536_Annot_ID_159892 3000 nt of promoter + ATG
ccgagattggagcattatgcttgtatggtggatcttctcggccgagcagggaagcttgttgaggcctatgagatgatcaaggctatgcgaatggagccggatttgtttgtgtggggtgctttgttagctgcgtgtaggaatcacgggaacatggagcttgcaaggattgcagcaaagcacttagcagagctcgaacctgagaactcagggaatggtttgcttctgaccagtttatatgccaatgctggtagttgggaaagtgttgtaagaatgaagaagatgataaagaagaagaggtttagaaggtttctaggcagcagctgggtagaaactgtttgatcctaagactcattctggttttgatcatcaaaaccgacttagattttgaaaaaaaagatgaatcggtcacatgcgcctcgaggtcaagtgtcaccaagcagctaaactgattccaataaggccagtttggtttctgtttggattgttacaagcctgacgctgggtcctggacttatattaaattaagtacataatttgaagcttgttgaggcctgtgaggctatgcaaatgaaatcggacttgtttgatcaagtagtggtttctattttatttggatatggaaatctatgttaaaaaaagaaaacaatattagtattaactaaaaatagaaagaaagctaaaagaaaaaaggaaaggatgagaatgagatagacatgattagaaaatgacaaaaggaagcctttatatgggcaagtcacggcatttgtcatttcccgaagctaatcttcttcggtttctttgtctaattttgtaacccacgtgtttggtcttttgctgctcctttcacacaatgttgagagctttccccaacctcataattctttccattaagagataaaatatatatatatatatatatatatatatataatgtcgatgagaccaatgaaatagttaacctatctctcacgtgtctatatatcagataagcagccttatgtctctttgagctttttccatttcatatattgagaatgagagagaattaagaaaaagagagagaaaacaatg

SEQ ID NO: 2439 - DNA, 3000 bp, Unknown
  misc_feature (1)..( 3000): cDNA_ID_2162086_gDNA_ID_1620536_Annot_ID_159891 3000 nt of promoter + ATG
cacgtgtctatatatcagataagcagccttatgtctctttgagctttttccatttcatatattgagaatgagagagaattaagaaaaagagagagaaaacaatggaggaaaagcaagtgaaggagacaaggatagtgttggttccagttccagctcaaggtcatgtaactccgatgatgcaactaggaaaagctcttcactcaaagggtttctccatcactgttgttctgacacagtctaatcgagttagctcttccaaagacttctctgatttccatttcctcaccatcccaggcagcttaactgagtctgatctccaaaacctaggaccacaaaagtttgtgctcaagctcaatcaaatttgtgaggcaagcttcaagcagtgtataggtcaactattgcatgaacaatgtaataatgatattgcttgtgtcgtctacgatgagtacatgtacttctctcatgctgcagtaaaagagtttcaacttcctagtgtcgtctttagcacgacaagtgctactgcttttgtctgtcgctctgttttgtctagagtcaacgcagagtcgttcttgatcgacatgaaaggtattcaagattctagcttgttttatcttaattcaaaatcctatttatagaaactaatccaaatgatcgatgttatcttttcagatcctgaaacacaagacaaagtatttccagggttgcatcctctgaggtacaaggatctaccaacttcagtatttgggccaatagagagtacgctcaaggtttacagtgagactgtgaacactcgaacagcttccgctgttatcatcaactcagcaagctgtttagagagctcatctttggcaaggttgcaacaacaactgcaagttccggtgtatcctataggcccacttcatattacagcttcagcgccttctagtttactagaagaagacaggagttgcgttgagtggttgaacaagcaaaaatcaaattcagttatttacataagcttgggaagcttggctctaatggacaccaaagacatgttggagatggcttggggattaagtaatagcaaccaacctttcttatgggtggtcagaccgggctctattccggggtcagaatggacagagtccttaccagaggaattcaataggttggtttcagaaagaggttacattgtgaaatgggctccgcagatggaagttctcagacatcctgcagtaggagggttttggagtcactgtggatggaactcaacagtagagagcatcggggaaggagttccgatgatatgtaggcctttcaccggggatcagaaagtcaatgcgaggtacttagagagagtttggagaattggggttcaattggagggagatctggataaagaaactgtggagagagctgtagagtggttgcttgtggatgaagaaggagcagaaatgaggaagagagccattgacttgaaagaaaagattgaaacctctgttagaagtggaggttcctcatgcagctcactagacgactttgttaattccatgtgaagatgatgaagggagataagatagtccctagtctcttagcaaaaaaagaaaaaaataaggtccctagtcaaagtcgaaagtgcatcaagatgatatacaggacatgaattctattttaagtgtaatatttggaagttgtctctataataagaatttttacgttgttgtcaaaaaaaaaaaaaaggagtttctgcatttggatacagaagcattattttaagttactctcaaacaggataagagataaaagatgttgtgcttctccattacagtttcttagaccaaattcaatcacttaaaccctcgaagttacatcaattattttcactttgtcactataccaaacagctcaactattttttacttgaactcttaaagttactgcaaattattttcactttgacaccataccaaatcaactatttttacttgaacccttttaagttactccaattaatttcactttgtcgccaactcaactacttttgagttactttaatcgaactcgttttgatggtcacaagccagaggttgtgtcttagaattatactatttaagtccttgtacataattttcagaatgagaaagctcttgatgcttttaaacagatgttggctcatgaatattatatccaaattcaacaacgattactagcattttgcctgcttgtacctcacttgtgaatatgaagcagggcaggagatccacggctactcggtggactagaagatcacggttttgttactatcaaaagtaatgatcttgtttgataagaaaacaacggtttgaaggaagttagataaataacatgttggtcaagtaaactacaaaaatacaaaatcctttgtcttttgccgcgtctatacatccacactacaaagttatgaatccgaattacggcaacgcggcagctacagtggttagatgtcatgttcagaaatgaaattctaaggtgtacgtacgtcgacataatttaaacgagtgtgctagttgttatgttcagacatgaaattatatgttaaccttaagcaagagggaaaataagtaaataaatgatagaggtagacttaattagaaaaatggtccaaaacaagacaacaaacttaataaagaaaatgacaaaaggaagccttaaatggtgctagtcaccaaatttgtcacttccttgtaactttgggaattctttgtctagtttatatactccacgtgctttttcttgtggtatgtccttccttccacaatgttgagatctttccctaacctcataattttccacttagggataaaaataaataacatgtcgatgagaccaatgaaacagttaatatatatcccacgtgctatatttcatattaattagatctggttcaagcatttaagcatccttatgtgtctttgagatttttccattcacacattgaccaaaaaaagagagagaccaagactccaagagagaaaaacaatg

SEQ ID NO: 2440 - DNA, 3000 bp, Unknown
  misc_feature (1)..( 3000): cDNA_ID_2991041_gDNA_ID_1620536_Annot_ID_159886 3000 nt of promoter + ATG
accgtggtttatttctatgtcaatcaattgtatttgtgtttctagtctttaagatggtaatcagttgccatcattacgatttgtctatctattttcattggttgcaacttgcaaacaaaaagagaagaaaaatagttgaggaacttttcttttcgtttgtttttaacttttgataatatggtcaatttattaagaaagcattacatcccttatattgagttataaatttagttgttaatacacaaaggtactattcaccaaaaaaacaaatacacaaagatactagttggtttatgtaatgtatttttatcaaattcacctataatttatgtagccatcggttgacaaataaacatattgagccatcaacgtgtaacaattctaattttctaaatactccatcctccacctcattggtcgacattataaaatacagtagtatatcacaaattgtttaatgaaattcattttaaaaaaagaagaaaaaatagttaaaaagtgatataattattttgcagttagcacacttttgtttctggcatgattcacaggtcgaaacgatgtcgtttagtgtctttcccagaaaaaacggagatcaaataggtcccaaatggatcccacaaacagcagacacggcgcttcttttgaattttctactcggcgttttacactttccacgtttggtcaaaacgctccttctctatacgtaacgaccgtttataactccgctatcatctacccagtcaaacactcaccacgtgtctatttaccgtctaatccgacaccgttaattccgctcctaagaatcgccttaaaaaccacgttttcattttctcatcttcaaacctctctgtcattactctggtcagcgattcttctttcttcttcttctcagatcctttcaccgagtaagaagattttaaagatgccgtcaacgccgacgacgccgactacaacaacgccgatcacggcttcgtattggtgttacagctgtacgcgtttcgtcagcgtttgggctgatcaaggcacaacaaccgtcggtagcgtcgcttgccctcactgcgacggcggttttatcgaacagattaacgattcttcctccgccgctaccgaattaacgattccggcttctactgaagtaagatcgatcaataacaaccgtagatccgtgattagacgccggagatccggtcgtcgtccgtcctttaatccggtcatcgtacttcaaggaggcgccggcgagagagaagagggagaagaaggagatgcggctagagatcgacgcgcttttgagttttattacgatgacggatccggatcgggtcttagaccgcttccggattctgtatctgagatcttgatgggatctggattcgagcggttacttgaacagctaagccaaatcgaagcgtcggctactggaattggtagatctggaaaccctccggcgtctaaatcggcgattgagtctttacctagagtcgaaatctcggattgccacataggctcggaggctaattgcgctgtttgcacggagattttcgagacggagacggaggcgcgtgagatgccgtgtaaacaccttttccacgacgattgcatcgtaccgtggctatcgattcgaaactcttgtcccgtgtgcagattcgagctaccttcagagcctaatcgacggagcaacaacaacgaggaggataacgccgtggggatgacgatttggagacttcccggtggtggattcgccgtagggaggtttaacgcagcaatgagagacggagagagagttttgccagtggtgttaacagaaatggatggtggtgggattggtaatagccaggatggtcctagacggatctcatgggttaggtcacacggtacactcgaatcggatagtaacggtactggctcaggttccggctccggtggaagattgaggaggatggttcgtggaatggtgtcgttaatgaggagagtgagaccaaaccgtagctcttcttcttcatcagctgcgatatcaacttcttctgataatctggatttgaacattgaagtagaatctagggttttggataggtcaaattcagtgatgagaagatacttcagaagaaacagaagtaacagggattcttcgtcttcagttcttcattgattcagaaatatatatatattattttttggtttgttcattcaacaatgtaaatataagattcagaagaaaaagattggtgcttcgttttctattatcaattcgattaattcttccttatgttgttacatcaaaatgtataatgttcatatagaagtgttcatcttttgtcttggacccagatgctttgaaacttttcccaagaatttggctttctttggtttccgagaaaatccgagaaagtaaaagaatgtgtgcccgaaccctttaaccttttttgagtttttccttggattcttagagaaaacaaaaagaaaagaagaaaagttgcgagaattgatggtgaagttgccaaatttgaatttgaattcaattccaagtttttcttattcgtacgtaccgttacatacttacatttatggttggaaatggttgaccaggtcaaaactgtctagtccaaatattgaactatgagttaataacaacacatcacatatactcaacactcaaaatcctctcctcagtttcagaactcaaatttcggtgattcaagtggtatcaaagatggctaaatgcataataatttagtacaattagtcctcactaaaagaaaacaaggaaaaatcaagcacgacaagtctgagtgtgtatggtgtgagagagagaccacattcatgtaatcattacctacattcagatattccacaaaaatggacaaacataaatcggacccacacaccatcaacccaacccctaccattcattctcaatctttccttttttatcttcatttcctgtttcttcatatatagcagaaacctttgggaattagacaggaagagcacataatgatg

SEQ ID NO: 2441 - DNA, 3000 bp, Unknown
  misc_feature (1)..( 3000): cDNA_ID_2162072_gDNA_ID_1620536_Annot_ID_159884 3000 nt of promoter + ATG
atcttcattttgctgttccttagaaggaggtaagaaacagtaaaatggccaaaaactctgtcgaattcgatcgttacatcgagcgcaaagctttcgacaatacaaaagaaggtgttaaagggctcatcgatgctaaaatcaccgagatccctcgaattttccacgtccctcaagataccttaccagacaagaaacgctctgtttcagacctagagatccctaccatcgactttgcaagcgtcaacgtggacacaccctcacgtgaagccatcgtggagaaagtcaaatatgcggtggagaattggggattcttccaggtgattaatcatggtgttcctttaaacgttcttgaagagattaaagatggggttcgtaggtttcacgaggaagaagatcctgaggtcaagaaatcatactactcgcttgatttcaccaagaacaaatttgcatacagtagtaatttcgatctatatagttcttcgccgtctcttacttggagagattctatctcttgttacatggctcctgatcctccaactcctgaggagctccctgagacttgcaggtaacgaaaatagtcttagcttttctttgttctttttttactcggaaacaatcaagtattagagtgattaatttctaacagtattgatttgactcagggatgctatgattgaatactcaaagcatgtactgagcttaggtgatttgctctttgagcttctctcagaagcactaggtttgaaatctgagatccttaagagcatggattgcttgaagagtttgcttatgatctgccattattatccaccttgtccacaacctgacctaactttaggaataagtaaacactcagacaactctttcctcacagttcttcttcaagacaacattggtggtcttcaaattcttcatcaagactcttgggtcgatgtctctcctcttcctggagctctggtagtcaacgtcggagatttcttgcaggtacagtaacaatctgaaaagaaaaagaaaaaaacagataccttgaaaattaaatgtcttttgcttatatatgttgctttgattttgcagctgataaccaacgataagtttataagtgtagagcatagggtactagcgaatacacgaggcccacggatttctgtagcgagctttttcagctcaagtatacgtgagaattcaacagtttatggaccgatgaaagagcttgtgtctgaagaaaaccctccaaaatacagagacacaaccttgagagaatactcagaaggatactttaagaaaggtcttgatggaacatcgcatctgtcaaatttcagaatatgaaaaagacaagtttattggctcttgtgtgtttgtaagatatttctaccatctctatattggtgtgtttctcgcttcagctagctactctgttcttggctctgcaacagttaaaccaatgtaccaaaaataagaagaaataatgtgtttgttatgtttatgtgttaagctactctgtatttgaatctttcttagccacatgtatcagaatatcagtgaacgtttaacattcatttgatataatgattcaaagtttatttaactagctattacctcttcttcaatttaaaaggttaattttcatcagcatcaagagtacacgataccaattttaaaattgctgattcatatatatggaatggagaaggagaagtaacaaaattgttgacttctacttgaatactatccaacatccatattaaattatatatatacatggataattctttcaataacatataaatttaaaagaagtctacttagtcaatgtgtatatatataaaagtatattgagatagctgtcattatgcgcagattcgtcatgccctccatcaccactggattatttgaatgtttacaacattttaaatgtcatagataatcaaagctcacaggacaggcacggtctcgatatgcaagatgtgaattagaccgaaaattctataccttcgacctaacatcatatgttttataacgcatatgatcggtctacttaatgactaaatggatcttgtataaacaaaaaatttcatttttttataatttgttgaattacatcgtagagcgtaaataattaacttatatgacaatcatgcactcatttaaaatgaaatgatttttctatacgtggtagtgtggtactaattaagtaattatattggctatatcatcaattgctcaactctacaaaatttcgttaaagatataaaaatatacattgatgacaaaaaaagaggtatacagtacagtatattcactctgcctatttcgtagccataggaatcgaaatgaaaatatccaatatttttggtattaaaggcaaagttaatacggaaacaatttgatttgacaatattctaccgaaaatttgaaaagtaaattctttcaaaggaatttctatttgtcttagtattctttttgtcacgtttcagaaagtttctatttctcaaaacgttttccaaaaatagaaatttcctgccatttaaatcaaaataaactaacgttgaaaaaggtttagatcttgaaacttctattcctcttcggtttaatgttttgcaccatcaacaaatagtccggtctgaaaagtttatggatgtaatctctataattcactagacaaaaagaaaaaattcttaagaaggaaacaaagtatcattttaatattacaaattttgtcaacgttctgactctaatcataggggataattgtatccggtacagggcgtttcacaaagaatcagctcctttggtcgccggcgatttagttattaacttatttacattgtatgtactttttgtagtacaacttcccaattactttaccgttgtacttgtcacagcaaatctccaacaagaaagtcaacactgtactacaaacaccaaaatatataaacattacactaataatgttcatgaagtgaagaaaaagcacaacacaaacaaacaataactaaaatg

SEQ ID NO: 2442 - DNA, 3000 bp, Unknown
  misc_feature (1)..( 3000): cDNA_ID_3067783_gDNA_ID_1620536_Annot_ID_159874 3000 nt of promoter + ATG
gagttctctcatgtctattgacaaactgattgaagatcatcgtgtaaaggaggaattcccggaggaagaaaaacctctaatgccagtagctttatccccttatcggggatctttgagtccctgcggattcagttctgtgataaatggcaaagtagagaatgaggtagatggttttagttactctggtggtagtgatgcttgtcaagtcgggaacttcagtcaagatgtaaaaccggatatcgatggtgatgcagtagttctggatgcgagacctaatgttgtagttagtttaggtagtagtagtagaaccgaagtgccatcaattgggaactgtgtttcccatggcgttcgggatgatgtaaatttgtttagtagagatgatgatgaaaacttttccaagtacattcacccgcgtgttacaaaacattcacctaggactgtacctcgtattggggacagaagaatcaggaagatattggcttctagacattggaaaggaggttcaaggcattcaggtagtagcctgcctaaggggttcttatctgtttcatatcttaaatacatttgatgggttttgttttaatgacatgtatttggtgttgcagatacgaaaccgtggagaaattattacttgcaccagcagaggagctatcctatcaagaaaaggaaaaactttgaccacatatctgattccgttactgatgattaccgtatgcgtactaagatgcatagaggtaaagagactttttacgcctaaacctctgttagatcttgtagctagctttctctttgttgttttaactagatcttgtaaatttaatttgcaggtagtagaaaaggtcaaggggcatcctttgtggcaagcgactcccatggtaacaatggagtctcatctgaattctttgtcggtgttatttacttacaaaagcggagaagctaacatgagaatgtttatttcagtgaaactacggatcaagtcgttcagggtgcctgagcttttcatagagattccagaaactgctactgttggctcattgaaggtaacattacacagctcttcctttcgcctcctattaagaaagtaagttcttatggtcctttggcttctgcagagaatggtgatggaagcagtgagcactttactgagtgatggacaccgagttggtctgatggttcaggggaagaaagtccgtgacgataacaaaacccttcatcagactggtatctctcaggataactcccacctggactctcttgattttagccttgaacccagctcagaaatgcctcaactgttaactaggttcagacttctattcaccacttaaaacccgccactgtgtttaattattcaaatcttttgtggcttaatttcttatttgttttccagtcacccgttgggacatgcttgtgaggagctgctacctgtgtgccaagctactaaaatagacaatgtgttggaatctgaccatcatgactcagcattattcccatctgactcattaggcaacaataatgtgacagaagattctaaagctatgatttctgtggcgctcaacgaattgtcttctcaatcacaaccaccttcccggaaatctagaagaagtgaacagcagcagcagcaggctgcacaacgcagaattcgtcgacctttctcagttgctgaagtagaagcacttgttcaagcagttgagaaactcggtactggaaggtaaaaaaacactaatacaagtcatatagtgttggcttatttgtgattgtgaatagaagaagatgatgattaaagtttggtgaaaactgtaggtggagagatgttaagctttgtgctttcgaggatgctgaccaccgcacttacgtagatctcaaggtttgcattttaatcagtagtttaaattctaaattcggtgaaaccaaatcgcatgattaggtctgagaaataactgtttggtatttgtgcaggataaatggaaaacgctggtccacacggctaagatatctccacaacagaggagaggagagccagtgccgcaggaacttctaaaccgagtcttgaacgcccatggctactggacgcagcaacagatgcagcagctgcagcagaatgtgaacaagctggagcaggagacacagtctcaaacgacagagggtctgttacttctctaaatgaatctgctgcagccttggaggtcgtctctcctttgtgtattactactactattgatgattatgtaagattctgacatagatgcaaagatttggtcttttactttggtttgatttttttaacttttctcaatgtaaagtttttaactggaataaggtttctctgaccagtttagggcttttagaggatctgttgtacatcttttgtgacattctcattctctttacatatttcttatctagactttttaaaaattcctcgtgtgtataattatttgatgtgctacttgtctgattccacgagttcgagttttgtcgtgtgattgaattcgaattgtcacttaccaacgtcgttaatacactaacactatgattggtctgatcgctggatcggtgaaccaattggaaaatccagttcaagttgttttagcaaaaaccaatctcttctctgaaccggaaaactgtaaaccggtcagtacttgatccataagaaaccctccgagtgatttgaagggtttgagctgtgttgaaaatggttcgtcggctctctctaaacccctctttttgtcgactgcttcttcacgccgtcgaggaattcttctccaccaacgaatccggcgacgtcttatcaccaccttgtcgaatctttagttgatgttgtttaaaggtgagtccaaattccacgcgccgccttgactttcatgaatgtgtgttttgatacatttcctacatattccgatgttttctagctagatctccaacgattttctgattgaatttagggttggttacatgatgatctttgactctaactcgcaggttttagctaataagggc

SEQ ID NO: 2443 - DNA, 3000 bp, Unknown
  misc_feature (1)..( 3000): cDNA_ID_2162054_gDNA_ID_1620536_Annot_ID_159878 3000 nt of promoter + ATG
tgcagaggcgcttgaggcacgtatcactggaaacatctcaccgcctgtttctaatccgtttccttcaagcacgacatcgatggtggacattttgaaagcgtacaagctgtttgttcatacttgtcccatctatgtaactgattacttcgctgcgaacaaatcgatttacgaacttgctatgaaagcaactaagcttcacatagttgattttggagttctctacggctttcaatggccttgtttgttacgagctctgtctaaacgaccgggcggaccaccaatgcttcgggtgactggaatcgagctgccacaagcgggttttcgtccttcagaccgcgttgaagagactggtcgaagactgaaaaggttctgcgatcagtttaatgttccttttgagttcaacttcatagccaaaaaatgggaaaccatcactcttgatgaacttatgatcaatccaggagagacaacggtcgtcaactgcattcatcggttacaatacactcctgatgaaactgtgtcattagactctccaagagacacggttctgaagctattcagagatatcaatcctgacctctttgtgtttgcagagattaacggaatgtacaactctcctttcttcatgacgaggttccgagaagcgctttttcattactcttcactctttgacatgtttgacaccacaatacacgcagaggatgagtacaaaaacaggtcactgttggagagagagttacttgtgagagacgcgatgagcgtgatttcctgcgagggtgcagagcggtttgcgaggcctgaaacctacaagcaatggcgagttaggattttgagagccgggtttaagccagcaactattagcaaacagatcatgaaggaggctaaggaaattgtgaggaaacgttaccatagagattttgtgatcgatagcgataacaattggatgcttcaaggatggaaaggaagagtcatctatgctttttcttgctggaaacctgctgagaagttcacaaacaataatttaaacatctgaaaaatgttacttctcaattacatcatttttgtttcccaatggttttgtagaatatgtttgatcccgtgagtggatgcaactcttttttcctgcaagtacatattgtattcaaatccttgtggaaatgataaattgtttaatcaaagatccgaagacaacacgagcacttttaacccaaacaaattcaaaacttttggctataatttatccaacgggttgcaacaccacgggaatgacgatacagacagagcaacaaacgatctactagaacatatgaaccgatgtaactaatagcatatagattgctgtagttagctaatttaaaccctatttggtttgaggttttggtggcctcaaaacgctccagtccaccttcttgctcttgggtttcttaaaaccattgccctttttattgctcggtgatggtttgtcaaagctccttggggacttgttaggacggttttgttcctcggagactacctcagactgttttcttttcaagtcaccatctgtttccccacttggctcaacctttgaactctccggttcactgaaagaggatgcattttgactagttaccgtttacaactttaacgagaagcaaaatcagaaatgaactaaacgataagtaggtgataaatctatttgcaaattgctatcagtaacgacttcatttgtctcaaaattagatgatcagtaagacaatagatctccagcgttgttctgttgtatgcacactctctggaaataacaaagaaaggaatataaaagcaagagtacagacctaaaagacttttttcctccattactgctagagcttgagggatttccaccgtttattgcctcttcatgtaatttctaaggagaggacagttttatttagaaagctgaaagatcacaaagtatttcaggccacagcgtcacagatactaacctcgatagagggattgaaagactgaaaagacatgcgtcctaacaatgctcctggctgaggatcccaatctgttatgaccacactgcatcgaaaatcacacattagtaaacactacaaaacacataacaaaagggtagacaatagatacacaatgtccttgtttacagtaatctgatgaaagcaaaacataaacatcaagtaagaagaaataacggtaccacttctttgcaacagtcctaagggaaggaaaactcccattaggctcttcttcatcagccttcttcttctctactttcagagaagacctttgcataaactatagacagagagtattatcaatcattattaacacgtatctttttgtctctcacccaaaaccagattatcaactaagagctacatgattgatataacacaattcttcagtgaaaaattgcaactttagtcccaaaccaatgtttataattggtgctaagctcagtgctacccccaaggtgaaatcaacctcgaaggggattatcaatttgtccaagaatcaaaacccagcttaatagagaaaagactaaattttcaagctcgaattcaattcaatttcagtaatttccttgagtttcaaatctaaggtcatgtaacatgaataaagctacttctacagagaaagaaaaaagacagtacctttagatttctcagagtgctactaatctctctcttcgccattatagctttccaaaattacaataactacgatattcccgttaccgtagaggaggaacaacaactccgcgtgtgttttcgtttttctaggtttagaagattttccgatttgaagctccgtccaaaaaaacacacttaggtttaactggtctacacctaaccgattcaaaccgtgccaaattgatttttttattaccaaaccaaagattctattggtttaattttttggtatttatttgatcatgtctgaagaatccaaccaaatccaatctgaaaaacagctgaacataaaaagtcaaggaagcaacttgaggagaaaaca

SEQ ID NO: 2444 - DNA, 3000 bp, Unknown
  misc_feature (1)..( 3000): cDNA_ID_2162062_gDNA_ID_1620536_Annot_ID_159880 3000 nt of promoter + ATG
gaactttaaactaatattactagttaatacttgatggaaaaataacttgaaatagaatttaagagaaccatgaatagcataaaagcatatccttttcacaagcctaacattccaataaaaatgagaactcatcttcattcatacatctttggctgatagataccagaaaattagacacaacacaggttcctctataccactactagtaaacaaaaggaatgaacttgtgcctaaccttatcagcataatccgaatagctttgtccgaaactctccaccatcaattcttcttccatctttgccttcttgttgtagtaaaccaaacaaaccgctaaaagaaacaacagactcaaaggcgcacgcagagcagtgcagtatgcagcgaaaagaagcatcgtagaagcatatatcggatgcctgacccatctataaggaccaaattgcacaacagccgttggaacaacaaccttttcagaatatctagcaagatatagcgttgaatcataatgcataagcattgtaatcacaatcaaaatccatatccctacattggcccaaccccctggtaatcggtgaagctcaggcccttcaaaagctgcaagccaatgtccaaccatgatgccaacaccaaacaaaatccgagaccacagaggcgtgttcacatcccatttgggatcatgagtgcgagcatagaaatctccatagaggcgttttctcacgctaacattgaagaaaaagaagtaatgatacgccaagaagaacacataaggccagccttcaagataaccattgaaataagcaggaggcacaagtgttagccatgtgaagactgaagttacaataccaagctgctcaaaggcattggcttcgccaagccaatgcttacggaaacagtaaattccataacccgcaagacccacagcgataaaccaaggccagaacaaccatgtccagctaaaatacatccagaagaatgggtccaagaccaaagtcaaagtcttttttgcagccacagtcaaaatcgatagcaaaagagttaacttcacaacatccatgggcttcactttcaactcacgaactttcttcaccattgacccaaaagagaaggttcgaaattggctaaggaaagggttatcggaatcggaaacagtcgagctagaaatcgagcatctgggtggaacccatgaaccttttctcactgggaacggcgcacaactccagatagacggactctttatcgcttcaaaacctcggagcaacggagtgtctctggaatcagcacgaagggaattgcacttaaggtgtttgttcaaatgcctgaacgaaaacttttggttcccttccaacgacgccgctctaggaacaagcttcgagcagagaagcacagcttccatggcgaatagaattcagataacggatacaaagacaaagattcagaaaaactctttcagcttcatatttgattcgaaatcgaaactggaaaacagataaacttcacatagaaagagagagaagtgaacctcttttacttcagtgttcggtaactaacaatgggcctatgggctaagagaaactggcccagtggggtaatatgtagaatagcttaaggtcttttaaaaaagtaatgggctttgacaagttatgcaggggcaaaactgtaaacattgaggaaggttctataaattggctcaactaattgtgttgacttttttacgccggctgatcttagccgttgaaaccgaccggttgcacttggcccaggttcgtataagccgctggaagaggagaagtcgcttcaaaaagtggtaattttcctaggagaaaaattaaaaattaatatgtaacttttttacttgtctattattgaaaagaaacagtctatgtaagcaaattttctcaattagaaattgtggaaactagaaaatgcaaattttgagaatgcaaaactagaagataaatttgaggaatgattttttttttttgtcagcaacatagattaatatgttaaaacacaatttatcacgatattttggaacgataatttccatcgatattttctaacggaatatttggattaggagatcaatggattcttctcaatgaacaaatataacatagtgtaaaattaaatttaagtaaaatgatttgacacttttgtatatacttacattttctaattttgactttttcatgaaatgttgtagcattatttttttgtgatattttatgttttgaacccttccgtgcttatggagtcgtctacaataatatattagcttcattatttaagaccaaaatatttatatgaagaaacaacaaaaataagaccaaaatcgggtatttaattttatcatttaggtcttcttataattgtcgcatcacacggttcgttcatcagtctaattagaaaagaaaggaaaagatataagataaattggtcaagaatatctaacaagtctttattatatattttagtttagatcgaaatggaaacgtgacatgatcaagagaacgatgtataattattgacgcgtagactttataatggggtatctaatattacaattttatttcatttgttttagaattgcatatccacgggagtcatgataactatttctataatcataaaatatgtctctttgacagcgaaaccatttatacactagattaagaaaaagtactcgtcgtctatattgtttaattaatactcatttttagagaattcgttttcatttgtcacacgcattgaagtttcttatcttatataaagagactctgcattctcttcttttcttcatcaaatattttctcttcttcgtctctctcacgtctattattttctgtcatcttttatttgaggtaattccttcttctaaaccataaaaccaaccatattgttctacatatattcttctttttaagttcttataaatataaatgttctttgtttttgtttatgatttttagaaccaccagatttgcagtttctggagaaatg

SEQ ID NO: 2445 - DNA, 3000 bp, Unknown
  misc_feature (1)..( 3000): cDNA_ID_2990516_gDNA_ID_1620536_Annot_ID_159873 3000 nt of promoter + ATG
ttataacgaccaatcaccatcgtccatcgataaaagcttatgcttagaatatgaaaaccagaacaaatttaataaacgtaagaaaagaagataataggagcaatgacgagattcttgttaggttcattgatagtctctcatgcatttttcaataagtcttaagtttcaagacgtcatggaacctttttcgtaacccacacgagtttggtttctattttagacaatttcgtatatatatatatttttttttcataataatatttggccaagatattaaatccattccaatactaaaaatatcaagaaatttcggataacaacaaaaatccaaattataatcctagtattggatttccgattgatgcccagtttagatgagaaccaataagaagaagtaattcaaattattgtatttatcctcacaatcgtgaaatcattatttaaaatggacgggccaatagatttccatcgatcatgataaagcgtttaattatttcaacttttatcctaaaaaaaaacaatagaaatattttatttcatcttatcctttctaaggtgggtggttttgaaatgttatcacacacacatcactgttctacgaaaataatatataatatatttattgagttttacaaatatgtatatctatataatatattgtttgtttattattatttacaattgtaacaaacaaaaaatatcttatcatctataatatataatttattaaattataattctatagtatcagtagctagacaagagaacaacattcgtgctatatgaaatcattagaaaatacacatagcattttgttcctaaaataattaaacatgtaatcaaaatttaaatagttgtttggatttatgttttcaaagtgaaaatagaccaattaacattcaaaagctggttgatgctatttttaacgtatacttaacattaaaatatttgttttagttttgccactctcgataattatccctgtcataggatgaggcccacctgttaggtacatgggcccactgggacccaagatttcttatctccgaacttaacgccgtttacacatttccttccaatatacacacaccgaactagatgccgtcaatccaacgccgtttatggtttatcctcccctagacgttaagattttgacggtttgtttttattatcctacaaaacataactgaaaaagtgtaaaacagagactcatttgacgttagattctgcaagtatctctaccgtccgattggagcaagtgatcagaaatattattactaatcaaaaattgatgaacatgattttgagggcaattttccttaagtaaaaaaatcataaagagacgataatgatgtacaaaattatctaaaactgagtataattatataagctatagattaaggtattaagaaaagaaaaaaaaaggtagatccacctgccacgtgacagaatgtcgtatagttatagtttacagattatctccactaacctaaatattaatttatatatatagaatccatgactatagtctatagttgaacttttagatttaatactatgaaaccaaactcaactcttttaaatacttgaaaatagataattttaaaattaatgagtaaagatatattcttggtaaaaaaattagtgtgtaattataacattccatataaaaaatcttagatttcttcaaagataagaactaggaaaatcaaagtaatttttgtaaattgtttactaaaactgaataagaaaatgaaagttgcatatatttttttcaagaatctgcaagtaaataaagtgtaactttaatgagatgtaattttggtttgacatggaatattctgattgggtagattcaggagtcatgtgatgatacatctatgccacgtggtaagatctgagggattacaagcaatgtaaaagcgtggcgaagaacctggtctaaaaagatgaaggtgtcgaccgataatagccggtgaagagaaagagtataaccggtaggaccggtggggaaaaggtcaatataggcttaaaaagggtttaagcaaaaaatgtggtcgtctttcttaagggtttttgtttttgtggcgtttcacagagagagaaagaaataggagattgtttttgcttgtggtgagagaagatcgcatcgtgtgggtagcgtttcaaacaagtaaaataataaaaagaataaaaagtttccgtcactttctcgaggaagaaggggttttggtgtgagtcctttctttgcgtttgtcttttcattttccgatctcgtaattgtcgtgttattcgccggaaaagttaaagattcagatttaaaggtgagagattttacagtcattttttttttagtcatcctgattctgtctttgaatttcataaaaccaaggagattttcgttaccttggtctgaaaatctctgggtaaatcccaattttacgtttttttaaaaaaaattcgtcgatttttatctttcatcgctttattcttcgatctgtaaaatccgatctgagatttagaacccttttgaacacccgtgatctggtggtcctttgatcttgagatcgaagtttttcgtccatacgattattttcttaaatttttttttatggtttagggttttcctgtggtgaaatatttggaacgacggtttgactctcaatttcagatctcaaagttgtttagggttttagggtggtttaagcttttttcaatgggctttgacccaaaaccttcaaaatcattcctttttttgcttcatgcattatttccagagacaaaacccttttattctgtttttttttttaaatttaaaaccattggctattttatctcgttttcttttgatttcaatgtctctttctaatttgatttctcaattttatctacaggttgggaattacattcacagaatttcgttgattggtgtgataataagccattgatcaacaatcttcttttgtggcaatcacataatcgtgttatgcattctgagaa

SEQ ID NO: 2446 - DNA, 3000 bp, Unknown
  misc_feature (1)..( 3000): cDNA_ID_1009105_gDNA_ID_1620537_Annot_ID_159917 3000 nt of promoter + ATG
ggatttactttgtaatctctgaatcattcatttcttgaaatgatatttacattcttatcaaaacaaatctacatataaagcttacatacctttatcttctttgtagccttgtaggtaatggcgacttaatacgttcactttgtagctagctatggttttttatatgtttgcttgtaacttaatcccttctggggatatggatatatatagtgtccaaccacgaattttaatgtgttaaaaagagttttaatttatactaaataattttaaaacatctcaaaattgatttaaattaatatttggtagttagttcgtgtattacatttgtatatttattaaaataatgaaataagtatgactagtatatatttttataataatattaaggatttattggtagtttatcttgaaaaattaaattttgtgaatttagtcaaaattcatgcatcaaatggttttatttgactaacatgtttttaattactttatcactacaagatataccattttttaaaagtcatagcatagtttttttttttttaatttatatacaaattactgttattaaaaactgtttgttacgtttgattgtatattagatctttaattataagacataaagatatttttaaaaaatcattaggaggatgttacaaaatattcaatttatatccataatcatttacatttttaaagatgtccccgttaccaaatgcgatgtgtgtccgttcccatatgaaacaagacatttttgtcgaaatttgtattggcaataatatctcacatttgtaaaactttgtattgttgaatttcaatttcaaatggcgttttctacaactcttttagaatattaacccgctattcttaacatttaaactaatgtgaccattctaaaattgatattccctttacgtgttggactttattaataaactgattaacaaataaagtgtattatttatcatcataatatatttagcaaactcaatttcttatcaattgtgtctacccaataaactaatttttataaatctcattttatgaaacaaattagtgtcttcagtgggacatccgacattcacatagttgaccttaaaacttacaaaaccatactattaaaaaccaattaaaaaacaagattaaaaagttatcgagccgttacaccttaattgaattattctgtcttcgtccttaagtcataacggtcatattttcaaaaacaaaaacgaccgttaatcccaacaaaatctctactttctcttacctcaactttgtttcttatgtatgcatataaaccccaaatcaaagtgaacttatcaagaaacacaaaaacaaacatcaaaaccccaaaaaaaaaccaaagttctcttcttgaattcgagaaaatgggaatgtcgaaatcgaaaggcaacacacacaacatcttccttctctgcaactacatcctcttaggctcagcctcaagttgcatcttcctcacaatctccctccgtctcttcccatctctctccggtctctcccttatcttcctctacactctcacaatcgcaaccgcggtatccggctgctcgatcttcgcctcctccacatccgccaccgcgagcgatagattatacggttcacacatggtagccacagtcctcacggccattttccaaggcgctgtctctgttctgatattcacgagaacaggggatttccttaggttcttgaaatcttatgttcgggaagaagacggtgaagtgatacttaaactctctggtggtttgtgtgtattgatgttttgcttagagtggattgttcttgtgttagcgtttttgttgaagtatagtgattatttggatgagagtgttgtagatgatgatgattttaaggtgaggaggcaagaagaagatctcaaggattggccttcttacccatttcaactcaagatttaatttccaatttcgtcattttattctattcatttacacgtgtgtgtgttggttcttgcttgtaatgtgattaatgtcacactttaaatggtgtacaaataattcgtcttagtgtgtattttcttatatgaatttttgtttagacacataaaaaggtcaacatcgtttttaggcactttaatgtatattgttgaattttgaccaaaatatatgcaataatgttaatgaatctacagctaagaggtaacaaagtttctctctaccccatctagtagtaagaaattgtgtgacttaaatttaattacatcaaaggtaaaacaatgaacctaaaatcattccatggatacaatcccagtaatttagtacagttttttcctaaaccctactccaatggaagttctcaaaacacctgacctttgagcttatctcttcttctatgtgtttgatttagtgggcaaaataatcgaaccaaaagtaccaaactggaaccaaaaagtaaattataaacttcataaccgaaagaacccactagaaccaatcctaactattttggatactcaaaaatacccgaaatacaattatatataccggaaatacctgaaaaatatccaaatggatcataaactcgtgagccgaagcaccggacccaaacctgaaccaaaccaagtttttttgtgtaccttacatagatcataaattctaaaaaaatgaaagaaccaaaacgaaatataaccgatttcgtaaccaagtaaacgtccagacctaatttggttggtgcttgtaaagtgcaagtcatgtcacatttcaatgttttttttcctgataaagtgtcacatttcaatgtttgtacaataattttttgttttccacaatgtgtgtccaacaattcttcatccaatttgttggctaagaaatattaggatgatatctttaccacatccacccaattcaccacgtcagcaccatccatattcacgttaaagaaacagaatcaaatttttttattttttctttaaaaaaaaaaaataccaaaagaagcggaaacagagaaaaagagagaaaaatg

SEQ ID NO: 2447 - DNA, 3000 bp, Unknown
  misc_feature (1)..( 3000): cDNA_ID_3067823_gDNA_ID_1620537_Annot_ID_159925 3000 nt of promoter + ATG
tggttattttgaattcatttcacccctctagagaatcattttattcacttcctcatgttctaactaatcaggatctactatctaataaaaaacattaaattcatttaattgtaaaatctaataaattgaaaatatatatatatatatatcggtttgagttacaaaaaagggctagagtttatattttataattaaaccaggttaaatattagtttagatttataaacagtttaagttttacaattaaacgaggtgaaatgtcgatttaggtgtataaagaaccttaaggttatagattttacaatcaaacgaggttaaatatcggtttataataaacaaagattagagtttagattttgtaaataaactaaattatatgtcagtttggatttaaaaagagtagttaaaatttagattttacaatcaaataagtttaatttttaaaatattatgtatcagattctgattggttagattaagaggggtgaataaaaggatccacccgtgaaccaaagaattgttccgctattttggttagcaaaattaatttgttccattttaattgttactaatagtaaaataaaaataaaaataaaaatctatatatattaaagcagtattattattaaattaaatcatcacctgaaagcgaaacatagtttttagccagtctagcacgtcttcatcgtcattgatcttgtgacctatctgccatgttaagtcacttgtgtaacgaattgcctttaatacagctacaatctgcagagtacataaattcaaatattgatgctttttttttgtttaatttaatcaaagtggcagttaaacagaaaaaccacgacattaatctatgtaaccttaggatctctcatcatagcgtgatttttactatcaggatcgaggggaagaatattgtaaggcacatagattttgttttttgcttccacctcggcatgggattccaaaatctacgtacagacaaaaaagaatgaacgtaaacatcgaggaaattaaagatatgttaatctagctagtatcagatttaccttagcagccactttgatattagctttccgatgaacagcatccaagacatcatagagaacaacagcagtttgatatatttttgtacgttgagaactagaactacaaaaataagcaagaaaacactgtgaacgaaagacgcaagtgttatataacgaaaacctttagctatagtacaaacctgccagcaccagcatttagcaaatcattgatgccctcgtcaccatattgttgatagaaactttgcatttcatgtgcatcactactcttctgtcttgcctttagagtactttcattattctgcacaagtcaaagacacatgatgatttaatgatgaagatatgaaaatctcaagcgagctagtttaatattggtaccttttctaaccattgaagaattgtattcttgaactggcgaacatcacgtccacttgatgtgggatcaagctcgtttgccttatctagcgcatgtgaatgacctgacagtatatttatagaatcatccacagatttgatgtcaagatcttgaagaaataaactctgaagtcgtaacgaatattgatttattttaaaactcacataggaaagcaacccggggattagtatcctctacgtctttggctacacgaaggatgggagtaatatcctcatgaagagaagatggaaccagctcactgtcaggactagctactgggaaaaagtggctaaacacagtttggagaatctgccctctgttgggctgattcatggatacacttcttttggggggcatctcttacaattttcatacagccaaactgagaaaccaaacattatgaaaatattcgtcaaacataatggaaatctctggcctgaaacttctgggttctggccttgcctcaattgtgaacagttaaaacataacatcaaaaatgataaaaagcaagtgccaaaagttttcaaaacaggggaaaagattataaagatcaatgtttcacctaacggcaaaggaagcggaccaaaaactatgacagcttcgtgaacacgcaagccaggtgcggtccaggaacagaataaaaagaagctatgatcaacgtcacttggcaaaactagcactagaacaagcctttaaattaattgttgcactagttataaaaacgttatttttatttttaatataatttaaaaaggaagagaggattaagagagatagcaataaaagaaatttaaaatgacaataaaataggcgccatatttaatttgtcaacgacatcatcttttctaagaaataaaaaaacttaatcgtatgtctatcggtctatcttaccttccaagaagaggtagcgaaaaggagacaattaaaaggcaataaaatagacgccaacttgtaataacttattattggtcaacgacattaattttctctaatataatatacttaaaagaaattttcacaaaagtggacgaaaaaagatttgctctcaccgtttgtcaaagtgagaactggttttcacgttttgtcttttcattcaatttcggaccaaattaccctgagaaaacttaataatggcacaaaccaaactgtgcagcagttcgtatcggttaagttgacggcgtaaaccaaaccctacagcagttggtttcggtttagttgatgcggttcagttttgaaaaagacaaaaaaaaaaaaactgaaacgaagaaaccgagaaaacgaaaaagagaataacggagagattgagagagaatcagaaagcgaaacaaaattcagtatccattgcttcaaaattcgacataacttcgaattgttgggtagttgaattgtgccactgaactcccacatccggtgaagtgaaagttactgtttttcccggcgaagccaagagaaagttactgtttttcccggcgaagccaagagaaagttactgttttttccggcgaaatttgaacctccggcgagatagcatctttagctatg

SEQ ID NO: 2448 - DNA, 1198 bp, Unknown
  misc_feature (1)..( 1198): cDNA_ID_2162180_gDNA_ID_1620537_Annot_ID_159930 3000 nt of promoter + ATG
ttcttccccgattctcagcgttgtctccagctcaggctcattggtgagttgacttattcttacgaacacgaacatgttctctatttaagaattttcaagttttgttttttttgtctcgttacagtcttcaaatacgacccagtgagtcgttttcgtttttttatttattacaaaaattggacattgaaatcgaatcttatgatcattggaataggaaagatatgatctttgatttgggtttcgtaaagtttcagtctttttatcttttgatgttctgattttgttctttttttgttcaggatccgaaaattagtggatcacttggatctcgaatccttccggctactcaaaggtgaggttttttttttctttctgaaatttgattcgaaatttagaatcatgagtgtaagaaaatgtttgaaattttctgttatagtgatgatgatatgataatgatatgatgatgactgatgagggtaaaaggataatgatgaatatgctgttgatgatgtgatgtgatgttgatatgttgttgatgattcagggtttaaggatgaggttctatgtcttgattgttgtttattgatattacccgttggccgttgctttgaactttagaccgcatttgtgaccccttgaactttgaacatggtgattactggctttaagaaaaagacagtgttggagaattgttttgaatattaaagatttggactttattgatatttatgtttttcagactttttcgatttgttaggttatttatttgactggattcgtgatggagctgtcccaattctttagagtaacctgtttcaggcttgtttgtgtcttccttgattagtgttggtaactttgtttgaagttaaaaggtttagtctttgagacttcacatttcacaataagttttagttcatctttcgcttttcccccataggtgactcataagtatttcttttctatttgagttcttacagattttggattactttttggtttatcattggatttatttggtgtttagtcaacagaggaaattcatttaacagtctaatagtcttaccgaatttaccaaagtatttttaacataagttaaaacatttgtgattttgcttgtttgttatgacttcttataagttctaattgtatgtatattagatcatccccatcggagaatcttctcctccataggaaaatg

SEQ ID NO: 2449 - DNA, 3000 bp, Unknown
  misc_feature (1)..( 3000): cDNA_ID_3067827_gDNA_ID_1620537_Annot_ID_159923 3000 nt of promoter + ATG
atcctagatgtaaaatcaatatacaattatgaagtttggattgatactaaaacttttttgaagttttcaatattataaatattcgaacttcataagaaaatgacaaaatgatgtttaatttcacgggacgaggttatatggtgggatgggtttggattgatattaatacgggatggtatattatgaatgtatctatagatcatcttaaaaacaaaaatttaattttttatttaataaaagtataggcctattatatacctcttgaatatgttatttgtatataaataatattaatttaaataaaaatctttaattttttaacaaaaatatcaacctgcgagcagcggtgtaccgcaggtcaatctctagataatacaagttttaaatcgttattacccctaaccacaaaagcaaaataatgaattttaatattatgtgtcaatatcatattattcatatacaaataataattcttataaaaaaatgaacatattcatccgaggtgtcccgcgggtcaatatctagttttgctagactttttggccaaaaatccctatactatttactattaacattcaggtccttacaaattctatctcaaccaaatattttatgtataaaaacttacaattcgttaatttgcattaaatacttcaattaactctctcttaaacttttttcttaattaaatctttctttacagaactatattcgattaaggctaatttcctaaaatctcaatatcgatattaaatataaacatagaatttttctgtcactatatttgttcttatatctaatttatttttactttatatataaaatacatatagttaataaaatatatgattttctgcatctgatataattcgaaaacaaataaataacttaaaagtatatttttttaaagtaataaaaattgtccggaagtatatcatagtatcatacataaaaaacaatagcatgtatctataaatcatctttaaaaagaaattcaattttttatttaataaaaatatatgcatgtgatgcacttcttgaatatgttatttatatataaataatactccctctgtttcataatataagttgttttagaccaatttttttgttttacaagaaaagttattttctagtttctatgcaaattatatgttactttaatattttatgattacttatattatttagtctcttttatgattggttgaactttttcaaagtaaatattcttaactgaaacaacttatattgtaaaacggagggagtattaattaaaataaaaatcactaattttctaacaaaaatatcaacctgcggtttaccgcaaatcaatctgtagataatacatgttttaaatatttattacctctaaaaaaccttaaccacaaaaatactgaattttaatattaaactaatatacaacaaatatcagaacataaaacatgaattatccaaactttacatagaaaaaaaatatatgtcaaaaatatatgccgtgaattcgaaacttgtgtttgccaaaacaatcgcacatttgcaatttcgttaaatttctgtcttaaagacataatctttttgatcatttagcttccatagctaccgtagtatctaattccttcccttagattttgatttctctcattttatgtttagcgttaacgcaaacgagttcaaaattttgagttttcggtttcttatttttagatacatgcctcatatttagacttttgctggtatcttgcttgattccttttgcaatttctcttgtttaccttgaaatataattttgtattgattgataatacacttggtgtgagcagtttttgatgggaagggatcaaatggataacattgtggaatctttgcaattagataagagtaagttcttagaggaatcgagaaagatgacattactaagctctttcagccatgtctaaacattttcaaatgtacagtattaaattacattgtagataaaagcgcgctaacagctcctcgataattatattacaaaaaaaaaacgtgcggtttggcgtggtttgccctagaatttttaatgtcttagtactccaatgttttttataaaatttaatgttggattttaagagtgatttttctatgattaatatacatataaactaaattccttaattattatttttgatacaacttaaattgattcatgcacttacccttgctatacagaaacctagaaagaaaatttgaattttggcatttaatcttcacacacattattagactttcgatttaattcaattaaaactcttttttcttacacattaaaatttgtggttggacactatatatatccttttgctttgacgggagttgtgaaagcgacaagcaaatatataaacgaccttatcaacaaagcaaacgtatagctacaaacgattgtgagcttttatatcaaacaatgcaaacatatagatcctcataactaacgtggtacacccatatatataacttatatatttgtaaatctgcttaaaactttacaacttacggcctttatacctttagatacggctatgcaactatacttttactggatttgtaggtttgcatgcaagatttaagtgccataaacctaaagcctaagggtcaatgtaaatataaaacaacctaaatctagatctttatatcactttgctcttttcatgatctctctcttaagtttggttttcccttctttcctttcctctagtgattcaccacctctgtcaccgtggcaagaatgcatagtatgtctgcctatttctgaatgccgcatgcgattttaaccacacaaaataagagggaatcaaaagattttttagaatagtataaatttcattattattttaattgatagactctatggaaacagccatttttctgaagaaaaaaactacggttctagcctcaaaactatcacgttatcttccatgtcaactgtcggttacgcacaatgttattttagtcaaattttaatag

SEQ ID NO: 2450 - DNA, 3000 bp, Unknown
  misc_feature (1)..( 3000): cDNA_ID_2990671_gDNA_ID_1620538_Annot_ID_159936 3000 nt of promoter + ATG
tattctgtctttatgttactttgtgtcatcttctaaatacttttacatataccttgcaggatactggtgggtttgtagatgaagaaagcgatggatctcaagcttctgcacagtcatcaagctcccaggcagttagccattcagatgaagcaatgtctcgtccatcaggtgttaaggcggcaaaggccgcgaaagctaaaaggactctgtcagtgattaagagcatgtgggagattaagcagaaggaatttgaattgaacgagaagcttagcaagaagacgttgttggagactctacttcgaaaaacagcgccgcttagtgatcttgaaatggctttaaagaacaaacttatcactgacatattgtcaaatgcttgaatggtgtcttttatgtcttgaaagttagtcttttttgtttcggttaacgcttcttcacttgtttttgttcagttaggttatgaatcttaagttgtttgtgttctgttctaaattggtttggttgtgctctgttctaattggtttgtgttagtgttcaaatggattggtttgtgttctgttctaaatgaatttaaattcgatttcagagtttaaaaggatgaagtccatgtcgagatgcaagagttcaaggaagcataaatagcaagtacatgcaagtgttgttctgttttgtgtagaagtatataggctatggtcgtgtgaagattcacttgagtttgtgtgtcaaattttgtgagtgtatcaagttttgagagtgtagagtctgtgtcaagttttgagagtcaaatgtatcccaaacactttcacatttttttcaaatgtttatattttcatagaggttgttaaaatttaaaaggtaaaaacccttcagatgtatcccaaacttttgattttgtattatttcaattggtaaatatggagatgcttttatttggttaaaatgaagcgacgtcgtttaataaagtcagctggctttataacttgatgaatgacaattgactaattttgtccgaatcaccggttcggttttctcgtttaaccggatagtcctttactggttacagccataaattccgattctgctgctcctgcttttttttttttattgaagtctgcgtctgtgagatcacgctttagctttgtaagttgctttccatggatactctctaaatctttacaacatttttcatctgttattagttcccaagttgcatatgaactctctgcttcttctctccatcgttgttcagttgtaatcgaagtaggtgcctaggttgactagctagtaattaccaccactcaacgaaatccatgaggttttggcgatgaatttagggatttctgtccaattttgaattgtttctggtgtttctcttaattgattattgtaagattaagattcatgtcggggaatagttactctaagttcatcaatcacacttagaacagacaataaatttgaccacagatcttgttcaatagatagagagcttaaggtttatcttcttttgtgcttactaaacaactgcaattctcatggagaagcctctgtttttttttatagtgtttaagcaaatatagagagtagtaactaactggagtattgttagattgatttatgcctttcttttgtggcttttgatcaaagattggtcatgtctcgtgtgccattattttcggtttatggtccttatgtgaaagtgtttattttaaattctttctcatctaaagtgttgaagaatagtttgattgttgtattggccttaaagcatttgtactcttactgaattcttgagagctgttattttcaggtggatgcagaattgcagactatacattcttttttaagttcttgagcttggaacaatacctttttcactctagttgtttcttcaactaaatggtaactacaatctctaaagaatttcttcaagttgaatttttgtctagcttgttcaaacttgtaaacacgcgattcaaaactcattttacaatgacagatcttgtttactactctttctttatactaatttgtgtcatcttctaaatatttttgtatatatacttcaggatactggtgggtttgtagatgaaaaaggtgagaacagattatatgttggaaacctggatcttagaataaacgagtaagtgaatcacagcttgttatattacctccacaccatagatcaaaactttgctcaataccttataagtttctcttcgtcacagggcttcgttgataaaaatgttttctccatatgggaagatcatatcagaagacttcctttggcacacacgcgggccaaagaaaggagaacctcggggttatgctttcattcaatacagccttaaagaggtaactaacaatctggctctcttggttttgcatttgtacttggatgaaattgtttcaagaaatgaaaaatgttttgattttgattgagcaatctcctgatttctacatctaaagtgagcatacaggaagctgaattggcgaaagagaagatgcatgggagattagcttgtggtaggcctttagtggtgcgtctagctagtgagaagcatctagaagattcctctcatgatcactccaaaagatcattaccagaaggaaacagaaccagatttgtaaacgggagcagctcaggacaaatgagccgagacgaaaaagtaactgccattaagaacaaactcaaagctttggaagaagatgagaaacgtgatcccaagaaacagaaaatttaagaaaacggttttcaaacacacaactttgggtctatgtgactctgtgactctgaccatttttcagttttggtttgatttgatttggtttaccggtttaatcgaaaccaattttgatttaatatttcggtttggctcagtgttatatataaaatttgtaatggaaagcaaaagttgacgcactaataggcacactgagtcaattccactaatcacttcccttttccaccttttcctcgtcgtgaagcagacgcgacaaatg

SEQ ID NO: 2451 - DNA, 3000 bp, Unknown
  misc_feature (1)..( 3000): cDNA_ID_3067878_gDNA_ID_1620538_Annot_ID_159952 3000 nt of promoter + ATG
ttaacaaatgaacatattttaacctcgcaaataaaggaagaaatgcaaaaatgtggcatgttaaagaaagagatcaaccttcactatatcttttaggtttctaattggtttcgatgtgagaacatctttgttggattgttggtaatgccacgttcttaatattgtttatactaatgttttggcgttggagtctgttacgtaactgaattaatgacattggctaaagcgcagtaccaaaagttatagtatagatttgtataactatactgaaaatttcctaaattatggcgtttactaatactgtaacgcttcgtatgagcccaagtaaatgacgataatgtcgtgtggtttgggagttgtgtggttcctcatgctttcacacatttttattaaggaatgtataattttattaaaaatctgaagctgaaatttacgtatcaacaacatctctatttattaatacaaagaacatttgtaaacatgatagcagccgtagataatatgatttaaatgattaaattaggggatacaaacttattgtgaaaaagaaaaaaaggcgatacaaacttatcccaattttattcatattttcattaaacgaaacgaaatagaaaacttatattgttattattatatagggttgatttaatcgctcttattatcttatatcgacgagatgataaaagacaaaagatcttacatatgcataattatgagttatgacacggtattagttgaagctactaaagtactaaacaaaagaggcgcaacaacacattctaacaatctattatatagaaagactcaaacctgttttattaatcatcttcatttaagcgtatcaaattgactatttcagtttcttgcttggatggcttgacttaaccatttcatattcgctaattcaagcaaaggatatcgtgtatatatatggggcgaaacaaaggttaatgagcaagctacgaggttgatttcatattcctttacatcatatctcctcaatcatcaaactttctatactttccgaaaatgccggtatgtcttttcttttagttacttaaaatcttagaaaactaaaggtactacttatacacaatgaactgtctaaagcttcaaatctaaatctttgcaggagaaagttgtattcaagttggaagtttttgaggaaagaatcaaacgaagagctatgaaagttgtatgtgactttccaggtatattataatatgtacaaacaatgtctatatataatataagtaattgaatctatttaggcttaatacaaattaagcaataatgtttgttgttgtaggagttactttgatagacgtgaaggaaaaaggtaaactaaaggtgaatggagaatttgataagtttgaaatgacgaagaaacttaagaaggtgtatgaatttgttgacattatcgcggttgggccggatggagaaccggcacaaaatcagaagctggttaaaaagcctgaacctaaagtgaagaaagcaccatcttaccgtggttggaatttgggtttctttaagtgatcaatttgaagacgtgatcggtttattttccatggactactgtattctgatgatatttcatctcattttttctgaaaaaattgtttgcccgttatttgtaataattatgtggctcttatattcatattggcgttatatgtcttttgttaacattattaagttctgatcatccaattgaaaacaacaaaaacaaaattttcatctaaattgtctaagttaagtaatagagtctcattgttgtgtccaaaaaaaaagaagaagtaaaagagtctcattgatcgcttttcataagcaacacttaattcttatcaccagcaactagatgctcaaactaatgctggccgaagtgtcagaaaagatagtcaacgtttgatagattattgttatcattcaacttcgttccacacttattccaagtaattcgtttatattatatcgtcaataatcgtgttattatatcacaagtgtttctttataataggtatttatgttttttggcacatgcaataaaattcattaagccctgtaattctgtcggttttcttaaataataaaaataaagtttagaagattagttaaagctatatactaacctttctgttacatttggatcatcataacttatatactttttcatcatattcatcagcgttaattgttagtaaattcatggaaatccatagagaatgattgtgagtttgtgattcaccaaagatctccatcaattagtacttcaaaaaaactcgtcttaaatagatttaaaaccattgcattgacgaatatctgaataataaaaacgatgaaattgtacatgtattgggaaatagtttgttaatcaatacatggggtatcaagaaattcataaagatttaggaacaatatttatgaaatttctttgatttccttttgcacctcccataaatgttttcctttatacaatatgttttatgcataggatattgtatttcctagcttcgaagaaattgtaaggctctttcgtatattctttacgtcttgagtgtactagttgttctaaattatactacagaattaacgaaaaacaaaatatcgtatatttgactataacacggtattagttgaagccactaaagtaagagaccatgccaacttccattctattatttagaaaaacctttttttgataatattcatttagaaagacttaacttgaaaaaaaaaaaaaaaaaaaaaaaaaaagacttaacttgtttcactttctacctttcttattatacaaagagactcaaaactgtttgtattggtcttgatgtataaaattgactatagttcttatggttggacctaattaatcattactatattgagcactagttacaaacaaaacattgtataaataaacggggaagcaaagggttactagtgtgcaatctgtgtggttacaatcatataacttcactgtccaatcttttaaacattccaaat

SEQ ID NO: 2452 - DNA, 3000 bp, Unknown
  misc_feature (1)..( 3000): cDNA_ID_3067845_gDNA_ID_1620538_Annot_ID_159962 3000 nt of promoter + ATG
ttgggggtaaaatgttaaacatatcttaaaaggttgagtttcacaaaaaggttatcaagagttttgagaagaataagagacaacaggtacatacaatagtagaagatcagtaaaacctagcggttaattgttgtaaagctaatctagatatgtcaacatgtaaagctaagttatacgaggtcatgtagtatggtggttttctagtttaccaggctctcagtggacaaaagtatttgtcgatttgataccatcttcctcgttgtgcgatagtgtaagtacgctccacaatggaaatagagaaaaagaagggtaatcagctagagttaaatccatcggcaaaatctaacacacatagttttcactcaatcactctagattgatttaataagtcatttataaaagttcttaatcctcaaatttctatggaaatttttgttcatatgatttaaaattttgtacggagctccaaagaaattaagtttacttggaagcgaaactcgactggatttgtcagacggaagactcttacattggatttaagctagagaaatttttattggatcgactagataagttgttctctcaaattgatactcgatactcaaacttgtacacaaactaaactacaaatgctacgttgcatctggtatgaattatgtctcaaaagaatccgaccagatccttttcaaggttacaccccgacaacaaaaccagcttggtaatttgcctggaaacgagggagttgaaaacgtaattcttggttcacaattaatcctacatttggagacttagtgcgatttagtcgctgcaaatttgttggtttgtccatcttagtttattcaacttgaatctcgctttcgtggtccaacttttgatttgaatagcatctccacaaacagaaatacacatcttttatttccagttttaaaaagaataaataagcctcaagcagctatcaaaatataatgcaatattgtttaaagagtttcattttattccgtagccatttgaacagcattcgacatataaattttaagtttagccaacaattaccgattcttgccaaaaaaaaaaaaaaaaaaattaccgctttaatgtttaaaggacgaagaaaacgtgttattttaactttaaattatttttaaaagtttaataattattgtgtatgcatggagaagcaataagttacaccaagtaacacttgagacatatacttgatttttttccattttcaacgttataggaaaattggtgtgaattagtatatccttgtctttttcatgccctgcaacttgcagctgcttatataaaggactaaggaaaggagggacactttcaaagctcattagtaatctaagactttttcatattttccaaacactaattgaagaaaaacatgcaggttcgattctttatatatattttcctaatctatgtttcttaattggaagcttgtaataatttttccgaatatttttttattgcttatatatcaaatgtcataattctaccctaattagctctttaccataattaatattttcatgacaggtagttgtactgaaattagatgttcattgtgaaaaaaccaaacaaaaagctatgtcaactgtatgttgtctctcaggtataaacaacactcatcaattgctaatatatattttttttactcataagcctctaaattctcttaatcaattgattaaatcataattaagtacattttgatttttttttgtattgaaggattattttttcttttggtattgaaggagttaactcggtggaggtgaaagatggtaaactaacggtgacgggagagattgatgcctatatgattgtgaagaaattgaagaagatatgtcataccgagtttatatcggttggaccggttaaagaaccagagaagaagaagcctgatgatccgaagaagcctgaaacgaagccaccagatgtcatttatcattatgtccctccatgtccaccttattaccataatttcaacggatgttacaatgaagatcccaacgcttgcgtcacctcttgaaaacaatattttggtcggatcagtttggttcacgatagtcatcactcatcagcttcgtcgtagtctttggttttgttctattgtgattgttttaactctttcagtccagtccattatacacactcaacatgactagaccaaggttgccactcccaggcccatttcttgttttaattccttttttgttttcttgttaataacatgcatttaaatttagatgacgacgcattaattgaccatatttaacacaaatcactaggttatatacgtctaattcaaatgattttgtttcataaaaaataaaattagatatctagtgatcttatagtaatatataacagtaatctaagtagactgctccacaattatattttactttatttaaaaagaagaaactacgtaagaggtaaataaagtacatctttaaaaacaaaatttatgaatgaaacattgtgactttaatctcggtttgatttcgatttcagctttggttttgatatgattcaacttttacctagagaacttgcttgagaagttcttatgaccgaagaagtcaataaggtccaaccacaaatcaacgttgtccgggtcgtacacgcggaattctgaaaactacacttccttttgtgttcgttagactcaaattaattttcaaccaaatcataaaaataaatataaaattggtagagaatgagtcattctgaatgactactttaacctctttgtggtcgttattgcaatactatttttatttaaaaaatacaaaaactttcccttgtggccttgtgggtcatatataataatacttgcaaattccttggcaatttctatttaaaccgatttcagtagacttgctattgtcatcatttcatatcttagatcatctctcttctctctctttctcttaagaatattggaaatttctgaagcttttctatagttgatctcgagcc

SEQ ID NO: 2453 - DNA, 3000 bp, Unknown
  misc_feature (1)..( 3000): cDNA_ID_2048407_gDNA_ID_1620538_Annot_ID_159964 3000 nt of promoter + ATG
aatactatttttatttaaaaaatacaaaaactttcccttgtggccttgtgggtcatatataataatacttgcaaattccttggcaatttctatttaaaccgatttcagtagacttgctattgtcatcatttcatatcttagatcatctctcttctctctctttctcttaagaatattggaaatttctgaagcttttctatagttgatctcgagccatgcctccaatggtacgccttctttttcctatgatatctcttaaaataattatgcgttgaataatcgtttgtatataaatactatttgactatatatagttatgttaatcaggttgaaaatatgtaattaaccatactgatctctgttttgaaataacagaaagctgtgttgcaattgagcattcacgaggaaagaatcaggaagaaagcgtttgtcaccgtttctcgatgtccaggtaactttattagttacatttttcgaaatttataacatgatatattgtttggaaaatgaacttatattcatgtttttttcttttgtctaaataggtgttacttcgataacaatggatgacaaaaccgggaaaatgacagtagttggtgaagttgatgtaccggttatcgtgatgaagctaaggaagctatgtaacacagagcttgtttcggttgaagttgttaaaccacctgagaaaaagcctgaaccagagaaaccggctccacctaaaccagctccagctccagctaaaccggctgaaattgttgcctggccggttcagatgaacaacccttaccaatacaatcctgcctatgcaaattcttactatcaaccatatgggaactctagatttgtaacggacgaatcaaattgtgtgattatgtgataacttatttcaaataatgtgttaagttagttttgatggaagagtgtaattttttagctactgtaatatacatttctcatatgagcttattcagaaaaatttatgttactgtatgataaatttgatctttatacgttttgttaactttaacttttaatcatttagtaatagttgatctttttcctatacagaatattattctctatactttgtcttttgcttatatactaatcaaatggatacaaaaatatcacacacacacacacatagttaagtcgctctcaacttatttatgaatatcaagtaccaagatcgttcacgtaatacattcaattgtccaaaactaaaataattttgaaacaattagagaatgagatattagtaaagatgtgatgtagagagtcaagatctgaaagtctcctttagcaaaacaaatactaatcaataaaattcctacttggagggatccacatgtaaactgaggctttcgaggacatttcctttcttgactatgaaatagcagtattatccgagtcttcttaccatttttcaaatataaatcgcacatttacagattaaaaaaaaaaaaattggattcatgcattgagttgattttgaaatctaacaaaactcttgtgttacttttaagtcatgacttctaaaattttagtttaaatcatgtgttattaaagtaatcgtttaaaatacaaattaaaatttgtgttaatctattagtattttaaaattacaaattaagaattatgttttttttgtctgcgaattttgttttcgttgcgcaaccaaagaattgtgggtaagaaatgtgtaatacaagtatgatgcatatagaatggctcgccatgaaaaaaagctgcataaatgaattgctaggatcatgaatgttaagttgatcaattatactggatataaaagttaaagtatcttcaaatgatactgtatcagacaaaccaaagaaacgtgtgagtatattagaaaatgaaggtatttagtacatttttatatatttaatgagattaacacttctaattatagtataatttatacactaacgcgttaatcaaaaatagacaatttgacgtagtaggagagtcagcttttaatctaaaattcgaaaaaatgaatatactaaatagctcatctctgccaataatgcttctcttgtttattatactctttactcacagataaatatagcgaaatggagagactagctagaaattacaataaaggatcacatacattgttacctaattattattttcttaaaatttgaacaaatacgtgtgtcagcattatgctaatcttctttgtatcgtttcaaaaaatttcaaatattcccggtaacaaaaatttgaccttaagaaacaaacatgtacacaaatattcgttgccatcacaaacacaaaacccatagatcacaaacacgttacaacttgttacctttttgttgttgttgttcttaatgattttgctacttgttactttcctcttgacttctttgatgatctcgggctttcaactgttttttgggcagcttcgaattattttcgtgtggctctgagtaggcattatattgttacgatacctagagacaacaacgataacattgaaacaaacttatctttcctctctcactattcacaacaactttaaaataaaataaaagaacaattgtgacaatctcggttttatttcgagtttatctattagttctgaaatgattcaacttttccaagaacacactgtatagaactttcctgagaatttcttacgtgcccaaagtgccaatagggtcaacatatggacagggtcgtacacgcggcattctgagtgatccgtaatgctttcgtagtttcgttacaaccaaaaatagtaaaatactaaaaaaaaattaattttttttgactactttactctttagtctttacaacaactttttggggtcatcatactcgcaaattcctacgcaatttctatataaacagatatcataagacttgcaatatgtcatcaagaagcttcgatatctcaatctatctctactcattctctcttaaaaaaaaaaaaaaaaatcaaaaatttctggagtagtttctcgagcc

SEQ ID NO: 2454 - DNA, 3000 bp, Unknown
  misc_feature (1)..( 3000): cDNA_ID_3067870_gDNA_ID_1620538_Annot_ID_159959 3000 nt of promoter + ATG
aaattgcaggaaaaaacagctgaattcaagttggatgtttctgatgaaaacattagaaggaacactatgaaaattgtctggatgtttccaggtacaccaaaacaaatctattgattttattaatgaaaccaaataaatactatatttaagcttgaaatattaaaaagcaataatatttgttgttgtagttactttcgtagacatcaaggaaaaaggtatactaaaggtgaggggaaaatttgatcacattgaaatgagagagattttacagcaacatatagatgagtctgttgacttaatcaatccaatgaaaaaatcggagaaaaaacagattccaggtttggctacagtcttcaactactttaagactccagcaacgcaggttagatttttttttgcaattttcaaattattttgaaggaattaaaatttcaatatctaccctaggaattctgtagaaatataaacacatacatatgtaaaaataaaattattacttattccatgaactgctaatttgcaggagatagttgtcttcgagtttagagttcttgatgaacgtatcataccgaaagctatggaagttatctgggagtttccaggtacatcaacaaaaatctatagatatgtttgtttgtttttttgagcaaaaaatctatagctattttatttaaacaaaataaatctatgacggtacgtaggatatattcaatttctatatagaaattaaaaattcaaaaattaaagcactaaataaacccatgtttgttgttgttgttgttgttgttagtagttacttcggtagagatcgagaatgatttttatctaaaggttaagggaggagaaattaataaagaggtcatgaagacgcaactaaaggatgtagataaacatgttaagataaaatggcatggacaagatgtagaagaagagccaaaaaagcaatccgaggccggtggctcgaagttgcaaccggagcaacttagtaaaaagaaaaatatatacgaagacgcctacggtgaacatcttaaaaaacgacaaggtattaaccaagcaaagcagccggcattttacgacgattggctcttagaggaagcgcatggaccttttaaccaacaacaaggttttaagcaagaaaatctgctgccaatctatggaggtgcacatgcgcaaggattgtataaacaaaatgcgaataaggtcttccagccgcaaccaaaaggaggctttgctgcactgaaccttggtgagaagaagaaacaagctgaagtgaagaagcaaaatcaagacgcaggatggtttggaaatatgtttggtaaccaacaacctcaggtcaagcaggagttcagaggcaaacgtgaaaatcagcatgctcagcgcatcgatccgcttataatacaaggtctagatggaaaatttcatgcatataaggagaaaaataataatccgtatgcccgtagctcaaatgggccaacatctaacaatggtacatcacaaaacttgggtatcaacaaacttgtttcagtttatcagatttatttttatgggataacttttaaaataaagtttttattattgtttgttgtggacctcactatattggcatttttttgttaaccttaaatatttgtgttaaccaattattgtcaacagagtttggatcaagcagtacgcggaatcgctctagcttctcacggtcaagcagtgcgatggatctatctcaaaccacatcatcaagcagtgtggcgtattcttcttactccacaacaccaaacagttctaggaattcctctcactcacgatcaagaagttcggagaatctgtctcaattccaatcaaacagtacggggaattcctatacatcctctcaatcaaacacagcgagtggatccaagcaaggccaaagttctaaaaaaccaggaaagtaagcatgctcggttgcaaagaaagggaggaatgtcaaaactaagctctgaaatttttgacaaagaaaaagagacttgtcaagaataaaggtccagcatatttttttctagtctagtctattagatttcttctaaaagagccaatctgaggtggtgatcggtttgacctccatggactagaaaaaaaggtattgtggtgtttattacatattaattggcaaagtattgtttttggttaacaatttgctcctccaattgtgtttagtcgagtgatatcgttgtgtttctttaagatttattaaacatttgagtttttttttttcttaatgcaaatcattataaatttaagctgtcccaagctcatgacatttacaacttgtattgactaaaattctaaaataaaacaggcaagcttattgtacgggtatataactatatacagtatagccatcaacgtgaaactagagcaacacaagtttttcctaaaatactttcataaatacgattggatatatatatatatatatatatatatacatattataatcgatctttccttgtttaagtttcttggcaatccttgaatttccgtttgaatccattctaactatttattatgcgaaacaactcaagcagtttaaatatttcagttacacaaaattagattatcttatttcctaccttcgacgaagatgtgaggttcattattaaatccttataggcttgacttagtcgctcttatattgacgtgataattaaagacaaaagatatcgcatatatatggtttaaaactgtgttagttgaagctactatagtattaaactaaagaagcgcagccacattctaacaatctattatatagaaagactcaaaactgtttctatgccgcataatttaatcatactacattatctatttcattttcttgcttcggcggcttgacttaatgttttctatattcgctagctaaagagtatatatgtagacctggaaacaaagtctatgagcaagcaacgaggttccaaattcattcctttatatcatctctctccaatctcgaaacttttccacaag

SEQ ID NO: 2455 - DNA, 3000 bp, Unknown
  misc_feature (1)..( 3000): cDNA_ID_3067882_gDNA_ID_1620538_Annot_ID_159947 3000 nt of promoter + ATG
gtaagcatcgttacatcgtctcctgttaatctttttgtttgtaccatatttaccatttcttactagacagttccgcctttttttttttcagttttaccggactttgcccaagtatacggcttcattggaagtgtgtttgacccatatgcaagtaatcatctacaaaagctgaagaagatggaccccatagatgttgaaacagtacgtttcttgtcttttcagttttcacttttacatcaatcttaattgaaaccacgtcggtccaatggaacaaatggttaaactaatcatttttttcctttgtttgcccccaccaaacaggtgttactattgatgagaaatctatccatcaacttgtctagtcctgactttgaggatcatgtaagtattttactccacaaactactagtcaattttaactcgaaaccctataccagaactaacctcaagactcttattgatttcaaaaacaatagagacggcttctttcgtcttatgatatcggatctgagacagcaactgatcatggtggagtgaataaaaccttaaacaaagacccacctgaaatctctacttaatgtttaatagaagaggagaactgtgaaaagtgtctcaggtgagccagccaacaaccagatggctacaaaatacagagattctgttgtggttttttgtttgtacataggaagaagatgaagctgatgttactcggtttagttgttgttactgttataaatagtctgttgggttaaggatggtatatgtacagtgtattatcataagttagatctcaagtttaaacatatgtatcagtctctttgatgggagaccaaaatctcttaatagagttgtctttgctttcgttttcattcgtttatagaggaagaaataaggtgactgtgaccatttgtataacaatatggataaactatttttagtggcatactctcgactataagaaaagatgcatccaaggaatatcaaatcttcttgatcaaaaggttataacttataaagaatggactaatatatattttaatttgatcatatcttaagacttacaccaaatccaattattttttttatagaatatgaaaacataaataaacatcattacttgcctcagaaaaataaaagtaaaaaataaaaataaacatcattattagagatcataaaaaaaataatttgcagggtattcagtgtgatcaatgatttcgacagatttcaagatcaataatttgtagttggcttcatttgtttgtaaacacattttggaggtggtgataaaacacattcttagtgatgaaatagataaatacatttctaaatagatgtaaatcaaatgatggtttgactggtttgcatataaaacattttctagaagaagttattaatcatattttaaacaagaattgtaatcatataccattccctctctcaaatttgttttgagcttttgttaaagtatgtatctgtctctttgatgggagaccaaatcaaatctcataatagcgttgtatgctttcgttttaattcgtttatagaggaagaaataaggtgacagtgtagaccaatatggttaagctatttttagtggcatactctcgactatgcatccaaggaaaatcaatcttcttgaacaaaaagtttataacttacaacttataagaatggactaatatatcttaagacttacaccaaatccaattactttgatagaatatgaaaacataaatgaacatcattatttgcccaaagaaaaataaacatcattattagaaatcatagaaaaaataatccggagggtatttggtgtgatcaatgatttcgacagattttaaaaccttttttattttctccagtaacttatcttgatcaatattttctcccttcactgcaaatacgtcgtccatgataccacaacttatgacatcaactcctaatataataataaaaagatgacaatcattcacattgttcaaaattcgtttgttgaatataattgttgggtgtgtgtaggtttgtacctggaaaaccacctgcaattttgaatccttttcgccattttttttcgggatatcctggatgcttgaatacaatcgtcatcgactacaaacaatgaaataaaactaaagctttagtgaatttattatataaccacataaataggtttactaagaaaaataactaaccattttttgaaaaactcaaaagtttggaaggagaagagaagatgatggacaagaatgtgattacaaactcgcttgctcatcaacctctatatatattactgaaaattgattttttttgttaaataatctataaaagtacatttatctctcaatttcacaatctctttcgacatatgtcacaatttctcataacaaatttttgacacaaaaatagatttatcttctttttttttttgttgaaacaacacaaaaatacatttatctctcaaagatttttttgttacaatatggagcaaataaattaattaaactggaaattattttaacaagataatatatgtaattaataaaaatatatgttaatttatagaattaactaatctgataaaaatatataaagtaatcaaagttatagtaaaaaaaaaaaaaaaatcaaagttatagtaaataatatttaaacgtatgtcacaaaatttacaagatataaacttttcaaaaaagagaggataaaccatcgtaaatataaatacaacgagtgtaagtattggttaataaaatattaaatatagttatcatcaaataatttgataaacccccaattcttaattcaattcgacaagatcattttgagtttctcagtctccgatactgcccaaacttaaggcccatatttaatgaactcattataggcccaaaacaaagcatataaagtcatcgtcttctctagtcctgcgaaaaccctagttttttgctctctcgaagttccgtgcgactctctgctcgagcaagatctcctaccgatacaatg

SEQ ID NO: 2456 - DNA, 3000 bp, Unknown
  misc_feature (1)..( 3000): cDNA_ID_2989987_gDNA_ID_1620538_Annot_ID_159940 3000 nt of promoter + ATG
aagggatcagcagggacatcaatataagaaatttcgtcatccttgagaaggtcattttcagaataactatgacggatttcatgatgcttttcctcagcaatgttcgacaacttttcaggataactatgtacgggttggttattccatctcttgtcaatggaaccaaagccattgttttccgaaaacagctgagtagttgtatctcgagcaaatttggtaaccagagaaaacttctctagtagatggattgaaagatcccgagttggatcatgactcttttgctttctgaagccagactgggaaacactagatactctattaccaacatctgaacttgttctcctttgattttcactagaagaacctccgtctaatgggtatacggattgtccacttgctacaggcagtgaacttggcagctccaatgaagacaaagttctctatcggatattatgataaaatgtattagccaataagagaattaaaaaaaaatcatcactgcacccaacatgagatgatctgatatgattacctgcaagggactctgaaaatcattcacaatgaacacattttgatcttctgacgacctataaaaagctagtatcatgtaagactatgaattctgaatattttctttgtgacataactatgtaacgagccacccagttccatacgataataaactcgggtgaaccaaaagttttcatgttagacctctctaatgagtaagtaacaagtgctataaaagcctgtcaatacattgacactgtgcattcctaagctactttcatacagtaaccgaaacagactataaagacaggttataaataagaatatcaatacagaacaaaaaactatctcatatcagacacaaaccttgcaagaaaaacatgctgcttcaccatggccagaaactccctgactcctccattgtagaagtacagaggtggaaatgcaagtcctgcaggtcattttaaaccattaagtctgaatcattcgacttgtcgagaaggaaaagggaaaccccctcccgtatagtaattcattatatatatctcacaaaaagcaacagccaaaagttttgcttaccagaagacaggacaacaattacatactgccatccgagagcaggagtgtgtctcctaatggacctcacttcagtaaacggaaccgcggtgatggtataaagactcctgtctagaaaagatatagaaactaagaacaaaggtaaagcattaatcttcaatactaacatatactaattcagttcaaggaatcctaaatacctttctctgatagctttgcatttgatgtttgtcccttgtacggaatccacgactagccatcatatatcaaaaaatggaaacaagtaagtgaatgaatacaaaactaatacaaacaaacaatcaatttcagtgattgattaccagaaagagaacagagtcttgcttagtcaacttcaatctaccactaatcctctcagatgcgaactgtgtaggatgaattgcaacgttatctttcaaataaatcaatacagcgtcttcgtgttcactttgtaaacttctctttccgctatcgctacgcatcatactagccgatccctaacaaaatcaagagccatagcaacacaatcaaacgatcaagtcaaatagataatggattcaaattcgcattggcgaagatttattatcggaaaattacgatcgaattgttgaatcaaaattgagaaagcacgagaagaaggacaaagtcagaataacaaacttgttgttgagaagcggcgtaatcggcgtcgtcagagagatcttgtagctccgttgcttccatactcatggtgatttcaggagaagagagaggtgatgagagagatcagattaccctggagacgaagtaagtaattagagaggaagcttacgcgtcgttgagaatattcgattacgtgtgtgtatcttcattaattttgcagttaaaaaggttttaattacaggtcggcgttgtaaccgaaccgaaccgaaccaagttgtaatcgaatcgaatttagtcaactttataataatccgaataatacgaaataagtttctttactatagtagtaaaatgcgaatttggtgtaacagaaccacattaaccagaatttatcagaaatgcatatttttagttgagtaacatactaatcaaacagagcaaattaatatttccttttagttaaaaccaaagcaaattgatctgtaactttaaacaattagtttatgctgcggctttttagtaacttttctgggctctgatcactcacatagtcacattcatatatttcagtcataacttttgctattttgttttgttagtaacttgtcaaaactacaaatcaagctgaaatctgttttgaaaatgcatggaaacaacttgtgtaaattaaaccacctgtagttgtatacttgagatcctttttaagtcgcacaagtttagaacgagaactagaagcttcatgtcaagcaatacctcatttacctttgaagagtgtcatctgatgaaacaatatgaacaaataaggattggacatgtggaagttggtgatactcctcttgcctattcggtggaagaagaggccacgtggagccattaaatagaagtggagtgattcgctgtcgatgacttgggaaaatcctagaaaatggcccatcaggccatcacctctccttacctcaaattctaataaactcactttttgtatttgtttatatgcttgcttttgcgaaatgtttttcttattataaacattaacaatattattgtaattgactcaacatataaaaaaaacaaaatggtatagtttttatataatttgtttgtaaaagaaaataaaaatgtggcctctctccatttagctcttctctctgcaaagctttaccacacaatagtctccttgtgtttctctttatatttgtctctataactctctttcgttaaagtttcataaaacctcaacgaactccttccatg

SEQ ID NO: 2457 - DNA, 3000 bp, Unknown
  misc_feature (1)..( 3000): cDNA_ID_3067886_gDNA_ID_1620538_Annot_ID_159946 3000 nt of promoter + ATG
cttagtatagatccacagaacttggatgcgagaccaaacttagcgattgaattagtagacaatctcgagagtatatcgagaatgatatcaatcgggattggatctgattttccttctctttccatcgtacgtttttcaaagatcgtgtattttggattttggttccagttccagttccagttccagttccagacttaacgtagacgacaacctagggttcaaaggcaattcattcatacctaatgggccgaatgaattcatgggccatgttagaggcaactaaaaggctggacgaaactatctattttagccttttaggggaggtaacgtattaatgtccccaactatcttttataggatgcatagttggttttaactaacattaaaggtgttactaacaatgggcaatgatggtaaaattataacgcagtggacacaatataacttagccataccaatgcaaagaatcttgaaactagtattaaactcagtcacgtatatgctctccagtctatgcttcgaagagctttcttctaatcccatacgaagaagctctctatgtttttctaatttaatcaggcttagacaactagtttcaaagtcataattcttggtgtctgagttgtcttccctttccatcgagttttttaaagatcgtgtcttttggtttccagttccagactacgtaggcgacacttcagggtttcaaaggcaatggcactaaaagtcactaatgggcctaacgacttaatgggccttgtgaaacgttacccaataagagacctggtttctcactgagttcaaccatcttcttccccatggctctgaattcttcagctttcttcgttccatgtcacaattacaatcaaatctgtgatcttcttctttcttcagctcgaaccagatcaactattaaaggacttcagcttcatggctatgtcgttaaatcaggcctttctcttatccctctcgtcgctaacaacctcattaatttctactccaaatcacagcttccgtttgattctcgtcgagcttttgaagatagcccacaaaaaagttcgacgacttggagttcaatcatctcttgttttgcccagaacgagcttccatggatgtcactcgagtttcttaaaaaaatgatggcgggaaaccttagacctgatgatcatgttcttccatcagctacaaagtcgtgtgcgattttgagtcgttgtgatattggtagatcagttcattgtctatcgatgaagactgggtatgatgctgatgtgtttgtggggagttctttggttgatatgtatgcgaaatgtggagaaattgtttatgcgaggaagatgttcgacgaaatgcctcagagaaatgttgttacttggagtgggatgatgtatgggtatgcacaaatgggtgaaaatgaggaagctttgtggttgtttaaagaagctttgtttgagaatctcgctgttaatgattactcgttttcgagtgttattagtgtttgtgcaaattcgactctacttgagttaggtagacagattcatggattgagtattaagtctagctttgattcttctagctttgtgggaagttctttagtctcgttgtattcaaagtgtggtgttcctgaaggagcttatcaagtttttaacgaggtgcctgtgaagaatctcgggatttggaacgctatgctcaaggcgtatgcgcaacattcacatactcaaaaggttattgaattgttcaaaaggatgaagctttctggaatgaaaccaaatttcataacttttttgaatgtgctcaatgcttgtagtcacgcgggtctagttgatgaagggagatactactttgatcagatgaaagaatcgaggattgagccgacggataagcattacgcttccttggtggatatgttaggacgagctggtagattacaagaagcacttgaagttatcactaatatgccgattgatcccacggaatctgtatggggagctttattaacgagttgtacagtccacaagaacacagagcttgcagcatttgcagcagacaaggtcttcgaattaggaccagtgagttccggtatgcacatttcgttatccaatgcttatgcagccgatggtagattcgaagacgcagctaaagctagaaaattgcttcgagaccgaggggaaaagaaggaaacagggctaagttgggttgaagaaaggaacaaggttcatacatttgcagctggagaaagacgtcatgagaaaagcaaggagatatatgagaagctggctgagttaggggaagagatggagaaagcgggttacattgcagacacaagctatgttctgagagaagtggatggtgacgagaagaatcaaaccataaggtatcatagtgagagattagctattgcttttggactgatcacgtttccagctgatagaccgatccgagtaatgaagaatctgcgtgtttgcggtgattgccataacgcgatcaagttcatgtccgtatgtacgagacgagtgatcattgtgagagataataatcggtttcatcggtttgaagatggcaagtgttcttgtaatgactattggtgaagaagacaaatgagagttggtttatatttaaccataatttcattcagttcacactgaaccggcgaaatttctttgccagacctattcggaattgaaacaagtggagtctcgaaacgaaaagaactttctggaattcgtttgctcacaaagctaaaaacggttgatttcatcgaaatacggcgtcgttttcaaagaacaatccagaaatcactggttttcctttatttcaaaagaagagactagaactttatttctcctctataaaatcactttgttttttcctctcttcttcataaatcaacaaaacaatcacaaatctctcgaaacgctctcgaagttccaaattttctcttagcattctctttcgtttctcgtttgcgttgaatcaaagttcgttgcgatggcggatgttcag

SEQ ID NO: 2458 - DNA, 3000 bp, Unknown
  misc_feature (1)..( 3000): cDNA_ID_3067946_gDNA_ID_1620539_Annot_ID_159985 3000 nt of promoter + ATG
gaatctcggttgtcatcgcttcctagtgataagcctaaggccggcttaactaatggaacttactagtgataccataatgcgaaaggtgctaattaagcttgacagtgaagaggattcttatcaagttttggaaaattttaatggagattccttggttgggaagaagtatgaacctttgtttgattacttttagcgatttctcaagtgtgacttttcgactagtagcagatgattatgtcatgaatgatagtggtactggtattgtccattgtgctcctgtctttggtgcagatgactatcgtgtttgtcttgagaacgagataattaagaaggttagatttgacaacatcttccttatatcaccacctttaacattaagtttattttctttcttgtttaagtttacagtatcttcaagaacccatgttcatgacacattttgttcatgtgttgtttagattgtcagagatttcaaacgtccagatggtttgaaagatacagagattgatgcagctgtagatagtacatatcttaattaaaaataccacttctctatgctctattgttgaggaaacatataatatttgcattcgttcatggttcagatatgatgttatggtaattcttgatctacgagaagatgaatctttgaaaaacgaaggtgttgcccgtgaggtaaataaatgtaaccgaagcgattaatggtcatatataagttgtatatttgatatatgggtttccttctcattgtgctcatgcattgaaaagcaccctgttatgactgtggttctaggagaacatttgcatttgacagtcggtgactaattgttaagcaagaagaacgcatgagagccttttaaagtgttttcttctagatcgttgcaaaaagttaaatgtctcttgagactttgtactcattctatagataaagatgggatttattacaaaaacaacaagaaactttgttacttgtggaaattcaaaattatccgaactagcttcacaaaatatgctcaagagtttcaatgtatttttttttgttctgtaattgtatgactccgtttgaagcatcaagattatggttataggtagtgatgctaaaactctctgttgttacagtgaccactaaaaacaccaacaaaaaaaacttaggtaacgtgtcgtctaaaaacttctaggttcaatttctttagatagtactatcaataaataaaataaatatgtacaaaggctttaaacaatgatgtttttcaaagatgattggtagatactaattagagcttcaatataaaagaacacatgcgattctgacattctgtggtctaacatggtttcttctagagtcaaaaccatacaattaaaagttaggaaagtaatagcaatgtggtttcaaatatatactcattactctttagattcatgtatggtgaaggaaacattataataaaatcaaagatcacagttttgtaggtccctcatattaatcaacatcttaaggcgttatacatatcttctttttgtaaatatttgactaattaaaatatctaattagagtattagactaatctcatcaaatatccgactacttgtgtcagttcaaaacacagtgattacgttagattttgtgctcttttgtttataaacaaagctaatttaagaaatatatgatctatttgcctccttggtcttaattttatactttcttggaataaaacacatttattaaaataatttttaggttcctagattcatgtcatgtggcttgatagtttccaacaattataccaatattttactcattcatatacaaataaacaagctttattctattcttcagtctcatgatatacgggattttgataaaattcagagtacccattaattattctatgttacagcttgtaataagttaaatttataaaacgtacaagttgaggaaataacaaatgttttcaatattaaatgatttattaatacattagtgaccaaaaaattattaagtgtaagaaaaaaaacacaactcagaaaaaattcaaaagaccgtctaagttcggttcatgtaagaacaagtgggacctctttaagtttctaaatcagagaataaagaagaagaaaaaatctcaaaaccttcctctaaaaccaacggctcctacctttacttacaccctatacatacacttctctttttatcctccatcggcggcttatggcggttttccggcactaatcatctccggcatatataaataaacgtacttcacgtttttttatataacttcaaagtagtttcagatttgtctctatctcttcacttttaagtcttctggttttgtcatcaccagctttttttgttctgtctctgtctttctctttgtgtatttttattctcgtcatcgttgttcttctatgagaggaagatcggaatgtcgaagagaattagaagattctcgtacatcacttcgttggaatttcacaggtcgatgagagatctgagaactgtttcattttgatccaaactcatctctttcaggtattccaaatttttctttctctgttctttctactattacccaaattaaagttttgatttttatttctcactctgtttcttgtttttctaattgcagagtataatggactaagcattttttttctccgaagatggttaaagaaatagcttcttggttattgatactatcaatggtggtgtttgtttctccggttttagctataaacggcggtggttatccacgatgtaactgcgaagacgaaggaaacagtttctggagtacagagaacattctagaaactcaaagagtaagcgatttcttaatcgcagtagcttatttctcaatccctattgagttactttacttcgtgagttgttccaatgttccattcaaatgggttctctttgagtttatcgccttcattgttctttgtggtatgactcatcttcttcatggttggacttactctgctcatccatttagattaatg

SEQ ID NO: 2459 - DNA, 3000 bp, Unknown
  misc_feature (1)..( 3000): cDNA_ID_2162338_gDNA_ID_1620539_Annot_ID_160005 3000 nt of promoter + ATG
gaaatagaaagaatacaaaacgtacggatgttgttaacctaaacacgattactaccgagactaaagatgtctaagtttaatactaagaaaagtaaaacaatttttcgagcagatatatgaatagtgattttttgggtcaacacataatccacccaacgttgatttttgtttgtcgtttacaatctctaaaacgtttattttctaagaaatatacgtgtgggctcattttaatgcccttcgtgcgtctacccgacgactttgtttactcgaaactatatcacacactacaccacatatttcaacatcacactgtatacacacatttatatatacatgcagaccgattattataataatattttctccggtccctaaaacatatatatcattcattcccacatgagatataatattatgtaaaacatacttttgactatgttgccaataatcaaaaagacatctctctctctctctctcacatcctattttccaagaagctcaccaatgcttttgaattctcccacatgtcttttgacaattttagtataaatactcaaaccccttagtcagtcattctcatgttcatcaacagcatttgatctcaagctcataggaatttgatctccacattatatcttgatcatcaccacaagaaaaacatttcaacttcttttatcagcaatcacaaatcaaagagatgggaagagctccatgctgtgagaagatggggttgaagagaggaccatggacacctgaagaagatcaaatcttggtctcttttatcctcaaccatggacatagtaactggcgagccctccctaagcaagctggtatgtaaaaattataatatcaaatttcttaattttgatcaaatttcttacattaattattggtaattattatttacaggtcttttgagatgtggaaaaagctgtagacttaggtggatgaactatttaaagcctgatattaaacgtggcaatttcaccaaagaagaggaagatgctatcatcagcttacaccaaatacttggcaataggtattttacttcacatataagtatataaccgacacacaagttttattttgttttcttactatatataaatcaccaaaagaaagtaactttatacacacgtctaggtcgcactactattcttttaactacacaatgatcggctctttaattacttttgtattgatgttcttcgttttccttttggtatcatctttagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtggctggtttagttgagatacaacaagagtttcaaaacttgggctccgctaataatgagatgatttttgacagtgagatggacttctggttcgatgtattggctagaaccggcggggaacaagatctcttagccgggctctagttaacatgtttgaggagtaaagtgaaatggtgcaaattagttaaggctaagaaattcaaaagcttttgtttaccgagaaaaaaacacactctaactcttgatgtgatgtagttagtgtattaattagaggctgcgttttcaaaaaattgaattcatttgtttctccaaaattgagtagtttagcttgtacgagtaattaataatcaatgacaagtaatcaaagagtctacgtatattaatattgccttgttgatgaaataattatccaacaaacattggatgccactataacaacaacagcaattaaaataatataagtactagattaattcactgttataatcattttctaatgaggttttgaaagttcaactatggcggaaaaggtaaagttacgtagttttataataaataacttgagaaaaaggagcttaatgatcataaacatttttaattaaaatctcaaatctctaaacatttgtagtttatgtgttaacgacgtctatgcgtcatcatccaaatttaagccccatattgatgacaaaaaatatttaaattataattatacaaaacatataaaactattgattacgttttttttggtaaggaaaactattgattactcttaaactagatgttgtcctttaagataatagcccaccaaaaacaaaatcgagataataataatctaattatttttaaaaatttagacactgctttgtattgtaatttttgaatatctaattcataacataattaaggtagcttaaaagaaaagaaaagaaaaaattgtgccctttatttgagaaaggtataattgtgtgaagttaaacgatgacgtttctttggtaccttaaatattaatttgtgtttgataatttattgtctatagattgaatgctttgttacataaatgggtttgaatcaatggataatggattaaagaaatggatgtttacattaaacaaccacacaagtataccgaaccgaaattgtttgatggctttgttatagaccgaaccaggtttccaattcggaaccaataattattaacctgaaccaaatcgaaatttgccgtctccgaattcaaccgaaccgaagttttttttccggtttaggagcttcgttttattgttgatgcttcaatttccctttggcctttgatacaaa

SEQ ID NO: 2460 - DNA, 3000 bp, Unknown
  misc_feature (1)..( 3000): cDNA_ID_2162345_gDNA_ID_1620539_Annot_ID_160007 3000 nt of promoter + ATG
gctctatcgaaaactgggagttttgctaagaagcactctgctaatgcaacaaaggagcctctgattatcatgttgaaggattctagggtttacttagcaagtgtcaatctccatggagttcacaacaacgttgctcaatcttttgagttaggatctcgattgtaccttaaagatccgcacatttctaacgtctttcactgtgatggcttgttattgctctgctccattaaggagaatacactcgaggtttggaatccatgttcaggagaagccaagttaattaaacctagacacagctactacaaggaatcagacttttatgctcttggttatgacaacaaatcctcctgcaagaaatacaaagtcttgagggtgattagtcaagtccatgttcaaggtgacttcaagattgagtacgaaatctatgacttcaccaatgattcttggagggttcatggtgcgactaccgaactgtctataagacaaaagcatcccgtgtctgtgaaaggaagtacttattgggttgttcgtaataggtattttccatataaatacttcctaagttttgatttttcaaccgagagatttcaaagtctgtctcttcctcagccgtttccttatctggttacggatttatcagtggttagagaagagcaactctgtctgtttggttattataattggtcaacaacttcagaagacttaaatgtatgggtgacaactagtctcggatcagtcgtgtcatggagcaagttcttaacaatacaaatcattaagccgagagtggatatgtttgattatgggatgagtttcttggtcgacgagcaaaacaaatctttagtgtgttggatctcccaaaaagtcttacacattgtgggagaaatttatcacatacaagatttggatgatcatggtagagattctgcgttaagatcatcatgctcagttcttatgaattatgttccaagtttagcccaaatccaataaagatttggcctgatctcttggaggaggcaaacacaaaggactttgtatgaattctgttccaattttgacttgtaattctcgcaccaatctagccaagtccctttttctttttttcctttaggaactttaatattgatcaggtttaaggttttctctggttccatgaacttaaaaataatcaactttgcttacatgtgttatcgcttgagttattttatggattatatacattcaaatactcaagcatataaatggtgaatcagcttgtagctagaaactgaaaaccattcgtttgacctaaaaacgaataaactttacagtgagcagaagaatcaactggcaattagtaacctatttatccacttttacatataaaatgttttattcaatctaaaactgggaaatagtaccaatttatacaagagaggattgatatatttttgtcaacacaagagtgacttgaaaagctttcttgaaaagaataaagaaaagacaatcaagcagtgtacaaacgaatcaattgtcaatcctcaatcttttttttggtcagcatcaatcttattttgtagaaatacaaacaaaaagacgcacaagtaggagaaacaaagacaggaagaagaataaatagatcaatagaacttcgaatgaacctttcttggaactcaagaaaagatctctctttgcagatttgccagatagtgctctcatcactatgccttctaaaatacctttccttggaaaaaggacgagacaagtactcgagaaaccgagaacgttgcctcgagcttgtattttgaagataccttgctttgaaatgaacgataagacagtgcgacatgacatgaaggagacgagaaatcaaaaatctctaaccgatgtagcaatctcgaggtctctaactttcgatctgagcttgttaataaagctcctccttgccagtttcaccacatttttcttcttgccaaactgcaaaagagccatcagcaactctttttttttttttttttttttttttgcaaagaatgatgtgttggaagaaatcacaatggttatcaaggaaaaattagtcttagatactttacttgaaggtcataaataattgaacctcattgtcttataaattactagtatcatgtttcaatgattgaaatgcaatttgtgtgtattgcttatccatatatgttatcgtttttgttcacatttgataacggtcggtcttctcaatttcccttattagttaccttcccgtttttgtgatttaataacaacaatggttgtaagtacttccctagcctcatcattgcagtaaaagattaacgaagatttatacaaagatgaacaacatataaaaatgttaaaaatcacactgttactctaaaattctaattggaagtttatgttgtattgtacgaactacaagctactaaattctatgatgctgtttctttttgcgtggaacacaattttcaattctagttctatttcaatatttgtagatcaagggtagattgaaattgatcatggtcgtaaaacatgtttagtgttccattgaattggtctaatcttatttcttcctcacaacgtcacgtaacaaccatcaactaaatgtctattttaagctaaatgttaatcataaagtattaaattaaaaataaaaagacagaaaaacgtggtaagaaagaaggaagagcgccaaagtctgagctaaatctatggtggtttcaagcattcctaaaatggcaatcttctcacaaaaaaatattatctcaccactgaaccattcttacaattcctcatatcattattccaaactgaaaaacttcccaagattttttgtgtgtagatatgttttgatagattgaagataagtttaaatgattttggatgagacttgaagcggatcaagctagagaaaggaatcgacgacaaatgaatctatgaagacaggtgaattacaacacttgatgcttcttgagtttatccgacgttcttctttcgggtttctcagatgga

SEQ ID NO: 2461 - DNA, 3000 bp, Unknown
  misc_feature (1)..( 3000): cDNA_ID_3067926_gDNA_ID_1620539_Annot_ID_159993 3000 nt of promoter + ATG
acaatattggatcaattatttgcctacaactacatattatacgtaaaagttatataagcaatggatgattttgtagtataaattaccgtcaagatttctccttttgattatgactcttcttcgtcaccaatgtaaatgcacatctctcttacttctttcttttatttccttatcctcaacaaaacccttcattgacctctgctctctctgtctctatcttattatctccttaaacaaattttttaaaccttaagagctacgagtgaattggttttattgtaaactgttttgacaagcgtccatacttttgccaagttatatagccaagtgtataatccctaagataaatgtcaagagatccatcttttctgtatgtgatgaattggaattataccgcaccaatacaccaagtacaaacaagatatacttaataacatggtatagtagactaataaattggtaaaatagaacaaggaacctatacagatgtcaatgaaatatgctatgcacatgcacttcatctttaactacaattttatatttttttaatatttttgatgaaattaatctaaattttcttagagatcaagaagcttgaagaaagaaggaaaaaaaaaacaacgtgcatccactattttctccggaaagaagaccaaatctgcaaattcatcaccaaagaatcagagatggatgttgtgcaaagaaaagtgaaaaaaattggaagaaaagttgcttctttccctcatgttgaaactattggaagagctctctttgcctcctccttcttcctctcttcttggcatgagtaagaaacatcattctgattcgtacttggaattcaaatagatctaagtcagagtaatgggatctgataatttttgaaaattcatatatacaaacatttgaagatgacttgtaattgaatgattcttaggcatcagagactctttgttttaacaacaagaaggttattgaaaataaagaaataaaaaaaattaaagaggttcttgatatttttctcagttgatgattaaacttaacaagtgggattcttttctttgttatatctagttacatggagctcaaagccaactggaatggaacagaggattattggagcccaaagtttggctattcaggagaccagattaagcatcttatgacagttagtatcattgtgagaactcttggaggacttatcttcatctatggcagcttcttcggagcctttctcttggtactaatatgaacactttatttataggaaagcttgaaacctaatgaaattaaatacgaatacattgaaataattataagaataatatacagctattgtgatatgcatcacttatagatcatatgctttgtgtcttattccaaatcaatatgtttcttgtgggtgcatatagcttatgtaccaaggcattgctacaatggttcatcatgatttctacaatcatcgtttagatactgaagaatttggactgctctatctcaaactcaaaagggtataacgacctatatttcttctttttaaggcactttcagtttctttagctgctcatttgttctttgttttgtctcctggtttgtttgtcagattctgaacgaaacagtgtcgtacaatactgcatacaatctctacaaatcagactttgacgagcagcagatagagcaagtgaaatcaaaattccgtgaggtgcgttattgaggcctacatgtaaatgtaataattgtagcttgtgaacactgtgtgatgattgatttaatgtgttgtgtagcttgcggatcacgcgatgacaaaccctgcattgttcggacataatgagtttcttcgtcggctcttaagcttcgtcaagggattggccgtagtaggagcattgctgtttttcgtggatatgaagtatcgtctcaacaaagccaagaagcaatccaaagttaaaaatgattgaaaactaaaaagccattacaaatgctttatctttatgtgctattgaactagaatcatatatccatcttttgacaatccaacaaatatgttacctttattaatttggtcttgatttgaataatggagctataattaattcatgtagttgaaaagttcaaaatacgaaaagaaaacaatatgactagctaaatttatttattagaagttgtagcagaatataaaattgaccacattagtacaactgtgcacgttctatgctactagctagcatagtcaattacaagcaagtaaacatatttttaatgaccttttcacaaattttcgaaaccaaaaccagacaacacttgataatattatttgttgtaaagctacaaaacgtgagaatcccgatagctatctttaatacattgacttctaaccggttaaaaaagaaaagacatttggtatgtaccaccaacgagtcaccctaactaaaactataattgggaactccgatcaatttttcaaatccctctagtcatcttaaaatataaatttatttcactctataattgagcataatgcaagttcgttctgatccaaaaaaaaaaaaaagttccggtcgttttataaggcaagtcaactttgatagaaactaatttagcattcgcataactgtacattttctttaaaatacacattaaaaaggtttaaacgttcaagtctttattttttatgatgaggatatagacggtctttgatttcaaatattcgaaagtcatttttttttaatatcacaagttgtagtattttaaacaatatgttatttcttgacatagagattatttagtcttttatttatatgtgtttactattcttcttccttttatataatcatataacctatagtttgtatatttcaattattccatcatttaccatttagtcgtctccttggtgatccaaatacttcatcaccttccttcatagcaaattctcttcgtctatctcatacatttaaacaaacatagacatacactaatcaatcttccttaatttaaaaaaaaaac

SEQ ID NO: 2462 - DNA, 3000 bp, Unknown
  misc_feature (1)..( 3000): cDNA_ID_3067942_gDNA_ID_1620539_Annot_ID_159986 3000 nt of promoter + ATG
aatcttctatacaaaactaattctgtttaatccgtttaaatcttatgataaaataataaatgaatcctctctctttcttcattattttgccttaatctgcaactgttgtcaacttctcatgatttgatgcaaaattattttgcgaaaggatcataaatttcactttgagtctctgactatatacctaaaccattgtatagatattatatagcatattaacaacggttggttagaaccacatggaataagttctaatcctagcattcttgaactgtagttgaaagaacgacatgttaacttctcaaacgtagctatccagcctatttccatttcgatgtatgaactatattgggccttaataaagaaacgggcctaattgcgaaacagactacggccatgaaatgtcaaactcaataaggttaaagcggaattgattattacggattagtacaagaataataatagtatcagtagtgatgcatgtgacaagggtccaaatggaaaccaccaaaatcttaacctaaatttgacacaaaaagagaatgattttaagaaatgtgggccgaaagttgttggctcaccacgccttgataatcctcttatctatttatattctataacaattcaatgaagtatgattttattgtctttctattgagacaattgttatacaataataatatgtgcttgaattgtactcgtatgaaatttttatatgtaatatcacaatttctattttatactacgttattcatattctacgagactacgacaatgcaaagaaaaagattacttataaattcatcaaaaatgtagactaaatgtctcgaactaatttttttttctttctctttaacaaatattaaaagtttttcttctcttttcaatggatttgtttcaaacgtaagtagttctgaaaatgtaagtaggaataatcttattcataaaccaattatgtggatttttctgcattttcctatcctcagtttactttgatgtttttgtgtagcagctaggggtgaacgttcagataccccttcaagttcggatcagatattttgagtttttggatcttcgggtttggatcagatattccgtattagattcattaagtactatatttcataccaaagtaacaaaataaaattttatgtccttcttttatttatttttgttaatgagtgtatgtttgagattatttgtttagtattttaaatatgtatttaagagaaattcgtgaattttatagcaaaataataaaatatataatgattaggaaatcccactgagatggaaatcaacatgtaatttcattcattgtattattgtctctgtatgctttgtctcctctttacatgaagaatttttagtcaccaactccctctctcacctcaactaatctatcgtctatgataaaatatttctttcttgtttaatcacaaacatttcaaacacgacacaacgaattcgaatatttaaaattctaattccgtgttgaaaaatgtcacttgattttgatcctagatttttctttgaaattaggtcaacgaaaaaaattggttttgaaaagatggagaaagttgcgaatttcttaagttttgtgagtgtaaattaggtaatctttagccgacaaaaaatccaaagagagtggagacaacaagaagaacatcatcggtcaaacaaattctttcttgtagtcaactttttaagtgcttctttgttcccaatgtattggtctctcaagttatcaatgatgtcacgctcacacaatagttactctcatattcgagtttcattacatcttctacagattccattctatttgggacaaatgatgaaaccgagaacctgtatctatttaaggtttttaaaacagtttccaaagattatcaaagaaatttcataaaaacgctccacctattgttgctttatattactgtatgtttaaaggttttttgacatttaaaattttaaaactcttacatcttagtctaatatatctctaaatattagaaataagaatcaataataccaaatgattgctaaggtttatcaatgctaaatctactaatttaggattagttatttattatatataatttgtttccaacaattatttatcataaatccccattacaaaagttgatagcctccatatatacacgaaacaaaacaaatattacaagtcaatagacgtcaaaaacaaaacttttaaaaatattttaaaataaatattaattacgtttaagaaatttaccaaaatatatctttaaaaacttaacaccacaatatccaaaattagtgtatctaaaatattaatgtgtaaaataatttcatgattgatgtatattttgtgagacatcactccacatcaccaaaaatacctaattttttctttataaaatatttttaacaaaattgtggataaaaaagagaatgatttggtactgtattgaataggttgaaattcccaagatttaaaatagaataagttgaaaatttgagtaaaatttaaaatacaaaaaaaaatgaagaacattagtggagcaagtactagctgcaacatcactccctttcaaaaaaattaataacaactctttcttctctctcttttctcaaaatcaaacccaaatttcacaactttcaaaatcctctctctttcttcaacatctctctgtctcttacaagaaccttgcggagttgggtccaaactttaaagcttccctcatcaaaacccatcttcttcttcttcttcttcttcaccacttttactttctccttctccaatccctcaaaaagctcacatcaatggtacatcttctttttcaagtaccgcccataatccccaatgattaaacccttttcatttcttcattcctcgagaaagttaaatgtcataatctaaaaacccttttctttttttccacggatctgttcttaatctccataaagactcaaactttctttgaaattgttttcaaagtttcgatttttacaatg

SEQ ID NO: 2463 - DNA, 3000 bp, Unknown
  misc_feature (1)..( 3000): cDNA_ID_3067932_gDNA_ID_1620539_Annot_ID_159990 3000 nt of promoter + ATG
aggtcgttatacccttttgagtttgagatagagcagtccaaattcttcagtatctaaacgatgattgtagaaatcatgatgaaccattgtagcaatgccttggtacataagctatatgcacccacaagaaacatattgatttggaataagacacaaagcatatgatctataagtgatgcatatcacaatagctgtatattattcttataattatttcaatgtattcgtatttaatttcattaggtttcaagctttcctataaataaagtgttcatattagtaccaagagaaaggctccgaagaagctgccatagatgaagataagtcctccaagagttctcacaatgatactaactgtcataagatgcttaatctggtctcctgaatagccaaactttgggctccaataatcctctgttccattccagttggctttgagctccatgtaactagatataacaaagaaaagaatcccacttgttaagtttaatcatcaactgagaaaaatatcaagaacctctttaattttttttatttctttattttcaataaccttcttgttgttaaaacaaagagtctctgatgcctaagaatcattcaattacaagtcatcttcaaatgtttgtatatatgaattttcaaaaattatcagatcccattactctgacttagatctatttgaattccaagtacgaatcagaatgatgtttcttactcatgccaagaagagaggaagaaggaggaggcaaagagagctcttccaatagtttcaacatgagggaaagaagcaacttttcttccaatttttttcacttttctttgcacaacatccatctctgattctttggtgatgaatttgcagatttggtcttctttccggagaaaatagtggatgcacgttgttttttttttccttctttcttcaagcttcttgatctctaagaaaatttagattaatttcatcaaaaatattaaaaaaatataaaattgtagttaaagatgaagtgcatgtgcatagcatatttcattgacatctgtataggttccttgttctattttaccaatttattagtctactataccatgttattaagtatatcttgtttgtacttggtgtattggtgcggtataattccaattcatcacatacagaaaagatggatctcttgacatttatcttagggattatacacttggctatataacttggcaaaagtatggacgcttgtcaaaacagtttacaataaaaccaattcactcgtagctcttaaggtttaaaaaatttgtttaaggagataataagatagagacagagagagcagaggtcaatgaagggttttgttgaggataaggaaataaaagaaagaagtaagagagatgtgcatttacattggtgacgaagaagagtcataatcaaaaggagaaatcttgacggtaatttatactacaaaatcatccattgcttatataacttttacgtataatatgtagttgtaggcaaataattgatccaatattgtaacctgtggttttattgatttttctttttgttgatttatgataatggttaatttctggtcaatgtaatttggtaagaagttggagacaacgctgatcacatatgattacaatattatcactattatgcatttttttcttaattaatctaaactaatgacagtcaaataaaattaaccacctattctaaatattaagaaaatatattaaatgttgcttttaaatgcattatttttttgtgatttacaattttcaataactttaaactagtaatatttaataatttttattgaattttacaatttatcaattataactaataagtattgcattgaaaacctaaaaaattaatttttttaaaacaatttaaaaaaagaaaaatcaaacaaaaaggaaccaaaagagtatttattatttaataatatattttcatacatattagctttgcttatataaacacactttctattattgataatttattcaataacaaaagacggtctcaataaaagttttccactgaaatttcttaaacaatttaccatatgatagttacttggcagctcaacaggattttaagtttgttaattatgatgactttttttttttttttttggttattccagacgataccatctcacgtagtgattatagatgggcgttggttaatggctatcatgtcaacgccactaaaatcaataatgtcattatttattaaacagtattattattcttaaaaaaattttgtttatgcactgtgcacacctgttatgcaaattgtctttttttgtatactgtattgataccattattttaatttattacttaatccaaattgtcttcttttttttttgtaaacgttgactttaaatacccaattcatgaatctcaccttctctaagataaaaaatacatttaaatcatttcataatgacccaagtttaagtcttttgtttaaatcaattggtgcgaacaagccgggtctgcgtgaatgatgatggtctttgtttattacgaccgaaatgactaaatcaaacttcttcttcttcaatggatgtttcttttttatccatctcaagacatattctttctatttatttacttcttatgcaaccagattcatcaaagctttaatcatatcactttcttgatcgttcgttcatagtttgcttccggaacaagtaagtatcttctgcaccattgatcatcatgtgattcttgattcttgtttccgattattagttcttacataggatgatttgattacaccataggttttaaagaagttactgttataatttctgcgaaaataaaatcattttttgagttcttgttttttgtatgtcttgatatcatgtaaaccctagatttctctgttatgatttgattttcttctacaagacgtattcagactctgatctaaatctgaatcttttttaatattatagaaaacattgacattaagatcacaatatgaagatg

SEQ ID NO: 2464 - DNA, 3 bp, Unknown
  misc_feature (1)..( 3): cDNA_ID_2162191_gDNA_ID_1620540_Annot_ID_160015 3000 nt of promoter + ATG
cct

SEQ ID NO: 2465 - DNA, 3000 bp, Unknown
  misc_feature (1)..( 3000): cDNA_ID_3067976_gDNA_ID_1620540_Annot_ID_160023 3000 nt of promoter + ATG
tgcaagtatataactagtattgtctccatcgtcggtttgtcggatggattcaaacttaagatcgggtcatgagctccgaggtctagactctatgcaaaacataacgtcgtttttaaagtgagaaggaaaatctgatgtatattccttgccatttgccgtaccacaacattctattgggaacaaattttgacaaaaagctccaaccagacgtttgacaaaaggctaaacgccatttatttgcaattttcaaatccacgtttcacgagaatgcaggtttttacacacttatcatggaaattgcaagttatttttcgattacaacttccaagcaatagcaaatgttgcaactgtgagaatctgaaatgcacacattttagaaaatttaaacaggattatcattttcctacattattcttagcttggtaagatgcaatcagtagaaccaaactcttaaagaacaaaagtttatgaaaagaagaacaacactcgagtcatttacaatctgaagatggtacttgtgcagaagtgaaacaagcagatcctttttagtggaaacatgtctggtcaccaatagagagtgctaacaagtaatatcttcaaagtggccacacacgataacaaccataaagttaaatttactttacatcccctcagtttctccttttcttcttcttctcttctttatctgctgagttcttcaactgcataacaaaagagtccgtcaatgacggtttactaacaaataaagtgtaccattttcttataccagcgacaaatgaacttaccattatgatgagaatccgaacaaacacagctacaaagtcagtgaaaagggtcaacgaatgttttacatagtccatgtcaccgaggtgtgccttttctataatctcttgtgtgtccaccaccatgtatcccacaaagatcaaaagtccaaagtacaactgcaaccagagacgtattcataacaatggtgagatgtctgagaaagtaagacaaagaacagatcattctaaaacagaggcattcggtttacctcaaacttaaagatagatgcagagccaccaaagattgaagaggcaaactggagccacattagcatagacaagccagatgaaagcagtcctccaaggtagagatactccctgcgtcttgctaacattgctgctgctgagaaacagacaaacgctatcgcagttccaacaaatgcagtgataaggatgctggagaaccaaaagaaagatataaaggtcagctcctagaatagtctaacagaaaattaacattgaacaacaagaatcaaattgcataaccataacacaccttgggtcaacatcaattgccactttgatcaaggggccaacagaagcaccttcaagaacagcagacacaaacagaagagaaagccttttttgctgcatcaaaacaaacaacaatgtcaggaaaacgaaactttagtacaataagaaagcagccaattcactattgggttgggtaaatcgagcccacgtacgtgttcataaggaggacatgaaaggagccaaatcatagttccaatacatccaatcgttgtaagaataccgccgatattccagagcacatggaggtaagctccaaaggcagacgccacaagagcacaacataaggtcaaataaacctacaaagattccaccacaaataataagaaccaatgagcatttgtaacatgagtgagtatacaaatcacattcccttctgcaaatggaacatgacaaatgaacaagaggatcttaacaataataagcagagtaaagtataacgaaagatctccacagaatcataatcaagtaagtatcaacaaactaaatcatggaaagacccaattagaaaccctagataaagtacgatcgcaacgattcgttcaacggaaaccaaatcatagaaattagatgaaatatagaaacatagagcgatcaatagcacgaaaacgaaacgaatctcaatctatcgactctaatctagacatcgcggtttggtgtgtgatatgaatagacatcggcggcgaagaaacttacccgtttaagatgattctgaacggctggagaaatctgacggaagtttttaagagaatcatagctccagcttctgctaccaggttgagaatcgaagaaggaagagaacgcatccattgtttcgttttttttgcttgactttgagaatcgattaatgaaaatattagttagaaaataaagactttcgttatttataatgggccttatgattggggactaaattgacaataatacccttactgcttatgtgtagttattacgcattcgctacacgtgtaggggcattaaacacggagaagggtagttctggaaacttcttgaacgttgagatcgtcgtcgtcgtaatgagttgaaactttgccgcgaagcaaatgaaatatctaaatcgtcatctaaccaataagaatcatccacgtggatttttcacttagtttacatattattgtttaagcttaggaataaatttgttttagttttgtgataaagtattttggataacagtatttattaatttacaaagacttttctataatctttctctattattttcagttgcatcaaaagtttaacaaactaataaagaaaagaccaaggacattttcatatcgtctagtcaattcgtaaatcatgggtcgagagtatggttaaatgtcaggttttgaattctagttctatatgggctgatcgcaaagcccattaacagtctcgtttatctttctatttttgcttacagaaaacatcacgtagtttcttccttaaactgaattaaaaaaggaaaacgacatacaatccaagtttctaacgataacaacatctctttcacttccttcatagctcatttcaaaccacacattcaaactaactctgcaaaaaaaaaaaaaactcagagcagaggagatcgagagagacaaagagagagagagagagagagagagatcttaacaaaaaaatg

SEQ ID NO: 2466 - DNA, 3000 bp, Unknown
  misc_feature (1)..( 3000): cDNA_ID_3067993_gDNA_ID_1620541_Annot_ID_160049 3000 nt of promoter + ATG
tgtgcatcgagacttggttaagttgatgagtgatgaaagtggtattcaagcgacgagagagttgggaaagtatctaggaatgcccattctccataagcggattaataaagacacctatggagatgtgttagagaagatctcattaaggttagtgggatggaaagggagatttttgagtatggcaggcagagtcactctcaccagatcggtgctagcatctattccagtccattcgatgagtacgattgcattaccgggggctataactaaaagtttggatagagtgtcaagagattttgtgtggagaagtcatacaggacaaaggaagcaacatctactagcttggaaaagagtttgcagaccaaagatggaaggaggattaggtattcggtcagaaaaatctatgaataaagcattattgtcaaaagttggatggcgacttttacaggataaggacagcctttgggcaaaggttttgagaagcaaatataaggttggagatccacatgataagtcgtggacagtggtaaaaagcaattggtcttccacatggcgtagtgtaggggctggtttacgtgaagtaatcctaccaggtttaggatgggtgattggcgatggttctaatattcgtttttggacagataagtggttgggagcttattgagaacagagtcagagatatgtagctacgaaaacatgcagtatgattgttttattgctaatggaaaaatattattacttgtttttgttttgttctttcttttcgtcaaggctaaatgcctaatggtcaatcatgcaattaagtatgtacaattttttttttttttaagtttatcttgtatatataaaatatagtaggtagaaattattttttcattccatcaagttaatttgtaagaatttacccccaccaaaaaaacaaaaggtaagtgtgaataacttgctcacattagtgcggatgatgtgtttaatacatgtaataaccaacaacttttgacgtattatccatctgaaaaagatgaaagagacctcatcatctctatacgagagaacgtgttaccctaatgggtataaataatacgccaacctatgcaagaaaatcatatcatcacacttaaatctttcaaaacacctttaaatctttcaaaacacctttagttcttacaaaacacctttagttcttgcaacacaaatattattgcaagatgatgaacaatttgtagaatgttgctcatcatgctcacgcaaacgaaggtaaatgtcaataagatttagacagatcaagttatataattctctaatcttccctcttcttcctttgtctaacaacaattattattattttcaagatttcgtccaacttcttcaaacttctagaaacaattggcttgatacaatggacctatcaaaagtattgccatatattccagaatctataagattgatgttgtctactgttgtggtagatgttgtgacaggtgctcgagatcgcttatcttggagtgatagtccagatggtcgcttcaccgtgaggtcagcacactcaatccttacgagagatgaagtaccacgtcaacaatcatggaggatgtttgagcgagtctagagagttgtggtacaagaacgtgtgaggatttttctctggttagtggttaaccaagatattatgaccaatgtggaaagaaagagaagaaatatttgtgacacaaatttatgtcaagtatgtaagagtggcgaagagactattttacatgtcttgagagattgtcaggcgatggcaagcatttggagtcgcttgcttccccctaggcggttatatgtgttctttacacaatcattgcttgaatgggtatacagtaatttgggagaacaagaacttgtcggaggttatccgtgggctactttattcgctttggcagcatggtggggttggaaacggcgctgcagaaatgtgtttggggagaataggaaatgtcgagatagagttcgtttcctaaaggattcagcgaaagaggtggtggaggctcactcgctgcttgggagtaatcgaggtaatgtaactagggtggagagacaaatagcatgagttccgccaggagatggttggctgaagttaaacacggatggcgcatcacgtggaaatccgggtttagcaatagctggtggtgttttacgggataatgagggtatttggtgtggtggttttgcgggaatctcggagtttgttcggctcctttagttaagttatgaggtgtgtattacgggcttttcatagcttgggagaaaaaggctacgcgggtgtagctggaagtggattcagatatggtggtgggttttcttaaaacatggattagcgattcgcattctctgtctttcctagtacgtttatgttatggcttcatttcgaaggactagattgtccgaattactcatgtgtatagggaagctaatcgtctcgcagatgaattagcaaaccatgcttttttgttacctttggggtttcatagttttccccttaggcctgattttgctacttcgattatttttgaggatgctagtagtgctacgcgcccacggaatgttcgtgtgtaatttttttattttgttttttaataatatgggagactagtctccctcattctaaaaaaaataaaaaattataattatataaaatagatataaaattattaattacataataatacacacaaaaaatgaatatcaagaaaaatctctctctctctaaatcaaaatcaaatgagagaagagaggcgatacgacgaacgattgcatctcttcgattcctacggctgtctctcgctcgccgagagttttcttcgccagtttccggcggttacttcagggatgaataacggtagaacggttgtggaccccataactgcttctcaaccaaacctatttataccctgcgcatgtctctgttctcgttgggttgatcagagtgaaagtacacaaattcctttgttcatattgacaatg

SEQ ID NO: 2467 - DNA, 3000 bp, Unknown
  misc_feature (1)..( 3000): cDNA_ID_2162422_gDNA_ID_1620542_Annot_ID_160056 3000 nt of promoter + ATG
gttgaaattctttatgaatgttattttcatttttctgaatatctaagagatttcggatcctagggacatacattcctttggaccgaaactagcatttcaaggaaacacgacttttcattcatttggcgggatcatacgttactggaccaagtgctactcggtgaatgataatgtttataagtacttcacgttgatttatgggtcctttaatttggtactcaacacatcttccttatatgtatatagttattatttatttattttaataactttttcactttaagactcctttttcgttggtaaacaacttgaattagacatttagactcctttatatcatcgacctataactatgccagactattgataaaaagttaaatttttagttcagtaaaatttctcatatattgtttgagtgaaaattgttcatgaatagttttgtgtaaattcgattgtatttatatatagtttacgcgtctctcaacattatatacatatcatggttgtttagtttagatttttttttattttttttttgaaaatgatgtgctcatagtttgtttcgtgaaaaaccatgtacttttttgataagctaaaacaatttcgattattaattcataagtttgagattgttactagattaatattaatattttttcgttatactttaccgtcgataaaaacttttatttcctttcataattcaatatgcatttctttattacaatgattcaatatgcatgcatttgccgtaaaacttttgttttataagtaatttttatgatatatttatttgaaaagttatctgtctaattaacaacttctgactatctccaaaatatatgcggtatataaaatcaactactttattttacttatttaacaccacattacccgccaagtttaataatatgtaaacttatttaaaattaatagctaagttacgaacgtataattaataattgtaatatgtaagctatatgaaataacttatataaaaaaataatcatatactattgaactcaagaaaatccaaaagacattatcggaatcagtaatgtttgtttcctcgggtctagatttggactgcctctgctggttttcacgtgcttgctgctgcaaatccgattatagaggatacacaaacacaaccataccgttttttccctcattattttaaaagttatatattgattattaattatatctcataacaggtcggtatattatataaattactcatgaatcatgattccccaccggccaacaccatctagtttattattctttgtattatttagcgagatcgagagaattaacaatgatgatattattggaatatatctcattttaaaataaaaagtcatcgaaagaatacctactttttgtttatgtgcctctcatccccggccaatccaaatcattagccttcgacttaaattataaaatgttctaatttttgttttcttaatctttttgttgttttatagagaaaaaatgcgtcttcttctctacgtttgaagttacaaacttacaatgttccttcttctttttgtcgtcaaagaaggtaaattcattagataagtatttacaaagtttgttccaagatactacggattacattgagtataagctctttttgttaaggtatatggatgctattgactaagtttacacttctagtgagatagaggaagttaaaatcatgcattaactacatctaaaagatgtcacatacatatgttgagaggtaatgatgtcaacattcttctttgtagtcgctgctttttctactttgtatcatttcatatagtataaaattaggttgtagagccccaacataatgttacttgagtatatcctaggctccgaagttggtgcactaccattcttaagcttagagtttagctttcaatggggagtgaatcggttccacttgcatcatatatatactttaaaaagatgtgttcacttcctcctatgaagcgacaaaccgatgccaacattttgatctggagatttccaggatgcgtcaacaaatcagacaataaaactaattactcattagagcttatagctagccctagagacgccattaaaatgttagcgggtgcaaattgctagaacaagaaatcaaacttggtacctcatggattattagggtgtatgtcaaaccattttgccactttgaatactttggctagtgtaaaacagtatttatattactaggtgcaagtgcccccacattactcaaaagtgggtctagtccacccataaataacagattatagtatgttttagatttttttttgttcataatatctgatgtttcgaaaaaacaattcaagtttctatgcaaaaatattaaattaaacagctatatgattgtttatattctgcaataaattatatcattggtcaaaatatttttaatagatattaatttatgttttaatgttaaaaaactcaaaataattattttcttaaactttgtgccttaatctaaaacatctatatttttgaaacagagtagtctttttagaattggagttcttttgagataacttggtttctgatggtatctaatatactaattcactaacaaacaataagtattcccctttctgcctaagttcggctacattatagctttttcttttcatcaaatcctgatccttagcttcttaccaaaacaaatcctgattcttagctacacacaatacaatactctaattccatccactaatttgatacatgaatttttatatattattttgttaccctttatatcaaaagccataaagggacaattcttaatcagttttaagacgttaaaaaaaaaaagtaatataaaatagatttttagtcaaaagtcctatgccacaaatgtcttatataatttgattccttgctggtgagagtcacaaaacccaacagacttcacactttcactttcattcgctttttcttctctattactgcaatcacttgttcacgata

SEQ ID NO: 2468 - DNA, 3000 bp, Unknown
  misc_feature (1)..( 3000): cDNA_ID_2162432_gDNA_ID_1620542_Annot_ID_160058 3000 nt of promoter + ATG
atataatcatgccattcaagccctatcgaacacagagaaaaggataggatggaagatttttgctgaatctacaagacttgagaaacttacctttcagaaacagttttctccagatcgataaatgcaccaccacaaataaaaaggatgtcttttgtatccatctgcaatttttattttccaccaagaggttcagctttttcatgaaccgagtattgtggctaactgtgccacaaaagggcattctgacatgcacaaaagaaagcttgaaacaggcgattttcacgcatttacctgaatgctatctcctcgaggatctctccgtaatcctttctcgggaatcgggacactgaccacctgcaaattagtaattaacagaagctggacattgtaatattttggatcacctagaatggcaaatgctatgatgagattcccagactatattgtttcctcataatgtttgctgattagatatattatcaaggcatagagtattcctaatcgtttctgttaacagtctatatgcagttgagttaaattaaagatttcaagtagaaaaagcttacagttccttccagcaattttagcaatgactgttgaacaccttctccagagacatctctaccaccatttgagctatgagactgacagcgaaaaataacttgctaaatattgagtatcaaccaattcagaatcaaaagtaaagagtgaagaaaactcagaccttcatagtcattttatcaacttcatcaatgtacacaattcccctttgagcttcttctacattgcacccagcttcctgcagtaacaaagtaaagcggttgctaattagcatctaagaaagaaattaacatgaatactgcaaataacaagattttccgaatactaaaatagtggatcaagaagaaagtggtgagaagaaattttttttttgaactgttacaaagacaggaacaaagtacatttgtagtttcagacgtagtcagcgaaaaactatttcgtaagcagttgttaagattatattacaaatgaaggtataaacaaatatgtaaaaccagagacataatatgaggtgatagtaagacataccacatatagtttgtacaatattgattccacatcttcaccaacataacctgcctggacaagaagagtagtttagttatgctaagagcaagacttgtgttaagattcctctaaaaagcaagaaaaacatcatcacttcattcaaaatatttttcgaaatgagggattgtaaggcatccatcctagtgggcctaatgcttccctaatgtacaacatactaatgttctgagtacccaaaccttaagagggataagtgaaacaacttgcctgagttagtgaagtcgcatcagcaatagcgaatggcacattgacaatacgcgccaaagtttttgccagtaaagtctttcctgttcttataaccaagcaagaaacataaaggccaagatcattatcatactaaacagtatctccaaatactctccaaaacaatatggcaagcaacaatatgcacctgaaccagtaggaccaagcaacaacacattactcttatccaactccacgtgatcaatattatcatcctccatatcaatgttatatgattctgaagcagacctgttattaaaaaaagagcaaaagaatcgagctttgttgtatcccatataaagtatcagaatgataagagcatggaagaagacaaacccttttttcctagaagcatgatatattcttttgtaatgattataaacagccacagaaagaacctgcacaaaaggaaagatatgtaaacaagaatctaatttagacacaaagaagaagaagctagggaccgaaaccaaaccttcttagccttctcttgaccaatgacaaactcatcaagcccttgacaaatttccttaggagttggaagcttaatcacagattgcttctctttatcaccaccattactttcatcctcctcctcatcagcatcctcaccatcttcatcgcttctaagaccttgaattttccaattcctagggaaagatttctgatcatcatcatcatcatcatggtcatcatcagttcctttaactttcccgagttcaataaaactcccttgtaaaggagagagcttgaatggtctaaagtaaaaagctgttttgcattgagaacagaaattaacagcttgatagatccctggttctcttgctgttagagacaatggacgatttgagaagatgacgtgcatctgagcagagcaacgaggacaattgacgtcacttctgatgtgatcataatcatctccgccgccacctccgccgccgccgctgcaggagtcccaaatacggcgggagaaggaagaggaagggattagggtgttggaagaagggcgtagaagagggatgtgaggaggagaatcaacggagagaaggaatctgaaactgcgagagagaagagatgatgatgttattgtcttcctcgagacaaatctggaaatggataagctacaaaacatctctctctgttgtctcgatgatatgattcttcaaaggtttttgctcagatttacattaacggcaatcttaaagtaagcattctttaaaacggcgtcggtttagctcaagtgatggcagaggtgaaggataaaggaaagcctccgtgcaaatgagagggtttctgttttgccgtttactagtaaaaaatccagtaaaaaaaacccagagtcgttattttatttattagttttcaacaagaaaattcgtttgtttaagcagacgaaaaagccaagctaccgtcgttggctaaatcgctctggttgccaactcgatcatcatcttcttctacccactttctctatctgctctccgtatctaggagctccctcagatctgtgcttaattctccggtaacattaccggcatcactgggattgctgatctggaaccgctgtgaaattttaggttttctctgagaagacaggcaagtttaacgatg

SEQ ID NO: 2469 - DNA, 3000 bp, Unknown
  misc_feature (1)..( 3000): cDNA_ID_2162440_gDNA_ID_1620542_Annot_ID_160060 3000 nt of promoter + ATG
agcaaaggttgtgctattgtcggattttatggatggtataagactgggtctgggtatactacggctcttggtgcatattattatccgatgcctctacctccttcttcggaaaagctagaagcacaaggtggtgctggaggagctccttgggatgatggcagtaatttcgaaggtgttagaaagatatacattgggacaggtgagattggtatcgtttccatcaagtttttgtacgaaaatgacattcatgagataatagtgggagatcatcatgggaacaagaacctacttcgacatgaagaggtgattactactacttcagcctttatccaattatacaaagcttattgtatattagatctttgatgttattcttttggattatcttgtttttttttaatttagtttgacctggactatccgagcgaatacctcacatcagtagaaggtagctatgatgtagtacctggaagtgaagaagatgaagttatgatcatgctcaagttcacaacaaacatgcgaacatctccgtgttatggactcgatgatgacccaagcttcgtgctccacaaggaaggtcacaagatcgttgggttccatggaaaatcaagtaccatgcttcataaacttgggatccacgtgctccccatcacccactcatgatcatatttttatgacttaaaacgaaacattatcctcctctgttttcaacaactttgatccgtttctcctctgcttttatttcctctgtttttattctctgaatcttttgaacttttgaatgattcctctgtttgagaaagtggatggagttgatgtgaagttagttgtgacttctctctttgattttcttcattctccttctaaatccagtacattcacaaatcaactatctaataaagtactcatcgtgggttagtttctgcattaaatcaacgttaaagatttcatatttaagttcaaatttcctactccacaaggatagttggtttccatggaaaagccagaaacatgccattcacatctgattatcttttactccattccaccacacgtttgtctcttatgttgtttaatcgacaatcttatataagacaaacgttttctacattattagagcatgtgattaaatactgggacgtacttaccttggcagctgcttagaggaggttcgattaaggctttaaacttttcccgcttcgcctgaaataaattataagttctaaatcaacatattatttgtgaactaactgctaggatgtggaggatttatacgcttaataagaataagaaaaggctggaaaaagactgcaacaaaatggagaaagagatgaacggaacaaaagaaagattaagacaatgatttggtataagagtcattatgttgtgccgtgcaacagaactacttaagtcattacttacacttgcttgttacaattcagacacactatatagtagaataagaagagagaagagagatcatttgtggttgaggattgaaatgataccgaaaatgacctaaaatgttagataaattatatataactgataagtggattctctcgttggaaattagaaatgacaagtgacttttcttatataatcagtaaaatataaaaagataaaaatatgatttgtatataataactggaattatataataagaggtatttcaaataaacttgcttcatttgcacaatgtgtagtttttttacttggctctgttatcataatttgttatacaaatatgataaaaataggatttgtatataataactggaattatatatgtagtctatgtttgttcgaccgaactttgtttttttctgcttaggtcatttatgattgtataaattttagacccgtgatatataaaatggacttaacgaagctcatctacgtaaaacaaaacctaaagttttttcattcgttgcgctacacgatacgtatactataaaataatctatgctcacagcctcacatgataaagacatgaaaccaaccgtcagagtcggcggctatgacaaaaacaaagctaaactatgcaagtagagttccgatccattatttgtacaatgtgtagctttaaaaattgactgttggatttttcaggaaagtctagtcctttaaaataataatttgttaacatactttaaaaaaaaagttttgatatggctatatatagtatgttaacgactatagaaacatgagtcttatataattattagattttgatctacgtaagggcatatacaatacaatatgaccggaagatgacttaagaaaacccaaataatatacagttggttccactttattgacaaaaacttgttccatattttattttatttttgggaaaatatcttgatgtcaccttttggagttcttaattatttgaaattaatttatcaagtggctctcaaaaagaccaagagtttcaactactttaattttttactctttttgtttgtttactaatgtcaatattagtttaaagtaaaatctcaacattttcttaaatcagacttttttttttcttttttttttgtataattcttccttctcaaaacgagtaagaaagttttaaagttttttttttcttttttgaaaagcctataaatagatactccttcatcttttggttatagatcaacatagcctctcagttcaatcagctgcctctctctcctcgacgatcataggtcagttctctcttttatatatggtgcttttatttacagcaatgtttcagaatcatatttaaattattgcatacgtaatgagcatgttcataaaaatgtagagcatcgaatattcaagaaatgttactttatagataatagtttcatccgcttctttttcaccaaaacaaaaacttgatcttcttcgttcaacttagaaattttacatgttgatccttggttgaaaatggtatatattactgactaagaaacacatacaattgccatccatatgtgaagattcaaccggtacgagatg

SEQ ID NO: 2470 - DNA, 3000 bp, Unknown
  misc_feature (1)..( 3000): cDNA_ID_2162553_gDNA_ID_1620543_Annot_ID_160070 3000 nt of promoter + ATG
gatcgcaatactagacttccaagatccaatatttaatctatacatagctagatagttaagagttttaaaaaaaaaaatctaagaaaacgataaaatacgagtaacaagtgaaatgaagcaatgaagcgaatagaaaaacaattaaaaaagaaaacaactaaacttatgagattaaaaaacaatgaaggacgcattggatcaaaggttatgcatagataaaaaataactaaatatcaaacaattacggattaggttgaactgaacactggcttagaaattagaagatggttctcttaattatgattaatccacccgcatgaagctaataaactatgctaatcacttctaattgctaaactctcatctaaaaataaataattacaaggcaatgcagagatgtccaatattaccttactaattttcttagcctcttaacattaattttccatggctcaaaccttttaataaacaagtgcaacaaaatgtcaaaatttcaaacttgaaagactaagtctaatatattaataatctcaacctaaatgaagaatctttttaaaagcaacataaaatcattatccatatgattcaactaagtaactattcacttagcatgattaggaaaagaccaatacgtaataaataataaaagacatgcataattaaagatgagactagaatttcttctctagttgtctagtaaaagtagagatcctcatctcaatattagaaacaatagtccaaaagtagtattcatgattatctataacttttttttggtagcgttgacttgatattcttttcaaatacatgtatcgttaagttcttataattcggttcttggaaattgaaatgcttaaagacgccatgaatataaataaggtaggacacaaaggagaatccatattataatgacaaaagaatatctatgtcgatacaaaaacaaattgatcaaagaaataatcaataaaaaagtagcaccattaatactatataattaaaggtaggttgtgaaatgattatgaagatacataaaccatgttggttaagggtcgcataagaggcatgtgattgtattattaagggtcgcatcttaactaccaccccaataaacacggcttccatttcaggacatgtgcgctctttactttcttctttttttggccatgttactgttatattcataagcttcaaaagattacatgttttattttgctcatatataataaaagcaaaatattgcaacacctgaaaacatttattaaattaagtctctataactatataagttattttattttagtttgactttcaaaatgataaaataaaaaatgttagaccgctttaacataggaaataggaaacatttgttttccaacaactttttctctaaaacattaagaaaaagtagtttatttcatatcttatttttttagaccatcgttttggatttactgtacggtggtcatgtggttaaggaggatcaatgatagtagtaattcgtagaatagttaatgagttgttgtcctttgtaatcatgcatattcggtataattataattaattagtatggttgcctctttaattatgtacttggtctaggaaacgaatcttcagcctgggatatactaaaattttgttgtgatcttttctcatatgggctgttgaattctctattgcggcatgtgcgttttgttattcgacctttgtttgaatggttttttttttttttactctttttgaatggtttaaatgtagcatatgtgatatgtgaatgaaattttttggatgtaggcttgcacgatatagctgtttggacggatcacttcgatagacaagatacagtaacgtctttaatttgggtctttttgacattacatagtgtggtcacgatacctatgacgacataaatttttcaaaacaaaaaaatgacacaaccatatgagatttgaggtccgaagacaaagtataaacaagttgtaaaagagacggtcaaaagtcaagtaggttaacaacaagattcgaagaagtatttaggttagtaacagttgctaaaatttataaattgaaaaatagcaaaagaatactagcaaaaaattggtgaaaatgtaactaactaattatgttagttttaaaaccaaaaaaattaatacaataaataattatacaaaactttcaagatatatatatatatatatatatgtatataatctaataaataacatgtttatatagcgaaacatattacatatatctatttgatgaattagatatatgaaaagaaacatgatatagaaaaagataaagctctatgtaaaactgaaatcacataagcaaacatacatacataatttatttcatttttattttttacattggacgtttaaatttatgtatgaaaaacatgtaacggataaaataattatttgtttgtaaaagctaaataaaagaagaaaatcgtcttcaaaaacatgatatatcacatagatcaaaatatcctcttgtcattcatttaattgtactttttcaaatataaaatgaaaatcgtccaaaaaagaaaatcgtccacataatagacttcttcaattaaaaaaaaatactttttgttttcgacattcgcgtcatcaaaaagaaatcccaagaattaaatgcaaaatccagctacagtataaatattttaggcttatatatcggacccttgagaggaatcataggagaagaagcagagagagagagtccaaacttggaatctggacaataaagaaagaaaaaccattttaaaaatctttttatactaaaactccacagatctcccattctgagatgcagagtgataataacaacaattgagaccaaagcaaaatccgaaactgtcaccgttttcctttgtcttcttctctgccaaaatctttcaatctttatcttcttcctttttcttgtttttctaaaactttctccatcttgaaaaccaaaacaacccaagattaataatatacaccaatg

SEQ ID NO: 2471 - DNA, 3000 bp, Unknown
  misc_feature (1)..( 3000): cDNA_ID_2162573_gDNA_ID_1620543_Annot_ID_160078 3000 nt of promoter + ATG
ttcttatcaccggttaccggcggaagaagagcaaaaacactcggcggggacaggggaaagagagggacaatctccgccggtctctggtggcggtgaagagtcaggacagatggcgggaagtggaggagagtcgtgtggggtatcaatgtacagttgccacatgggtggctctgatgttatttgggcccctacagccagagctccaccgccatactaaccaatccttctttcacaaatctctttctttctttttttgtttttttttgttttgtgttaggatgaatcaagaaactagggttttttttttttgcttttgatcatgaagaatcgtttgcttttttatctacttagattttatttttgtatcagaattgacatatctttccacggtgtaatctctctcaaaccttgggtttatggttttctttagcttgttgcggaattaatttgatttgactcatataaatatgcttccaagtgtcttcaatcatattctggagaaatttaaatatttatctctaatgattgttttcattttaatactcttattgtacaattatgcttctttattggatcttcaaagtgtggtataattaatacgtagcaattagctataacgtttaagaaagctggctattcttgtcttccacaccacatatttgactgcttctcaagaaagcgggctactttatcctctactacaccatcaaccttacaattttggcggcattgaccatatactttttgttcccataacagttaaatacaaaaagtaaaaaatgtacgaatcgttcgtcatatcacaggtttgcacaattgcttttctttccaattactcgtatgtatttattaaaaaaatgtcatagacttaaccaaaaggataaacatgttaataagatgcaagtatgactactccgtgagagagcgcgaatttgtttttgtgtttataagttcaaaaaaagacaataactatccagatacgtggtcaaaaaaagacaataactatgcatatacgtggtcgtgaagcattgatgggatactgtttggctttgtctgaatgtgtcttgatgtttggattcatgtccctggtctctctcatatatccagaagtttcaagactatacaactgcaatgtctgcaaaaacacacatatctatatatataaacacattcaatacccacttgtcttttcagtgccctctcgctttttttacatgggggtttgggtttgaaacttcaggaaaggagaaagaaacgtgaactaaattcgacaaccttttctttttggatgtccattttcctttccttttttgacatcagccatataaaataataataagtatatattttaatttgactctatcaagtatctactaaatatgtttcaattagaatagcaccaaaaatgattaattccgattatcccaaccggggggaacatagtccacgaaggtaaatttatgaaaacgaagtctagtactatcatcagatatataattaaaccttagagattaaaactactggaatgtaaaaaaagcgcaaaagagtggaataaaatatcaatgataactcttctaaataagtcgaggatgcaagatagtcgttcggataaatgctcttgttatcgaaaattgttggatgagtgttacaaataagaattcaacccctattcatatcaaaatgaatccgaaacgaatggtaagaagaattcaatcaaatggtaattcagaatgaaaatctaaagtaaactaaatgatcaaaattaaataaggatgacttaatacgtgtaatccataatgatcaaattgattggggaatattaatgaatataatcatagttggtccttcaaaaaaaaaatccaaaaattcacctcaagcctccaaagttccaaacccatgtagatgtctctcaacaaacccaacccacgaaacaaaaagataaaaatctcaaagcccgacccaatttattcgataagacaagaaaacaagtgttattatttcttctgctttctcaattatggtctctgtccaaaaagattatactatagtaatagttttgtgaagctttttttaatagcatagcaattcgtagaagaaagaacaaccaaatgtcaaaaatcttgttttaaaaaccaattagtttcacgtcacagctcacacataataaaacaaaactccattttttttttataacgtgaaaaacaaaacaaaacaaaacaaaggaagagaatttgcgcgacaacaacgatcgatcagtcgtcgtcttctcagatcttgttcttcaaaggattctatgccgcaagagcttcgattgtatcctctctgaggattgggtaatacccaataccatggataacaatagcgagcgcaaaggaaaacgaatcgataaggataatattcgtgtcaagcggaaaactttgcaagctttgctcaatgattgccagagagccctcgagttattaaacttagccgaagtcagttctgaagacgatgaagatgataaaagcaccggcgagggaagtgggtcacaagagagcaggggagaagtttcttcttccgatcgagaagatcctgaagctgatgaagtaagtatatgcatctctctgaagaggaattgtgaggaaaatttgcttcaagctttaaagttcggaactttttgtttatcaaataagtgtgcgttgaattttggtgaatgtgtatacatcaacattttataatgatgcgtcatatgtttgtaatgatacaataatgtcatgactttcttcttccttgtttcagttatatgatctcatcaaatccagggttgaatgtgatgacttccttgaaaagattgagtcagcccaggtttcagcgccgcaacatcttgctggtgaggactataatgttttttttaagcctgtttgctcattggttgtatagatgattgtgatttctggtgttttagaagatagtagctcttgggatgtagttagtgaagatgatctttgggatgatgaaacc

SEQ ID NO: 2472 - DNA, 3000 bp, Unknown
  misc_feature (1)..( 3000): cDNA_ID_3068058_gDNA_ID_1620543_Annot_ID_160080 3000 nt of promoter + ATG
gttttacccggagttatcagtctagtggctggtttactcatgtgggtcacatcgcttcacaccgtgagaaagaattactttgagctcttcttctacacacatcaactatacattgtctttgtcgtcttcttggcacttcatgttggtgactacttattcagtatagttgctggaggaatctttctcttcattctagaccgcttcttgaggttctaccaatcaagaaggactgttgatgttatctctgcaaagagtttaccttgtggaactcttgaacttgtcctttcaaaaccaccaagtaacagctctgttttttctctgtagatgagagtcctctacctccaatctagagcatttactgaccattttcctctcttattctaccagatatgcgatacaacgcgcttagctttatctttcttcaagtgaaggaactgtcttggttacagtggcatcctttcagtgtttcatcaagtcctctagatgggaaccatcatgttgcggttcttataaaagttcttggtggatggactgcaaagcttagggatcaattgtcaactctatatgaggcagaaaatcaagaccagcttatttctcctgagtcatatcccaaaatcacaacttgtgtggagggaccttatggccatgaatctccataccacttagcgtaatgcatttcgtctacatgaattgtttcaatacagtaagctttagctttactcaagaaagctttatttgcgagtgcaggtatgagaacctggtattagtagcaggaggaatcgggattacgcctttttttgccatcttaagcgatatcctacaccgtaaaagagatgggaaagattgtttacctggtaaggttttagttgtatgggccattaaaaactcagacgagctctctctgctctcagcaattgacataccttccatttgccatttcttctctaagaaactaaaccttgagattcacatatatgtcactcgacaatccgagccttgcttggtaagtcttacataactcttttgggagctgcaataggccttacttagtttttgaactcttcaatgttccatggttatacaggaagatgggatggttcacaaggtggtgcatccttctgtcaaaacaccatggaccaacggatgttccatgtcggttttagttggtacaggggataacatatggtctggactctatctaattatctccaccattgggtttattgcaatgatcacattggtggacatcttttacataaacaagtacaacataacaacatggtggtacaagggacttctgtttgttgtttgtatggttgcaagtgtgttgatttttggaggtcttgtggttgttttctggcatcgctgggaacacaaaaccggtgaagtggaagcaaatggcaacgacaaggtagatttgaatggagaagaaacccataatccatctgcagcagagcttaagggcttggcaatagaagaagatgtccagaattacaccactattcgttatggcaccagaccggcctttagaggtatacactacaaaattagcggtgtcaagtccagttatctcgtttttttatttataaaattatagaaactgaaatcattcggaacggtttgacacggtttcgttcggttcttgaatccgacttttggtgtagatatttggctcgattcggttaagttaaatctttgattggttcatgtaatatttttattttgtaattgcagagatatttgagtcattgaatgggaaatgggggagtgtggatgttggagtgatagtatgcggtccagcgactcttcagacgaccgtagccaaagaaatacggtcacatagcatctggcgatcggcgaatcatcctcttttccacttcaacagccacagtttcgatctctaacgatgctctcaaggccaaagaacattatggaaattcgaagatatattatcgatgcatataatttatataatcacagtctgtatgtattatggaaacaactttaactaatttttgagattgatgctacttcatgatagcaatttcttagttcttttgagttaataacttaatatataaatataatggtacaacaaccattacaatcgtcattataatcatcttatccatactcaatagtcaatactctcaccttccctaaagtgtggttgaaatcaaactttactctctctaggcctgattataattcttttttgtctacacatacaacttcatgagacttaattataatttcttagtgttcttttgttgacatgtaaatcgtagctaagtctaagtggtacttttatttgttattggattttgtttcggttacttaaaagtgtaatgaagaatttttttgactatatacatctaagtttttccttggactgattataacttgtgtgttcgagattgatacaacttcatgatagtcgattattcttgtttaacgtaacacattgttagatagtgtcatttaccagaaacaatctaacagtgaaactttgcaaatttatctctctgctggatcttgaacgcggaaaccgaataatgtttctttcgagctaatccgaatgatgttgaaattctatatgttcagattcaggtaatgtaagcttatccaataaccatcatagtcgtcataataaccatcttatctatactaaagtagtaagtactctcagtctctcaccttacccttaattgtggttgaaatcaacctaacgtgacactctctcccaagtacgttactctcacgtgttaatgacactctcatttttttttatagttttttttattgtgtactaggattgttgtccgaaggaatctttcataaatgagaatgatagaaacctcaatggtccagaaaattttacttgactcttctaagaatatcttattagtttatctctagtaacgccaccttaaaagccgatgctgcttctgagccaacttctcatcacaacactgagaagtggaaattcaaataaagatg

SEQ ID NO: 2473 - DNA, 3000 bp, Unknown
  misc_feature (1)..( 3000): cDNA_ID_3068054_gDNA_ID_1620543_Annot_ID_160081 3000 nt of promoter + ATG
ataaagtcatccgtggacgaaaaaatcagcacaagcatttaccagcttgacatagtaattgcaacattgatgatgatttgatttgatttgatatttattttgaccaatactcccatattagttataaaataacctagtgtttattttaaaacacatatatacgttgtcttatattctttctttagaatgattatcaaccgtttttctttactttttttggctaaacttcgttgcgtgcttctaatcacgtctatcctaaaataaaataaaataaaaagagagacactattgatctatctatcctatatagtgtctaggttcattggtcattgtacactggtattactataaacaagtttagtagattgcatttctattttcagttaagggtttcggtttagcccaagtttgagtatgtatataaaccgccccatgtatattttccctaagtaatgagaatgaaagttattttggttgtttagtaaaatggtatcatagctaaaagatttcatcaaacttttctcgatccctaactttctcgaaaaatcacttaattttcttggaaaaatttattcgattctcattcagttctgcttcaatcttcttcgcaaatccatcttgtgtcgtctctaagcttcgttcatctcaatcctatgcgattcatataagtgttgtatgttattattgacaaagagtatacacatatatatacttgtacaagggagagttactagggttaagcatttacaatggtttccatatacagagatacggaacatcatagtagtaatgaagtgatcttggattttcctttacacgcttcctcaagatggagggggagctgccactctaatcttgttctttagttcaacaaatcttgtccttgtgagtggtttgtagggcccgccctgaatttttgggggcgtaaaaattttttaagggaaaaaaaaattgagggccaatttaaaagaaataaataattggggaccctttttgtaaagaaaaaatttccaattttttaggggtcacaatcaattgtttctccttgcactgttcggtcctggtggtttgtgtgagaatgtccccgagttgatatttggtgttaacgtgagcgactcggaagatgtcttattgaatgtagcctctgatgaagtgatagtcgatggcaatgtgtttcattcgcgaatgaaaaaccgggttagcgcaaagaaatgttgctccaacgttgtcgcagtagataactgggtttttttccagattcaagtaatgtagctaatccaacaaccgtcattttttttttggtagaatgagggagactgcgtctcccgttttattaaaagaaaattaaaaaattacacttggacatgtctcgggtacgaaacccccgctacatcatctaacaaaatagaactaacaacatcgggcctagactccaacaaatgcaaacataggagtaaagagaaagcatagttcgttaatccatcggcaagatgattagcttccctatacacatgagagattcggactatccagtctttcgataaaaagccatagcacaaacgtattagaaatgacaagggatgagaatccgcaattactctatagtcgtctaggaatgacaagacgagaatccaacaaccgtcatagtcgtcataaaaacaatctcttatctatattacgtactaattactctcagactctcaccttaccctcaaattgtggtcgaaatcaaacaacgtgacagtctctctcaagtacgttactctcacgtgttaatgaccctctcctttttaaaaaaaaaaataattttttaaaaaaattgtgtactaggattaatgtttaaaagaatattttttattaatgagaccgatagaaaccccactggtccagaaattttcttccttttactctcctcctaagaatatcttcttcttaatttatctctagctagtaacgcctccttaaaagccgatgctgcttctgagccagctctcatcacaacactaagcagtagaagaaattcaaaaaacaacatggatgatcatgaaacccctcttttgtccaaggacttatcatcatcatcatcatcatcatcatcatcatcatctgtggtggtttcatctttgaaatggatattgaaagttgtaatgtctgtgatttttgtgacttgggttgtgttccttatgatgtatcctggatcactcggtgatcaaatcctcacaaactggagagcaatctcctccaacactctctttggcctcacaggtaccatcacttgcttcgttttctccgaaattttccaaaagcattgctaatttcactctctgattatcttaaattgtaggaagcatgttcttaattttcagtggtccgattcttgtcatcgccatcttggcttctctctatctgataatctcaggggaagagacggttttcactaagtacgtacggttgagatttcttttaactattctattgatttgattgtgttgcttacaataattaagcatattaataatatatgtgtgtttccgtgattgtgaaggaagaagataacgaaattcccgaggtttaggctatggacatttcctgttcttgtggatggaccatttggagttgtttctgcagctgagtttcttggaattatggtcttctctgtttttttcctttgggctatctatgcttataccttgaggaatctcaacgttcttgactacttccacgtgcttcccaataacagaaggttcttaaactcattttcttctttatcccatcttagctttttgtttcattccaatcattggttttttgtttgtgtgtgtgtgtgtgaacagtatttttctgttggagttaacgggtctgcgttttgggatgattggattgttgtgtatggtgtttttgtttcttccaatctcgagaggctctattcttctccggcttattgatatccctttcgagcatgctacaagataccatgtttggcttggtcatatcaccatg

SEQ ID NO: 2474 - DNA, 3000 bp, Unknown
  misc_feature (1)..( 3000): cDNA_ID_3068042_gDNA_ID_1620543_Annot_ID_160085 3000 nt of promoter + ATG
ggcggtggaggttacggcaaggtttgtgtcttaacaaatgccttcaaatgaatgtaacaactaatggccttagttgaaattcatgatcccaaattttgatggttaaataggtttatagagggattcttcctaatgggcaactcatagcaatcaaaagggctcaacaaggatctttgcaaggagggttggagttcaaaactgagattgagcttctctcaagggtccatcataagaatgttgtcagactcttgggcttctgctttgaccggaatgaacaaatgctcgtatacgagtacatttcaaatgggtcacttaaagacagtctgtccggtaagatcaaacttctatcttcctcatgaggatttcagatagttcttggatgctgaatatgttagtaatgcagggaagagtgggattcgattggattggacaagaagacttaaaatagcacttggttcaggcaagggcttggcttatcttcatgaacttgctgatcctccaattatacatagagacatcaaatcaaataacatattacttgatgaaaatctaaccgcaaaggttgccgacttcggtctctccaaacttgtgggagaccctgagaaaactcatgtcacaacacaagtcaaaggaaccatggtgagtagaaaatttatcctcctttctctttttttctcaaatacattttaaacttacaatatctttgtaatcagggctacttggatccagagtactacatgacgaatcaattaacggagaagagcgatgtgtatgggtttggtgtggttttactcgagctattaaccggtagaagtccgatagagagaggcaaatatgtggtgagagaggtgaagacaaagatgaataaatctcggagtttgtatgacctgcaggagttgttggacacaacgatcatagcaagcagtgggaatctaaaagggttcgagaagtatgtagacttggctttgagatgtgtggaggaggaaggagttaataggccatcaatgggtgaggttgtgaaagagattgagaacataatgcagcttgcgggattaaatcctaactcagattcagcaacgagttcaagaacgtatgaggacgcaatcaaaggatctggtgatccttatggcagtgaatcgtttcagtacagtgggaattttccagcttcaaagcttgagccccaatgattgattatgtttctttttgttattttgttatttcgtaagtgacttcatacttgaaatgccttgtgaatgtggagtagcatgattctgtttgatatgtggtcgctgattataaagcagatgaatggagagccaaacgcagaatcaaaaaccaccagatctttggcaatgtcgacaccagtttcaaacataagaaaagtaatcaagctcaatgtatgatgaataattgaatatattaattcttgttgagaagtttgtgtggtttcaaagatttaatccacacatcacacacacttttaatttactccaaacctttcacatttatgcatgagattatattacaaatttatattacaaataatttgtagtacgtaagtaaaattagtattaactaataagaaaaaaaagtaataaagttattgggtttgcaacctaacacatcaacgatcccatcgaacaacaacagttacatgacccagggtgaatttatggttgtcgtctcatctgagagcactctctgatctagtgtccttgttgtccacacctcaaacacgcccccaaaatgtatgacatgatttaacaaaaaataaaaagaaacatgatttaagacatgtggtgtgtggcaactctgccatatatttcatggtgaggtagcgaaccggcaccaagtttttctcgatatgtttcctccatttaccattctttacggtagactacggtagactcataactttttttataccggagtcatatcgtattagtttcttaagaggattaaagcacacatatgtttttgtgtcttatttactacaaaaagtctttttactaaaacactaacaaaacaaaaataacatacaaaaaaaataagaaaagtggtgggatgtggccaaatagcattagcatacatacgtaggaaaaaaatagacgatgtggtcatatgtcagagtggtcaaggtcccatcccatctctgagttttccgtcggtttggagtatattgatcggagaatatgatatgggcaaaaaaaaaaaatcgattaatttttaatcaatttggggtacactgaaaacaaaaaatattttttttattaatttacttggaggaagtactggtcaatataacatcaaaccatcagcatcattcattgttgttgcaattagtattattatctcaagttgataaaagcttgtgctgattttttccatgaccatgactttattgcatgttgctgttagaaaaaccatatcagtgcatagtcgcttaccattactctatttcaaaaatctctcttttcttgagaagaaacgttctaggaaaacaaataatatatacatgacttctcccagttttgtgcagaaacaattaaatgttagatcatttagttaagttttgttacatattgcatatttatgctttatcatgtaaacagatttatttatgtagttaataaaggactagtctattataatggtgttttgtgccaagtcattgttcataatttgttcctccacattaccgtattgacatttcaatttctcccttggataatacctttgaacccttccgcaatatatagcggttctttattatctatatcaagttgaactatttgtttatatggtccactgtctatttgtttgctttatttataaattttcgcttaacttgttcaaagtcttctcctttatgtcttacatgctttgttagcaaagaacatggaggctgcatttttatgttagagttcgtcataacttgtgcagaccacatgctttcttcttgaacgaattgtgatacatatcattgtgtgtctgatgaag

SEQ ID NO: 2475 - DNA, 3000 bp, Unknown
  misc_feature (1)..( 3000): cDNA_ID_2106638_gDNA_ID_1620543_Annot_ID_160079 3000 nt of promoter + ATG
ttctacacacatcaactatacatcgtctttattgtgttcttggcacttcatgttggtgattacatgtttagtatagttgctggaggaatatttcttttcattctagaccgcttcttgaggttctgccaatcaagaaggactgttgatgtaatctctgcaaagagtttaccttgtggaactcttgaactagtcctttcaaaaccaccaagtaacaactctgtttattctctgttttctacctctaatctaaaacatttactgacttttttcttcttcaataccgcaaaaatcagatatgcgatacaatgcgcttagctttatctttcttcaagtgagggaactatcttggctacaatggcatccatttagtgtttcttcaagccctctagatgggaaccatcatgttgcggttctcataaaggttcttggtggatggactgcaaagcttagagaccagttgtcaaatctatacgaggcagagaaccaagatcagctcatttctcctcagtcatatcctaaaatcacaacttgtgtggagggaccttatggccatgaatctccataccatttagcgtaatgcatttcgtctacttgaaattttttcaatgccataagctttagcttaactcaagaaagatttattgcgggtgcaggtatgagaacctggtcttagtagcaggaggaatcgggattacgccttttttcgccatcttaagcgatatcctacaccgtaaaagagatgggaaagcttgtttacctagtaaggttttagttgtatgggccattaaaaactcagacgagctctctctgctctcagcaattgacataccttccatttgccctttcttctctaagaaactaaaccttgagattcacatatatatcactcgacaatccgagcctcgcttggtacgtcttaaataagtcttttgggagctgcaataggccttactaagcttgttgaactctttaatgtttcatggttatacaggaagatgggatggttcacaaggtggtgcatccttctgtcaagctaccacggaccaacggatgttctatgtcggtactagttggtacaggggataacatatggtctggactctatctaattatatccaccattggatttatttcaatgatcacattgttggacatcttttacataaaaagatacaacataacaacgtggtggtacaagggacttctatttgttggttgtatggttgcaagtgtcttgatttttggaggtcttgtggttgttttctggcatcgctgggaacacaaaaccggtgaagtggaagcaaatggcaacgacaaggtagatttgaatggagaagaaacccataatccatctgcagcagagcttaagggcttggcaatagaagaagatgtccagaattacaccactattcgttatggcaccagaccggcctttagaggtatacactacaaaattagcggtgtcaagtccagttatctcgtttttttatttataaaattatagaaactgaaatcattcggaacggtttgacacggtttcgttcggttcttgaatccgacttttggtgtagatatttggctcgattcggttaagttaaatctttgattggttcatgtaatatttttattttgtaattgcagagatatttgagtcattgaatgggaaatgggggagtgtggatgttggagtgatagtatgcggtccagcgactcttcagacgaccgtagccaaagaaatacggtcacatagcatctggcgatcggcgaatcatcctcttttccacttcaacagccacagtttcgatctctaacgatgctttcaaggccaaagaacattatggaaggaaattcgaagacaaattgatgcatatattttaggtaatctctgtcagtatgtactatggaaacagctatggttgatatgtgtatgtttatctttcagttttcgatgtataaagtagaaatcaaatgtatgagcatctatggtttctagttctacacttgttggtgtttctacattggacatttaatattaattaaatgcaagctgataagtcctataattacatagctgcccatatattttcggaattttttaaagtagagatatattcatatatatatgagggattagattctataattacgaatgtatttaatttcaaattaaaagttagattctcataattctccttacttactctgtgagggattagagtcgtaaaaatgaccacaagatgtaatttttttttaggtcattgatctaccatcaatttgtcggacacacttatcttataagttttaaattttaacaaatgtaagtgaaattttgtggtagactatcattttcaagtagaagtagaatttaagtaaccttccttgttataatttttttttaaaaattatgtcattacttagagcccaccagaaatgatgacgtgtaaaacaccataatcataaaggataaaataaaattatcatcccaccgacagtttattagcggagatgtctttttccatccacccgacattagcccattgctttactagtaaacaaagtatatgcaattttttgttagaaaaaacggtgcataaaaaataatattttaatgtctccgacaaattttaattgtatgaaaaataaatacacaagattacaagttggccaaaacgctcaatcatagttggccaaaaatatactattccaaaattagagttagctgtaacgtaacatgtacaaataaaccaaacaaaacatataataacaaaataattgaagtgagttttaaaaaggaaaaaaaaaaaagagtaaaaaaccaaaaccagatctctcaaagagtctttgtacattattgactagagagagctttttagcttcacatttcttcacttccacacacttttacttctttctctcttctcttctcttctccagatctgatcccaaacctttgattcattgttgttgttctctgctgctttatcagagagcatcatcatg

SEQ ID NO: 2476 - DNA, 3000 bp, Unknown
  misc_feature (1)..( 3000): cDNA_ID_2162559_gDNA_ID_1620543_Annot_ID_160072 3000 nt of promoter + ATG
gtggacgttttcaaaagctatcaagtatcaagagatggcaatttaataatgatgatggtcgatggggccaaaaccatttttgtttcaacacgtcggtccaagaaatttctaagtatgtcaaagttttcgtgttgtttggcaatcttttttataaaagaaagcagtcgaagttttcaaaaagcagtgctctagataaccttaacatatcttaaatttagaccgaccaagatttggaatctacctttgaacataaaaatgctttacacatcgatgacgtgtatatgttatagatagatttagcatgagtatacatatagactaatcagaatgaaacaagtagaggaatttattagtctaagtaagcagttaatgctctctcacctaacaatcagccacgcacatctaactcctaattatctttttttatgtaaaggaaagtcttcataccttactaataaaataataaatatttggttgaaaaataaaataacatgataattaattgttattatatgtttaatccatcaatcaatactgtcttttggtacaaattgtccacaacttcttgaggattttttaagatttaaaggcgtggtcttcaatatttacataagactagagactttggcattgttttttcctactttgatatgaacttaacttctttataataacaaaaaatgaaaagaggtgtaacataaaaaactattcttgcccaaataggtaaatatcgaattctgattacgcaagatgcttttatgttgggataattacaattcgacattagttggttaatggttattcatctttccactcatcatgaaactaaattcaagaatatatagctttatacttgaaacttatgtgtgtttttgattactagattctaattaacgtagaattttctaacatttttcttgtactctgctgccattcaactttaaaaatattgtacacaaaagatattatttctttggtaaaattcaacctagatatcgactaccacgctagttaaagtttttgcatcagttgaaaatggaactccttttaagtttattgatatattactactcttattagtctaagcgttcagattaatgtatcgaagttaatgattattataagagtcatatatacaagaaagtaacgctagctaatcaagagataatgatggtagttaaatgtcaattttgattagagcacgctcgtagacttggttgcacatgccattgcgaaatgttcttgcattcatctattagtttcatatttattatgatactgatgaatcttgttcagataagaattgtacgttctttcaaatggtggaatttgtttgtcaatataaaattttatatgttggaataatcagagagattagggcgtaagatccgtctactgggagtgagtctttcctccgcccaattggcataaatattgaagacaaaacatgaaattttccatcaaattagataaacatataaatagaaaaagagaatcaatgaattttttgttacagtttttaaattttataaattcactactagattaggtaatggttagtgccaaacaatgatcaaactttcaattaaaggcttttaacttcaaaaagtcacatgatccaatggcagttaatatagataaaaatattaaaagctggtccggatctagagaaatgtatggcttcaatccggaactttttaatttgttctaaattcttattagcattacttcagttttaacttgattcaatcattgttgagttatttttcccgcagaaatccagtgcttaaattacattcattagcactatcattcaattaataaaatatgatattgcgttaagcttttatgatattgatttttaattttaaattgctaattataattaatcactaagcatttactgtataaattttgttgaagaaaaaatcttcgtggcattgaacgaaggctggcccaaaatgtttatgggcttaaagtcgaagaaattttgtttggtgcattaacaaatacatttctaaaacatgacatatgaaatgaattaaagtaaggcatgagtgatatgacgatttcatttttcaagaatcattcattcttatgaacaaaagaatgattccccaaccccttcattgggactatttctcactctcttgtaaagtgtactgcaaagagtaattctttaatagtccatatctaatcccatatatattgcaaattaaatattttacctatgaaaacgaagcaaaaccgttttactatttctccttcggctcgagaatgcttatcccacaagtgactttacaactttttttattatttttttttttttgtcaaagaagtgactttacaacttataatttctttattcctttaatttcggatgaatttgtctttagtactaatatcataaatcacttagaactaaaaactgatatactcaagataccactcaaaggtcaatcgtgctaattgaattgatatgctgtttaaattggtattgtatgatataataattaataacgagttaactacaagtagctttatatcgtaattgaattttaatagattaaaaaataataaaaaccttgcttaattctaaaaaaaaagggagcatttagcaacattgaaaaggaagcgttgactaaatcttccacacgaatgggctcgctctgtctcatgcacgcacgtccctggcataacggtgcactctaccacagaggatcattatttcttcttctaacctcagaaaacggaaaagtcgtcgtcttcttcttcgttcccgctcccacgctctctcctcttcctcggatcttccatcttctctctaacagcaaatgactcagtcgtaaccttctacactttctctctctccaatttttcacattttatttttggcttccgagctatgaccccagtgcgtctgcttcgtctcgaccgctgatcggaataaaaccaccgccgagtttcctaggtctatgtgtattgtaatatcctccggaa

SEQ ID NO: 2477 - DNA, 3000 bp, Unknown
  misc_feature (1)..( 3000): cDNA_ID_3068119_gDNA_ID_1620544_Annot_ID_160100 3000 nt of promoter + ATG
aaggtaattgtcctaaaacagagataagcatgtttcagatgtttttgtgagaaccttactatcctaaaacagataatttattttgccacatgttatatagattggcacgtaagagacgttgagaacaaacttgttggagcatcaaatgattcctccaaagaaatttatcagattgggaagactagtgtctcgcggctgacatagataagcatgctcggagcaaacagctagctgcaatgtccaactggcattaggaacaatctaagagacactagccatttgagccagtgagatcaataagaggactagctcttccaatcatcaagcagagctagtaacaagctgataaaggagataaagtcttcttaacggtcgaagcttcaacacccagcttctagaactttgaaaatctagatcaacctctttgatagcgtgatagtcatgtgtgccatgcatacattcatatgtgcatacattcatgcattcatacattcatacatccatacattcatacatccatgcattcataaatacatacatccatacattcataaatacatgcatgcatacattcatgcatgcttacattcctgcatgaatctatgcatatttgctttcttgattcattgattgcttatttacttacattgtttacttgctttcttctttgcttcttttacttatttgatttcttaactagcttgcttgttttttgttctctctgtttacttacatctttaacttgtttacttcttgtttgtacgtttctttgattatttgatcgttgctaactccatattgcttcatttcatttcttaatttgtgtgtttgcttccttcttattcccttcattgtttgctgagaccgaccatacatgcaattcacttgtttacttattgtcagtttctttatttctttgattatttggcattcgcttattcattcatggcttagctcttttacatgtttccttctttgattctttgtttctttacttctgtgcttattctacttgttttattgcttctttcattttttgtttactcacatcattgtttatttatttgtttgcttatatttaaatctatacttctttcattgtgtataaaagattaattttgaatttatacaaaatttactcagataattttgacaacaatatgaaaaatcaaaacactaataaatgtctgaataaccaaactgaacccgaaatataattactatagactggatgtagccaaaaattattattataaatccaaatatatcaaatattatatataaatcaaaattactaaaatacttaaaataaccaaaaaaaatccaaaaattaaccaaagttttttcaaatctaaccaacttttttgatatttcgggtacccgaaccaaagtaaccaaaaccaaacctgacccgcatatataaaatacatgtatggaccctccaagccaaaactctaaaaccataatctaacctgaacttataggcctaaaaatgtatatgcaaacttataaaactttatataacatttccaaatttttattaactgtataataataacactttagctagagatatcccaaaaaaaaggtcactcggatggtataataagatcgtatctatctataagtggacctttgtggcttcattctcagatatagtagttgacacattatacatcagtttaaattatatattaactagataaggatccgctcgatgggcgggtatgcgattggtgcattatttatgtattattgttcgaatagaactgtgagattataataacatctgtttgacacaattaattaattaattaaataatatttactttaaataatcaataatttaatctattgtaatattatatttaacaaaaaaacatttatacaatcaatacttcggtgtgtttaaaactagaaaaaaatcagaaacaaagtttgaaagaaacagagtagtcggattaaagatgtcatgcgggtggagattcaaaaccgtagaccatcatcataatgatagtcgttagaggcttggattgagctgagacggttctagacggttttgtcgattagtttgatttattgagctaattgagagggtaactcaccgtgtcttcttgcattcctctcacaccagatatggtagagagtagtttggaagacataacgaagcagaaagaggttgagccaaggaatgcttgtgttatgaagtattgcggccagctggtccagtttgacgagtagttggatggaaggaggcgatgtgcaaaatctttccaaaccgttgaggagtaggggcatgagaagaacaaatggtctctaaaaatacacttttcttattctttacaattaaatcagtcctcattcccccacacggccacaccacaattaatctgttaacactttattaacgacgaaaaaactaaataaaaaaaatctctttatacatttgacaaaagttgaaaaaaaaaaaaaaaaaaaaaaagaagaagaaaaaggagggaggaccaaattatctcaagaaaaactatggccttgaatgttttgtagattttgtaagagtttttggtttttgtttttcaaaaacttatttttataccattcaagattttaaaattttggtttccctacaatttagaaaaacaattttgttggagtttgccattcatgattttagttttttagttttcctaaaatttagaaaatttaatttttacttaattaacgttatttttctcaaaaaccaaaaactaacttttttttgggttttgaaacaaaaatataatatcaaaaatctaaaacgaaaatctaaaatctataaactaaaatctaaatccaaaaactgaatcgaaatacagcatccattcagggcctttataacaaaaagccaatgagaaaagtctgaaggaagagaatcgtcaacaaacgatggctatacaacaagaataaatacatcacatttttcagacaaactccaatttcacagtgaaaataaaaacaatg

SEQ ID NO: 2478 - DNA, 3000 bp, Unknown
  misc_feature (1)..( 3000): cDNA_ID_2162697_gDNA_ID_1620544_Annot_ID_160120 3000 nt of promoter + ATG
acgaacttaatggtaacacaagttttttgaaaaaatgaattgtaattgataattttatatcttaagttttcaaaaagaaaaagatataagagtataaacaacccatccaacttaaattaggttttctttaagacaatgctttttgttcttttttggtataacccacattaaaattccactaatgacaaatttaaattcgaaatgacataaatcatgaaacttttatatactaatattaagtggaaatgaaatatgattcgtatatactcatatacatttcattataaaaacaaaaactaattatatacatttgatgcgcaatatttttttggttagctttgatgcgcaaaatcactactatagtaggccacatcaaataaaatcacaataaattgaaaaaaaaaaaatggagacagacgcttaaaattgtaataaattggtgataacattttgtctagacaagtttaagcccacgtattgaagtcatcaacatggcacgccaattttgtttttctaaaattgtcccaaaacccaacatttttgaattatatatctctcagaaaacttgcgtggtcatagaactttatgtgcacatgcagatataaattgtagaaaaaatgttaaatgacatggattgattcatcatttttcatcttgatcgggtattatgcggatttcacatttatttgtatattcaaatcaaaataattattttccataaattaagttagtatgttttatttggggaaaaatgttatttaatcccccaactttaaaagaatggccattttatacatcaacttcgtatgtgaccgtttaaaacatgaactaaacgttgactaatttttaaaacatgatctttcgttgaccaggccaaaataaacatgccgttatcagtcattaacggaatttctaacgtccgttatcatccgttaactttataatcaagtttcaaattgtgcccattttaaacatcaacttcttatgtggccatttaaaacatgaactaaatgttgactatcatttaagacatgaaaaaatcgttgaccaggccaaaatagacatgtctttatcagtagaacctagaaacccgttaatgactgttaatctgtccaaaacaacgtcgtttgagaataatcgaaagaacgtcgttttaaaaggaatcatgtaagcaaattgaagactcattataagattgttcgtcttgtttgagagttgtagaaatagatttggggaactgggatttcatttagaaaataatcctgattttcttttgattattcttaaaacaaagtcgttttagggatactaatagagtcgttaacaagtgataatgaatgttataagttcttttaatgaataatgacaacatgtttattttggcttggtcaacgaatttctcatgttttaaatggtagtcaatgcttagttcatgtttaaaatggtcacatataaagtcgatgtttaaaatggccacaatttaaaacttgactaataaagtcgttaacggatgataacggacgttagaagttccgttaatgactgataatggcatgtctatttttgtctggtcaacgaataatcatgttttaaaagttagtcaacgtttagttcatgttttaaacggtcgcatacaaagttgatgtataaaatagctattttttgaaagttaggatattaattgacatttttcccgttttatttgaagtctttctttcttagttagtctatcatatggtgtacataatttagttcgaattttcaacctagtggttaaaatatactaataagttggctaatattaaatggcactgacttcttttacagaaagaatattaaataacgttaccgtactttggtaacgtaaatagaaataacaagtgaatattagtgatttttcatcttataccaaagattcaccttgggaaaatacgtattatgagggtaaagggtgtattttaacttcaactattttaacggtgctttttcctacttataccataagagaatgtttatttcaaccttaactattaacaaaatttaaattaattatctcaactcataataaagtgctaaaatctatattgactaactttgacgttagttaaccgttaaaaaatgctgacgtgacatgatagatctgatttggcatgacacatcgtcagctatttaaacgttggcgttttgatttgttaagaattaagaaaaaagcaaaaaattcgatttaacggggattcgaacccaggacgattggatgcataaacaatgatttaaccagttggactgcgagatatattcaatacaccttcccaactcatttatttattacaatgtttccgtttttatcattgttttctaaaaatgcttttaccaaaaaaaaactctagaattttgctgaaattttataaaaaaatataattatttcctttaataatgtttgtaagtaataaattaatataaactgtttcaaaaaaactaattccgtattaatttagatatatccttaactaatatatatataatattatttggtaatatatataatattattttgtaacattctctttatattaatatatatataatattattttgtaatattatttctctttatattagttagggatatatcttagttaatatgaattatttttttaacatttttattaatttattatttataaaatttattaaaggaaataatcaaatttctttttataaattttcagcaaaaatcaggaggttttttgtcaaagtgtttttggataacaataataaaaacgaaagcattgtaataagtagatgtgttcgaaggttagccgaatatatctcgcagttcaatcgtcccggttcgaatccctttagaagcaaatttttttgcttttttttaacaaatcaaaacgacgtcattttaaatagcagatgatgtgtcatgccaaatcagaccccatcatgcattgtcagcactttttaacggttgactaacgtcaaggttaatca

SEQ ID NO: 2479 - DNA, 3000 bp, Unknown
  misc_feature (1)..( 3000): cDNA_ID_1532708_gDNA_ID_1620544_Annot_ID_160125 3000 nt of
gttgaagtttagatatgatgtatcatgtttacacttatataatgttagtctaaaaaataaaataaaaaaataataattatcactatataagttattgccattctgtctaaattttaacaggtcagtgaattaaattaatattattaacaataagatatgttatcatgtattatcaataagaaatctactaagacatgttatcatgtgcgtaggagttttggcccaataaatgcttgtgcactccaagaacatcacaaaggatgagaatgagatgcattcttgctcttcgatttcttaataaatgtataatattgacttttcttggttcaaaagtttgtttttatctgttgcatcttgagtaggaagagatatttttgctatcttggatccacctaccaatcttgtttctgaccattctttctattcgtttgcaatttggttgctgctaagttggatcaaaacggctttattccatagtttcaaatgcctagtgctactggcaagataaagcgaaggaaagtacgcagagcttagagcttagatcttttcttagttttgtttacttacctatgatggagttttataggagtacgaataacgcatgcaagaaaactgaaccccttatagatataaagatgtacctttaaaaaataaaaataaaagatgtaccttgacacatagactaattggaaaacttacaaaaggcgtttttttctgtgtttttttgattaaaaccacaataccgtaccaatcacaatacttttaactgatttgtgtttttcgaaaaaaaaaaagtttgcgatttaatttgtcaaatgaacaatacattggaacgctttccaaaagaagaaaaactctttacctagcggttttaagtaaaagtgcattccaacaaagagatcaattaattttttaacagctgtttatattattatttttgtgccaatgttgatttcaataatagaggaaactaaaccggataaaccgggtacaaagaaagagataaagaccagtcttagctagtttgttttatttaattaaaaactatgaaaatgcaattacaggaaatagaaacataacaatgcttttagaaattttgacaattattatctactataagcttatatacgttctataatcaatttacttgtaaaaaaattacttgtaaaaatgattttttttttaattttccataatgaaactattcaacggatttaataatatgtatgttaaactttaaaatgtatattttgatttatttgtgtatatggtttataaatatatgttattgtttatttattaacacaaaaaataaataatgattaatatatatatttatatatatataatctataatccgcaccacaaatagatttttcaccaatcaaacattattccgtactgcttattttgtacaaaccacaattgtcccacaaatatatttttcacgcacttaccgcagttaattcgtactgcacggtcataatactttctccgtacactaaaaaccgcggtgaccattcagatccatagaaatcatccatcgtaactgtaacgagacgacgaccaccacttttcatggaccaaacgttttttctcggtatatgggccaatctcgtctgacagttcatttttctggaagcttaaatatttgtttactgattctataattcaccatataatctttttcttgtgtttgttttcactcatacgaactaacaatcgattcacggttaatcacccatcataagtttgctttactttaaatgcgcttaactttagagttttctttagatttttaatcaaaaaaaaaaaatagtgcattttaataacatatatgaccaaatcaatttatttaaattttccttatacaccactatatttcaatataagtagtaatatagaagagagaacaattaatttatgcatgtaaatccacacaatttttactaaaataaatagattagatgagattcttgtaattataaaaatcgtgtttactactacgttacaacaatctagacgtaaaattctactctttcttctatcgatgtgttatagattgatcgacaattataacaatcttgaacatacatgatatagagtttaaactctagacgtagaattatatctggacaagtcaggagctaagccacaatgtgttgctctagttatagttatagtacttttcttaagttagaaacctcaattgcttgaaagctcaagctcttgcccattgcccaatatagaactaaaaatggtttcaatggataaagtcatataaaaagctttatattttcttcttatgaaattctaaataattagtttaaggaatggacaaaagcgtcatcagtgatgtgataagatcgtcttatcgcatcaacagaatggatgggaaaccacaagtgaaatgtttctggtcaaattgaaacttggagaatattaaagtttttgaaacagaaagatttaataattatatcaaatctttttaaataaaaataaaaaataattatatcataagaaaatatcttcataataacatcttaataagtatcctattgagttacgcatctttgtaatagaaaccaaatacaaaataaaccaaatcaaaatttataatatttttttggaaccttgatacattatggttggttcaggtctacatcagattgtatatatatacttaattataaaactgacatattattatattttccttcggataatctaattaaaatacattttagaaaataatattttgataccaaacagtgaccaattattggtgaataaaaactataataatatttgttcttcatcttatacaaactagtataagagcttggttgctcaaaccattttctcttctctctgaaaagaaactcaactttttttctttatctttaacatcaaaaaactttttcgatatctttacaaccattaaacaaaaaatttggccactacaagttgaaaaagttttgattatatctaatcgctgaa

SEQ ID NO: 2480 - DNA, 3000 bp, Unknown
  misc_feature (1)..( 3000): cDNA_ID_2162693_gDNA_ID_1620544_Annot_ID_160119 3000 nt of promoter + ATG
ttaacatgtagaaccgacgaaaatcaaaaaggaaggtgaatgttaatatgtaagagttggaccaaagaaaaattgtcaaaatgagttggaatctatcgtaaaggtcactcaagaaattgaaataaatgcgtatcagatattagtggatgtgatagtgatactgtaacattatagatttttttccccctttctttttatatagaaagtatttatcatatactcctatggagacatgatttgcaatagcatttacattcataaattatgagggtttgagtgtttgagacagacaatatagagcttaataaataatattatccggataataaagttagaatctaaatgcaatattttttggtccaagttttactgcacacaatttatttaagaagacatatttattgtatgtctggttacttttacttttgttttcttaatttgttagaaattggagcaacattgtattcggagcagaagaagtggtgaagaacggttgggacttttcataaaactgtagatgtgtcattggacaaaaatgggtacagctgtttagagagaaaaccaatatatatatataaccagacatacatttaaaaagtatactccatccatttttaatacatgatgttgaaggtttttgaacacaaatttttattattattattattattatactaaaactttatttattatctatttaaatacgatccaaccagtaataaaataatatgtaaaatataaatcttcaaaaccaataaaaattaattaattttgtattgaaagttgaaaacatcatataatttagaacataatttttcacttaaaacatcaagtataaaaaagtgtctatataaaaacatagaaacccaaaaaagaaagcacacaaaaacttcatctgctaaaaaatataatataattgcatttcattccataagaggattttaattacaatttttatgtaataaatctacattagaaaaaatttcatacacaattcttatgatatatattattttacatcgtagctagagaatatctatcttatccaaaatcaaaattaataaaagtatgagatagaattatgcttaagatttgatacatatagctgaaagaataaacttatgtttaagatttctatttaggtgtgcaacaatttaaatatatatatatatatatatatatatttaatatattgtttattcagttgaaaaatgtaaaaagcattatataacacaatgagtaatagtcacaacttgcacaatatgtatatagtttgctgatgcttttgttggatatatattaattctgaaagtttgtaaaatgattgaattacgtctgcgttatataatcaattctaagtcataaaattaagctgtagcgttatgtattaatttgagattgaaaatacaaatacataaataatacatccatccgtctttgaaataaaaaatttaggtttcttataattgtttccataaaaattgattccttagattttctatataatttaaatgaatttatgttaatattttgtagactttaaaaaatataatgaattactattggttcgtaaaaatggaaaaatgttttagtgtaggaaatgaggcatgttttaagagttacatgcatgtttcttaattgtgtgataactttatacgtaatttataatttaaatttaaattttgtgaaaattataaaaaatacacttatattaaacaaaggaagtatcagtaaaattatttcttcctatcgacgagtgtgtttacaagagtgttttactatccaatttcaattgttcttttttttttttttttgaaaaagggttcctctaatttccattgttgcacttcaattattttctctctttgttttttttgagcaaaagttttgcatgtatattgaaaattttattgttttctaaaataatattaaatattttcaatattttcaaatcttgcaaagaaagtacacttgtactataacatcgttacttagtgatctgtcatgtgtgacatcagtctttcgatctcgaacgcgagagatatgtccatgcatgcatgcatgtgatcagtggatctgtactctttaaaaacataaccagtttcgtaacgacaaattattacagaaacaaaacaaaattgtaataaatactgatttcaaacaaccaaatgacacatgtgcaaatactctcttggaatgatagatgtatatatatatatatattataatatacaaatggtagaagatataattgccaggttttgaaactggcttctaaaatggttacaattaacatgagtacttgttacttgtatacatatcattgtttagaagaacaaaaagttgcttaaagatatctctagaaggggatgtaacaaaaattgttttgtatttggaataaacttctaataaacttttctaattgttgttcgaattgtcatgttattttgttattcgacttcttgagtacttggacccaacattgaataaattgtaatcaaattatgttaagccaactttaatatctacattttatcgcaatatgtaaggacaaaactcttcttactacataaattaaaattagagaatttcaaatgacaaaatctaatggaagttgaattaggttcatgaagatttatgccgctatatcatattagggcttaagaactctttttgtcaaattgctttcattaatttaaaggtttagaatacaaagatggagatggttttctcatgactccaaatttcatataaacgaacttgacaacactaaaggttacaacataatagggcataactatagaggttatgtataaatagggtataattgtaattagtattaccctagtctctcttgtaactagcctatatatattgtaattacaatctctaataatattaaggcattacactatatggtatcagagcctctcgactcttaagacctaaatttctcgtgctttacgcagccttctctttcatctcttctcatctttcacg

SEQ ID NO: 2481 - DNA, 3000 bp, Unknown
  misc_feature (1)..( 3000): cDNA_ID_3436760_gDNA_ID_1620544_Annot_ID_160111 3000 nt of promoter + ATG
acttggggaataagacatgtatcttgtggaccaagtataatacatacattcttatatatcaaggttttgttgaagaacaaaaccatcaacaaaaccatctccacgttctttttcctttcattttcgaaaattcatctctttctagttgttttgacttctcaccaactcaacaccaccacaatgtttctttcccaccaccgtcaacaccttctcttgatcacctgattgcttcttacctgtttaccctcttcttctgttagaatccttgacaacctcttgattcttgttcacatatttttcatgagagtttgaatctttcgtaacctcttgattcatcttccattcgagcaaaaaaaaaaaaaaatacccaccgtgaacaaccatataagttgccataagtcgtccttttaacccatgcatgagatctccgaattgtcctttaaaggttcaataaagttttcaaggtcagcacttaatattttgttacgtttcttccttccagttcctgcttaagtataaggacgggcagtaagaccgccccgtatccacaaatttaaagagcaatttttttttttttttgtatatacgaaagggcacaaaaaaaatttatatatgtacaaagacacaaaaaaaaatatagctataaaaaggcacattaaaaaaatttctatatataaaaggagtaccaaaaaaaatttatatatgtaaaaggagcacaaaaaaaaattgtatatgtaaaaagaggacaaattattaatgttagtgggatattttttaaatttgcccagaagcatttgaaatgtatgagccaacattgcttgcttccactggttttattatgaaataaaatgatgttaagttgagtttcttgatcaaccatggaaggttgtttgtgaaaacagttcagttttgtctatttgatttcagttatgagtgagctaaaacagtttatctaaaggttcggcttgggctatgaatgatctagagctaccactaattagcaaaaagattttctccaaaacataaagttttttaattggttttgagttgcctgaattttcatccctatacaagttgcaatttcaaatttttatcataaactttttgccacttaagaaaccacccaacaaaattttaatctcgataaaactacatgtgttttcggttttattcttaaaactgtgcttccaaatgaaccgatcagttaaccggtaataattcatccgatttgacttacccaatatttaaccaaaattaatccgattttgactctattttaacccaaaaaaaaattaaaagaatatcttctctacaataagatatctttttatttatttttttagttttgataaacaattaaagataagaacctataacttaattttaccaaaaaaaataatatgaaaaatataccacgaatttcttttgttttaagctattggtaatataagaacatatacattttccttttgacaatcatttttttttctttaaatctaaagctatgtttcttttgaaacaaaacatacatttttcggtaatcataaatatgacctttgactacttgttaactgataggttcagttggaggtatagttttaagaacaaatccaaaaatacgtgtagttttatgagtttaaagtttttttggtggttttttaattgacaaaaagtttggagtggaaaactgagattgtaactagtattgagctgaaaattcaggcaaccatagattttcccttaataagttacttaaaacttaaaaatgaactagaatgattttcatgattgttacaagaactagatgatgatcatgattgttgtaaacttcaagatttttgaaaacccatatgaactataatttcaaacctttaagaataacacaaaggtaatttttttttttagcataagattattccactaagattaaccaataaaatgaaacaatcatgtctaaaattggaaatagagtaaaatttattaataagaaacaacaatcatcggaaaaaactcgtaaatatgtcttaggatcggagttctcttgggattctagatcatcaacgtagaccagcatcccgtgttcttcatccaattctcggccattttgagagtgtcactttgcgtcttctcttcatcggctcgtttcaaattctctttcatttccctctcttttcgagctctaaggctctcaccagcggaagtcgcggtcagattttctttgaaaagtttatgaagatcccgctgaaacccttcgtagacatgtatactgcagtacccaaagataactaatatcgttttttttttttctttcatattccacttattgtaagctatagtgataaacttatttaacctttataatatttttactaataattaattacccaatcgatttaactaaatttctttgttttatgaaacgagaatcttagccacaaatatttggtagaataaatattatcacaatctatactattacatgttgtgtcacataaactaagtatcattacacacatacaaaaaaacaatacacattttatgcacatatgaatctgcccgatacttgaagttatttttcttcattaaaattccgactattatatcaatcaaagactattttacaaaaataaaacgaaattctaataactctttccggtggaattaaattcttgttagccgacaaaaaaaaaaaaaaaatcttgttacgattacaattatcttgatcatgttaatcataattttgcatttgtcaaattaaaatagatattttcatggatttcatttgtaatgggccttaggcccgattaaatcaaaaagggtttattcaaaatctcagagagcctctattctaattttgcaagtgaaaaactttaactcttttttttttcgtttttgggatttgccaacttcgatttctttggttgggatttgtttatacgtttccttcgatttcgctcgagcttcgatctgaaaagcttcgagcttttagacaaatccatg

SEQ ID NO: 2482 - DNA, 3000 bp, Unknown
  misc_feature (1)..( 3000): cDNA_ID_2162663_gDNA_ID_1620544_Annot_ID_160113 3000 nt of promoter + ATG
ataacaagaagatatccttgcttatttatatggaatgaaatgtgaaaatctgatactaatttacttaatttcacatttttgaatactttaattaggtatttgatcagccgttttataaatcatatatatgaaagttggccaacactctccatatgagtgacatatcatcacacaagaaaatgacatatgtcattctacattaattaaattaaaaaactagcaaaactaattgagaaaaaaataaaataaaaccaataatcaaaactaattaatagtcatacaagacattagacataccaaaaaaataacaacatgagactctatatgactatatggtagggatgagaattacattgttgacttaaattactagcatatcaagatgtgattgtgtactagatgacgagagaatatatggaataaagaattgtttgttacaattaatttagacaagtttcaaaacacataaataatataactacatacattgtatcagtatatcatatattgttgtagtatgtgatcatgatagtgaaatattagaataataaatatataaatattcatattgtagtagaattgatatttcgagttatagatgaatctaatcataaaaaataataattatattaaatagatgaatttatcaaaatgaacatcaaaatcaacaaaaaatcataatcatatttttcgataattttaaaaacaaaaacccatgctacgcatgggtgttcatctagtttaaataaaagttgaaattccaagtgtgaaacaagcaacattaactaagaaatattgaatacaaagataaaattaatgtataacagcttcacataattaatcaatcaccgatacatatctccaaaaaaaaataaataaattgatttctaatattttattcgagaaaattatttgatttgatttaaaggtatggtttgtaaaagttctatacttgaacctacaacacaaggaatctattatctctttgccaaactgtccactcttaagagttcgaaaagtgacacaagagaaattccaagcatggtgtatacatagaaagaaaggttaaaacctaagctcttatggaatactcttgggtttttatgaaatctgatgataattgataacgatagtttttcaaccactaaaagcaagtgaacacatctattaacttggattgaacattttagaacattctctataaaagagaaagatggtaaggttttttccatataagagaatagtgaattaagcaatatcttttgctttttggcaaaaaaaaaaacaaaaaacaatatcttttgcatagttaaaaaacaggccatacccaaattaaaaacaagaaccaaaaaaatggaaaattgggttagaatccaaaaccatgtagcacactttggcatggttcaccaagaaacaaaatgaggattgttttacatgaaaatgtttgtttttaataatttgattctaatagatttaacatatttttgaaacgacaaaaataggaaattttgtctcggatccaatttcttcattttcaatatttcgctatatggatatagcttttctagatatccaaattttggaacgtttcatatcaaatcaaattataaactagtataatacaatttgtaactaaaactacaacatatatacttaacatcatatcacgccgcacatagtacaagtaaactatctacttgtagaatatttcttggtgactaaattaaagataatgatacatcaaataaattaaaataaattgcggcatggtcatggggatctgcatcactcacaaaattgcggatgcaaccaccatctcgacttcattcagtctttgggtagctatggctcgaagagaggcttgcaacacagtggacggctccaagttttccgtagtaaatttctacccaccagaaaatggatgaacatgccaataagaaaaccataagagattcatggtcgatgcatccaagtggaaagagcttggagctcagaaccaaatctgctagtaaagacgttggcatatatgatatatccatcaaacccgctctaacttaagccccaagagaccttcccttcgccaaaaagccttatcggaaatgttatgttctcttatgtggtcgagatgtagaagttaaaattgaagaggctgttagagacttaccaagaaagggataggacttactaattgttatccaagtctattgtgggttgtcttcggtaatcggttctaaactagcaaattttatgcttgctaactattcgtagttgagctatgagactaccatgttggatggggacctccggtttgggttgtcggcaatgtggctctcacgttagacaaggacagccaaggaattgaaacgttggtcacattgcataaagagaatatgttgtctttcgaccagaacccataactccttgcatttgcttcctagttccttggtctaatttttaaatctaactgcctatattaatataaatctcctcattggtatagatatattaaattataattaagaaatatataaatcttagtataaataaaaatattaaatctgaaagtccactaatcccgtggtctcaagagtttgaaaatttctagatcaactttttacccattcttgcgaatagtaaaatttccataattgtcgccaaaacattctccaattatgctaatataggaaacccattttctactatcttatatatatatatatatatattgaaaatataagaataatttaaaatgcaacaacaactatagatttcattggaacacttcagaaccatgaaactttttgctattattttgaccttatatattccaccaaattctcgatggtgaaagggtcaatatttctaaacatagaaaacttaacatgactataaaagcagccaaagaattccattattattcattcattcttcagtctctcttcctcaaaaaaaaaaaaaaaaaaaaaagtttaaaacaaaaactaaaaaaatagaataatg

SEQ ID NO: 2483 - DNA, 3000 bp, Unknown
  misc_feature (1)..( 3000): cDNA_ID_3068096_gDNA_ID_1620544_Annot_ID_160118 3000 nt of promoter + ATG
tatatgaaatttggagtcatgagaaaaccatctccatctttgtattctaaacctttaaattaatgaaagcaatttgacaaaaagagttcttaagccctaatatgatatagcggcataaatcttcatgaacctaattcaacttccattagattttgtcatttgaaattctctaattttaatttatgtagtaagaagagttttgtccttacatattgcgataaaatgtagatattaaagttggcttaacataatttgattacaatttattcaatgttgggtccaagtactcaagaagtcgaataacaaaataacatgacaattcgaacaacaattagaaaagtttattagaagtttattccaaatacaaaacaatttttgttacatccccttctagagatatctttaagcaactttttgttcttctaaacaatgatatgtatacaagtaacaagtactcatgttaattgtaaccattttagaagccagtttcaaaacctggcaattatatcttctaccatttgtatattataatatatatatatatatacatctatcattccaagagagtatttgcacatgtgtcatttggttgtttgaaatcagtatttattacaattttgttttgtttctgtaataatttgtcgttacgaaactggttatgtttttaaagagtacagatccactgatcacatgcatgcatgcatggacatatctctcgcgttcgagatcgaaagactgatgtcacacatgacagatcactaagtaacgatgttatagtacaagtgtactttctttgcaagatttgaaaatattgaaaatatttaatattattttagaaaacaataaaattttcaatatacatgcaaaacttttgctcaaaaaaaacaaagagagaaaataattgaagtgcaacaatggaaattagaggaaccctttttcaaaaaaaaaaaaaaaagaacaattgaaattggatagtaaaacactcttgtaaacacactcgtcgataggaagaaataattttactgatacttcctttgtttaatataagtgtattttttataattttcacaaaatttaaatttaaattataaattacgtataaagttatcacacaattaagaaacatgcatgtaactcttaaaacatgcctcatttcctacactaaaacatttttccatttttacgaaccaatagtaattcattatattttttaaagtctacaaaatattaacataaattcatttaaattatatagaaaatctaaggaatcaatttttatggaaacaattataagaaacctaaattttttatttcaaagacggatggatgtattatttatgtatttgtattttcaatctcaaattaatacataacgctacagcttaattttatgacttagaattgattatataacgcagacgtaattcaatcattttacaaactttcagaattaatatatatccaacaaaagcatcagcaaactatatacatattgtgcaagttgtgactattactcattgtgttatataatgctttttacatttttcaactgaataaacaatatattaaatatatatatatatatatatatatatttaaattgttgcacacctaaatagaaatcttaaacataagtttattctttcagctatatgtatcaaatcttaagcataattctatctcatacttttattaattttgattttggataagatagatattctctagctacgatgtaaaataatatatatcataagaattgtgtatgaaattttttctaatgtagatttattacataaaaattgtaattaaaatcctcttatggaatgaaatgcaattatattatattttttagcagatgaagtttttgtgtgctttcttttttgggtttctatgtttttatatagacacttttttatacttgatgttttaagtgaaaaattatgttctaaattatatgatgttttcaactttcaatacaaaattaattaatttttattggttttgaagatttatattttacatattattttattactggttggatcgtatttaaatagataataaataaagttttagtataataataataataataataaaaatttgtgttcaaaaaccttcaacatcatgtattaaaaatggatggagtatactttttaaatgtatgtctggttatatatatatattggttttctctctaaacagctgtacccatttttgtccaatgacacatctacagttttatgaaaagtcccaaccgttcttcaccacttcttctgctccgaatacaatgttgctccaatttctaacaaattaagaaaacaaaagtaaaagtaaccagacatacaataaatatgtcttcttaaataaattgtgtgcagtaaaacttggaccaaaaaatattgcatttagattctaactttattatccggataatattatttattaagctctatattgtctgtctcaaacactcaaaccctcataatttatgaatgtaaatgctattgcaaatcatgtctccataggagtatatgataaatactttctatataaaaagaaagggggaaaaaaatctataatgttacagtatcactatcacatccactaatatctgatacgcatttatttcaatttcttgagtgacctttacgatagattccaactcattttgacaatttttctttggtccaactcttacatattaacattcaccttcctttttgattttcgtcggttctacatgttaaacccttcaaaaattaaattataataagtatagtgaagaccaataagcagttgcatggaccctgattgattcattaccgctaaaactttgtctgaatccttcttcctatttataccactctcttcttcttctccagtttcatcacaccaaacttctcacatctcctcattctgtattttgacaaaaaaaaaacaccctttgttttttctctcctttgcatgttgtgattgtttttgcttcacaacatg

SEQ ID NO: 2484 - DNA, 3000 bp, Unknown
  misc_feature (1)..( 3000): cDNA_ID_3068100_gDNA_ID_1620544_Annot_ID_160116 3000 nt of promoter + ATG
cagtggacgtgatgatgggattgatgtttgcattctctgagagagcttccatgcattcctctttgctcatgttaaaggtcaaacatgtctctatcatgtgttgcacctatacataacacatgacacactatcacgtttttatatatatacccttaagaatgtacctaaaagaaactgttccttcatgagaagaaacgcatgcacatgttcgagttattaccagatgaatgtatacagcgggagaagagtgtctcatttctattatatattttgctacaaccacaaataaactcgtatacttagattaaaaggctccactatatatattgacgctcatttatagaagagcttgcaaagaagaacatgaatagtgatgtaaacatgtggcccgaagaccgcacacgtaggagattaattataattggttgagacatgataagaagatattgtaagaaaagtgaaaaaagagagagagaaatttgtaaaaattactcttttatctcctcttctttgtttccatttccaatctatatctcatttttcatccataggtcctatattttttcccaaaataaataaatttattcaatcaattttgctatagccttatctgcggtttattaggtcataaattttaattaatacacaaatctaaataaatatgttatatagatcatagatttaaaaacttttacgggaatttatctatttaataatttacaaatactagttgaaattcaatgttatcttgttaatgatttattactagatttgaaaatccgaaaatacaaagattcaaatccaaagttaaacttttgtatttcaaaatccacatgtctgattttaaaatctatataattttctgggtcccataaagatttatatattcattaacaaataatggtatcatatatagagttacagaataacaacatttgcttcactaaacatgggaaatagatattggattagcaatagactattaaatttttttgagtacataaatgtaatttctaattactgtgtaagcaacattgtttttctgcaaccactacttccgcataccaaaaagcattcaacataaaaggtttccatgaaaactaatataggctgtggtaatgatttaaacatccaaaaggattcagaaaagaaaacaacaataaggatgaaagcttaacgaaatttgcttcaaaatacttaaataaatatctttgggtcgactgtgtaagcagcattaagaatgggtttacccataatttgtccagataaaatcgtcactctaatgtcaaatctctataatagaacccatctaaaactcttctattgagttgtttgatttttcaacccattgtttacaatctcatgtaatttattttaccactttgtgtaggtttgtttaactaagttctttacatgcatctatcatcaaaacgtgctggtacatagctaaccaatccatatatttatgcttaatttctgttagtttttaatagttagttatccggtaatttagtgtgaatgtttttaattgctactataaaatatgttacatcaattattctaaaatatagcttctttttcttttttttttaatataaaacttcattgatcgatccctaactattgatggtactcttcgtctcgttgtcacttttcggatcaatcgatctacgactactggtcaccaacacattttgatctacaaactcctgatcgatcgttttaggccaaacaagtccaataacgcatcaaaacatccaaatctctcacaaacacctagtatatgtaatagactcaaattaaaacaagagaaaaaaaaacgtaaaaaaaactgcaatacgacaaatgattcaaacgaaaactaaacgaaagacttaagacaccaaaaaacaaaacatattagaactattcaaaagaaaatactttaataaatcataaaatttcagaactggaacaaccaaaaccgaaccaaaatttaaaaaaaaatctaatagctggaaccgaatgaaaccgaatcagaaccgatagcaatactcgaacgcccagccatactttttgtataagaactcagataaatgatggatttaaagcattctaagttttaagaaaaaaaatgatggttataacaatattgacatataaaaaaaaaaaaacgccagccgtcaattagagttttgaaatcgcaataataatgttatgcatgaataggaattaggttcacattctttttgtatttgatctgttaatatcatggccgatatagattgaacattttatctaaaatactattatatttgaccatgaaatcatgttgttcattaccactacaacgtttacaaccatattttcactaatcactagttgaattcatatatctaatttgagaaacaaaatatttcaaaaataaaataattttatagatgatccacttatgtattttcaatttgtctatgtattttaactaaactaattaaatcagtataataagcatacatttaatttcatgcaacccgcgatttctaacctagttatcatctaactacgttcataagcccagtcaaattaggattgaaataaatgtacaaaaagtcaaaaagtcttcagtcaattcaaagtcttggtctctcaagttttccatttaataaataagatatttgaattcgaaataacaaaagtctatattatttaacacaataatatatccaaccaatgaagacatacaaaatatcttagttattaataactaaataaataaaaaacacgtcaagccgaccaaactttcctccaaataagaccaaaaaaactcttaacaattccaacaacgttaagaagaaactaaagaaacttcctatttccaatttcttttcaaacaaggactctgtcttttgtctctacttgccctaccactttccttgcaccaacacttgaaaatctcaaatcttgtatatatatcaacaaacaaacacaaattctatatatcattcataacaaaacataacc

SEQ ID NO: 2485 - DNA, 3000 bp, Unknown
  misc_feature (1)..( 3000): cDNA_ID_3068108_gDNA_ID_1620544_Annot_ID_160108 3000 nt of promoter + ATG
cttgaagatctttggaaactacaagaaaattgggtgtgagactataatgttgtttggaatggtagtgatgagtgtttttgttggggtaataggtacttacattgcacttcgagatataattggtagtgtataaatgttttgagaattatgagggttgtgttgtcctaaatgaagtttttttaataccccaaaaagtgttaacttcaattcataaaagttcttccttttaggtacttacattgcaatttctagctctatcgaagtgttggaaacatttgagtggttggttttttatttccatcaaaatctttcttatttcagtcttgcgttacactttacttaatgttttcttttgtaaagcttctcaatgcaacattataaatttggtttcaatgttgttgaaggcttagaacatgaatcttaagatgacattctttcacattattatggtaaacactatgaattggttcccatatagcaataaagatactatatatatcggaaaaaaaaagaacaaattcagtgcctaagtcattgggatattaattactgatgttcatacatgtttatgcttcaattatgttttaaggaatcggaaaccagatgtaatactgattgaatcaaaccaactctacaactatggggaaagaaaaaaatacattcgaaacaaaagtattaaaaacgttaacaagagaaagaggctttaaatagctaaatctcaagccaaacagaaagcgaatgcttagtgatgagattgaggcctgtaggtgtgtaaccatctgttgaagcggtccataagtgacaattccatcttcgttgttggaacattggggacagttatcggcttacagccttggtgagtggcccgaccacgacttgtagcttaagtccggcctcgcattagacagaaggcattccaaactcggaccaggcagtgtggtggctcaattctatctggatcgagagaagtccactttatagcgcctcggtgcgttcctaccgaggcttaccggatcagccgataaagtatatcaacaacaacaaaaaaaaaaaaaaaagttcgtgcctcggattgacttgtcattgaggtaatgaagtagtggactcctggtttggtgagcttcacaagatcatgccctgtcttgtgcatcgccacgggagaagttgggtcgcatgatatgaattcaaggtctcggctgatctctaagatgtcgttgccgcattaaaaaaaaagattatctccaatatcaaagtgtctttcctctgcccacttgaaataaaaatcactctcttgagaaacactccatcccttggagtcaccaactttgtagatcttgctcggtggtggtggaggaatggaacgtgacgggtcatattcgacaagaacgttattgtctggatgtgcattgttcacggtttgagctgatgaaatagatatagttagagctgtcaaatggtcatccgactatgggctaagcccaatccaaaacattatgggcagtccgtggtcagcccataaataaaacgggtcatgtagtttattgaccaattttgtccgcagacataatgggcgcccatacggacaattgggtggcccagtttcattaaaaattagtttcctcagaaatcgcctctttttgtctcctctctgttgcggcttcagaatcgccatcggaaggttggactcatcatcgagacgggtcacgaaccggagccccgtttagttttcgaactcgctaccgattccgagttgtacgagcaacaatcatcatcatcgtgttgcgtgtttatcctttttggtccgaggtgaatttctgaaacaatcttagtgttcttagtgtttctgaaacaatcttagctttttggatcagaggagagcttgctagctttatcggttaatggatcatattaccaagttaatgtcattctcattaatttgataaaagatacaattgagggtttatatacaattgtaagaggcctaaaccatagccattaaaccgaactaaaccaacactatctacactggtttatacaaaataccagttcacaatgactcactaagactctaattacaacagagactctatatacactaatagattgaggtctcacatcttctttgcttgttcttagggtcttcatgaattgaagcacatcaatatcttggtcgaaagattccccctttcaggtatgtagagaccctttgtgttgaaatctgaatttgattccatagagctaagattcatcacttttgatatggattttggactccaaagagattctgaaatgaataggctcagtttttgtattggattttctcaggtctctatcacaaaggtgctcatcgattcctctgttttttgttttcttttgaaattttcttttatgatcattggattttgataccattcattactgatcattgatcgatgagtatgatccttcaacttttggtttttgggtttcatcggattgatgctttttatctgaaaggttgatgcttttgctcgtacattaaacaatgctttttatctgaattgtatagttttgtgatgtgtattagcttatttaagtttagttaagctgaaagcattaggattattctacatatgtgtctgacttggatgaattgttttatatgaagacactgaaagtgatgattatttcatgataatcttgattagtaaacgttattgatgttgatgttcccattgcatcatgatttgtgggaacgagaaatcatctgttccttgatgttgatgttccctttgaatttttcaggagcaaaaactctgattttggagtatccttagtgttgttctcttcccatattgtaaaaacgacttcgtttaattgaaggaaaaagcttctttttggtttaaagtctctctgctcaacctaagagatgaaaatgtataatccatctttcattatgtttttgttcgatttccttctctgtttttgtagtcaaaatttggtgtggttatttgcagaatg

SEQ ID NO: 2486 - DNA, 3000 bp, Unknown
  misc_feature (1)..( 3000): cDNA_ID_2162488_gDNA_ID_1620545_Annot_ID_160143 3000 nt of promoter + ATG
gaatccatgagacaatttttaaaaaactgaagttgtaacccctattaaaacagcatattaataatattttaaaattttataaatattgattcaaatacatccaccatataatccaattccaaaataaaacctgttgtataatttctttacccgtcccgtgatttttttttaaaaaagtaatttttaaaatttaagaattatttttatatataaaagttttgcaaattatatcattctctaatacatttatattttatagtttaattttatatatagtaacattatacatactacataatattttcggttttatataatcttttctaaattaggatgatttgatatgtttaatattagtggtcttaaaaaataataaattaaatatttaaccagtattgaaacggtggattaattatattttacttttttattaatgttgattcaaaaacccgtcactccaaatctgtcttgccaaaaagccatttattttattaatattaattttattaatgatatgactctgaattataatctaaacattttagctaataaataggagtacaccatatttatttaataggggaatgtaccatatgacccgaatgcacttttacccaaatccaccaaaaaagtcttgcaaaaatactatagagataagaaacgatagtcggttttgataggtaaaagattagcaaatatattagttagcttaaattagttaaagaatacaaattgaaaaggtatattacactttattcgaatatagtatcaaaacttatataacacagagatttgataattttttaattgttgaatacttttttttgtgctaatttttatgtgattaagatttaattgattatatatataaaatattaaattgttttacgaacttatttgtttataatttggtaacagatagatatttgagtattcagtatattttgcttcagtttaggaaatctttgatgacccgtctttagatccaataaaccttataatctagatattaacctgcagtataccgcaggtaggcttatattttagttaaactaaaaacttttattgtaaagatgatttaaaaatatatgatattattttatttgattttaaatgtatagtaaactgtgagttgtatatgttttgttgatattatgtatattgtttagtgtttataattagacacttgtagtttaattgttaatttaagagtttcacatgtagtataccatcttgtattaatatcgatctaaacccgtcaattctaggattttccagcttgtattaaaaattgaatcacatcatacacataaaaaaatctaatatgttattaattattatagtatataagattataaattttcaatataatatgtatgaaattgaatataaatatttcaaattatgacccgttactcagtagaaagttttcttaaatctatttttcaccctttataatattttttcatgtattgaacagtttatatttgtttttaaaaatttaaattatggcatatgcgaaaaaactctaattttttttttataatgatgatattattttttcgcaaaaatagaatcatataaagatgagaagtgaactataataattaataaaaaattaatatgataatttagatataaaatctaatttgttgattttaataggttacttttttggaaattaataatgtatttttttaaatttaattaaattaattaaaatttaaatatcaaatcttatatgttgatcttgattggttattatttttgaaaattaataatgtatttcgttttttaattaaatttaattaattaaattagtatttgactttttaatccttaaagagataaattaatttactctttaaaattttatttctaatgatatacctatgtaattacttaaaaaattaatgttatatttaaaatgtactttccaaataatatagtaggatatgtaaaagaaagtataatattttaatgtttgggtatctttatatttaagacacaatgtctcaaatgtctttatagagacattttggagagagatgtctcaaatttaaagacccttttatatttaattattcatatcttataattataatttttttaatatagctaaagaccctctccttttatatgcaatggagatgctccttcatcattagtatattttgttttgaattcaagatttctaaatatagaatttcctaaaataaatacatggtaaactcgtgggggttattgacttgatttgatacaaaaaatgagaggatatagttgtgatcgcatttgattaatttaggctgatgagcaatatgtatgcaatatgcatggatggtgtagaagcgaagacaactatcaccatacttaagattaaaatcaccacaattttaatataatttaacaatatgattttatgcataattaattggacttaattattactaagacattatcagtttgcaaccatccaatttcatgtagaacaagaagtctttagattaaccctcacaaaagactttccgtttttcggggttttttcttgactaaacaaataatcttggagacattaatgatgttatgagtcatgtgaccaatacagttatttagacatcaaagttatctgcaaattcattagagacgaacggtaatagtcacacatgacaataagaatgaagatgtcacttagataaaaattaaaccaactcatgtatttgcctaaataaatcactatttaccaaatttagcaaacaaatcgtaactaaccaatcaacatcacacaatctcaaccctttaataatctcacattctctcgcttcttcttctcggattcctaaatattatcattcattcatcatcctcccaactcattggctctcttctctcctctcctttgcctattttctaaaatcttctccggccacccaccggccaccttatgatctttttggtggcggcgattacaccatcaatttgttagtttatttatatattaat

SEQ ID NO: 2487 - DNA, 3000 bp, Unknown
  misc_feature (1)..( 3000): cDNA_ID_2162493_gDNA_ID_1620545_Annot_ID_160145 3000 nt of promoter + ATG
gacattatcagtttgcaaccatccaatttcatgtagaacaagaagtctttagattaaccctcacaaaagactttccgtttttcggggttttttcttgactaaacaaataatcttggagacattaatgatgttatgagtcatgtgaccaatacagttatttagacatcaaagttatctgcaaattcattagagacgaacggtaatagtcacacatgacaataagaatgaagatgtcacttagataaaaattaaaccaactcatgtatttgcctaaataaatcactatttaccaaatttagcaaacaaatcgtaactaaccaatcaacatcacacaatctcaaccctttaataatctcacattctctcgcttcttcttctcggattcctaaatattatcattcattcatcatcctcccaactcattggctctcttctctcctctcctttgcctattttctaaaatcttctccggccacccaccggccaccttatgatctttttggtggcggcgattacaccatcaatttgttagtttatttatatattaatatgggttgcggtggctcgaggcttggaggtgtggcgacgacaagggcggaagaaggcggggttgtgccacttccagcgggaatacgtccccttctccggcgaaggttagaggagatgaagaaacggagccatgcaggcgtcttgaaagggagccagacgttgtctaagaaagagcttcttaggcataactcttccgaggacggagaagatacggaggagaacgacggtagcttgaaggcgtccgctaaggttgctccggcgcctgatcataatgtagaagagaagaaagaggttatttatgaaaagattccatccaaagatgatgttaaagaggtgaaggaagaagtagttgtgaacaaacaagaagaggacaatcatcatcaagatgttgtggagaaacaagaggaggaaaataaagaggttgtgaagaagcaagaggaggaaaatcatgatgatgatgtggtcgtcatcaatgttaagaaggaaggagatgatggtaagaatcatgatgttgatgaagggagtatcaacaactttgatgagagaatgattggtcctggatctccaagctttagggtttattgcgtcgatgttccttctgatgatgatgatgaaggtaaatcatatgttcttatacaaacacacatatatacatgtataaatcatttactatttgtatttgtatatggatgcatgcattgttagagacatatatatgtttatatatgaaatgcttgttatattatgtagtttcgttattgaaacaatttatccattcactattgcagaaaaagatgtagaagacgcgagaaagtcgatggaaaccgaaagcgtcacgacagagataaaagaggtggtcaatcacattaattcacattattgattatttgatctatgaggatctctaacaatgatatatttgtatttctataggacggaagcattgtcaaaaaggagaaaaaagaaagaagaggaaagaggttcggaatcgcattgccgaggaagtatttagcaaatgtgactgcgccgtgctatgcaggtggaggatgcatgggaaacactcattctcgtttggtgcaagagaaatcgagccagtgatcgatcaaaatatgtttgccatctttgcattgactgatttgttgaagtaagaatggtgtggtgtacgtacgggatcacgatgaataatcaaaaccaccttacgattttagacctttgatttgttttaagagacgcttgtttcagaatttgtacaacctcttcttcttcacctttgctttctttgatcaggataattaagttagtgtttgacgaatttacttttttccacgtggaaagatgtaattaattgaacttgtgcaataaaaaaagtgttgtctaaatgtcaaatttattgttacattaaccaatgaaaataaaattagagtaacatataggaaactgcaattatagaagaaaaaacacactaaaaggtgtaagtaattgaactttgtgaattccgtttgttttcggaatgcacaagtgttagtcataataggaaagataaaaatcttaattacaaatcctaaaatacaatttttaatttattttttagagtttatattaatatgtcgtcaaaaacggtatattattcagaacaaaattatcgttgaccattagttaattaataaccaagttcaaatttgataatttgaaagtttatttagacaaaattaattagttgaaagttttatcaatgatggcctcttaaatttttaacttttttttgttgagttttataaaaaagaaaaaatggttttcaaactaaatttgtttatgatcatgtttatccgagttaagcccaatttgagatctttgtcagtaatgactaagagtacctcccgcatatagaattcatgtagtttctaaaacatatatatatttttttaacttttaaatatatatatttttttaattgtatgagtttctactaaaaaattactattgaagttggtctaagttgcgagaccaaatttttatatgctttcggttcgaattgacatttctctgtgtaaacgaagcatcaataagaatttatcaaacttgaatgtaacaccatttctttagttgatcatttccaaacatttattaatcaaataaaattgaatttcaaagtcacgtgataatgatgatactcaaatttaaaaaaccaataacactttatttcaacatttctatgaagaaatcaattattaacacttaaagttattaattgaataacaacgaacaacatttaatttagtcaaaattagattttttttttcttttttttggttttattgttaagattttataccaaataaaattttacaaacgaatctaaaagaaagaacaaatttaaacttacctatcagaattgttgtaagatatttgggttttcttcgtattaggtttcatcagatccagactcaaaaa

SEQ ID NO: 2488 - DNA, 3000 bp, Unknown
  misc_feature (1)..( 3000): cDNA_ID_2162504_gDNA_ID_1620546_Annot_ID_160152 3000 nt of promoter + ATG
ttttatagggaatcagatatctttagctttctcatcttaatatggattaaaaaaaaatctttcaccattttctttttcattttaataataataaccagtcacacacataagtcacaattataattattctcacaaaaaaagccataataataaagaaaatattatatgtgtaaagattcacatttgactgctttaaagccatctacgcttttaggtttcctttaaatatatgccagccaaaccctccgataaaaatctcacttccaacatccaaatccctagaaattgtaaatggctgagaacaacaacaacaacggcgacaacatgaacaacgacaaccaccagcaaccaccgtcgtactcgcagctgccgccgatggcatcatccaaccctcagttacgtaattactggattgagcagatggaaaccgtctcggatttcaaaaaccgtcagcttccattggctcgaattaagaagatcatgaaggctgatccagatgtgcacatggtctccgcagaggctccgatcatcttcgcaaaggcttgcgaaatgttcatcgttgatctcacgatgcggtcgtggctcaaagccgaggagaacaaacgccacacgcttcagaaatcggatatctccaacgcagtggctagctctttcacctacgatttccttcttgatgttgtccctaaggacgagtctatcgccaccgctgatcctggctttgtggctatgccacatcctgacggtggaggagtaccgcaatattattatccaccgggagtggtgatgggaactcctatggttggtagtggaatgtacgcgccatcgcaggcgtggccagcagcggctggtgacggggaggatgatgctgaggataatggaggaaacggcggcggaaattgaagtgtagatttagggtttgtaaccgcctatgtgggaaatttgaaatttggtggtgtttattagggttcttcaattcgtcggatttgctttcatgtaaacaatgtgtggaaggcaaattgttttttttagtagacttgtaagcgcttttctgagaatttgattgtcttttggagttagtctcttacataatatcttgttctaaaatcctccgcctaacaccggttactctccgtttaatcgctaagtccatcatatccggttactctccgcttaatcgttaagtccattctatccatgattaatgactaatcccttaaaaaatcactcattcgattactctccttctaatccgattacaaattaattatttttttaaagtaatattaagggccccatttcatgtaaaagtttttttctccaaatatattgggccatttattagatattttcagtcaaattaatttttttataaaatatggcctttttaaaaaataattcagaaaaaatcatggaatcatgggctactgcccttttgcccatcctatttgggccgagcttgttatcatcaacctcgacccaatgggtgagtcgtaaggtgtgagggtcaagactttttttatttttgaagtaaaattgatatataaaaaacccatattttataaaacaacttataattagcccaaaattatagttcaaaaccccattttttgttttaaaaataataagcctgattttgttttttaaataaagctttttatagcaaaaacaaattgggtaaccttacatctctaattttatttgggatggggctgattatcatcacaaggactatgcataaatgttttcaataactccatatcaataaaaaataatctggtttgattgcttttatccagctaactaaatttcacaccaaatgttgaactcatcattgttttttctagattttgcatgattcgtttgttcaagtaatcaggttcgactttcgattaaagcctaaaaatctcatgaaacaaaggttttaggcaaagaactctctatataaatatataggcgcatcatttcataaaaagtttatttccgaaaagttgatggatatccgctttaggtgaccagttcgatcctaatttcctaacttttgtaatttctttttaacaggtgacggcaaattatgtttggaccggccctaaaagtagtaattatttcctttaaaaataatatctaaggttaagagaaacatattctttacataaacaatatctttggatgtttaaattttaagcttgatattttaacgaactttggcgcgaaaaccatctattcaaatatctctttccaccacttgtgttttcattgatttggaattgttatctgcattgagatatctttgaatgatgaaacatgttcctttgctacctttaaattaatgcttcagattagatcggtctcatgcacaagacaaattgacatacatatttgcatctttgaaatgctgacaatatttgcaatctcctaagaatgataacacaaagaagcaggccaagcattggattttaagtacacaactatagctttttcactcgaagccaaagtcaccttatctatgcggaaactccacatactttccattgcgcattagaaaattctcagtttggtatcttcccactaattaccactccaaggcaccacttatagttttcttctttgactaatcagatcttgggcacaaaaccattgacgacattcctcatatgctagctttcacatacttccctaaattggttagtataaaatccaccttatctaaagctatagttgactaatagctttcaccttatctaaattttataagttttaaaatttataaaatccaaaaagtattggttaacaaaaatttataatgaatagaaagtgaggttttgtattttgggatttcacatatattagtaaatattgtataacacaaaacaaaatattaataaaaaataaattttatttttgagaaaatagttgggctgatttcgtagcccacttaatcagcctttaaatatggaaaccctagcctagaaagtgaacaagaaaaacgtaaagatcaaaatg

SEQ ID NO: 2489 - DNA, 3000 bp, Unknown
  misc_feature (1)..( 3000): cDNA_ID_2162750_gDNA_ID_1620547_Annot_ID_160180 3000 nt of promoter + ATG
cgcaatctccttccccacttgatcatccctcccgatttcagctcagacgagcactttccctccggtgaagcagcgcgacagagacgagtattgtacgccggttgagaaaccacctcccttcttggaaatttgttcctgcgagaagaactagaaacccagaaaccccaggaatttctattcatagaaagttcatgaggtgcgattcttctgtaaagcaagtctccagctagctccgaagccatcacatgactctcgtcgaaaacaggaagaagaccaccaccactcctcttcttcatcggtttattccggttcatcctactgtaatcgaaatgcgatcggagtgaaaacatgcttgggtaccggagagacacgtcactcgccgtgattttgctcacctgcatcaataaaccttaaaaaatcactcgaaaacccagacgaacaacaaaaaacgagatctgtctataataaaaggtgaaaaaagcagagaatcgagtgaataccatgacgactctaatcgatttaagattttccggcgatctctgaggaagaatcgaagcatcgatttcgtaataagatccagctcttatatgcgcgactgcaactgtaagaacaaacccaaaccaaaaattcagaaattagaagagaagcgagaaaatcaacaaaaacgaagaaactatagcttcagtagtttaccattcaaagtcggtgacgacggcgaagagattttcccggcggtggtttctctaatcggattccgtttcacgaacatcgtactctgtagaacaagagaaaaactaagagagatattttttttctggagaatcaaaaattgttataaggaataatgaaaaaatcggtttgttgttgttgctgctgcctggagagaatatatttgaaaaaacctgactctgcgagtataacaagaaacacacacgcgctttctggtacgcgcgtgggagacactaaggaaacagaatcaagcggtgatgagttttatttttctcatcatgagactgatagtgactgagccatttatatcacagcgaaaaaaaataaaatctgagagcgagagagatcttacactcatgatttttgctctcgataatcttcgttcctccttttcactggattaaaaaaatcaaaatcagcaacggagaaaaaaaaacatggacgcggatggagaaattaaagcatttctgagaaatagagagaaaacataaacccagaaatatttgaagaattttgttttataccagaaaatctttttaatcagcagagagcttatggggaagacagcaaaaagaaaagttttgaaatgtcgcatttaatgaatctgggaggtggctttatatatgaggttagagagagagagagagtggtgtgagtgtgtgagtcttatatgcgtgtgcacggcacgtgactatattgctttcgcagcaagttggcgtatattgacagatttgccctcaaactgtatctaaactgtaaacgttcgcggaaattggtgtacgaaatcatctacaatgaaagattgaaagcagacgtagtgatattacggattgatgccacgtgtgtcattttgaaaatttaacggtgataagacctgaaggttaatgtaattggccgtagcgaataaatttcgtgttacacgtgcggagaaggcatcattaagctactgctactagagtggggaccgactacacacgtgaggaattgttttttttttttgtcacagtgattattcttacatatgattattttcggataatgatatgtgatttatgatgttttattcacattaaattgtttatgatgtaaggattaatgtctctaatgtatcgaccaattttatactccaatgataactgaatctgtttttctttattgagctgaagcttttttaaaatcaaaaagcttaatttacgtaataacatgatataattgatattttttttataaagtatttaaaccaatcaaaacaaataataagcttgaggacttatgaccatgattatttgcccaatacatttaagttatatttttttgttgagtcaacaatatttttaataatttaaaaatatttttttcttaattatcaaaaacagtcaacaatacatttaagttatatttttttgttgagtcaaatatgtataatgtaagatgttaaaaagataattaagaaaaaagtaaaaaactgtaaacgggcctaaatgggccaatctaagctgaatttttttggggatccgactatgagatggatcaaaataaacgggtctggataccttcataacgggtcgggtctgatgaggaaagagagtgattttttcgatcgccgagagatgaaaggtcagtgctttgtcgtcttctaccgtctccggaccaaagagctcaagtcacgcagctaacaaagtacagatttttcccttgtttcgattgcaaaagcgcataagcttcgtacttgccaaatctgaagtcaaaccaaatacactggtcaaacaaaaagtcgacgagccccagattccgatagcaaaaccagtcggacccaggatttcgatgagccacactggttagcttccgacccaattcacgtcctaggtcaccgagaacgtggtatgtgttttctaaggctttcgaaagggtttaggttatagtttagctttagctaagggattgggttttgttgtgcgtacttattgttcgatgaaacttctgaaagagttttggtcaattgataatgaacaaagtagaaaactttatctccttaaaagtagtgacatgggagctaattctcctgtttgtgtttcgcagaaactgtgtgagcatttgcagtttctctcttgtggttgagctaaataaaaatcattgtacattttcaagagctaattatttctgatcattgttatgtgatactttcttttgcagacttctttgcatgttttggttttgttgagtcggatgagttttatttttggcttctctctcgaccagtagcagaaagct

SEQ ID NO: 2490 - DNA, 3000 bp, Unknown
  misc_feature (1)..( 3000): cDNA_ID_3068160_gDNA_ID_1620547_Annot_ID_160188 3000 nt of promoter + ATG
tgattcctatgtgcctaaattcgaggctgagcttgcacagttttgcgagaagttggtgtgtaatgcttgtcatacttttttttttcttttctttagagtttgattcttctctatgctaagatttggaattggttacaggtgaatgatcttgataggaaagttaggcgtgggcgagaacgtcttgcacaagaagttgaaccggttccaccaccttctctatcagcagagaaagctgaacaattgtctgtcttggaggagaaagttaagaaccttttggaacaagtggaagcacttggtgaagaaggcaaagtggatgaagctgaagcgctaatgaggaaggtactatttgtttaccattctctaaaaaaagaagacttttgaagtcttaacaaatcatactgaaacttgaaatatggtgttctgcttgattcctccgtatttgcagttataccttatgtgtcacctttattatgatcataaatttagtacattgagtgcttatcatttggaaactctggtaggtggaagggctaaatgctgagaagacagtgttgttacaacgaccaactgacaaggtactcgcgatggctcaggagaagaagatggcattgtgtgaggtttgtggttcatttcttgtggctaatgatgcagtagaaagaacacagtctcatgtcactggaaagcaacatgttggctatggcttggttcgggattttattgctgaacaaaaagtaagtctcagaactaatacttgaatcttgtttcatttgagctgtcattccttataaaatggggatagtgatgctttgtttactttttctattctaggctgctaaagataaaggaaaggaagaagaaagactagtaagaggaaaagaagcagatgataagaggaaaccaagggagaaggaaagcgagagtaagaggagtggttctagtgatagagaaagatatcgtgatcgagaccgaaacagagatggtgacagacacagagaccgtggtagagattatagaaagccttatgacaggagatcgaggagtgggagagaggaccgagatcgaagcaggtcacgatctcctcatggaaggtctggtcacagaagggtgtcgagaagccccattcgccaatactagtttgagaccctcgtggaaggtctggtcacgaaagggtgttgagaagcaccatttgccagtactagtttgagataaggtgttgtcactatgtcttggggccaggaactttgcaaattaatgaggtagacaatgtgataccccctttggtttcataagcatgtgttgtcttttggaacttccttgttaaaatttatggataaaatttgtctttctaccggatcacagctattctaagagtttgagaccttaccgattctccttcatcggttatttgttaagaggtcaaaagcgttgaggtaggtattacccgtaaaacttttacattttcattgtatttctcgatacttgagatgctatagcgtcattttattttatttttgtcttttggtacaccatttcaagtttgatatacctttctgatttaaagaatacagaatcgggattgttgggatcgaatgacacgaatctatttgaggtaacaaatatacaacagaagtcatccttaatagaagttttgggttttgaatttggtttattttcttcgagttctctgtctgcacttaggtgtatacacagaaggaatgataatctttggctttggggttaggtataactgttgcatttcttggaatctagccttcaatggattggtctgcatgatatctgatttctatcgggtaaactcactccgttgtttatgaacttttaataatcttttccaaactccaaggctagagcattatagtaaaacagtaggtaaggtattctctggtgggagcaagaactgttttggtggtctgtgttgaggttccaagaacagctgtgttgttggtctaccacaaagccggatggcgtctttgtaatcctggcttaaatcctgatctaaacatttacaactttgtctttttttttttttttttttttgccgatttctcctctacagtctatttgattcaaacaagagctcagcatatgaaaccattgtttcggggctcctggtttgcagctatagataagcttcttttatatggcaaacttgtaagaatgacgcaacatttgtcaaaataaaagttgttgatgagagttgaagagcatgcaatagttggatatgaagagcatgcaatagttggataccaatgataatctttgacggtttcgttgggatcagattaaaaaagttcacgttttttgtagcccaattttctaatgcattgatcagcgggttaacaaccatttattcaatgaaactttatcgttttggcatatatatacaaaaaaaaactttaaatcatttaactaaaattgaatttcttacactaacagttcaaatctggccaaaaccatcaaatctgcaaacagaaccacttgtacgtggagggataaaacgaaaattagttgtttggcgtacttacacataattttgaatcgtgcctataatgacatgaggttaactaaaatttgaatttcttaccataccaatttaactccggctaaaactatcaaatcggaaaacaatgtgaaagaagtcaacaaattttaattatggaaatttcttctgcagttaaacgtcatcgttttacataatgcgtagcttaattaatgagttgagtgagtcaacggaagagaagaagaccaaattagtcttaaactcgtttaggtaacagtttggtttaaagcacagaaacagcccttcaataagtttcaatgtcataaaaccaaaaaaaaaaaaaatagtgaagacgacgaacctttgaggacactcttcggtttctccaatccttcatatggttcgtaaagatctctttttctctctttttctccatttttcaattcaattttggctgatctaattttggatttcagatg

SEQ ID NO: 2491 - DNA, 3000 bp, Unknown
  misc_feature (1)..( 3000): cDNA_ID_2162791_gDNA_ID_1620547_Annot_ID_160193 3000 nt of promoter + ATG
tgcagggaatattaagagttatcagatcctcacacaatgattgaaagacatttcccaaaacagctagtctattattaccctacaagtatgtgcagacccttaaggcaacaaatagcatggtatttggtttcacggaagccttataactatcgaaaaccaagagtttttaaatccttcaggtcagaaatacttggttcttacaccacaactcttaacccgcaggtgcaaacttataattcatgtattttctaatagccaaactacgagctttacattgaattccatctaaaggaaagaaccattcaaaagatgtatatctattctacgtaagaataaagctagccgacgaatattgcttaaacttaacctcggaagtaaaagaccactcttaccttgagagaaagaacaagaagaatgtagatattgagaacaaaacttgccagcaatgcaattgtagtgtgagaactcagaagaagctcaagggtattctcagaattccctaaagaaatgttcttggtgattatcccatcagctctaagtctatcaagagacaactccgtccagacttgtaaacccacaaagctcaaagctgttgttgccacggaaatgtgcaaatatgttatccccattagaaactattatagccttctcactccgaattaacccacagattctcatttagcatgacgtcccctgcatcaacatgattttgcataagctaagcaaaccaaaagcttatgtaagttagagaattgagttaaaaagtttcaatttttttataacgtaggccaatcgaagcaagtaaaattcaaaaccatgatcacgaagttcataggatactgcaattgagagagatatgtattaaataagtaaaattgaagaaactgggaaattcaattaaccaaaggagagagatgagctgaaagattgaggtcaatagaagaaaatatgaagataatggtggattctgcagagagcgaaatggatcaaaacctgagttcgcgattggaaaattctcctcagcaccggcaattgcgtcctctttttgtctctctttctcgatggacaaggaaaaatgaagaatataaaatgcggaagaaaaaaactcaaaataataaaccatgcggtaaataaaaagttacttaaatttgacgatgccgacacgaacgagttctatggtcaccgaagtggttccaaagaagtaaagctataaagagcgcgctttgccaaacagaggtgaaaaaaaaacggtagcaaaattctctaatagtcttgtcccacaaccttcttctggttgctgagacctatatcaacatttccagcacattcaaaatcagttacttggtatcaatttgatgtatcatccccttataaaaccgagtttgaacatcgagaatgagcatcgaatgtatcgttgatcatggctctgtccagcatgtttgataacaccaccatagtccataggtataatgatagaaaatcgtcctagcagactctttttctccataaataatatccaaataacttcaactatatcatagttgctacgatattcatatccagaatccgatatcaagaatttgggaaacaaaatccgaacctatgatatgaaagtagtcaaacgtacatagatcattgatgtaacgaaaaaagtcaaaatcccgaacacataggaccgtgggaaatgtcattctccttgattcaccaaaggacaccttaaagttcacaaattcactcacttacttccattccatctcaaacaatccaaaataaaacactctagtcaacgtttatgtgacgaatattgttacgctcatcctctttaatctttggaatcaccactttcaacacaccattcttcatttccgccttaatctcatcagtcttgtatactttctccggtaactcaatcctactcgtaaacctccgtccatctccagaaacatcttctccctcctctgtttccccttctcctctaatcaccaatgtgttctgttccaaagccaatttcacatcctctctgcttagtcccggcatatctatccttagatgcaacgcgtcgtctttctctttcacgttccaaccacgtctaactccagaagctcccattccacgagtagctgataccaaagggatttcgcttacctggtccatgaaattcagcatctggctcaagcttctcgttggagtaaacggatcgagtatatctgtttgaaaaaacaaccaaattttcagattcaacagatctccaaaacaaagttagatgtactctatacataaatcactaaacatgtatcaaattgggaaaatctatagcgaaattggacggaggaaccatggatttacgtgagaagaaatcgccgccgtggcgagaaacatgtcggtttgagtgatggttcctatcgacaccgtcttcatagtttctggcggcgttggtattgaagaggcgagatgaagcagccaccggacgaacggctcttaaggcgcgagggacggcgacggtggaagaagagagaagtctcctgagagctaaagccgatgatgacgccatttttggaaagagaagaagcttagaattagcaagtgattaattattttcaagctcgatgagatattttttatactctttgaacgaaaaaaaagctgttagagaaaggtttatatagaacagagagtagaagaagctgctagaggctagagagtcgcttaaggatggttctagaactgcgtggtctccaagtaaaataaagaaaaataaagaaaaagaaagaagaaaactttttccgtgacggcccatcactttggggcccagatttgtaaatttatcttccgtttactttggtttggttttaaagtcgaatttgaaagtcggtttagatcgatttggtttagtttcttcttcagtgtatctgcgaaatcagaggatcttcttctcttcaacatcatcatcgtcgaagctgaagagaatctaaggtaaatcgggtgatcggatcaaggatg

SEQ ID NO: 2492 - DNA, 3000 bp, Unknown
  misc_feature (1)..( 3000): cDNA_ID_2162798_gDNA_ID_1620547_Annot_ID_160195 3000 nt of promoter + ATG
gatcgccactagcaaatacatcctcaaccgtcgagcttaactgagttaaccctgcagcatcctgtacatataccaaaaagaagagaatcaattgcagatctacccccaagtgtccacataatggatcacaaaatcactatgaatactaacctgtagtgttttgtaggcagcctccattctctgtttgacattgtccactctagcaagcgcagctatacaatctgctgaagaaccctctgcctgcagagtaccgaattcgataagagcacaagtttcaggaatttgatataatctaattttcgagaagagatccaaacaaaatctcaggaatcagcacaaatgcgtaccttcttgagcttctggaggattccagcaacagaaccacgcagagacacagcatcatcacggagacgcaacacgtctcgtgtggcacgaggaacacggaggagagcaccaccgctctgctcttcaagagaagctccgatctcctcggaggcaatctgaagcttcatttccagatccacaagatgtttctcgagtgaatcctgtgggtgacgcgcctggcacgacgagttaacccatcgcttcgcatcgaacttctcatctgagaatggacctagatccagcatcatccttgatccgatcacccgatttaccttagattctcttcagcttcgacgatgatgatgttgaagagaagaagatcctctgatttcgcagatacactgaagaagaaactaaaccaaatcgatctaaaccgactttcaaattcgactttaaaaccaaaccaaagtaaacggaagataaatttacaaatctgggccccaaagtgatgggccgtcacggaaaaagttttcttctttctttttctttatttttctttattttacttggagaccacgcagttctagaaccatccttaagcgactctctagcctctagcagcttcttctactctctgttctatataaacctttctctaacagcttttttttcgttcaaagagtataaaaaatatctcatcgagcttgaaaataattaatcacttgctaattctaagcttcttctctttccaaaaatggcgtcatcatcggctttagctctcaggagacttctctcttcttccaccgtcgccgtccctcgcgccttaagagccgttcgtccggtggctgcttcatctcgcctcttcaataccaacgccgccagaaactatgaagacggtgtcgataggaaccatcactcaaaccgacatgtttctcgccacggcggcgatttcttctcacgtaaatccatggttcctccgtccaatttcgctatagattttcccaatttgatacatgtttagtgatttatgtatagagtacatctaactttgttttggagatctgttgaatctgaaaatttggttgttttttcaaacagatatactcgatccgtttactccaacgagaagcttgagccagatgctgaatttcatggaccaggtaagcgaaatccctttggtatcagctactcgtggaatgggagcttctggagttagacgtggttggaacgtgaaagagaaagacgacgcgttgcatctaaggatagatatgccgggactaagcagagaggatgtgaaattggctttggaacagaacacattggtgattagaggagaaggggaaacagaggagggagaagatgtttctggagatggacggaggtttacgagtaggattgagttaccggagaaagtatacaagactgatgagattaaggcggaaatgaagaatggtgtgttgaaagtggtgattccaaagattaaagaggatgagcgtaacaatattcgtcacataaacgttgactagagtgttttattttggattgtttgagatggaatggaagtaagtgagtgaatttgtgaactttaaggtgtcctttggtgaatcaaggagaatgacatttcccacggtcctatgtgttcgggattttgacttttttcgttacatcaatgatctatgtacgtttgactactttcatatcataggttcggattttgtttcccaaattcttgatatcggattctggatatgaatatcgtagcaactatgatatagttgaagttatttggatattatttatggagaaaaagagtctgctaggacgattttctatcattatacctatggactatggtggtgttatcaaacatgctggacagagccatgatcaacgatacattcgatgctcattctcgatgttcaaactcggttttataaggggatgatacatcaaattgataccaagtaactgattttgaatgtgctggaaatgttgatataggtctcagcaaccagaagaaggttgtgggacaagactattagagaattttgctaccgtttttttttcacctctgtttggcaaagcgcgctctttatagctttacttctttggaaccacttcggtgaccatagaactcgttcgtgtcggcatcgtcaaatttaagtaactttttatttaccgcatggtttattattttgagtttttttcttccgcattttatattcttcatttttccttgtccatcgagaaagagagacaaaaagaggacgcaattgccggtgctgaggagaattttccaatcgcgaactcaggttttgatccatttcgctctctgcagaatccaccattatcttcatattttcttctattgacctcaatctttcagctcatctctctcctttggttaattgaatttcccagtttcttcaattttacttatttaatacatatctctctcaattgcagtatcctatgaacttcgtgatcatggttttgaattttacttgcttcgattggcctacgttataaaaaaattgaaactttttaactcaattctctaacttacataagcttttggtttgcttagcttatgcaaaatcatgttgatgcaggggacgtcatgctaaatgagaatctgtgggttaattcggagtgagaaggctataatagtttcta

SEQ ID NO: 2493 - DNA, 3000 bp, Unknown
  misc_feature (1)..( 3000): cDNA_ID_2990998_gDNA_ID_1620547_Annot_ID_160194 3000 nt of promoter + ATG
gatttgagtgtttcttgaagcatagagatatactgcaacattatgtcatctaatgcaagtatcagctcgtctgcctctgaccctccagtaaagccaatacacctttcaactgcagcttcaagaagaacaacaacttggggaatagactcttccatcctacgcactgtttcactgagttcaattccttgagccccaacaccacgagtaacagcccctctcagatccaccactgcaatctcagaggataaaatagcacgttccatcttcccatacctaaagcatgatcaaaccttatgtcacaaacagccttgaagaaccacgacccaaaaaagtttcatcaaaaaaatgggacaatccataaatactagaaatggatacaagacatgggggaagagaagtacacaacatgaaaacttacttttgcttaaacgattcaaagggtgagtacacggccttcagcgtatctattaagatcctaagttcagattccgcaaacaggtgctgaatatttcttgcaaaggaaccagttacgttgtgcagttcaatcagagcctcaagatgcttggtctgaatattaatacccttgggcaagtctccagataatagatccatcacacctgttcaaggaaaacatcagaattgtcagtattctcctaaatacacaaaatacagatataagtcaattgaagataatcgtgcattgtctggaaaatttccagtgactaaatgaaaaatgtaacaaataagttgttgttcaaacttcctgcaagtctctcttgcatattgacagattcatgacatcggccactatgcacaaaaattacaaacttaacaagaacagccaaaaactttagctcatgtaaaggcagaaaaaagtgatactcttcttacatctatctacccaaacatgaggatggtagagtagaaccactaaagaagcaacgcaatcccaattcagctgggtaaaaagactagactaagaaggaaacctaataatcaaactgtactgacatcatatctaacctttggcgagtgcttttgtttcaggaacagcatctccagttgcaaggttaagacgagaaacaaaactagcccccagtactcccatggtctcaaccaacagctttgggacgagagtcatgtagtcatcagggaaggcaaccatacacctaaacaatcatgaaagcaaaaacgtacaacagtgattgatacttaaagctgcaatcacctaaagatctgacatactgtcactggaagggcccggaaaatatatacagtttactgtaaataaaagtaaaacatttaccatttccactcttgctcaagatagagtagcaactcgtcgtaaaagcttgtcagccaactggcaaatgatgtctgagatgatgtcgactgaaactcatcgccgctagacaacctttgactttcacttctctcattggcaagcttgtttgccctttgctttgtgtcaaaatcttcccagagttgtttaatcggctttagacggacttttgaatattgcaactccagagacttgaatctcccaatccggatgagaattactcgcaaatcttgggcgacatcaacctgccaaatttggggaaaggcttttcagtccaataatggcaacagagacattacaacctaaagtagttgggttctctagatatacaggttccaaccttgtgatatgttaatgcatcagtaagacgtggctgcaccatcgcctccagcctatcttccaatacctctagttgctttctcacattagcaaattctgcaacctgttgacaaaaattggactttaagtggtgacggaaaaagacttaaatcctcagagtactgaagctgacataaaactacctctccaacagcagacaggcaatttcgcatgctagcaagagtttctgcagcacgaggaagatcgccactagcaaatacatcctcaaccgtcgagcttaactgagttaaccctgcagcatcctgtacatataccaaaaagaagagaatcaattgcagatctacccccaagtgtccacataatggatcacaaaatcactatgaatactaacctgtagtgttttgtaggcagcctccattctctgtttgacattgtccactctagcaagcgcagctatacaatctgctgaagaaccctctgcctgcagagtaccgaattcgataagagcacaagtttcaggaatttgatataatctaattttcgagaagagatccaaacaaaatctcaggaatcagcacaaatgcgtaccttcttgagcttctggaggattccagcaacagaaccacgcagagacacagcatcatcacggagacgcaacacgtctcgtgtggcacgaggaacacggaggagagcaccaccgctctgctcttcaagagaagctccgatctcctcggaggcaatctgaagcttcatttccagatccacaagatgtttctcgagtgaatcctgtgggtgacgcgcctggcacgacgagttaacccatcgcttcgcatcgaacttctcatctgagaatggacctagatccagcatcatccttgatccgatcacccgatttaccttagattctcttcagcttcgacgatgatgatgttgaagagaagaagatcctctgatttcgcagatacactgaagaagaaactaaaccaaatcgatctaaaccgactttcaaattcgactttaaaaccaaaccaaagtaaacggaagataaatttacaaatctgggccccaaagtgatgggccgtcacggaaaaagttttcttctttctttttctttatttttctttattttacttggagaccacgcagttctagaaccatccttaagcgactctctagcctctagcagcttcttctactctctgttctatataaacctttctctaacagcttttttttcgttcaaagagtataaaaaatatctcatcgagcttgaaaataattaatcacttgctaattctaagcttcttctctttccaaaa

SEQ ID NO: 2494 - DNA, 3000 bp, Unknown
  misc_feature (1)..( 3000): cDNA_ID_2162779_gDNA_ID_1620547_Annot_ID_160190 3000 nt of promoter + ATG
gtttttcgcctctgttcacctctctggttacacagcgcttttcatctcatggctcgccaatttcaaactcatactcttctccttcaatcaaggcccactttttccacttccctcaaatctcacccgattcatctgcttcgcttgcttccccatcaagcttcaacaaaaccctaagcgccgagactatttcttccaatgggaataccccattgaagttttgtttagtaaccaattcgtgactaaagttgtaatcttgagtgtagtgttacatatgtataatcacatacaacatatatatcccattgtgctatttgttctctatccactccatctatacttggtacttgagattctcttaaagctcttcaacgctttcttctctatagctcttgattgcgaactcgagccacagctgaatgaaccatacttggcctattctcttcgagacttctggggtcactggtggacactcatgctcccgacgatcctcctgccagacgtctacgctaggatgcggcgaatcactgaagggaaaatgaactccgagaatgctctgtacttgggagtttttgtcacattccttgtctccggtgcacttcacgagtttctcttcttctatataactcgtgagcggcctactggagaggttactctgttcttcgtgttacatggggtttgcattgtggcgtacgacgccaggttaaagaagaagattgcgcggtggatagggtttgaattttgcccgtgtttgatattacaagtgatggttatggggtttgtcgttgtgactgctggttggttgtttttccctcctcttgtcaggaccggcaagattcagagattcgctaacgaagccttgctcttcattggtttcgtgcgcaacttgtttaacgaatccttgttcttcatgcgtaagttttttaacgaagccttgttcttcactggtttcgtcatgcgcaagttgtttaacggagccttgtttttcattggtttcgtcaagctcaagttgtttaacgaatcctccttgttcttcatcatgcgcaagttgtttaacgaagccatgttcttcattggtttcgtcatacgcaagttgtttaacgaagccatgttcttcattggtttcgtcaagctcaagttgtttacttttggctggtgataaattgctaaatcatgatataagggatttaagtgtttctgtagctcgattatcatatcatctctctctgtttcaaaacaattgtggctttacaatttcaatgtgatttatttatttatataagtttactagtttacccttgaatggtaaaaagatttcttattttgtgtgagatgcaaaacgaaggctctaaatggcctttgaattcagctgaattcaacggtaaaggtaagcatctcaccttctacaatatgaaaagcaaagataataagcccttcttacaatctagggatgtgttaaaaaaccagagatgaacaaggcttcgttaaacaactcgcgcatgatgaagaacaaggattcactatgttatcgcgtcaaggttcttgctgctactgtatgatttatgtgtcacaaagcttaaacatgttttttttttttttgctaatatcatttttatttggaatgcatgttctcttttggtgtatgcaactatgtaaagaacacatcaaaatactcattggtccttgctaaaggtttagagacgttccaatggctctttgttttagggaatgcaaggtgatcacgtatacatatgtgaaataagagttaaaacgagtaatgtatcttgttcttgttttcacacaaatactaagtcattggaacagagcattctccgtacgtctttagtacatttaattaagggtttgtttgacaagtctttagtacattgatttttctagctagtaaagtctatacgattatggaaacgttttgaagtcactataatattcaaaacaaaacgttcccatagtcacaaagtttaggacgggtgatgattagtaggcatgtccattttaagacgggttgaatttcgtgaacttttattccgaagtcaattcttagccaaactagttaacttttacgcgtttcaaaatcaacctttatccaaattagtgatagtttgaaaagtgaatttaactacaaatgttttatgaattcattttgtaacctatcttcagtcaaattagtgaatatttatttattttgccaaagtcaactcttagcttaattaatgaatacttgaaaagtaaatttggctacattttcatacaatttttttatggctacatgaatttaacccaatctgaattccatctcgtaacatgaaattttcatttcgttatggccattaatggtgacatagaccgcacccaaaaccgtaccgcaacagtgctgtaacagtatcaaaatctttacatatacatatgtatctatatattttcgttactatttgaaccgcaccgcacttctcctgcaccgcaaaacgcagccaccattcaaatcaataggtatcaaaaataattcaggttgtgttttttactattcggattgcccgtttctgatttttattcgctagtatctgttctaatatctgaaataaatgtatttagcgatcaatatttttctttcccctataatataaatcaatatttttgttttctaaaataataaaacttaaatttgtgattgccttatgtctatgaatttattaaaaatttaatttcgttaagtgttttgttttttcgtgatattattttttagttcaactttttcttgatatgattattcattatttatatagggaatagagttttttattttttattttgcaatcatagagttttaccatagacgaacgccttttattcgtcgtggcgaacgaaaccctaatcatcacttctccacttttgttcgtcatcctcttcaaaatttcttcaatttgattctgcaatttcctttatctctctctggattaagtttcaatttcttcttagcccgccatg

SEQ ID NO: 2495 - DNA, 3000 bp, Unknown
  misc_feature (1)..( 3000): cDNA_ID_3068166_gDNA_ID_1620547_Annot_ID_160181 3000 nt of promoter + ATG
aaactctcaaaatacgaaagcgcagcgatccaaccatcgtccattctatggtcacaaatactcaactcctcaagcacttcacaacattgcccaattgctttaatcccatcaaagctaccttcacaaccactaagctcaagcttcaccaaactcctacatccttgtgctaagaatgttaatcctatatccgacacagatgaactatacaatccgtctacgcttcctaccaatctcaatcccttcagattcttacacgcagcaatgccatgcaagagattatcattacacttatgcaattctaactcttgcaaatcagagcagtctccagctaaactcaataatcccaattcagaagcgttaatcactttaaggttaagcaaatcaaaactctctctgcttaatatcctaagccctctatcaattacgtcactgtgcaatagattctcctcaagaaactcccaattcgacgagtctgaagataaatgaaaagaaatcgacttgtgacagaacaaaataccggaattgacccgcggattcatacacgcgttcaccaaatcgacatgcgtgagattagggaatctcgtggtgagtctctcagacaagagaaaatcaaaatcaagaagctttagactccgtaaacgttgtccctgaagattcaaccagcgtttgcagacgagtgagacgtcgttgctctgtgattcaggaagcttctcgatgatcttgaggagaagagaatcggataaagagagagttgaatcgatttctgaaggtttgattgaattgaaaggcttctcatttttgatgtggttttggacatgcttatcaaattcagacatttcttgtttgctccttcagctgtatatcttctttaactgaatttgcgcgtctttattgttgttgtcttaacccagaaatagtggtcttctttggacaaggactagaaatcaactcttcgtcttcgagttttttcggtttggttagttccggtttaggatatttggttatggaagagactggttctgatttaaaccgaaaaactataaagaataaacctagattcggttctcccagtcaaattcgtcagcttaatcaatcacctctttagtttcccataattctcaatttgatacatataacccccatcctcaattatgctactttcgtttattaatgatcgatttggttcttcatatgtataaacttttgaatcagaaacaaaatgacattactttcttacaaaatttgtcacaaacaaaaatataaaataaaaccctagtttatactcttccatattgatgatgaaatcttcgtagtcctgatcagtgaatctcttctcttccattaatgaactttggtatggagaatgcttttccagtgatcaatgacggcctttgactcagacctgattttagggttaccgttcttagagagaaatagaagaacgcgtaaaccgtcggttttggtaataagacgagcgtttagaggtaaggttcgcatatgtctaaggatctcaacgcattgtatggcttccggagagactatgtaaaaccctttgtctcttgcaacatgagcggctcttgtggcggtgcttatcaattcttcaagttgcttcgtcttgatcgttcttctttttctgtttcttctcgtcttcacatgatcgttcacacgtggtggtggtgggagatcatcggaaaaagccattgtttgagagaaaaacaacgcagagaaaaagtacttaagaaactagagactgagagagaaaattaaagagcgagattgatgaacaatgtgagagatgaggactacctcgttgattatatagacatatttaaagtttccaattttcggaaaaaggaaattccaatttttaatttatttttttgtattcaatctacgtcggtttatttgagatcgccacatatttcctttttctgtaataaataacaaggaaaaccaaatatatttttctttaaaaaaaaaaaaacttatgttctgatcaacaaattacatgtgtttgcttgggggccaagtttaaaccccatatactacacctttgggtttcggatgcagaagacttcgaaatcggtctcattgtcctatgttgattatagtgattgatgaagataagaagaagaaaacgtaaagagctttattgcttttactttatgtaatggttctactgtatatatatacagaggaagtgattattgttcactgcttttatcgagaaaacttaacaaaaacccactcacgatccggcgagctattagattaggaatttgtcggcacaaacgtccgtcgatataagctacaatacctggagccacgaaattcccaatactagctttccacttgattttcttcttcttactgtcactaactactactggtaccattgcagtattggacctgtaatgaccttagtggcttgctgtttcagtaagcgaattgcaaagctgacgagtaaatgttcacacaatgtcataaacgttggcccgatcttccattcctcatcatattgagagataatatgttcacatgactcagggtccatccaaatcaaacaaagagcttatcctaaattgaaggtaaacctctatttggtgagtttccaaaatgagcaaacctctcgtggtaagtctctcagacaagagaaaatcgaaatcaagaacctttagacgtacttgtccctgaagaaattgggttatttggttatgaaagaaattggttctgatttaaaccggaaaaagaaatttggttcggtttggtttagagagagaagaaataaactaaaatatttcccgtgaatatgagcgagcaatcaatgagaacagcttttcactcaaaagcacactcccccatcaaagtttcttgcttttcgtctctttccactgttttagattttcatttcaatcatcttttgtatctttatcagcttttatatatgcttcttcttacagatctctcagactctctcttcttcttcttcaaactataatg

SEQ ID NO: 2496 - DNA, 3000 bp, Unknown
  misc_feature (1)..( 3000): cDNA_ID_2162766_gDNA_ID_1620547_Annot_ID_160186 3000 nt of promoter + ATG
gtctgcaaacgctggttgaatcttcagggacaacgtttacggagtctaaagcttcttgattttgattttctcttgtctgagagactcaccacgagattccctaatctcacgcatgtcgatttggtgaacgcgtgtatgaatccgcgggtcaattccggtattttgttctgtcacaagtcgatttcttttcatttatcttcagactcgtcgaattgggagtttcttgaggagaatctattgcacagtgacgtaattgatagagggcttaggatattaagcagagagagttttgatttgcttaaccttaaagtgattaacgcttctgaattgggattattgagtttagctggagactgctctgatttgcaagagttagaattgcataagtgtaatgataatctcttgcatggcattgctgcgtgtaagaatctgaagggattgagattggtaggaagcgtagacggattgtatagttcatctgtgtcggatataggattaacattcttagcacaaggatgtaggagtttggtgaagcttgagcttagtggttgtgaaggtagctttgatgggattaaagcaattgggcaatgttgtgaagtgcttgaggagttgagtatttgtgaccatagaatggacgatggttggatcgctgcgctttcgtattttgagagtttgaagatattgaggatttcgtcttgtagaaagatagacgctagtcctggaccggaaaagttgttgcggtcttgtcctgctatggagagtttgcagctcaagaggtgttgtttgaatgacaaggaggggataaaagctttgtttaaagtgtgtgatggagcaacagaggttaatattcaggattgttggggactgagtgatgattgtttcagtttggctaaagctttcaggtaacttgtcctttttgcttcattggtcttctcggtgggcttttgaatcatcatttttgttctttgcaggagggtgaggtttctgtctttggaaggatgctcagttttaacatcaggaggtttagagtcggtgattttacattgggaagagcttgagagtatgagagtagtgtcatgtaagagcataaaagacagcgaaatttcaccagcgctctcgtctttgttctcacttctcaaagaactaacttggagaccagacactaggtctcatctctcgtcgagtcttgaaggtgccgggattggaattagaggcagcaaattcttcaagaagagtgttttacattgaacatatgttgtgtaagtgcaaactcttagtttattatcttcttccctggggcattactactctctcttgtaaaataacacatcccaaactcttatgtatagcaatgtatagtattaaaactcttgcgttcacaatactaaatttcaattttagctgattagagattttaaaaaaaaaattgtaaggtttgtagtaataaatctttttatacaagagaaataccctaaaataccacactattaagttttagttccaaaagtatcatcattagttttttttcttcgaataatactacaactttttgtataaaaataattgttcaaccaaaatatattacaaataaaatataagatattttggatttcctattttcaattttgggtttatatttttactatttaaaagagattataattcattttaatattcaatgtgtggtaatattgggaaaaaataatattagtgatagtatttttaaaacaaaaacttaaaaatgtggtatgtttgagaattgctcttatacagctagtgttgcagtcatcgcaaatcaaccacaatagtaaagaagtaccatataagttatatttgaaaactctcaacctaatgcaacgaattataaacacatgatattctcaacatgatccgtgacagccgatattcttgctgacgacgttctagtctgaatttgaactcttctacgtctatttcgttttggtagtaatagtaaacgtgtgttgcatacttactccaatgatggagtataacgaattcatcaccagccaccaggatgagtgacatccgcaaatgtgatcggactaattaaaccttgaagcatgccagaaaaagtaaccttggaccaatcttgtttctcggcatcctccataactcacatatccgcatcctcgttgatcatgttattgcgaaatatccatgctaacttcccttggtagtttataagagtggaacctctatggctaatcgttatgttattgggagtctggacattgattaaatatctcagacctaacatcgaaaactcaccaaaacacaactaccgtccggatccttttctgttgctttgtaatagattgccccgttgatgcaaactgcattatcgaatggaaagtgacttccaatgccgcattgaaaattctcccatttctttttgggatctccgaatgtaagacttctatgcatataatttacacattttaaaaggtttgtttgttaataataatacccacgatctacgaatactgtatattgtccttttctaattcccacacgttgccttaccgaagtgtgatattatctaaaataggtgtaatgtaattatcataaatatacaaattaaatttttgtaaagaaaaaaatcaattaatatttttcttatcttaaatccgcatattaagctaatcctaatttaataattaacaacataattcaatgttttaagggtaaagtatagtagtagaccattttacacaatttaagagatgtgcacaacactatctttgtctcattctaagtcaaaagtcaacttaaaaatcccaccgtgattcccattttcttttattttagcccaaaaaacaaattaataaaaaattcgaaacactctctttttctctttcgttatgtctctctctctctctctccatctctttcaatgtatccgttagaacagttcgtaatccgccgctaaatcaaaccagcgagagagatagatccaacgtgaagaagaaatcgaaaacg

SEQ ID NO: 2497 - DNA, 35 bp, Unknown
  misc_feature (1)..( 35): cDNA_ID_3068222_gDNA_ID_1620548_Annot_ID_160201 3000 nt of promoter + ATG
tctcatcaatcatctcaagaaggaagaagaagatg

SEQ ID NO: 2498 - DNA, 3000 bp, Unknown
  misc_feature (1)..( 3000): cDNA_ID_3068204_gDNA_ID_1620548_Annot_ID_160212 3000 nt of promoter + ATG
aaaatcgaaacaaacgccatggctgaatcggaacctgaactgaaccccacaactgaactggaacctgaatcaaaccccagtactgcattggaaactgaatcaatccccaaagctgaactggaatccgaacctgatgctatacctgatccaaaacctgaaaccgaaccagagaccaagggtgagaaagctggtgagtaaggtagcagccggggaaaggtgtccatactgttggggacatgtggaaacagatgaatataaaattgcttagtaagttgtgtggtttgtggctacctgtaacgtgtgaggatttgtgttttttggttttgtgttgcattcatgcacatgcctatgcctgccttgaggacgacgacgacccttttgacatgtccccgatttttgtctattcattttaccctattttgtttttgttggtgctactcacaccaaaaacagcacatttgttctctgtttctcctacttttttctatcttttatttaaaacaccgtccattccaataaacaatgtttttgtaattcttccccatctcttagctttcctcgttcgtctctacgttattagtagatctcaagtatcaccataacaaatttgtggttatttgaacaattaactccttcgcgcataacttaactgatatttggcttcttctagtatatccttccatgtttgcacttcccttgtctaattacaagatatggaaatggtggacaacaaatattagttgtgaatcaagaaaatttatcaaatggctgatgtgataagtatagaaaatcttattcatgattaacaaacttgtaagttgtaaactattaatgagtcaacattatattccagatttattttggaaatatgcatgtgtgagctgtaaacgatagaattaccatttaaaaacgatagaaagataagaaaaatattttatcatttaaattttcagtgtaggtcaaaacttaactatggttgaataaccatatttacaaataatgacaaagtaaccacagttaagtaaccatagttaaataaccacgtttaattaaccatggtcaagtaactatagttaagcaattatgggtaaaactggtataataaagtaactttattatttttgaattcaaagaggataattagtacctaaatatattgtttacatttaatttataacctaataatatataattagtctaaatctaataaattcaaaaacagacatgtgtaagttgtagaccacagattaagaagaaaataatttattttcatgtttataccactcttaacctactgagtcaaaacttaaccatggttaacttaaccatgattagtaaattttggatttttactttgaacaacttaataaatttcacacccaaatacattgtttttctcacattatatatttgaggtgttctcaagagagaaaaaaaaaaaaggaaaaaaaactaatatcaaagagcagggtttgtgagggtgtatctgaaaaaaaataaagtttggttgattcaaaaaatattcttatcctcggagttgcgatccaacgattggtatgttttctcctattttcatggtttcttcttctctgtttactttgtgccctttcgctttctcgctttatcactttatactagagaaaattggttttagggctttgaaattgcagtgatctataagggttttatgggtttgtatcacacttttggtgtctctgtgatggcgaaatttgggtttgattttagggtagtggaatttgtaccgtttgtgtgtagatccgtttgaaatgtttttgaaatggttacaattttcgcgggtctcgtactggtttgattgattgcattgaatgaaatgtgcattaggtttttttttgggttcgtagtgattatgagatgcaaatggtattgggagttttgattgtgggtttggtgaattgtggtttaggttaggttagatagaatttgaagatctgtgatcgtaattgtgtttatttggctttgattggttttggttcatcatcagtgattatattgttgttagatttcgaggggaggcttcatttaaatctggatacacctattgttaagatgtttgattgcattagatgatagattctctagatctttcttttatgagccttgtgtatctctttaaccataggttaagtttggtgaattgtggtttagtttaggtttatctcttgttagatagagtttgaagatcgtagttgagtttttgtggctttgattggttttggttcttcatcagtgtttaaatgttgctagattttgagggtcttcattttaatctggatattagttattgttaagatgtttgattgcattggattgatagattctcaagatctttcttttatgatccttgtgtatctctattatattcagctgattgttgcggaatctgtattccgtggatacgcgcaccaatatgtattcaacgggttcacgggcaaatttgtttgtgttttatgtggcttggatatggtaatttcataatatatggccaaagagtggttctctttatgtgtttttaaatgtaatgttaccttaggaaggtcgaaccgggtttgtttagtaaaattcggggtccttctaccggttgagaataatgctaccggataagattgattttcttgagctaatgatttgcatttatggttttacccagttggactagatctgcatctatatcaaattttgggaccttgtagctagttaaacctcatgtggaaacaaatctaccgtttctaggaaaatgtgtgtactcttttaaaatcatcagattctactgaatctgttctctttaataataaacatgatatgcttatataaacattccactgaatctaatattttttatttgcttctttgattttgcattgagacaggtttggaacgttccgaggagtctgttgaagatcctcgattctaaaaagcttccagaggacaataatttgtgacggagtaactctcgaggac

SEQ ID NO: 2499 - DNA, 3000 bp, Unknown
  misc_feature (1)..( 3000): cDNA_ID_2048541_gDNA_ID_1620548_Annot_ID_160217 3000 nt of promoter + ATG
tcaagcttggtctctatgttttagaaaaaaagaaaaacttagagaagcaattgttatttatctcatcacaccaatataatttttggaaccaaattgttaaattaccaaatgtcccaaacttgtgatcaaatttagatgattatttttaaatgaacattaaagaaaaactattatatatatacacacccattatagacgtaactctactgcttccaacttttccctaatctttgttcttccggccaatcaaatgggtgataaacttcgattatccatcggaattttgggtattgtattctttactttttgtgtaatatacactaccacatgctcttttcttcgattttcaaactttttttcaacttttaaacttagttttcgctctaaaatgtgttttgtttgtaacatgatatctacacgaaatatatttgtatgagttttttttttccgggttcttaatacttatatatggccacttcacaggaaacggagcttctctgttgctatatacagctccaatgtacgtagatgaaaactttataaatcgcaaatttaatttgaataaccaagaaagtagactatgtactatatatgtagattaacattttctttctgtttatgtagagtaacattttcaagggtgtttaagaagaaaagcacagaggaattctcatgttttccttacgttatgacactctttaactgtttgatatatacttggtacggtttaccgattgtgagtcatctttgggagaatcttcctctcgtcaccattaatggagtcggcatccttctcgaatctatcttcattttcatatatttctactacgcatcaccaaaagaaaaggtaaagtattcattagaatcgtatggtactttttcattagggaaaataaaaactagtgacattgatccatatagaatataaactttgaaatagattaaggttggtgttacatttgttccggtgatcgttgggttcggcttaacgacagcaatctcagccttggtatttgacgaccatcgtcaccgaaaatcattcgtcggaagtgttggcctcgtggcttccatctctatgtatggttctcctctcgtcgttatggtaagccatataatcaaaccaactattacatactaggaatattttgtttactaaaaaaatatgaatgcgtgtgtgctaattaatgtgaatatttgagtgtgcgcagaagaaagtgatagagacaagaagtgtggaatacatgccgttttacttgtccttcttctcatttctggctagttccctttggttggcatatggcttactcagccatgatctctttcttgcggttcgtttttttcctaattcactcattttccataattaatagcagtacaaaaatactaaatgtggatttaaaaacttcttgctttgtggaccgaaaagagaaattgtcgaaaatctaaaaaaaaaacgttttcttatggattcttaaaatttagtcaatttttgcggtgatcgatcacaaactaatttgacgttaatcagttcatggtgtttcagtagttgaaatatttatcttaaagttgagaaatcaaaattcgagttctactatgatttcaatcatggttagccattgtagatgcttttaatatatagcaaaaaaaaaaagttttcacatattttgctaattaatcttgattttagtcgttcgacggttattaaagaaaactaatatgatgttacataaatcatttttttgttaatgcgtagaatactacaaaacttttttttttttctcgaaatggttagtggtctaagaaacgaaatataaagaattgttgagatttttttttttttttgagatttcatgtgcattgttttgatgatggcatatatcgaatgtttttttcttacatgtatagtcacctaatatggttgcgactccattgggaattctccaacttatcctctacttcaagtacaagaataagaaggatttagcaccaacaacaatggtgatcaccaaacgaaatgatcatgatgacaagaacaaagccacacttgagtttgttgttgacgttgatcgtaatagtgataccaatgagaagaattctaacaatgcctcatcgatctaatatctcggatgtgttttccccaaaactccttgtaaatccagagatattttatctaaacacctcatatgttgtacgtgctttcattaaataacgttacatcactctatacgttatggtggtgatgatattgttgatcatgtgaaaaataaaggtggaagtgctatgttttcctctgtatttatattataagatcaagtgtatatgtacacgaaagatcaatgtgttgacaaaaatggaaaaaagagttaccgaaacttaaattttttttgacgaatggagaattattgaaatacttttttttttgtgtaaaaatgttaataaagatgggtttaaagtttaaaccacaaaaaacaccattatggttttaatcaactcttcttgaattttgttttaattttacccctagacgtaatactgggctaataaaagcgtaaggcccattaatagttggttctattcataaagcccaataacgaagacgctcttaaaacaaaacgccgtttaaagaaaccgcgataaaacgcacatatggattctcccaaataaatccctatcaccaaatcttcttctcttctttatcttccccaacgcgaaaccctaatttctctgcagatttttcccaaatctcaggtaacatgatctcttttcttatttcggattctttcgtagtaatatatgaactttgctgctaattttttcatcctataacgtatttgaattcttcggctcgataatgattcttcataagcgtcaatttgtttgattttttgacgaatttgttgagatctgaaaattttgtgattcgtactactgtagctgcttctcgttcataaccttggttcgttgtgttatttgtagctctaagattcgttgtgagcaatg

SEQ ID NO: 2500 - DNA, 3000 bp, Unknown
  misc_feature (1)..( 3000): cDNA_ID_2048538_gDNA_ID_1620548_Annot_ID_160218 3000 nt of promoter + ATG
cttcctaaccgttcagagccaaaatgctttgcatcttaaccaaaatttagtaatttagagcaaccaattatttttttatttttaaaagttggtgaaagtttttacaatacattgaaaaagacaattgtgcagattttcaacaattttaacaaattgcttgatatatcaccgtaaattattcggattagaatattctacatgttttccgtagttaacataattgaataaacaattgatgaacaaaaaatgagtggttgatattgttggattacgattaaaacctccaacgtcaattgtcgcaaaatattctcggatagagacattttattggtgacgtacattcaaatttggataatgcatgacacaatagatgatgacaaaaagtaacctattcatggttccttcgtctttaggtaatctcaatgctaggaaaaactgtgtctaaaactcgagtacatcacttcttaacaaacattaaatattaaatgattaaataggaatgacattaaaaacaatacaatcatcaattttattttaattttgtaaaaatcttaaactttttaacaaaaaacgaaaagataaataaacctttgtagaaaacttttagttgcattgaatttttggtcaatggtatttaatagagttaggtctgaccatttttcttgcattgaaaatcagttaggtggagtaatacaaggtcaaagaggaaaccatctaaaaagaaaaactcgttggatatcaaaatttagaactatgatatcatcatataaacatatattgttggggtggctagagaaaacaaacccatccgaagacgttattttttctcattctcaaaagtcaatttttttttttcttttgtccaaaatactatatctaaggataccagtataccacaatattatttttggactatttttgttaaacgaaacttaaaaaaaaaacggtaaccaaaagacttactcatttgtgattttttttcgttggcttaaaacggtaaccaggatcgatcgactgtctcatcatttgtgatttttttttgccagtactttattttttttggtaaactagattggtcttataacttataagttataacaaaatcacatccctctgtaaatttatttattttaactttaaccaaaaaatcaaaagaataagttgtgctgtgttgaggacaaattttataataaagaaataaggacacgaaggaagaatggaagtccttgctagttggtgccatttccaatacgattccaacaacttagccaacttttttttttttttttttttttgataaagaacaccttagccaacttacgaaaagtttctaactctttcgttctttattagttctatatgtattaatgcatgcattattgtgaccaaaaagtatatattaaataaaaaatgtatattttcatgtaattttgtttgtaatattatttattttagttttataaattcaccgtattctattagttcgctaggttcttgaaactcaaaatttgattcttgagtgatatatggtaatctagcaactcgaattagcctgtaaattaatttagaacaatgtaaagatttcatgtttttacgtataaattacatgtttgcaaattaattagtttggattttggtatataaatgaggatattttcattcatttaagtgttttgatgttgagaaaacataggtataaatgatgaatatataacaccaacatcataattgttagtaaatattcatttgaaaagagtgagatcagaaattgattgataaggaagagacaatacaaaagagatggaaaatgaactaagtaaaccataagcataactggatgtgcatttcaagcataatttggctcaaaactaaatttataattaaaatagataatcctaattttttgacaagattttttttttgttgagaaaatgtttataatatacaaagttcttgataaaggacactagtttcacaccccacgtgttgctaaccggccaccacaaagctaacttaaaaatgtttttaacttttttaattggagttcctttttatctccatgcattattatcattttctattatatattccataagcacttaaacaaatcagtcttctttattcgattcggaatttaatgtgatacaaacaaaataatcaaagtttttgtgtgtatatccgtttaaaaaaagggagatttgtgtgtacgatttggatcaagcctttttgcgcatcaaaattgtcacttgcagacgttaatgtgcccgttagaccttcacaatctattaaactaaataatttaaaaaatttctattactggatatatatatatatatatatatataacgttataatcaggtaaaattactttcgtaaaaacaaaaaacaaaaaatgatttacaaatttggttttgtaagatatatatatatatatatatatatatatgcgtttgtaatttgggatggaatggttgctaataggttgttgaatcacataatttgtgtgatatatcatctagtgttatacgtgtatataagtttgtgtaagacattgtatatataaacaacttaatctccacacacgtctaataatgtcatatatatggtctgataactccaagaacttgaaattagatttagtaaactcaagaaatgaacaaccatctttctaggttcgtttctagttaatgaaacatccgtgtatgaaaattatatgttattctaaaatttccagtagtttttctaattcaagcttggtctctatgttttagaaaaaaagaaaaacttagagaagcaattgttatttatctcatcacaccaatataatttttggaaccaaattgttaaattaccaaatgtcccaaacttgtgatcaaatttagatgattatttttaaatgaacattaaagaaaaactattatatatatacacacccattatagacgtaactctactgcttccaacttttccctaatctttgttcttccggccaatcaaatg

SEQ ID NO: 2501 - DNA, 3000 bp, Unknown
  misc_feature (1)..( 3000): cDNA_ID_2048545_gDNA_ID_1620548_Annot_ID_160216 3000 nt of promoter + ATG
tttgacgtgaatgtaaatggatcagcagggccatgtcaaggcaatatcttcagtggcagcctaatgcattaggagaaagagcacatgtgtgtttgtttcctttctcctttccctgacactgcctctcttttccctactctctccctcacacttccctttatcagatatatattctaggatttgtgagatatggtcttacataggtgtagttagtgtttttgtttgatatcataggcaggggccagctctaccttacataggtgtagttagtatttttgtttgatatgataggatgctactctatctgtatctgcacatcttttgtgatataggactgtgtcatagtttatgtgactgatgaatctatctagaggttcatcaatctgctaaccttttgggctgttccttgtgtctaatgtgattgtttgatatgttggaagacaaatcttatgccttccagagagcgtaacctgaaatcaagcttgtcacgtcatattatgttggtttaatttgctatcttaacttttgtcatgctgtatgaattttatacttagagagttggcattaactaaagttttcttggaatgttgctgaagggcaaaataattacagatgctacactggagtctttatagttaactcttctggctctttttttctttgttgttctaattgctggtttgccatgcaggtattctcagcatttgggtttgtccacaagattactactttcgagaagacagccggataccaagtatgttccaagccattaatttgctattttgctttgtattttaatgttaatatctattatacttaaaatgtttactgtctgacttgctcgtaggcactggttcaatttactgatgcagaaactgcaaccgctgcaaaacttgccctcgatggaagaagcatccctaggtgacagttgtattaaatttttgacatggtatttagtctaactgtgaagggctgcatggttctagatatttgtttggagggtctgacatttggagcctttcaagcgtctgttggagttttagcactaatggcttgttccctagtgatgtatggctaatagcgttaatagatgtaggaaaacgaatttgtaacgagtcttttcatgtaggaacctgggaaaatactgtaggcaatggtagatacttagattaggattgtttttccatgtagaattcttggaaacatcgtctgtttattttatcacaaaccatacaggctttgcgttataagattctatatgtttgttagaggcatacttgtttactgacttatctttctgggcattaggtatctactcgctgagaccgtgggacaatgctcacttaaaatcacatattcagctcatacagatctgactgtcaaatttcagagtcatcggagcaggtatgtatgtgtattcacactttgtgttgaaacatgttttggtttacttggtgattgacatacttctgggaccaaaattactgaattgtttactctctatcttgcagggactatactaatccttaccttcccgttgctccatcagccattgatagtactggtcaggtgagcaatttgagatcagtctcttactggaaaatgcatttatgattgtaaatctgctttctacttagttgaatctcttactggtgatgtttattttatacaaagagatgcatgaaaaaatgcagacttcatttgttggtttagttactaaagtgaaagattaatgtgtcattcttactaggtggctgtgggtgtagacgggaagaagatggaacctgaaagtaatgttcttctcgcatctattgaaaacatgcagtatgcagtaaccttggatgttttacacatggtaatactggctctctattctaaaacctcgttgaaactttggttctgaaaatattgattctcttctcttgtatattgacgagtaggtttttgcggcttttggggaagttcaaaagattgcaatgtttgacaagaatggtggggtacaggcactgatccaatactcaggtaacatcttgtatgatatactctgttttagttattattgatctctgtaaagagcaaattctcaaatgactctggcgggtttcttccagatgttcaaacggctgtggtggcgaaggaagcattggaaggacattgtatctacgatggtggtttttgtaagctccacattacttattcacgccacaccgacctcagcataaaggtgaacaacgatagaagcagagactacacaatgcccaacccaccggttccaatgcctcaacaacccgttcagaatccatacgccggcaatccacagcaataccacgcagcaggtgggagccaccaccagcagcagcagcagccacaaggtggatgggtccaaccaggagggcaaggctctatgggaatgggtggtggtggtcacaatcattacatggcaccaccatcttcaagctcaatgcatcaaggtccgggtggtcatatgcctccacagcattatggtggtcctggtccaatgcattagagagagaaaagaaagtccctcaaaagtcgaagacaaagaaagatgtttaatctctctctttatttctcttagctctgttttttaaagtttggaacacttgtacttgtgtccaaaagatgtttttttaaggataaaaccatttgagaaatgtattagaagctcttgatttctctatctatgtctctctctcgccactcaccatatcattttcattatcaaaactctgtctaatcatgtacaagtgaaaaattattattggccaaattttgtgaaacattggttagaattactggataagatttttttaactcaagtgaagaaaaaaaaaacacaggaagagaaagataaagagaggaggatcttgtggctcccgagtctccaagtaaagtcttctcttttgctctgaaataaaaagagtaagagaagaaggaagaagaagataaaggattcaaaaaaccctaaacactccaatg

SEQ ID NO: 2502 - DNA, 3000 bp, Unknown
  misc_feature (1)..( 3000): cDNA_ID_2048590_gDNA_ID_1620548_Annot_ID_160204 3000 nt of promoter + ATG
cagtaaatgtttagtgaactaatctgtgatttgacttttcgctcaatgtgaatactttcttatatgatacaatcgtaattgtgtagaaaatacaatattgtagtcgcattatctattatgcctgaccactagaaagtctttagaattttggtcatagtcatacactcttacttgtttagttgtttggaaagagttgacttttgtaatcccttcaataataatcatctatctcctaattctcttttcaacaaaaatatttatataaataatgattcaaataatcaaataaataaacaaaatcataacaataatatagcacagcgggataaacaattaatcaacttagttttgcattttaagtaattttttggataattctttctagaactcaattctcacttttataattcgattttctcttataatcccaaaacttatcattcaagtgaatcttatttttgtgattttcctccttctcttcttttacagagatatactcgaaatcttttttacccttttatataggtcacgaacattctatccatcttttacgtaatagatacacacacaaaaatacagtaaaatattttaaaacgaataatataattaaaatgattacgtacactttgggaccaatccaattacaaaaagggtttcgtcactgctttagtttccaacaccaaaccaaacaaaaaaatggatttaacaaaattaatatcattctctctcttgtttctatctcttctaatcccgacgacgacgacgaccacttccaccgttacatgcactaacgccgtttgtcgccgtgacggcccgatcatccgttttccattccgtctaaaacaccaacaatctcattcttgtggttacgacaaaggcttcgacttaacgtgcgatattaacgccggtaacagaacaaccataacgttaccgttttccggtaacttcaccgtggaagagatcgattacgcagctcaagagatttggatcaacgacccaaacaactgtcttcctcaacggatcttacagctaaacctcaactcgacgccgtttagtggcgtttacatgcgtcagttcacgttctttaactgtcctacttcagagtatctccgttttaggccgttgaatccgataacgtgtttgagtggtaaaaacagcacggtgtttgctactccttcgcctagagtgataaactacttgtcgtctcaatcatgccggttaatgaaaaccgtttatgttccggttcggtggccgttttatgagcaaatcgtgtcgtcttcggatttgagtgataacctctggcttacttggagggttccaagatgtagtaggtgtgagattaaaggtggtaagtgtgggattaagagtaattcttctcgtgaaatcatttgctctcatgttcataaaccaggtaattaatatttctttgttttcaccctaattttttcatttttttaattatatttagttttaaaatttctagaacgttaaacgtatttgtttaaaaaaaaaaacgtatttgtttttataatgtgaagatatgattttgacgattagagtatattagtttgacgtagaccatgacgaaattttgtttgaatgagtcatgtgtttatgtgtgtatacaggtttataaatttcgttgaaagacgagctacatataaccaattatatttgtccgttctggttgtttaaatatgaaaactacatgagactattcaactagatatttttgactaatgaaaccaataggcgaaaaatacatcctactatattatttgggaagtacattttaaatataaccttaatttttgtaagtaattacataggtatgccattagaaataaaattttaaagagtaaattaatttatctctttaacgattaaaaagtcaattactaatttaattaattaaatttaattaaaaaacgaaatacattattaattttcaaaaataataaccaatcaaaatcaacatataagatttaatatctaaattttaattaatttaatttaattagaaaaacgaaatacattattaatttctaaaaaagtaacctattaaaatcaacaaattagatttgatatctaaattatcatattaatttttttattaattattatagttcacttctcatctttatatgattctattttttcaaaaaataatatcatcattataaaaaaataattagagtttttcgcatatgccataatttgaatttttgaaaactaatataaactgttcaatacatgaaaaaatattataacgggtgaaaaatagatttaagaaaactttctactgagtaacgggtcataatttgaaatatttatattcaatttcatacatattatattgaaaatttataatcttatatactacaataattaataacatattagatttttttatgtgtatgatgtgattcaatttttaatacaagctggaaaatcctagaattaacgggtttagatcgatattaatacaagatggtatattacaggtgaaactcttaaattaacaatcaaactacaagtgtataatcttaaacactaaacaatatagataatatcaacaaaatatatacaactcacagtttacttttaatattttatatacaaaatcaattaaatcttaatcacataaaaattagcacaaaaaaaagtattcaacaattaaaattttatcaaatctctgtgttatataagttttgatactatattcgaataaagtgtaatataccttttcaatttgtattctttaactaatttaagctaattaatatatttactaatcttatacctatcaaaaccgactatcgtttcttatttctatagtatttttgcaagacttttttggtggatttgggtaaaagtgcattcggtcatatggtacattcccctattaaataaaaatggtatactcctatgttattagctaaaatgtttagattataattcagagtcatatcattaataaaattaatattaataaaataa

SEQ ID NO: 2503 - DNA, 3000 bp, Unknown
  misc_feature (1)..( 3000): cDNA_ID_2048579_gDNA_ID_1620548_Annot_ID_160206 3000 nt of promoter + ATG
aatcatgatagaaatgagctgaacatttattatgcataagtaaagaactaacactgatgagattaaacttgaatgttgaaacatataaaacattatgcaaagtcaatgtggatgaaatatgcactgtgcctgtgtgactaatgggtactctagtgccatttggaagtgagactgtaataccagtaacaggaaaagtctcactaaacattgccaaatcagaacaaacatgactactagctccactgtcaactatccaagcatcatgaggcaaaatggaatataatgatgaaagacaatgatgttgaaatgtgaaagaatgattttcatatcgtaaacttgttgagggaaattcaatagaaacattaccagctgtagaagtagttgccatagctccatgatcagtgatggtagctgatggaaagggagttgactgctccggaacatgaagatgagtattgagttgttgtattaaagaatggacttgatccgtcgtaaaaagactgagatcaagacttgatgcagtcattgcaggaggtggaatataaggagtagatcccatgactgcattagcaacagcattatgtcatttttcattcaaatccgaagaagagaaagatactcttacaaatgtctttttcttgtgataattttacgggtgggaagatggttgactttgactcatatcgtccatattcaaaggtcttgatagtttgaattcgatgttaatagtattttattcgtataaacaattaaataagagttgacaatgtttagacaaatttggattatgaagtagtaacaatgataaaatcttgagactggtctccaaatccgacagctaggaacctcccttggcattcataagacaacgtacaatcagggacacgatacggtcaacggtctctattagcacttaattatcagtatcaattaaactatcaattgagtaatataatagacgttcaaatttaattttaaacttaacggtctaaatttgtggagaacaaaatttggtaaaaatgagaagataaagaggaagaggacacgtgggttggttcgtggttgatcgacaagtactcacgggctatatctttaacttatcatccttttattcttaacaaaagaaatttggtggagataaatttaatcatggtcatggttttagtagctacaaatgcaaatgtgattttcttttttcgtctgcgtttgcaagtttgaaatttttggtgctgatgaaaaaaagaagagatgatgtttcaccatttttttttttgttttttgatcaaaggatgtttcaccaacataagaaaagaaaacatgtcatgaaggagttaggactaacagtttgaaaatacttaagaactcaaatgttaaaaaggctcatatttttttcccaaattatgtcatctccttctataatctaaatcattcgtgatttaacataaaactaaatattaagtaactttattcaaatctatgaaatcgatttaccatatacacgattttaaaaaggatacaagcggaaatgaaactgtgcattgaaatatacgaacaaaaagcctgagtttacgaaatttgacattatctcatcaacacgaaacttcgacgtattacaaagacaaaaatcaaacctacaaaaatagagaacaatagtcagttacagaatttaagtttgccacgaaaatgatacatcattatgaagtttttgtatgcctaaacattgatatcagttaatgtcttcgactgtaataaagaaatgccttgattaactccgtaactacgtcttcttttgtcagcaaattctaatttattacatgcttaagttgatttgatcccataaccaaacaacatatatatggaatgtatataaaaaaaatctaagcaatctaaaaaaattaattataatatatgctataaaaaaaattataggaaactttgctaaatggcataaacagttattttaattaagtatatggaattgtcaaaaaattatcattatttttttaaaaatacatgattgactctttttttttgtgtgcaaacaaatacatgattgacaaaaaaaaaatacatgattgataaagatatttctttcaacatctatggatgagaggatcaggaaatgtagcattattttacttttgaaaactacatatattattgttgtgagcctgtgaattctgtaatcttccaacatattcgtctactaaaaaactgacaactcaattcagaacatatttttctactaaaaggtgaagttaaaaactcaatttaaaaaagatttcgtacttaatagtcaaagttaaatttggtccgaaatctttttgaagtatcaaagactgcaaaggtataactgtctttttggaataactttaaaaaaattaacaaaaacagtgaaacaaaatttaagaaaatcgaagaaaaaaatgataaaatagcaaaagtttgtgactttcgtggaaactccttccccgtcctctctgtcctctgataaaggcttcactttcatcattcaatctcttcttcttctttcttcttcatcactctctctctttctccaatttcttcattttatcagcttcctctcttctttagtttctgggtcactttagtttcgctctttccgaggaaaaacaaaacaaagatttgatttttctttttggtgggtttaaacagtgatttcttcttttgcccttttattggttcttattgttctcctcaaaagtctacaggattgtcggaagcaaacacacttgtccatgttcggtttgattttttacctcaaacaagtttcttcctttttttttgctgtttagtcgaattgcgtttttgacactggaaagttttgaaatttgagtttgatttttactgaaatcgaaattgttgaattgaattgaagtttgttgaatcagggttatgaatttccctctaattggtgaagaagacacatgaagcagtgaaatctctgtttgtattgaatcttattagtctcaaactatg

SEQ ID NO: 2504 - DNA, 362 bp, Unknown
  misc_feature (1)..( 362): cDNA_ID_2048705_gDNA_ID_1620549_Annot_ID_160230 3000 nt of promoter + ATG
gatcaatttgaatttttgatatacatctaaaataagaaaactaaaagaacataagaagtaatatatttttaaaaaattgacctaaaaacaaagaataatcattattatgatttaactccaatgagaaaacaattccaagcacgatctccaaccactcgaatcttcactgtcggaaacaaacggccaatgttttaccacgtcgcattcttaattggatgtaagtctttacaagcacttaaaacattaaactcttttttctcattcgtccacgtttctttttaaattaatactgttaacagataattattcacaaaaaaataatatctgaagaacaaaaaaaaaggtttcagggccttaaaatg

SEQ ID NO: 2505 - DNA, 3000 bp, Unknown
  misc_feature (1)..( 3000): cDNA_ID_2048687_gDNA_ID_1620549_Annot_ID_160236 3000 nt of
tctaattatatcgtataacattaaaacttaggttctcattttttcataaatcatatctatttgctatgattgatttggtctattgtgattcactgttataatttagagattttatttgacttaaaaagtcaaattactttgaaacatttattcggtatttatcaaattgaaaatatataagaacatatgaaaaacattttttcatgattattattcatttgtctcgattttgttttttccttttctttattattataaaatatatacgaattctatatgcttttcgattgtttacaacaaacacaaatttaaatataagttatgatacaacgagaatactagtataaattataaaattccatgtcttggttttatgttttgaagcaacacttgatgtatatgatagatatgttaacaaagtaaatcaaactattattagccttttatcctaaaagatataaatacaaaaaggatagagggtatatatggttggtaaaaaactagcaactaaaaagattggttggtaaaaactaaatattatctacttacatcatacaaagtaaaataaaaactaaacattatctacttacatcatacaaagtaaaataaatctaaatatttaaataaatatgtttggattaaaactttttgaatacatgataataaaaatatcttacgggctactaaaaatatcatttatttagtgtttagtcatgctttacattatcgatatagttgaaatcaacataaattattactattatatatatgtatatatatttttttcttatttaatagaatataaatatatatatatatattttaatataagtaagattaaatatgaaagaaagaagtttagatattactaagggatacattgtttacaaattaaaaattcaacttaactaaaacatcagttataaccactctagtaattatttggacgaagcagaacttattttatttttattattgtcttaaaacatttggatacactaacatatgatttttttttttttaaatgaaaacaaagatttaaaactcaacttaaagccacattttgttgctcatattaatgaacaaaaaccaaacaaacatttcaaagtttagcggggagcatggaaggtaggaacttgctaacatctttttcccctagcaattttcatctgttgcagaaaggagtgcgctaggacctccattgcctctttgaccatttctttgaaggctttaggtgttaccagcagatgaaggaccttgtcttggtccaattcaagaatcattcctgtgatttttggtgcaaactgtggctcaagttcttccaccataaagaacaaagtttcaccaatcaactacaaaaaaagagaaatttaggtcatataaagataacataaactatatttgtaagtagctgcaatcttaaagtaagcaaaatcaattttacatctcgttgttctttgggaggtaaagaagcaagatcaaaaggaggtgaatcaccacgggcaacttttacaactttgttaaaaaagcataaacgattcatgacttaagcaatgaagacgacgatatatttgagagaagaaacaaaatttagtgttttgatgaataagatttcatgtgctatatataacaaaaccaaaacaaaatatctaggtaaatgccaatattctttctttttaataattggggattcaacacgctctttagatcatgtgtgtgaaccacgcgctataatatagctaaaacaaaaatgatataacaccgtatgcctattttttttttctatgtaaatagtataaaattttggttttagatttgtcgaaaaacaatggctatatgttagcacgtatgttgaacaatgcaaaatttactaaatgtatttttaatcatttgttttgtatatctacaaataacaaaattatctaactcttagaattaacattacaaggtagtgtgattggcttataatgcatgagcttttattttttatttttttgggacaaactaatgtgcatgaattttaaaattagatttttaaaataaaaatattgaaaatttcacaatttacaatatacaaaaatcgaaaatgtggtacttttgacaaaatccaatgtttgttacaaatttatacattggaatagaaagaaatctaggagagtaatagcttactcaatcaaaaactgacacgtgtcctccatcctcaccaagtcaacattctctgtatctattttaattttgtaaggtaagaaatcttttgcacaaaaaaagaaaaggtaagaaatcttttgcatttttaaaagagaaggtaagaaatctgagagactttgatctaaccacgcgtttaaaaggagacagtgaacacacgcgctatgaatccataatccatttagttggatgtgaaagcccatataatgtcatgggcctaatttatatagcccatataaacgaaataggaaacacacgagagacagaagcactgtttgggttttggctatatgagagagataataatattgtgggagattgaataagtgagaggacctacctaccttgttggtcttttaacattactacaagtcacaacattggtattggtctgaaattattcttcttttgaatgtcggcaaggaatttgtttaagtactctctacatgatttttttttaagagaaacagaggctgatgtattatgatataggaagcttatgttatacaatgattggaggatcaaccagaagattagacttaagacataacataaagaataaaaatcacattatttgattattattattatttataataaaaaaaaggagaagaagcaagaaatagaaaaaagcattgggctgatgattcgttggtcgagttcaacgacattaactcattggaacgcttcagttttgttcctcctcagggtccgttacgcttcttcttcttcttcttcttctttcttcttcctcctttgtttctgatttcccaaaaattcgatccttttgaaatg

SEQ ID NO: 2506 - DNA, 3000 bp, Unknown
  misc_feature (1)..( 3000): cDNA_ID_2024949_gDNA_ID_1620549_Annot_ID_160241 3000 nt of promoter + ATG
aatctcccacaatattattatctctctcatatagccaaaacccaaacagtgcttctgtctctcgtgtgtttcctatttcgtttatatgggctatataaattaggcccatgacattatatgggctttcacatccaactaaatggattatggattcatagcgcgtgtgttcactgtctccttttaaacgcgtggttagatcaaagtctctcagatttcttaccttctcttttaaaaatgcaaaagatttcttaccttttctttttttgtgcaaaagatttcttaccttacaaaattaaaatagatacagagaatgttgacttggtgaggatggaggacacgtgtcagtttttgattgagtaagctattactctcctagatttctttctattccaatgtataaatttgtaacaaacattggattttgtcaaaagtaccacattttcgatttttgtatattgtaaattgtgaaattttcaatatttttattttaaaaatctaattttaaaattcatgcacattagtttgtcccaaaaaaataaaaaataaaagctcatgcattataagccaatcacactaccttgtaatgttaattctaagagttagataattttgttatttgtagatatacaaaacaaatgattaaaaatacatttagtaaattttgcattgttcaacatacgtgctaacatatagccattgtttttcgacaaatctaaaaccaaaattttatactatttacatagaaaaaaaaaataggcatacggtgttatatcatttttgttttagctatattatagcgcgtggttcacacacatgatctaaagagcgtgttgaatccccaattattaaaaagaaagaatattggcatttacctagatattttgttttggttttgttatatatagcacatgaaatcttattcatcaaaacactaaattttgtttcttctctcaaatatatcgtcgtcttcattgcttaagtcatgaatcgtttatgcttttttaacaaagttgtaaaagttgcccgtggtgattcacctccttttgatcttgcttctttacctcccaaagaacaacgagatgtaaaattgattttgcttactttaagattgcagctacttacaaatatagtttatgttatctttatatgacctaaatttctctttttttgtagttgattggtgaaactttgttctttatggtggaagaacttgagccacagtttgcaccaaaaatcacaggaatgattcttgaattggaccaagacaaggtccttcatctgctggtaacacctaaagccttcaaagaaatggtcaaagaggcaatggaggtcctagcgcactcctttctgcaacagatgaaaattgctaggggaaaaagatgttagcaagttcctaccttccatgctccccgctaaactttgaaatgtttgtttggtttttgttcattaatatgagcaacaaaatgtggctttaagttgagttttaaatctttgttttcatttaaaaaaaaaaaaatcatatgttagtgtatccaaatgttttaagacaataataaaaataaaataagttctgcttcgtccaaataattactagagtggttataactgatgttttagttaagttgaatttttaatttgtaaacaatgtatcccttagtaatatctaaacttctttctttcatatttaatcttacttatattaaaatatatatatatatatttatattctattaaataagaaaaaaatatatatacatatatataatagtaataatttatgttgatttcaactatatcgataatgtaaagcatgactaaacactaaataaatgatatttttagtagcccgtaagatatttttattatcatgtattcaaaaagttttaatccaaacatatttatttaaatatttagatttattttactttgtatgatgtaagtagataatgtttagtttttattttactttgtatgatgtaagtagataatatttagtttttaccaaccaatctttttagttgctagttttttaccaaccatatataccctctatcctttttgtatttatatcttttaggataaaaggctaataatagtttgatttactttgttaacatatctatcatatacatcaagtgttgcttcaaaacataaaaccaagacatggaattttataatttatactagtattctcgttgtatcataacttatatttaaatttgtgtttgttgtaaacaatcgaaaagcatatagaattcgtatatattttataataataaagaaaaggaaaaaacaaaatcgagacaaatgaataataatcatgaaaaaatgtttttcatatgttcttatatattttcaatttgataaataccgaataaatgtttcaaagtaatttgactttttaagtcaaataaaatctctaaattataacagtgaatcacaatagaccaaatcaatcatagcaaatagatatgatttatgaaaaaatgagaacctaagttttaatgttatacgatataattagataatttaaaatatatgcataatatacatatactattatttttatttaatgtgttgaaggatacaaaattattaaaaccatagcgattacgtaatttattcactattcatcagtttcttaatccaaaagaaaaaaaagaagaagataaagaggtatttatatatcagatgttcaaaaaccctaaatcgcgtttcttctctcaaatctgccgccgccatcattgatccaggtattgctctaaccttgactcttcacgtcattcgcatattactctcctcctcgctgatccattcgaattctgcactcaaatcgtgtttttgtacatcatagtttcaagcattatgattctctctagccaatgacttttcttgcgattgaatccttttgcagtctcgttatcaaaagttgaagaatttagtttagtttggttgtgtagataagatttgtaatcgcaaaattcgatctttgttacagtt

SEQ ID NO: 2507 - DNA, 3000 bp, Unknown
  misc_feature (1)..( 3000): cDNA_ID_3410233_gDNA_ID_1620549_Annot_ID_160247 3000 nt of promoter + ATG
gtctccagtcaaccctgcactgtcgttgttgcacgtgcttctctcttctcccacacgtgcttcccagctcattctctctgtttttttttcagtaacaaaaatattccgaaaacaacaatacatactaaacaaataaaaacaatactcgaaaccattattaatatttttttccatttaaaaatgatttgattccaacattcctaacaattactgccactctcggataagttcagatgctttttttgcctttacatttttgtttcgatgtgtagcttttctccaatggtttcattttgcttcgtttgtactttattctttattctctctataaagaaacaagacgatgcatgcatgaacgttatataatcttatcacacttattagatttaatcaatagagcatcacggaaacaaattcatagttaaaaatcgtttttttcgaatcgattattttacaagtatgaaaaccgccatacatactttgatataattatataaaatggttgggacgtccaattgacaaacctcaatatttaataacaacttcgcattcattttccgtaatagatatactttttaatgatcatttcaagatatagaatagagtttcagaaaattttcaaaatttaaatatataacttactatcagaaaagttataaaataaaaatatatgtcataaatttatcgtctaattgtttcaaatggagaatataaatacacaaattatttcttaattaaaatatgcaaatttttattttaagaaaacatctttttcgtttttttttatatccagacaagacatcagataaaaatttataaatgtaaatgccaacgtttgatgaaacactcaatgctatattttaaatattaagcattcgaatttaacatgtaactatctaaacaaagaaatacaaaataataataataatacaaacaaattaaaacaaaacaatggacccctagctagtatagtatctatgcgattgtcatgtttagtaatcgatagccgatagttagactgttagaacttaagaatcataggcagtaccagaaagaagtattggcccatatcgaagacttgaagtgaccaaattagtccatgtaaatcaaaacgtaaagtaattgggtcggatacattttgcagttgggctcatataactttgaaatatctctctcgtagtctcgtataaaggatcggttatattagaggaaaaaatatatagattttttttttttgataaaggacaaatagaagttggcctttcaatatacaaagaataaagatcaattttgggtgtggatactgataaatgatttaaatgtaacaagaattaacattacttcatattcaatggacaatggttatccttttcttcgtcgtcgcccgactattaggagatgacgagtcatcgtttatcttaattatttagaaagcaattgatttagtacgtgagttaaaataatttcgttgcacgttgtccggccgtttatgtctttatgacgtgcctatgatcttatctaactatcattttctcttccttactcaacatcctaaaagaactattcaaatttattagaattccattttcttgagacatgaatactatcaataataattaaactatagttaaacagaaaggcgtaataacataaccaaagccaatgggtttttgcttgacttcccggaaatttaaaagattatgtggttcgataatttacccccaaattattgatgagcaagtagtagtctttagaaaatggagatggacagacctttttcccatctttaaacttgtaattaataaagactttttagactattgcaatactataatgaatcgtgtagtgttgtgttgtgttgatctctgtgttggaacccaaatacaaaaaaatattgtgctaaaaagtgctgcattgatttacaacaatcaaatactcaaccatatttcaagtgggttgaattttaataaggatgaatgattcaagcatcaatctataaacaccaacaacgaaaagcttctattcacaatcgaatgttgtaatcacatacatatatataaactgaaaacaatttttagttaaatatttttagttattaaaagttggcaacttctacttaatgttatatatgttgcacctactattagacaatatctagttaaaacatagcaaaagaaagcttgtggccggtgagaatacaatgaagaatgtaaccccaaaatcatcccaatttccactattttgcctcttaataatagtaaacaattaataagggaacgcatgataaaagttcgaagattatgtacatatgaatatttggttaaacaagacatatgatgttgttacaaacgaggattacataatgtaatagtaatctaaagtcttagggactaagagttcctcattttaatttttaatttgaataaaaattaaaatgatcaatataagagtttttaagatgcaagcaacacaaaaaaacaaaaaataagaaatgaaaaaggaatatttttcattagttagtgtacattttaatagtaataccgtgtatgaccacgacatcatcaaataataataatatgatatcgtatgtaatttttatatagtagtgtgttatttaaaagtttccaaagtgcgtgtaacatatgggttcctagtaccttccgggaatggttagcgtcgtcaagaaactactctgtaaaaagttagaattaggttttccaaactaagaaacatgcttgtaaccaaaatttaaacaatggacaaaatacgaatggaattatcttgcccatgtgatgtgacgtgttttttattttcaatttgtttttattccagaaaataaaataatgacacgttggagccaatacgaagaacacatctatccatcccaatcgctctccacttttctgctcttcgacgacaaaagtttcaaactctataaatacttgaacgcaacagttacaaaaatgtcaaatcgaaaacaaacacaaaaagcaaacaaat

SEQ ID NO: 2508 - DNA, 3000 bp, Unknown
  misc_feature (1)..( 3000): cDNA_ID_2048645_gDNA_ID_1620549_Annot_ID_160251 3000 nt of promoter + ATG
aaaaaaatattatactaataaatgatacctcattaataaaaataaataattattaaaaggcactttacaaatgttaagagatttgcttaagatatatatatactagattttaacccgcggtataccgcgggaataatttattttttaatgttagtatatataaaagtttacaaattgcatctatctataaaatatttttattttatagtttacaattgttattaagtaacgtcctgccaaacccgtcccgtcaacccatcccgtaaaaaaacccatttattttattaatgttgatcttatttatgatatgtttatgaatcattgtctaaatattttgtaattttgtagtaattaaatgctatcaaattatatctatgcgctttgatgattataatccaattgttatagtcatggagaaaagtaatatcaaaaatgataattttgtagtaattaaatgatattaaatattttggaagttttattttagtaaataatcgtgtaatcgtgtagttaatgtgaagagattttgggaagattgttaaatgtcaaatatttaattcgaaattttttttctaattatcaaaaacaaacatcaaaatctagtggcagccattgtaaataagtcccaactacaggatttatttcacaaaatggctgcaaaaatgtatatataggtacacaatagtgaataaagaaaatagtttaaaagcaaaaccctaaataaaataaaagattgagaggcacgttttcctcaaagatcaatgacgatacccgagctgccaaaggatttgatagaggagatactctgttacgttccggcgacatatctgaaacgattacgttctacttgcaaaggatggaaccgtttattcaaagatgatcgaagattcgccaaaaagcattatgacaaagccgcaaagcagtttctacccctcatgtcaaccaacgaagagctttgtgcgatgagcgtcaatctccatggaacgataccatctttagaggtaaaagataagccttggctattcgtttcagattctaagcattgtgatatcgaaatatctcgaatctttcacagtggcggcttgttgttatgcttctcccgagacggcgaaatttcaatcatagtttggaacccgttaactagtgaaaccaggttgattcgaacccggaatcgtcgcgataaaggacgcaactttgttcttggatactatcaagaagacaaaaaaacctactacaaaatcttgagcttttatcttgatagcaaagatttcgaaatcttcgagtttaactctgattcatggaggtttattgatgatatctgtccaggcttgtccttgctatactctgatcaatgcgtgtctttgaagggaaatacatacatgtttgctatagatgacttaagtgtatccttgctcaaatatgatttttcaacagagacatctgttcctgtacctcttccctataaaagtcgttcttttgaagctattagtctttccgtggttagagaagagaagctctctgtgttattacagcgagataaaagttcgaaaactgagatatgggtgacaaatgtgattgatgaaaccaccaccaaagtgatggtggtgtcgtggagcaaggtcttatcattggatttgagccctgatcttaaaattaggtatggagaaagtttcttgctggacgaagagaagaaagtgatcatgatttttaataaccggatggaagaagagaacaaatccgaagacaaactatacattattggggacgacgataataaagccacacaagtatatacaatccatggatatggaccagctgtttttaactattttccaagtttggttcaaatcgagcaaagctctaggcaagaggaaaagagttgactgaataaacatgtaatctccattttttgttctcttaacgtaaacatgttcaaaacaaagatttaaatccatactacaaggtgtttttggtgtttttaataaatattatggtgtttttttaatttatatatttgacctttgaattatgaaattcagagtatagataccaaattaatttatatatataacaccacaatatttataaaaagaatttgtggtctattttgtgatatatttttttatataccaaaataaataaataaaataaataaaaagtattgttcttctagataacacatcttttaagttaaaattgagttaaaatagtcaaaatttaattaattttagttaaattatgggtaaggcaaacttgatgaatttctattagttaactgatcgattcaattagaaacgtagttttagaataaaacaaaaatatatgtagctttatctagattaaaaatttttttgataaatttttcagtgataaaaagtttggaatggaaaactgaaattataacaaaaaattcaggcaaccctcttcacaagtttattttagtaagctcttggaattttatttaacgttaaaataaattttggagagatcacgtgcaacgttggattcagatctaaaaaccatcaagatctaacggcaaggattaattgttgactgaaactccccacgtgacttgagatcaccgatacactgtgtttttgtttttccccaatctaaaaatgtatctctctcccgaaaatttaaatccctagctattaccttactcgtcgttctcttttgattttcatttcccgaagaagcgttttctcaggatatgcttctcgatctctgaggttttccccttcaacttctattggatgttccttttttggatttggtcattattatgtgattccttttttcctgatctgaattcgagatttttattcctttgattaaatcctcaaattttgcatgttttattaatttcctgattcagaacatgttttatttgatttagatgtataaagaatcttttactcaaatgtattttgattgatgcttacagaagaaagggatttgcaaatttgagaattcacattttggattaagatagaaacg

SEQ ID NO: 2509 - DNA, 3000 bp, Unknown
  misc_feature (1)..( 3000): cDNA_ID_2026764_gDNA_ID_1620549_Annot_ID_160255 3000 nt of promoter + ATG
tctaaacgaaagtgtatgatttattatgttgtttttgttaatttgaaaagtatgaatctattggcttatgcaagtatgggatatgtattaggtgcacagacttgacagagactgtagtggacttttggtgttggcaagaacacagacggctgcaacagttcttcattccatattccgagagaaaacaactggtgcatccgcatatgtaaatcctctgctttctctccgatctttccattgcttgtcatggatcgtgggaaataaacataagtttctcttccaatgacttttattttacttggcagggtgtcaaaaagaacgtaaaatccttgaaaagaaaatatatggcacttgtgatcgggtgtccaccacgtcaaaggggacagatttcagcgccactcagaaaggtcttcacactctgttttagctagagagttttatccatctgagtttttagtctattttgttttatctaggagttgctttgtttgttcgaattcggtcattgcttttgctgctttactggagtcaaatttgaaggtaaaatatatgttaaatatctgggtaggtggttgtggatgatggaaaatctgaacgtatcactgttaatgacaatggagaactcgtttctactcagcatgctatcaccgaataccgagtgattgaatcttcaccacatggttagtgagactgacttccatttctattcagttaaacttaaagcaaatgattttgccttgagtttttagcacattgttgaattgcaggatacacatggcttgagcttcgccctttaaccgggagaaaacatcaggtctctatagatattcagtttttgtttcaactttctctcttttttatgttctcttaatactaatctgttttcaactgttcttcgattgccacagcttcgtgtacactgcgctgaagtgctaggaacaccgatagtcggggactacaaatacggttggcaagctcataaagcccgggaaccttttgtctcttctgaaaacaacccaaccaagcaatcatcatctccttttggattggatctggatggtggagatgtctcttcgaaacagccacaccttcatctccattcaaagcaaatcgatctgccaaacatatcacagctcttggagaaaatgcaggtctcttcagactctgatatttcggatctcgatagccttaaattcgatgctccattgcctagtcatatgcaactaagctttaatttgttgaaatctagagtcgaaacttgtgacaaaaattagattttttttcttaccgagctttcttctttgtgttcattgaggcccaagtatttgtgtatttggacctgaatattctcatacaaagataaataattataattaaatgatttttcgcatataatcattattgtggtatgattaacacagttggtgtgatgactgattgacacaataatcaccgtttggattcgattcctttaatacttgtcactagagttgtttgactaaacagctaacttgtcactagagttattgtgtttgtattttgatctgttattaatctgattgggtataattacagatagagagacatctatattgtaattaagacaatcttaaagtgtaaactaaaaagatctctctgacctctggaaaacgaaaggtgggtgacacatcactctagctatgaatatgatgaatattcagtacctaaccgaacaaagactggtttggtatttttattggaaaaaagagataaataattgtgaatgtgaattatcctgtctgaaaggtaagctgatgacatggcgttatatgattggacgagcttcagaacaaaagagtagcgtcgaatcgaatctttacctactacactttgaactttgaagtacattacctacttcctccttgatcgaacgtcttttctcaaaactattttatttccccaattaaagtagtggtgataaattcacaaaaatacaaacacttttatttttgacgtcaaaaacaaatacttctttgaacaggctattacaatatttttaagaaaaaagtaagcaaaatagtccacaaaccaaaatctgtaacatattaaacgatttatgtttttttttttttttcttaactagagaacaattcgggcttttactaaggatgatgagtgtagttaccgaatagtgtattcatataatcttttaatgagcttaagatatgatattatttcgactaatcagataagagtagttagataatttcgtaatagagcaactctttcgcaaataaaaccattgtaaacattaccaattagtttttctttttttttggtcacaaccaattagtttgtttgttctattttatgaagtgcgtattaaagctaacgtgtttacagtaacgccacacaaataaaaataaaaataattatgtactttatggatttatagaaaaaacaagaatagtcaccaaaaattgattgtgtcatatatcttttgtcaactattttatcttatttttctatggatatgtatgtccaaaatgttagacaaaaaaccaaaaaatcatgtccaaaatttcgttaggctgccgatatctctgtttccctttcaacgactatctatttaattaccgtcgtccacattgtttttaatatctttattcgaggttggtttagttttttttaccaaactcactttgctacgtttttgcctttttggtatggttgtatttgtaccaccgggaaaaaaaagataagaggtttggttggtcgagcttactgattaaaaaatatacacgtccaccaaatattaaaacaatatatcccatttttcctcctctcttttggtattacattaatattttattatttccccatttgctctgtatatataaacatatgtcaatagagtgcctctacagtcatgtttccatagacataatctctcaccattgtttttctctgcaaaactaaagaaacaaaaaaagaaaaatcggagaaaccaagaaaaaagaa

SEQ ID NO: 2510 - DNA, 3000 bp, Unknown
  misc_feature (1)..( 3000): cDNA_ID_2048620_gDNA_ID_1620549_Annot_ID_160259 3000 nt of promoter + ATG
tcttcaattgttttatatatatcgagaggccgaagaaatctgtaatcacagacagaggaaaaataagaataaggtgcagtttttttgttctttgttgttatttaagaagattaacgtaaatagtttccgacattaactagtttgcgttacattggtcctggttgataatgaagaagatgtacaatcttccaagagatttgccggaggaggtgctctgtagaattccgttgacatctctgaggcctgtccgatctacttgcaaaaagtggagcactttatccaaatgtgggagctttgcaaagaagcaccttgctcaagcaaaagtactagcagacgcaaaggagtttatggtggtcttgatgatgaattttagggtttatttgatgagagtcaatcttcaaaacaacgttgttgaatcatcatcatcatcatcatcatcatcatcatcatgtataaaacgtgaagctaaacttattagcttaggcgatgaagaagctgatatatctcaagtctttcactgtgacggtttattgttatgcatcagcatcaccgaatccaagactaggctcgttgtttggaacccgtattgggggcatacccggttattcgagcccacacatcaattcaacaaattcgatagctattcgtatgctctcggatacgacaagagccgcaaatcccacaaaatcttgaggggtattacttgtttggatcccttcaaaatctacgattttaactctgacttatggagggatcttgatgtaactccggagtggcacttatggcaaatgctccatggcgtgtctctcaagggaaatgcctactggtttgctagagagaattataccgaaacaatggacacagaccattttttcttactctgttttgatttcacaagcgagacatttgggccgcctttgcctcttccgtttgagtttgctgtttctgaagatactatgagtgtatctagtgttagagaagagcagcttgttgtattatatcagccgtgggattatttacagttggacatctgggtgacgtctaagattgagcccaacgctgtgtcgtggaacagcaaggtgttcttatcagtgagtttaaaacaactcgtcagccctcagtttcagttaacttttgggagtttcttcatcgacgaggagaagaaagtcgctgtggtttttgataaagactacgataataagcgcaacatagcttacatctttggagtggatggatcctttaaagcagttgatctcggagattcagaccgaaagtgttttccacttgtgtgctcttatgttccaagtctagtgcaacttaattagtcgaccatctattccttgcttactttttttcttcctcttttgtcatcttctttgaacaagatcattatttgttagtcaataacatattaacttgtttctcatacttgtttttgtttgccatatatatttgaattcgtttccaaatggtgcacacgctccttcccctgcagctaatcgtttgttactttcagtccccttaagttggagcaaactgtatgcttcttggttggcattctccgcgaaagcatgcatcgtttcttccaagagtctttaggtattgatagttcatcgttttctttttctattgtaacacagtagcagttaaagataagtcgaacgggtgatctttttgttcattagacaaaactagagaggtttctcttctctttcttctagtaaggaacaaggctaaggttaatagatagctagctatctgagatatctcacaaaagctttcactatggccctgtactatatcaacttcatattttaggtgtttcatatttcagataaaatgtgctcatatcttcttcctctttgttcagcgtcttctgcaaaagtgatatagatcttgacatgctgctaaaatacctcttgatatatttagtttttcttaccaatttaagttatagcataatccttttatcatgttagttattgttctatcctaattgtctagcatggagtagaatgattttgaagcagggacttgtagaacgatttttcgtgtgccacaggtttactcccttccttaatgtggtgaccagcgcttgtccttgtggtctgtccactcattctgctatctttcaacgaatatcacaaaataatagtggttagtatgtctcatatgattaccttaaatttagcggctactgactgatgaatcatgaggctttacgctactactatttctcttgtgttccacaaggcgtttccaatacttggtgatatcctccaacgacatctgcctagtattttgaccttgccagttgccaaatcaattaataaacccttcaccagaagattcttactacatcaaacaataaataaaactaaagtttgactggaagaagagttttggaacgttagacaaattttcagcatttgacgatatgaaagatgtctaaatctaaagaaacagagatacaattctttcaatattatatacttgctaactatcaagaacaggcatgaaaaaataaaaatattaaaaaaaaatacatattactatatagaattcatatgtcatcgataacttttacattattttttacaatccgccttacttaaacgcgccttatctaatagatatataaatgtatctctatttatattataatttaatttaaaatcaatataaaaaaatgtgttttttcaatttttaaaccacataacctaatagtataatatttgatatattattattttgttttaagaatgtagtatatttgtattttattagcaaaaccattattaaattgtaacttttttttcttctatataaagtttcaaaatccacttaagaagtgaagatataagtgaacaaaggatgtagcgtaatctagcacaacatatttaaacctcacaaaacccacccgaaagatgaacccatatctctctactctgttgctgacgatacatacacctttacttacattatattcccgccatcgcg

SEQ ID NO: 2511 - DNA, 3000 bp, Unknown
  misc_feature (1)..( 3000): cDNA_ID_2048606_gDNA_ID_1620549_Annot_ID_160263 3000 nt of promoter + ATG
ttatcggggacaccaatgttgttaagctttcttggaaagaagccacaaagccattagcctatacaagagctttgttagtattgttagttttgcaggtttcttatcatgcttcccaaatatgataaaatgcttatcatggctcatcttcttttctgatttttggtttctcagatatacagacctaatgtatggcatacccccggatattgatgcgtttcataattttatggacaaactctcagaagacttgctgaataaactagatatggagggaatgtgcgaattagaagatgatcaggttcaagcacttgtgggttcatcaggacttaaacaagcacaagacacgttaccagaaagtaggattttcttacatgaaaatccaaaagtaccttgtctcttttggaggatacgagaatcggtaatattctatataataaccatctacttattaccttttaagaaattatcaagatttacttttttgtttttgttgtagacattattaaaattggtgacgtccaagtcatggaagaaattcctaggttttattagagaccaactctttcacctcatttgttgggcttatgcagcctctgacttagtcagtgctactagaattatgcgcaactgggaggtagagtatattcctctgtgtccatggtatctttgctccttttgtcgaccagagtatcttggagaagatgaaaatcctgagaaagaagatgatgaaaatcctgagaaagggcattactgttatggaaatgatatagaggattgcctactatacatcaaacagcatggcattcctagagagatctgcaagaagtttgactgtaaggactggcagcctccaaatgctgacgacccacatatgcacacgacaaaattaaagagtgttcgaaaaattgaatcaatggaggaggcgttgctattgcttccacattttcccataggagcggacttagttgtttttaaggaattgtggaccgtaggagaggagatttattatggtcccggaacaaattccagaggtttccgctcatatcatgcagtgatagtatccagtattgagatctataaaggagaagtggtggccatctgtaagatgagcaatggtactaaagtttgtgacgaaggatatgttagggtttctctagcgacaacatacatggttgtgggtgccagtcctaaaaaaaaagaacatgttcgggctacttctaagccgatgcatcttctctctgaattcatcatcatagatatagatgagaatgagaaagagaaagaaagagagagagagaaagaaactgaaagcgaagaggagaatccagaagataaccagaaagggaatccagaacataacccgaaagagaagtccgaagagatgcaatatcctgactttggtgctagcaagtttcataactccttgaacgagcacatcatgcctgattctgacaaggtacagagacgtgaatacctgtgtatatctcctgttttactcaaaccaactattttggtgtggcacatgaatttgaacggaatcgggactcagggccaatttttttcatattttccaacaggataaatacctgattctgcacaatagtttcttggttgtgtgatattgttctttccattatcgtgttcttcttattttagccgttttctgacattttttcaatgattccagagcttgggcaatgtaagtggagaagaaatcaagatggttacggaaggtttgacaagtttgagtaaatttggagagaaaggtcctcaagaaagaatgcacgaacctgtagaaattgttgaaaggtaagctgatttggatccaaagttgaatgtgagtcttttgaatgtttgtgacttgtgattcatggttgtatgtttcctttttgctacgacagaggaaaacggcctgcaaatgaagccggtaatgatgtgggtacaaagaaggcccgtacagagtcatcaggttgtgcacatgggatttgagggaatcactttcatggcctattttagtaaaacaagagtatttcttttgtctattagccaggtacaagtttttgttggctttttaaggctccttaacatgtcacgggacgaaaaagagagaaacaaaacaacaataccaagacattgatatgcaaatgggcctcataagtagacccattaagaatataatgcataatgaagcccaaattacgccgtttctccgttccctttgtcttctgagcgaccttgcaaggctctctcttctttttttcttcttcttctcaactcacccaccgagtttcttctcaattctcgcgggacatttcgcgggcgagggaaaaaggtaaaatttttggcggatagagagatcgaaaaagcttaacatttagtgtctgggttgttttcttatctcgtagaaatttagaaaattcaatactcagcttagcaatacccaaatctaacctcgttatagctaagattactttatcgcgttttttcttctcttgtgctcatcgaaaaccatatcaagggtcgatctgtgttttttgtctgatgttcttgtttaagatctctgtcaagcacgtaagtagcttaggaactagacgaagcaatcgcagaaatatttaccaagctcccatttttcttttgtgggtttttctcttgtgtttgctcatattgattctgatctgatatacgtgtgttttgcttctttgtttgattatataggaatctacaagtatttaaacctttgctgatttagaaacgcctgagtgcatcatcttcgaggatagcagtataaacatagctagttgattgtagagaatgtataaagcagtaagtaagcgggtaactagaagtagtggatctggtttgaagcagacaaatgtagataatggaggagagattagtccaactgttgacagagtatctgaacaaggcaaatcatcagaggcagggagtcacatgccaactgatgcaaacggaaatggacatttgcatcatgagattatg

SEQ ID NO: 2512 - DNA, 3000 bp, Unknown
  misc_feature (1)..( 3000): cDNA_ID_2048612_gDNA_ID_1620549_Annot_ID_160261 3000 nt of promoter + ATG
gtcggaagatgaaggggacactgtacctctgaaacagtcttcaaatgcagaagatcatacttctaagaaacttatacggaagtcgaaaagggcagataaaaaggataccttagaaatgccacaagaaggtcctggagaaaatggtggttctggtgaaattgaaaaaagcagctcttcagcatgtaaacagacagatcccaaaactcaggtaaaaagatatagctgtcttgaggctttaaggtgccaatcttacattattatgagggagggagcaatggattgaaaggatccctcttttatgcagagactgtacatatcttttcaagagaatcaatatccagacaaagccacgaaggagagcttagccaaagagctacaaatgacagttaagcaagtaagaagtttctcctagtaaattgtttgtttagttctcccttttagtcgacctagtttcatctctgctaagaactgattatgttctgtaggttaataactggtttaagcataggcgttggtcgataaacagcaaacctttagtttcagaggaaaatgtcgagaagttaaaaacaggcaaggaaggtgaatgtgagacatctgttgctggaagtagcaaacaaactatggaaaccgagtcagttgcagagaaaccaaccaatactggatcacggaaaagaagaagaaagtagactttagattcaatcatgaaggttttagatctaatgcaaggacaatactggaacacatacttacccaaaccccgagatatgaagacaccaaaccctgcaaagcatcgggtttgttcagttctttgtttcacatttttggggtactttgaagaccttgaaatttgaggcaaaagaaagaaagaaagattttcttcgaaattggatgataggttcatttttaacagttaaagaagttaaggctttgtgttatgattatgaaagtttttgtttatttccatctggagagatgttttgagttatggtttctgtaatcgatagagaccggtttaagagatcaagagatttaaactttaaaagtcttgtttgaaccggttttaaaccctcaaatgtgaacgtttaaccggtctgtaattgcttattattaaaggcccattaagagcccatggatgtttatgatacagtattagagtcctagaattgggtaacgtgttgcagaaggtaaacgaaaatgaagaaggtgctgagagtatacggcggcgttatgaggctggtgagacttttgccggcggattcaaggccgtattacgccaagtacgccagggagaatttcgttaattaccgtgaagtcgatcaaagcgaaacatccctcgacgaactcttccagcgagcctataatcactcactttgggtactcaagaaggtaacaaagattctgggtttcttttaaatctaggtaccctttgtgttaactgtctgttctcaatcatttgcagtactcaattgacgaatcagcagcgacgaagttgaaagagatttgttttgaataataacgcacaccaagtgttcgacgttatgtccctgagagtgttggaacaagtttggacgatttgttaaatgggtaccatcagttttctacttttgatagctatatcaagaacaggggttgttcatgtgtctttgtctttcctttttagttgtcttgactttctgtgattgactgctgaattggtcgttgtcttgtttgagtagctagcttcttgtttgtttccatgatcctgaataaaattgttacattcttagattcgaaaacatcacattacttaatctcatctttggtaatgaaagaaactcatcagagcaaagtagaagtggcagttaagtaataacgagagagaaagattagggattgtttgggtaattaaagtgatatatatgtagctaagggacaataaacagtagctaagagtttaggtccttgtcgaaaactcgaaaatcttatatgaaaccaacctaaccaaaaccaaagtctttttgagattgtttttgcttctggagttaaaagtagaagctagagagaaaagttggactacttaataatctttatgatttttttttgacctttcctcttatggatttattttagtggtttgccaacttgtggagttcactttcttcttaccacacacgtgtttgcagagtctttgcacgtgtcaaacctggtacatgtcagttagtaaaaatttagtttaatttagtagttgtagtttcatgtgactgtatgttcataactatatgataaacatgatagtggtaatctaaaaaatatttgtatggtttggtaataatggttttattgaataaatgaataatgagtactagttcgatattgaatacgtgtgtgacactcatttattattttgtctaacttctagaaagagagactcaaaaaaagggaatgcagcagttactaagaaagaaaaaggtgagaaacgaaacatcagcttcgtgtaaatcaaaactacagttttctcgggccaggtggctttgacccaattttctcttcaacatttctataattccctttctatccctcccttaacgacttatcaatcaacactaatcatcatcacttcactagattgttatacagaagtatccatacaagtgtcacataaactgaatacccattatcaacaaaagtatcactatcttttttcttgaattaacagtttaacactaaccaaatagatagatagtataatgtttttgattttaagaaaagaaacattacattttccttcgtagaatttagacaggtgatgttaaagaaaacaaaaaaagagaaaactaataattgtatatatatatgtatataaataaatattagaacatcagccattttgtgaataaaccagttataaaagtctaaaaaaggtaaagagaaaaacatttcaccaaaaaaaatcctctggttaatgttttctcactttctctttgttttctttctaacctctttccacgaaaagtcacgatg

SEQ ID NO: 2513 - DNA, 3000 bp, Unknown
  misc_feature (1)..( 3000): cDNA_ID_3068242_gDNA_ID_1620549_Annot_ID_160256 3000 nt of promoter + ATG
gaggtttggttggtcgagcttactgattaaaaaatatacacgtccaccaaatattaaaacaatatatcccatttttcctcctctcttttggtattacattaatattttattatttccccatttgctctgtatatataaacatatgtcaatagagtgcctctacagtcatgtttccatagacataatctctcaccattgtttttctctgcaaaactaaagaaacaaaaaaagaaaaatcggagaaaccaagaaaaaagaaatgggaagtgtagaagcaggagaaaagaaggctttaggatgggctgcaagagatccttctggtgttctctctccttactcctacactttaaggttttgtttcctcttctcctttcacaagaaaatttggttttgttatgtagaatttttatggttttattgaacttgtttttgttgaaaattgaattttggttttgttaatatataggagcacaggagcagatgatgtgtatataaaggttatatgctgtggaatatgccatactgatattcaccaaattaaaaatgatcttggaatgtctaattatcctatggttcctgggtaatttcttctctcttttcttatctgccttatttttcagctttattcttgactggtgtccatgaatggcgattttctttcatctgttaaaaatggatgttatcgctagacttcaatttagatcccaatcatatataaataagatggtttcagattttaaatggaattacatctttttaatttatttgaagttatgcatagattgttggtaaacttaagtatattagcacttgtgactagcttaataatttctaagcgtgctagagataactccaaacagtacattttcaaatgtaagtaaattgtttagacatatattttaattttagataacctaagggcaaaaacaaatattagataatcttagattgtaaatacatgaaattcttatttttaatggttcagatgagttgattagtaagtagttaaccatatgatatgtaatattttgtacaaatgttattgatatattcttctcggaatttagatacccattatatgatgcatgttgttaaatgacttttgtggtatgacagaagattttggtataaagttgacttgacattattgttaatttgaagataattgaacgtgctactgttacacatctgacattcgtttataaccacacctgtcactgtttagtcttctaaattaatatgcaaacaaaaaactctgtcaatgtgggacttgtaggggtaactgaaatatacgagtaagattccgtaataactaaaagtgtaattttgatttacaggcacgaggtagtaggtgaggtgttggaagtgggatcagatgtgagcaagttcaccgtaggagatgtagtcggagtcggcgtggtcgttggatgctgcggtagctgcaaaccatgcagctcagaacttgagcagtattgtaacaagagaatctggagttacaacgatgtctacaccgatggaaaacctactcaaggtggcttcgccgacaccatgatcgtcaatcaaaagtaagcacacgcacacaccttgtttcacaagaaacacacagagcatttgtttcttcatccacaagtaacttatttttgtttcaaaaggtttgtggtgaagattccagaaggaatggcggtggagcaggctgcaccgctactctgcgcgggagtaacggtttatagtccgttgagccacttcggtctaatggcgagtgggcttaaaggagggattctagggttaggtggagtagggcacatgggtgtgaagatagctaaagcaatgggacaccatgtgactgtgataagctcatcagataagaaaaaagaagaagctatcgaacatttaggagctgacgactatgtggtgagctctgatccagcagagatgcaaagactcgcagattcccttgactacatcattgacaccgtaccggtgtttcaccctctcgacccttacttggcttgtcttaaactcgacgggaaattgattctcatgggtgttatcaacactcctcttcagttcgtgacccctctcgtcattcttggtcagtactatttcttgcgtttaaatcatatctagctaataacaacaaaattcaatagcaaacctgatgtttttttctatattttgacagggaggaaagtgatatcagggagctttatagggagcattaaagagacagaagaagtgttggctttctgcaaagagaaagggcttacgtcgacgattgaaactgtgaagatcgatgagcttaacattgcgtttgagaggcttcgcaagaacgatgttcgttacagatttgtggttgatgttgcaggaagtaatctggtggaggaggctgcaacaactacaaactaaagagggcagggcacattgatacatgaacgaaaaattgtaacgggcttgtttgtccaacgaatgttttgttgttgtctttttcaaatggttcaaacacgaatgctttggctttatttttttctaatcaatgtggattttctgtttacgtgtgtttgtcacaagaaaatcattatgataagaattttcttccacttgaactcaaatttgttaacaattctgaatctgaattatggctgacaccaattgaaactgagaaccagtttaaagtgattataaagaaaagtgaaatctttttattgccaaccaactttgggctaagtattaaaagaaaataatacttttttgataagaaaaaaaaaagaggaaaataatttgattataattaaaatctaaaaactttttcgcggaagcgttaaggaaaaatctttgatctttggaaaggaagagagcaggcgcaatcgagtaatccaaaggagttgcgttgttctgcgatcacgaagcggtctctcggcaaatctttcgacgcaagacatcgattcgtgtatttcatttttgctttggaactctatgcggaagaaccctaattgattcgcc

SEQ ID NO: 2514 - DNA, 3000 bp, Unknown
  misc_feature (1)..( 3000): cDNA_ID_2048633_gDNA_ID_1620549_Annot_ID_160254 3000 nt of promoter + ATG
gcggtggtgaaactggcggagggggacttggcataggatcagtaggaactggtggagtgggacttggcacagaaggtgtaggagtcggaggtggtggtgaaactggtggggtgggacttggcacggaaggtgtaggagtcggaggtggtggtgaaactggtggagtgggacttggcacagacggtgtaggagttggaggtggtggtgaaactggtggagtgggacttggcacagatggtgtaggagttggaggcggtggtgaaactggtggagtagggcttggcacggaaggtgtaggaggtggtggtgaaactggtggaacaggagcaggaggagtgtatccaccgtcatcaccaccactgtcatcgccgccaccatcgtcgccaggggaaggaggaccacatatgggtttgcaagaagcacattcgacatggcaagagtcagggcaaaacttgggacaaacatgttccaagttgtaacaatgtttgtacttcttgatcttacatgttgcgtggcttgggttcttggctatgcccgggggtgtatcggccattgttaatgcaagtgatgccaggagtatgcatcccaatatttgaagtcttgtgtgtttagctagatccattgccaaaccaaacaaagaagatagaaaggtgtttgttttttcagttgttgtgtgctttaggatttgatggtatgaatgatgatgatgcagtacaagtgctctgatatggtttatatagataaatatgttgggtttattaaatatcatgttggagtctttttaatcttttaaacaagggttccttcttaaatctatatggagcttgtaatttaagattattaacacctttatgcataacttagttatattctgtatatacatgcttcaagtttttatttgatcgcaaaacggattctcgagtgttaactagtagtaggttaaaactttcacaatataattaagatgaattaaaagatttctcgaaattttgattaaaaggataaaaactaattagcctaccattgaaaaaaggcttggccatgatcattattttggttcgaatttttttattaaaaatgagaaatggggttgttaaaattttagagattaatactgataaaaatatcatcaccttagttgacaattaacttgacatgtaaacaattttagcgtaaagtcaacctcatatttaactaggcaatatatacaattagccattagatatgaaatatataatatctagcaaaactgttagaatgagtttcgattccactttatgcaattctacgtaatacataatgtataaatgtgatattagtaattatatgtataatcatgtaaaggctacatgaaagtttatggggaatcactttgcgatgaagtgatccgcatgctacttgaatttcgtgtggtagcacattttgacattttggaggtcacatgatagaaaacaacaatgataagttaagctatgataaacacctgctttacagctatatgttttcatttttctactttgtcttctatttgaagaaacatcaaaatactgccattttctctgttagcgttaacaattcatcaaaattaattttgtcgaacgatactttgtttcttattcacttaactacatgcatgctttggactttatgcgactcaaggaggcaccgactatatgtgttattatcaaaattctcttctttagttacatatgtgttattatgttccctctctgtggttatttggtcctctttattttaaggactactgttagtccatagtatatcagatatttgataaattgatcggcctgaaccagacctggcttgctcaaagaatatgcagaacaaaagccataaagagagctctgtaaagaatatacagtaaacatgttttatgaattaagaaagcttgaagttgaaaataaaacataactcttctttatgtaaggaaatcaaatttgatcataaaaaacttaacaaactgtgtcaattaaaagcaaggaatactatataccaccacttgttattgaaatatatcagtttattgaattattcaagattacagtgaagtaaatccaaaaaaaggtacaaagggtttgccctgtggtttaatcactagctcgcctcttcttcttgctggaattgagttaaacttggaacataattaaacaaaaatggccagtttgaaaagaatcctaaatccacttttctgacttgattgtcctctccaacaatgtatagcacgtttttgaagttggttccatcatatctagaatatttatcacaacacacgaggactttcttctcctcatcgaccaaaaagcttttaccataccaacacctcaaataattcaaatccaatgctacgaccatgctccaagacaaaacgttggtcatctcatcaatcttataattatgacccatatctctgtccttgatgtagcataaagttgtaataacaccgaaagtttctcttctttaacaaccaatagagacgcaattgcataaaaaggatactgacacggaagtagcagacttctaaatctctctgttttataatcaaaactcactaagaatgtgcaaagatcaacttcctttttatcaaatatttatctttttcgcaagcaaaccaatgagtatttctcttcaaattttttggttactatatctcttttttatcacctaagcgccgtcgtttctcttcaaatctctctgttttataatcaaaattcagttatttttaacaactgattttttgtgattatttagaaagtgaagacaaaatgttaatcctcacctcatggaggatttaccaaaataacagagaaattaacgctaaattaacagttacagtattacttttgtcagaattaccaattaattataagcaaaaatatgaattatttgattaatgagtaatgactatcggttccatctttcccaagttcctctgctccaaaacctcttaaaccctaattcgaatttagcctaaaccctaaa

SEQ ID NO: 2515 - DNA, 3000 bp, Unknown
  misc_feature (1)..( 3000): cDNA_ID_2048658_gDNA_ID_1620549_Annot_ID_160248 3000 nt of promoter + ATG
aagaaatgaaaaaggaatatttttcattagttagtgtacattttaatagtaataccgtgtatgaccacgacatcatcaaataataataatatgatatcgtatgtaatttttatatagtagtgtgttatttaaaagtttccaaagtgcgtgtaacatatgggttcctagtaccttccgggaatggttagcgtcgtcaagaaactactctgtaaaaagttagaattaggttttccaaactaagaaacatgcttgtaaccaaaatttaaacaatggacaaaatacgaatggaattatcttgcccatgtgatgtgacgtgttttttattttcaatttgtttttattccagaaaataaaataatgacacgttggagccaatacgaagaacacatctatccatcccaatcgctctccacttttctgctcttcgacgacaaaagtttcaaactctataaatacttgaacgcaacagttacaaaaatgtcaaatcgaaaacaaacacaaaaagcaaacaaatatggctacttcaatcaaatctataaccctagctctcttgatattctcagtgttactaatctccttgtctctcggctccgtcacagcgacggagactacacgaaacgaggcggaggcacgacggatgtatgaaaggtggcttgttgagaatcggaagaactataatggtctcggagagaaagagagacgctttgagatcttcaaagacaacttgaagttcgtcgaagagcacagttccatcccgaatcggacttacgaagtcgggttgacccggttcgctgatttgactaacgatgagtttcgtgcgatttacttgaggagcaagatggagagaactagggttccggtgaagggagagaagtatttgtataaggttggagatagcttacctgatgctatcgattggagagctaaaggtgctgttaatccagtcaaagatcaaggatcctgtggtaagtccaattgcgtttgcgttttaatcgcttattttttggcgtttctattttttggttttgagctaatcagggattttttttgggttggttgatataacaggaagttgttgggcgttttccgcgattggagcggttgaaggtataaatcagattaagacaggagagttgatatctttgtctgagcaagaacttgttgattgtgacacaagttacaatgatggatgtggtggaggtcttatggattatgcttttaagttcattattgaaaacggtggtattgatacagaggaagattatccttatattgcaactgatgttaacgtgtgcaattctgataaggtaaagaaccactgatcagtgataacaacgacattgtttgtactttatttatttatggtgtatagtacttatctgttatgttctgttttttctttcaactcatgcagaagaacactcgtgttgttaccatcgatggttatgaggatgttcctcaaaacgatgagaagtctttgaagaaggctcttgctaatcaacctattagtgttgccattgaagctggtggcagagctttccagctttacacatctgtaattttctatgaaccttactttggtttctcttaatccaagatttgtttcgagttcataaaataatcccttttgttgttgttttcagggtgtgtttacaggaacatgtggaacatctttggaccatggtgttgtagctgtgggatacggatcagaaggtggtcaagactactggattgttcgtaactcatggggatcaaactggggagaaagcggatactttaagctcgaacgtaacatcaaagagtcatcagggaaatgcggtgtggcgatgatggcttcttaccctaccaaatcatcaggctcaaacccaccaaaaccgccagcgccttcaccggttgtttgtgacaagtctaacacttgtccagctaagtccacttgttgttgcctatatgagtacaatggtaaatgctatagctggggatgttgtccgtatgagtcagccacttgttgcgatgatggttctagctgctgcccccagtcataccctgtctgcgatttaaaggccaatacttgtagaatggttagtttcttgttctctcttatggcttaaagactttgcttttgtttgtttacttgactgattcgtttatgaaatttggtgtccacagaagggaaacagtccgttaagcataaaagctttgacacgaggaccagcgattgcgaccacaaagtctacaaacatgctagtgggcagcgcttgaggagagataatacaaacgaagaaccgatttgttttcagcccacgttatcaagattcagtcttttgtctttagacacttccaagttggatcatagtttgattactcttgtcaaatttaatgttatcttggatttgattttacttgatgtaaatgtttaagaagtaatctgatatttgcttccataacattgtgtcatcttcatttgataagtttgtaacagagtatcatcattcacatgatgtaagatagattctagtttaaaacataacgtgttaagctataggaaaacagtttggtgatttaaccaaaataaccaaggaaaagctgatccactttaatcaactacaaaatttgttctcttaaccttccagtaagatagtaaaaaacatctgtacaataatgccagacattagcgttaccatacttcctttggcgatcatcatagaatccatacacctagatagcataaatgattttgtgttagagcatccacattggtgggctctcaaaaatataatctctcacgtttgatgaaaagattataaattgtaattttctagaattaaatacgtgacagaatcatatgattttgatatttaaaaatatttattggtctgaccaataaaatatacaaaaataataaagaaaaatcccaaaaacacaactaataattcatctgcctcttcttgtcttgacgtcaactgtttgcagaaatctcactgaaactagagagaaaaccaa

SEQ ID NO: 2516 - DNA, 3000 bp, Unknown
  misc_feature (1)..( 3000): cDNA_ID_3068248_gDNA_ID_1620549_Annot_ID_160242 3000 nt of promoter + ATG
gctctaaccttgactcttcacgtcattcgcatattactctcctcctcgctgatccattcgaattctgcactcaaatcgtgtttttgtacatcatagtttcaagcattatgattctctctagccaatgacttttcttgcgattgaatccttttgcagtctcgttatcaaaagttgaagaatttagtttagtttggttgtgtagataagatttgtaatcgcaaaattcgatctttgttacagttatggattcgagttactctgattctcgtcccatgttcgtgcaatcaccttatggtggttggaatcaaacacagatgattgattcaatggctaatccaatgaacaatgaacaaggagacttgcattcactatctgaatcacaatcacaatctcaaccgtctcagcaattacagcctgcattgaaaaggcctagacttgttgatgataacttgtttaatcctgcttcgtcgtttcctcagccttcgagtagcaatccttggatggttccatctttgaaccctcctcctgtgaacaaagggactgctaatatattctataagactagaatgtgtgctaaattcagggcagggacttgtaggaatggtgaactctgtaattttgctcatgggattgaggatttgaggcagcctccgtcgaattggcaggaaattgttggacctcctcctgctggtcaagacagggagagggagagagagagggaaagggagagggaaagaccgtctttggcgcctgttgtgaataataattgggaagatgatcagaagataatcttgaggatgaagctttgtaggaagttttgttttggggaagagtgtccttatggggacaggtgcaattttattcatgaggatctgtcaaagtttcgtgaggactcggggaagttgagagagagctcggttataagtgttggtgctactgctgctgatcaaccatctgatactgcttctaatcttattgaagtaaatagacaaggaagcatcccggtacctgcacctatgaacaatggtggtgttgtcaagactgtgtactggaagacgaggttgtgcatgaagtttgacatcacgggtcaatgtccttttggcgataagtgtcactttgctcatggccaagcaggtatgttatatgttgaacatgtatctttgctaatgcgaccttatattatagtatcctagtatagatttgcaagttctgtgtatacaggctatctctgaattctcttcttttgaccgacatttgtttgatcttgatttggttgttgattacgaaattgcagagttgcataactctgttggaagggtagaaggagaagctatgaacgcggtagcgtctgtgaataaacaagcagtggtacctgcgaatgaagcatttgcaatgaaaccgattacacaagtaacagcagattcctctggtctgaatgaagaagggcggcgaaagaagtgtttgctcaagtggagcgactccaagaagattaaccgaatatatggagactggatcgatgatttaccggtgggtcaaaagtcgacaaagccagtagagagttgagttttctagcctggtttcatttgtctcgtccttttgatgatcaaaactgataaagctttggtcgaaaattttgaagagtagaaacactctttattttgttcattagcaattctttgattcgctatagcttagaatattgcttttgttataatctttgattacacaaaaaaagtggcttggctcactaatagcatcttattcttaatttgtttcctttggcttctaatgttcatcattatatggataggtttcgtatttcgtttgccttttaatgttctaacgaatcggaagagatatagaaggaattgggcgtatcctaaatttggcctctagtgtttgttgttggttgacaaaataaaaatgtttgttgttgacttttgttttcagattaaggtttaattatctacatcaaagtgcattaaggttaatcggatgttaaaaataaaccactttaccgatttatcaattttcttatatgataaaccaaaaccggtacggtttgctaccgttagattttggatgctcaaattaaatcggttggatggtgctagtttttagaataacgatcatacattctcttttctaatctgttgatatattatatacatacgaatgcttattgttaggtacttaggttcatcgcatgcaaacaaaatcatggaattgtaccatcaatttttaaaaatatatatgtctaaactacgaataatgcagaataaatccatttaacaaagggaccataatgattctttagtgccaagcgatctttttggtttgtttccctacaaaagaattaataaagatttcatactaacggcttaaagtgattaatcatattgctatggctatggcaatacttatttgataatttcgtcgtagctttattctttttatagaaatcacacaaaatatatgggccctcaaattaatagtgttcgtaacgtctcctttactattccccacttctccatttctatgaacttttctttttgctactattgtttttgtattcttttcaacatgacatgatgagttattaaagagctgttgtaggtagagagtcgtagtaaaaaactaaaactgtcggtggaggctggagagcacttgggaatcctatggccctcccaaaaacatataaaagataagaaaagtagtgaaatatagtaataattattgtctttgttagtgatttagtggattgtctaaccatgattagtttatatatttgttttctcacaaataatgaaagtaggtagtatcaatatctagacctaatattttccatatatttaggtcaactctttcatatctggttgatcagtaatcatacaacgttggaattgtttgttttgtttctattataaactaaaacattggtaaaaatagattttcatttgtggaattttcgtcaagtcataattcacttgtttgaaaaca

SEQ ID NO: 2517 - DNA, 3000 bp, Unknown
  misc_feature (1)..( 3000): cDNA_ID_3068256_gDNA_ID_1620549_Annot_ID_160232 3000 nt of promoter + ATG
cagagaggaataacaacgttcaagattcttagtcaagtctaaaacagaggaatgcaatctgaaaatcatgagcatacagtgtagatgatccttcaggctcccattttccatatactcgtagacaaggaacctgtaattctcaggttagatgagcaaagggcaatccacacaaatggggagaaacgaaatgaaggtcaaccgtaatcattcacctctcgttcttcttattacaaaaccctttcaaagcaactaggtggcggtgatgcagcctggcgagaagctctatctctctgcaaaattcatcttcagcttgttcagagctcttgttcatcttttttacagctgcaaccaacccattactgaactcagctttgtaaacagtcccaaagcccccacggccaatcaccgcgttgaaatcttcagttgctttccttatctccttgtagctgaatttccgaaaaccaaacgaattacctgaaaaatcaaaaccacacatttgttttacatggtctaacatcccttgttagtgtaccatcagaagaactcttcaccttcatgaatcatcgaccttgggcggggagaaggagatgtccttgttagattacaagcgatgctcttggagtcatcaagttctcgtttttttctttggataagaactattaggactacaaccatcacaagagcaaaaactgtgacagcaatcccaatagtcggaaccattgtcaagtgatatggatggtgactttttaatggagacaaaacaagattatcgctgcttggactatcagctaacactggaggagaagcttctggactcagcgatgatggagacgaacctgagtagatgtgtcaagaaagtcagaaaagaaaagaaagtccaatcttgatctgatactaagaagattatacaggacacactagtaatatatacaggatctgtcaagcatctttcccaatatagaaacaatgataagattctacactccatgaatggtatgttgacagagaaaacagtatatacctggagtggggctaagctcaggcacattaaagaagcagctagctagttcaagagccgatgaattgtcaacccggcttgctaacacagcataagttgcatcacgacaagtactcagtttgatgctattatcagcaccaacgaggctcctaaggtagctgatactggaattcaaacaattcctgcattgatcacccggaggaagcgggagtttgcagtttctggaaacatctccaaaacttgtggaatgaagcattggcggtacagtagtcagaccctcacaatcatagttaacaagaatcttggtccctaatccacagaagatggtagcatttcttgggattccataaagctccatggttctagagatagtagtgatacagatttcagtcaaatctgatgtaactccaagatcagctgtgtagtttgcatagcgggcgacagatattgcaacgaaagcattcatgtagcggcagcatttagctctctcggtgttgttcgagcatacggaagccactagagtgaagttagatgaagtaaagtccaatggacaacctgtaaacacaatatatcacataactttgcttcaattttgcaatagtttctttctctcaatgaaaatctcatcaaagactacgactttaagcaacgaattcaccacaaattagaacaaaggaacacacaaaacactttaatgcacatcgaaattcgcacaaagcttaaacctttcagaaaaagcaagattaacaacagttcgttttctcttctttatctagttacgaatcaaacccatggaagaagattgtcaaggaagattctcaaaagactgatgtggtgagagacaaaacctgcttcggtgagtaaaggaaagtactggaatccaagcaatgcgaagaatgcgagcaagagagcttgattataaaccaacaccatggccaaagaacagagagagtcgttaggagaggtcaatgagaagtcgcctgaagagaatatgacagtggaagaaggtcagtgacaatgagatggagagagaaagagagagcccccaactttctctatttcttgatgaaacccattaaacccctgaataatccttaaatttgtcattctcttatgtttttacccgaaagttcgttgtaatagttttaagcacccccatacaaataaaattactaattttcgttcaataaaacttttcatgtataaacataatcattgcagtggtcggtttttaagtttctttttttttctctatcttatctcttcacatgatttggttccacaaagaatattaacaactcttagaaacaataagccgctatatgttttcatcataaaacacctgtaaaatgttaacatacggcggacacctaaatgtcaaactagatgatagtatggaaggaatattaaaacttctccaaatactttatcatatggtttttctctcatgtgtgaggttagttttatgattgatttggaccggcacaaaacgtatttaattttcataagactaaagtactttataattttagctggcatgctaattaacttgatagcatttgattacttgataatgatgacagtctcatgcaagttcttcattttttggttaagtttattctttaaaatggaatcaaagaaccatttcatgtaggatggcatgttaacttgttaagtataataataagaacaaaccataaaggaaaacgagaagccaataaagaactctcttctatagctattaatatcatcattgtatcctagatactcgcgattcctcatgttattttttgtttgaaaagataaatttagatttaagtttttatttaccgttttttgttggttggtcaaaacaacttgtaaatcacccgttccaagtcttttggagttttaccaagtagttgcttcttcccaaagtcaaaatctttgggtttttattcttttaaacttctttatgggattttggtgcaagaaagaagaaa

SEQ ID NO: 2518 - DNA, 3000 bp, Unknown
  misc_feature (1)..( 3000): cDNA_ID_2048691_gDNA_ID_1620549_Annot_ID_160235 3000 nt of promoter + ATG
agagcattgtaagataccggtggcgaagcctgaccgtctgatccttcttgatccggtttaatccggtggggatctttgccacaagggagataaaagaaagacttaaagttaggacaactctgtttccgcaagaaaaacttggcgcattcccatggtgttctttgattcgtaagatctagaatacaattcatacccacatcaagaatcttcctcttgatgagtgttcgacattttggaccgacctgtgtgaagtaattgtacgagagagaaaggttcttgagggctgagagctcgcagacaatctccggtatagtaccgtagaaattgtttctagccaaattcagctgctccatcttctttaggcatccgaaagagtacggaatcggaccggttaactggtttaactcaacatcgaaaaccgtagctcggttaaggttcccaatttggtacggtaagcaaccagttaacttgttattcaagaaaaggacttcttgtagggacttgatgtcaccaatgcttcccggaataggacctgtgaatctgcatcacatcacatgtaattccccccaaaaaaataactttagaaccttaaaaatacaagatacaattcacaaatatctcgtgacatcataataccaaacttgaaataaaaacagagtaaataactctgtaatttgaaacagagtaaataattccctgataacaaaacgagaatgaaagtgtggagcttttgagacctgttattagcgaatgtgaggtaaagagcggtgatcgatccaagattttcagggagtctctgaacaagattgttgttgttgatgaacaatacgtcgaggtctagattgaaaacctgaggagggacagaaccggagaaagaattgaatctgagatcgagaaacgtgaggttcgttgcttttaacacagagcttgggaactctccagagagcttattgttgctgagatcaagctcgaaaaggtacttcaatttgctgaagtttggaacagagcccacaaaattgttactgtttgcgtgaaagatggtgacttcttctaacttgttgaggaagttatctagccggagtttcttgccacccaagttaaaattgttgaactgaatgctggcaagtgcgaggtcgtttgttcccggtaacttggcgcactcgagtcctatgtatttgtcctgagcgcaaatgtcggtgcctacccatgttttaagtatgctctttggatcatcttcgattagcgtctggaaattcttgatgactggataaactttctttattaatgggcttgagaaatgtagcggcggtggcggtggaggaggaagtggccgtggtggcggtggtgatggtgttatataatgatgataaggagggggaggatagtgttcaggctccggagatggggatggaggagggagtgactgtggtggcggcgggggtggtggcgtttgaggaggaggaggcagcggaagatagtcttctggctccggagatggcgcaggagaattgtaattggtgctatcactgccaccgccgatgatgatttcgagagattttctgtaggtgttgtggttgtttccggtggctagaattgaaagaaagtgaacagacagaatcaagaaaatggaaggataataatttggggccattgctgatagattgatgagagccttgaggattggcttaggcagagctacatatagagaaagtgactgaaaatgatgagaagtcaatgcacatgtcttcttgtgggctggttttaggttacaacttacaatgcaattagctaaatttacatttgaattattggtaagaaaaaatattaattaagatcttcatattataatgccaaagggtggttggatacatgtgtagctatagcttcgttggtgtatgatttttttccgtcaacggcttccacgaaaaatcttggtaatagaaaaagagtaacataaattctttagtgtgtgattagcaaaaaataataaccaattagtatttgcaacaaactattttctaatagaatctgatcaaggactctaccatagattttggtgctttggatccattcttagagtcaaaggagcgaatgcctctggtgagtcaaagggcattggctttgtacagtacaacactgaagaatcagctcacaaagccatagaacatatgaaacgaatgtttcttaacgataggaaagtatatacgttggaccttttcttcagagagatttccaagcgaaaaggagatttaatttcacggatatttatgtcaagaatctctccaagtccttgactgataaagatctgaacacaatttttcaagagtttggaccaacgaaaagttggtgtgatcattagggatggttttggatttgtcaattttaagaatccagaggatgcagagaaagctgttgatgctttaaacggaaagaagtttgaggacaaggagtggattcttacaaaatcgaaaaagaagtatcagagtgaatctgaagtgaagcgaggtttgaaacaggctatcaaaaacagatcacagggttcgagtaacttgtgtgttaagaaattggatacacgagtaacagatgagagcctcaaagacattttttcttcctatggaactataacatcatgcaaggtttgaaactctatacacagaaaaatttgaggtcgttgttggattcaagatttttacatttttgaatgtaaacaggtcactcatgagcgacaatagtggagtaagtcaaagatcaggctttgtttcatttttgaagccagagggcggacgcttttaaagttgtcagtgataccctatgggtttctcaaaaaaaaaaaaaagtattttaataagagagtataaaagactaaactaaaaagtaaaaagaaaaagaattaagacattgaattgagtagcaagttagaactaaattaagccccaaaactgatcagctgttatgtatgattcagtagctttccattgatgaatcaagttcatcttctag

SEQ ID NO: 2519 - DNA, 3000 bp, Unknown
  misc_feature (1)..( 3000): cDNA_ID_3068294_gDNA_ID_1620550_Annot_ID_160277 3000 nt of promoter + ATG
gagaatattacatattcttttgttcttattattgttacataatcaccaaaagtaagaaggagtactccaaaattaagttgagatgtcctccttggagaagtggacatcaaagccaattgatggagttgcaaaacgaccagtaaactgatttgtgttttctttcttttttagtttaattatgttatttgcttcaattagaaataagatgagaatctgttctccttatgtttaggatcagagccatctcgttcatattttccttgcttgtagttgttggagctacgactccactttgcttcctgttttgtctgtttctaaaaaaaaaaggcaatcttaattgccaaacaaagtgttattgtgttcttactctaaaagctttggtagagatcaaagctaacaccaatacttggccgttgatttttagattttatctttgtattcttatgaccttgtattgaattatttttaaatttctattgattgttgctatgatgactattcaccaaaaaatgattcaattgaaaatcgtttatatatcgttacgtacagtgtacaccacttgacgaaaacatgatcataagattatgtgtttccccaacaaacctggacctttccacagtcatgcctttatgatgtcagacctcatatcccctgtaacttgtgattgggacagggagaaaataagagaagccttacttgacttagagcaggagattctgagtttaaagctgagtactaatggagccgaggatacttatattgatcaagactcaaataagaaaggcctagtattggatatgtactacaagagagtgggccgaacatatgagaagtctatgaagagcttctagaagaggtgaaggcacacaaatatctcttgtagccgttgaagaggactcacgagtgtctttagcaacaaggtcaaccaatgaccagtcactctcatcaccaagaccaaggaacctcttctcttatgtctctttcagtcttacgttaattgtaaacggtcatattctctttgtgtgtctttaaagcattgtaaacacacaaaggttacaattctaattctatcaacatgatttggtctcatattctctcacatacaaactctcttgttcttcataactctcttaatctttaatacaattccgcatattctttcaacttatgcttggctaccacaaaaatttgggatctacacggctaaatcaccttcaaggagctaacaatggctttaactggacaaaagagaattggaatactatgaagatctgggaagtggctccactaaaacattcgatattcactacatcaaaaactcctactaggaagaagattggcgttccagcttaggtaagtagccactaaccaatttatttgtttcagaatgttcacatgaatggcttgcttggaccattcaaactcttctcattggaccggccatcgtagttaaacagcattatagagaagttatatgagaactgagaaatgtaaagtcaaggaatgagccaagaagcataagaagaagattcatctaaacattgtcaaaccaaggagaaagaacaaccattaccatgtccgtgtaatcaattcagtactgccttctgcccgaagaactacattacgcgattactcgtgtcacgcaccggtttggtttcattgatattgcataacacaacggatacaaattgaagagcttaacttagacataaatattaaaactaaataaaaatttatcaaattttttaggtgaaaacgaaatcagtgggatttttgttttcttttgcatttttttcgaattgatatgttgaaactttcaaactgaactcgtatattttttctaaggtggccaccatgtcacatagctagagagaatccttcagtatatttgtttttgaaaacttcgtcatatcaaaattttctgatacaaaccgcgtgattttatattttaatgattaatcttcagaggtgtcatcatcggctcaatgttagctgttatgacttttcacatcttccatcaatgatctgaatttgatacagctaatgaaatcaatttttttctatcttctttttttttgttaaagggtttgattcttttctatcttcaaggtaattattatttttgttataaccaaatcgtcaaagtccagtggcaaaagaaaaagaagtttctgtctctttctttgagtagtattgattcgggttcgaatcaaacatgatttccccgaatctcatagttaattttgggcttaaatgtttttggaaaatttgtgatagtatctattttctaatactttttgtaataatactttttttaaaacctttgaaaatcaatttaaaactggtcgtatgacattttttgtttttttccaggtaagccctgctcaaaccattactaaagttattgagcagcaaagttgggaagaggaagagcaaagatcataaaataaagaagtcgaaataaacaatctaacggggcagacaaaagtaagaaaattatacaaattcgatatgaatttttatttaaataaagattaaacaaatttgataccatctaattaaatagtcatttcaatatattttatgaaacaaaacaagagaaaactaatcaaaaatctcgaaggtatcaattatcatcgttgggctcaatgttagctgtcatgacttttgttgtcttaattaattaaacaacttgttattgaattaaaaaaaaaggaataaaacttgcatgagagtttgaaaagcaaagataggaaaataaataaaagtcgtagtaaactaactaacatggttgtattactatacaaatcaaacaaataataacgacgtacgtgcccactagttgtattactaatttactatagacatgtcaacgtcaaaattaatgtagtatctgataatgtaacaagtagcattgctataactagagtatatagaaacacgactatattgatccattagaacacaaaaccaaagtgctactatccaaacataaatatg

SEQ ID NO: 2520 - DNA, 3000 bp, Unknown
  misc_feature (1)..( 3000): cDNA_ID_2992061_gDNA_ID_1620550_Annot_ID_160284 3000 nt of promoter + ATG
gtattaagtactactttcattctattttacttattgtttgagttttgtttatcaatagttattaatccataatggctaaaaatttacgtgtgttgtagtttagatgtttgcgatctaacctcatattaatttagtaattttagttggatattttcttattattacgttatgtgaatatgatttattatatgacattctttctgtttatttttgtgcggtctgataacttgataacattgatatacaattttttcacgtaatggtcatctgagacattagacatatccacacaaaatacgagactctatatggctatttgcaagggaagaaaattaaagtgttgacttaaattactagcatatcatgatgtggttggtgtactagatgacgaaaaaatatatggaataaagaattatttgttaaaattaaattagacaagtttcaaaatacataagtaatataactacatattaatatatcatataattttgttgtatgtgttcatgatagtgaaatatttgaataataggtatataaatattcatattatagtaaaattaatatttcaaattatagataaatttaatcataaaaacttataactatataaaatagatatgaatttattaattacaaattaacacacacacaaatgaacatcaaaatcaacaaaagaccataatcatatattccaacaattttaaaaataaaaacccatgcatagcatgagtgttcatctagaataacaaattaactaataataacaaatatgtaggtaattttataaaaattgtatatataaagatcataagtttataaattatctatatgtggtgtaatcatatatatgaaagttggccaactctctttatatgaatgacacatcatcacttagcttttgccacatgtccacttaataattaatgtaagttaattgtttatggtgatttattatttatttatatatattataaatttttacataattaattgtatgaataataattttcttttattttgtatgttttttttcttaaattaaattatttaattgattctcatactcttggatattttcccctaaattttatcattttaagtcaaaatatgattaaataattttatagtggattagctaatagtttccgtaggttgttctttttctatagaatatattaaaaatggtgagaagtacttgagaactctagcatcaaattcttggactcaaatcctcactgatagagtttttcggttatggacttcgtattattttgttttgtttttgcaaaagtggcaacaatgaaaattaaaagaagaaaattattttacatttatgtttcaaaaaatcaataaggcttatcaaggtttggttctatttgtctatttactataacttaataactctttttatttaaacgaaacgacagcccgataatcaatgcttaattttcctacttaaatactaccacaatgaatttcagagcgggtactccgatcttctttgcattttgtcttttttttttttggtttaaggttgacacaaatgaaaaaaaatctgaaaataatgtttactaagaaaatattttgttaggaatttaaatgcaaaatgcaaaaaaaaaatgatgatttatggagcttagtatcaaataggaattctgtcttcttgcctattaaaaaaataacctaaattttatatttaaatacttttaaattacgaaatataaagtgaaagcccgcacgtggtgcggatactcatctagttattaatatttgccaagatttgtgttgaaaacattacgagtaggccttggcaaataaacagaaacaactgaaccaaaaatttaaaaataactaaaaattcgaaaccgaatcggtaccgaaccgaatattttggataaccaaaaatatctaaaatataattatatttttaaaagtattagttatttttaaactaaataataaaaaaatacttgagaatatatataagtaaaaatactcaaaaatcactgaaaatattcaaaaataaccgaaatatacgaaaatatacgaaataaaataaccgaatgcatactaaatttaaaaaccgaaaaaaacagaatcgaattgaaaccaaacaaaaatttcaaaataatcaaatggatactaaattttagaaccgaaaaaactgataaccgaacaccgatgactaaagtctatgagcataacacaatccacaaaaaataaacctccacagttttactggctatgccataaaagcccactggacctaaatgggcccatattcaagcatcctgtaatctcacaagagctagttatctggtgcgggcatgagtataatacgttatcaatcttcctcttcgaccattaaagaagaaaaaaaacaatatcatcgtgacgaatcgaacggtttatcagctcttctgactttgcttgaatagatcggtcaggtgaaaaacacgagagactctgtgaagaagagatcgctgcgatctatcacggttccattgcctggaggattcttcttccttgttttgatcttgttcttatcaacatagtctgtgtaagctgttcgattctcgccattttcaatttctgttttccctctctgtgataaatttcggagttctagggttttgtagtttgattctccgtttttgtactggtttgtgttgttgctatttcaattttggttgaaaatttcttgatttttgttgtttcaggtgattttattggctataacgagatatggatttggcatcccgttataaggtgaatatctttcttcgattgtgagcttaatttcagctgtcaggttttcagggtgattaaattctgttttggatcgaatgcatgtttccttcttgtttccgtgttttcgaatagctgtatttgttgagaggagtctgttttgcatttgctcggtgttgattccaatatgaattttagtagtttctcaatggtgtagaaagagtgactggtagtttactaatcatgaggatg

SEQ ID NO: 2521 - DNA, 3000 bp, Unknown
  misc_feature (1)..( 3000): cDNA_ID_3068277_gDNA_ID_1620550_Annot_ID_160288 3000 nt of promoter + ATG
agatgtgcttgtgaaaggaaaaacatggacttctgggattcaggaagagttgactggttcctttgtgtttgtgtgcgctcatggtagccgagacaagagatgtggtgtttgtggaccagttcttatggagaagttcgagcaggagataagttcacgtggactttcagacaaaatctttgttttgccgtgttctcatatcggtgggcacaagtatgctggaaatttgattgtcttcagccctgattcagctggaaatgtttctggccattggtaagaaaatgtcaaattcaacttgcatatataattcagaaaagtaattgaatgtaatatattatgcataacgatcttggttttatgcaggtatggctatgtgactcctgatgacgtgcctgcaatgcttgatcagcatattgcaaaaggagaaatcattcaaaacctttccaggtctgttttccaacttcttgtttctagattgttgcagatatgtctctgttaaaacagctttacatttcctcgtgtacattgtactttttatatcgatatccatggttgtagtaaaccttacactagacatataccctcgtgtttgaactgaaacggtttttcaacagacaaaaactattgtttgctaatgaatgttgcaactccgtatatgtataactagtatgatactgcaatgtagtcaagaagtttctgcgtgtaatggtactttcgctgaggtttttgtttgcccaactaggaagctcataaccctttactcacccattttatctaataaaatattgttatcactttatttctagaaccatagtcaacaagtttcaggttcataccttgtctgattgcttatcttcatttaacgctgtgttttcaattgaccaacattgtttaacgaaaataatttctatttcagaggccagatgagactaagacccgagggtgaggaagctgagaaagaggatgagcataaaatcccaaacggaaacagtgtaatggtggaagaacgcgaacctgtggagcagaaagggttcacaggaggttgttgccaaggtgcaaacggagtttcatgttgccaagaacaagctgcagagccagtcaagaaagaaggatgcatgaagctaaactggttgaaatcgatggggaaagaagaggttctcttgggagcagcagtagtttcagctgtcgcaaccgttgccgtggcttacagcatttacagaaggtcaggttaagaacctgaaccaccctcctctttttacacttttaagaagaaactttatttttggtagccatattatagaagtaaaggaagaaaagaaaacatggagaggtaataatcttttggaactatataaccatcatttggtttcggtatgggcaatgcaggaatgggatgtaatcttgcttttgactcggtttagtttggtttatcttattatgttgtcattggaatatatcaatcttctctagttttgagtatacgtatatgaaattagcaggtgagggagctacttattttagttatactggcccacgcgttgaggcaatacaaaagtcacagttaggagttaagcaaaaaaatgtcatttaatttcccgagtggtcgtttaaaacatgaactaacttttgagacatgagaattcgttgattaagtcaaaataaacatgtctttatcagtcgttaatggaacctctaacgtccattatcacctctaacgattttattaatcagctttcaaattgtagacattttaaatatcaactttgtatgtgaccatttaaaacataaattaaatattaactaatatttgaaaacatgagaaatttgttgaccataccaaaataaacatatcatcataatactttaaagaaacttataacatccgttaacgaaagtagaaactggaaatatataataaaaccatatattatttgggtcaaacgacacaatttggtttagtttcaagcttgattttgattatgggacaatgttaccattcaacaaaattataagcaaaggaccaaaaaaaagatcaatgagtaattcataatcgacaaaataattttattgattaatataaaaagagtataaaaatgggtttgaaaacatgaaaaatagatatctgcgaaggtacacacacaaggacagtcgtaagctaggtaaatggatcccacctacctcattctttttcaccgacgagatttttctattcacatttcagtttttggtcttattttagttgttgcttcactattcatatgttcattatatcaatggcttctagtcttcttctagaaatcgatcttaattcttaaaccacccacttagttcaatatgtactattatttctcaataatacaaaatagattacaaatagttttgaattatgattgtatttttaagaagaagaaagacactaaaaaaaaggatgaaaaagacccgtaagtgttttttcttaagagatagaggagatttctggtcacctcacccctcactgacgcctacgcggaaaaagcaaacaactttcgatttctttactcctttttttccttctctctcaaaacccctaaaataagaaacttcaaaaaaaataatcattaaccaaaccaacacgaatcatcaaaattttgaccatttctccatcagttccagtgtcaacttcagttcttcttcccattcttctctcaaattcccatctttgccgttcaatgtttttgttttctttatgtagttgacgaaattaggattttgattgtcgtgtttctttctttattctgtgttcggggaatcctttgataattttctctctttatattccaccaaaaaaaaaagcatcttttttgtttctttatctatctgattgttgtatagtttctcaattccaaaaccaaacagaatgattaatcaatcaaaaagggcccagctttgacatatctctctctttctctctttagccaactagggtttttgtgatttttgttctggggttgttgtgggaaaatg

SEQ ID NO: 2522 - DNA, 3000 bp, Unknown
  misc_feature (1)..( 3000): cDNA_ID_3068269_gDNA_ID_1620550_Annot_ID_160290 3000 nt of promoter + ATG
ttcggctgatatgtccgagcctactttgcatcatctcttctaaatttgttcaccattaccttacctgattctttgcattccattatcagtctatatcatgacgtgacgtagagttcgggccgggtcactgttaactttaaaattagaaactcttttatttaaatatttcgaataaaaaaataagtgttttaaatttaaatgatcgaacttcaacccaacttccaccagagtgattacggccattcgtcacatcaatcttttaatgacctattggcctcactattttatctaataattacactttatccaatattaattattgagtatattatgtggctttgataattggccgagttggataaaatagtgaggtttatactaatattgttgttaagttactattcagattcaaactcgtaaaattttatgtaattgacaaaagggtaagttggtttgatataactacgccattattctttcccaagagacaagaagtttgcaagggcaagataataaaaaggtgttatgggtatggttgcattgacaatttaggtttagtatggatataagtttggttgattcgaaatttgttcggttagtttttttttttttttttttaattttaaatttcctttaaaagagaacatacaatgccaaaaggctaaaaaggcacacaggcctgaacagaacaaggcaaaagcccaacacaggcacgcaggccccaaaagaaagaggaagagaggaaggaaaaaaggagatagagaccttacccgaacaacctaaaccaggttgagagaaccgacgatcccggtctggctaaccgttgggcacgagccaacggatcaaggcgcgccttcaagataaccttaatctccttgacaatagttaaggaagttttctgagaggaggaatgaattctttggttccgctccttccacacaagatagactgaggcttgaaaggctaatttgatgatcaacgccgtattaggttttagtttgtttggttttactttggtttgtgttggagttgattcccaaagattttaaacattcaaaagtaattttctgtgctcttatataccaaacaattttccaaataaacttcatcgtttggtttagtaaaaagtttattaatcaaacatcaacatgcaacgattgtgacatggtttgggttagactagttcggtttagtttgacttggttcagttaaaatactcacctgtacccgagacgaggatattagaagcgcaaaataataaaatacgccggaggacgacgacagccgtcgtccacgtgctgttgccggtagtccacgtgcgtccatgtgaggcattgaggcgcctcggtcgtaacttccgcctacttcctacattatgttaactcaatttttaagtgtaattaattactaatcactattcagtttttgttttgttaacatgatttctcgttttttttttttgttgaataatttttagattcatcctcgtaaaatggtttaactaatggagtcattttaaacagtaaaattaattatttctagaaataaagaagaacatgcatagttatttaagttttaataaatttattatcagtggttcaatgtaccagccatctcgaattcttaggaggacatgtctcctgatagaaaaatattttaattaaaatctaccaacaagattgcattggtgcaattaatatctaatgattatgattccatgttgtataatctcattgcatagatattgattcgaaatagaattttcaaatcacgaaaatatgaaaatggataaccttgtcagttgtttcatgagtcatgaccctctcatctatgtttcgtttaacttaatttaagaacacaatttttttctcatgcacaaataattagtttaagagtttaatgcgtagggtaatccaacaccaagagtgaattttctcttcttagcttaaacaaattatacatcataaaaaatagctaatctcagttttataaaaatttcaaactaattttttattattgtactttaaaatccttaacaattttcaaaaccgtaaaatgaaaccacattcaactaaaaattggattatttacacaaacatagaacatttagtaaaactctgaatgataacatacagtttaactgcacataaagtgcgatgcagttctaataataacaaaaaatatatatagattttttgttactattacaaccgtaccgcatgatgcggttctgtctctattcgtagcctagagatcagtcgatttcatattttaaaatttggatttcagattcgtcgaatatgaccaaaatgaacgtgaccctacaatcattttttacggacctactactaaatctatactaatactcaaactttatagcctagacataacaaaaacataacacgaagattcatacacaacgagtgtataatataatcttactaattagtgcttagatgcggctccctacttaattacagtaattaaatttgcttttgagggaacatcgcaagatcgagagtttaaaaagttgcttaaaaaaactttcccattaaacgacgaaacatcgaactttctctttatcttcttcattcacctgaagaaagcaaatttaaagaatacgaaagaaagaaacatcttcttcttcttcttcttctctctcggacactaatcggatcggatctaacaaaactcgtcaaagagaaagaaaatattttcataaaccactgatttgtctatgatcaggttatagtttctttccttcttcttcctctatgtttctgcaacttttaccggaacttcaaaattttgcgggaaaaaaaaatcgaaactttttctttctctctacgttgtctcggcggttacttgaaattgattcgttgattgagtttaagtaaccctaatcattgctgggtttcacttttttcgatttctttattcgggtttgaagttaacttttaaaaacctttctttcaggaattttgtcgaacaccttcaatg

SEQ ID NO: 2523 - DNA, 191 bp, Unknown
  misc_feature (1)..( 191): cDNA_ID_2162868_gDNA_ID_1620550_Annot_ID_160292 3000 nt of promoter + ATG
gaatcaactttctgaggaaccctgaagatccctttcacggatattacaagcagaagcttagtgaataccattctcatattcaacaaaatggaactatcgttgaagattttggtcacattccaacaaggaatgttagtacataagtcactgagccacctccaggtatcatcagaaataatatcgagatgatg

SEQ ID NO: 2524 - DNA, 3000 bp, Unknown
  misc_feature (1)..( 3000): cDNA_ID_2162848_gDNA_ID_1620550_Annot_ID_160287 3000 nt of promoter + ATG
ttaaaccacccacttagttcaatatgtactattatttctcaataatacaaaatagattacaaatagttttgaattatgattgtatttttaagaagaagaaagacactaaaaaaaaggatgaaaaagacccgtaagtgttttttcttaagagatagaggagatttctggtcacctcacccctcactgacgcctacgcggaaaaagcaaacaactttcgatttctttactcctttttttccttctctctcaaaacccctaaaataagaaacttcaaaaaaaataatcattaaccaaaccaacacgaatcatcaaaattttgaccatttctccatcagttccagtgtcaacttcagttcttcttcccattcttctctcaaattcccatctttgccgttcaatgtttttgttttctttatgtagttgacgaaattaggattttgattgtcgtgtttctttctttattctgtgttcggggaatcctttgataattttctctctttatattccaccaaaaaaaaaagcatcttttttgtttctttatctatctgattgttgtatagtttctcaattccaaaaccaaacagaatgattaatcaatcaaaaagggcccagctttgacatatctctctctttctctctttagccaactagggtttttgtgatttttgttctggggttgttgtgggaaaatgggatctgcaagtgggttttactcgaacgaagagtttgaattggatcctaaatggcttgttgatcctcgtcatctctttgttggtcctaagatcggtgaaggtgctcatgccaaagtttatgagggaaagtaagctttgacttacaatctttatcatccatatatactaagaatcaaaagttaaaagttgtctctttttatctataatcattgcttgctacagaaatttcaaatctttgtttaagtttgaaaaaaaagaacttagtcttgaaaaaagtttgactctttgcgtatatgaagcacaagagaatcttttattgtctggttcagttacttattaggctaattggtttaatctttctttctagtatttattgaagcttatctgtttctggagatgcttgaagattgttgtttgatggattgaaaatgtgttttttgttttgtttaggtatagaaaccaaacagtggcgattaagattattaaaagaggagagtcccctgaagagattgctaaacgagataaccggtttgcgagagagattgctatgttgtctaaagtccagcacaagaatttagtcaaggtttttcaattttttctatccaccaactctgttcatttggctaatcagagagtattgggttgtaatcaacaacgtttggtaatttgtatagttcattggagcgtgcaaagaacccatgatggttatagttactgagcttctactaggcggtacattgcgtaaatatctagtcagcttacggccaaagcgtttagacattcgtttggctgttggttttgctcttgacattgctcgtgcaatggaatgtttacattcccacggtatcattcaccgcgatcttaaaccaggtaaatggaaagaaatctaaatccgtgacttctaagtatgtatggaaagcttatgatcttattgcatctgcagagaatttgatcttatcagcggatcataagacagtgaaactcgctgatttcggtttagctagagaagaatcattaaccgagatgatgaccgcagagactggtacataccgatggatggcccccgaggtaactatattactactaacccgggatttttcttttcttttcgcggttgtcttatcggacatcttggttaatgaatgatacagctctacagtacggttacgttaaggcaaggagagaagaaacactataatcataaagtagatgcttacagctttgccattgtcttgtgggaacttattctcaacaagttaccatttgaaggcatgtcaaatctacaagcagcatatgctgctgcattcaaggtaataattcatctctcaatcggttctgaagcaaaactgaattacaaactaagaccgaatagacgaactcatcatcgacacgaaaaaccaaaccgaaacttagattgaactcccttgtatctctgctgtggcctctctgcatttgatctttacttatttggaagatccttggattcgtgtatcaaaatttgtcatttcttggttaccaaattgatgaattcaaagtaatgaaaccggcattgtgactaatttgtgtttgtttttatgatagaacttgaggccaagtgcagaggatttaccaggagacttagagatgattgtaacttcatgctggaaagaagatcctaacgaacggccaaatttcacagagataattcaaatgctcctccgttacctcaccactgtttcggcaccacagatcattcctccaccgaatcgacgagtcttctcatcagaaaacatagttttatcaccggaatctcccggaacttgctctctgatgtctgtcagagacggagacgtttctcgtcagaccgttaacactgctgattcatcggagaaacaaacaaaaggaagcttcttctcctgctgctcatagatgatgtatttcgttgtgtaatctgtaaagaaaacgagaggaaagtgtttatgatggaaaaaagtataatgtattaagattagaaatttagatcacagtcacaagaaattgttcgtgtataaaaaatattgagcctgaaacattaataatgtttacgtttttgcataaatgtcgaaaaagagttaaattaaaaactacgccgttgccggggatcgaacccgggtcacccgcgtgacaggcgggaatacttaccactatactacaacgactttgatgttcaatctctagaggttaagcatatatattacaattttattggattgtcttctaaaaccctgaaacccttgagaagatctctcttgttcgaaagatttgccacttcgtttgcagaagcgaaatg

SEQ ID NO: 2525 - DNA, 3000 bp, Unknown
  misc_feature (1)..( 3000): cDNA_ID_1032240_gDNA_ID_1620550_Annot_ID_160283 3000 nt of promoter + ATG
cacattgaacacagatgtaaggagaacgatcgcctttcgtcccacaagcatcacacacgaaggagatcaattttggcatgtgtgagtgtatgcttatggatcttcatatttgatagagaaactggtggagggccttcagtcgcgcaatccagatccaagctgaacttacatatatcacaatgatatagtaagttcccagtagtgcctccacatatatcacaacttcggtccgtataatctggagctccactggagataagcttaagagggtgtctgacatgagaagggtgaataatctctggtgattcaaatacagagacacatccctcatgaatcaccaacctgcaacgagggcagcaatatccatgtttgctagtaccatgacaaaagtcgcatgacataagagaagcttttaagtcaaccatcagtaggggatggtggtgccactccatattcagatcagatcgagcacacaaggaatcaattatgcaatcgatatccaaattgactttacaatcatagcaatgatagagaaggcgcttcgtgtttttaccgcatagatggcatttcgggtctgtgtgatcaggagctccggttgtcagaaactcaagactatgcccatcatgagaagggtggttgattctcgcttgtatgttgaacacgaatacacatttcttgtgtatcgtaaacttgcattcaccacatgagtagccatcaccgtaggatcgattgcaagcatcgcattcaaaaccttcgttaacgtcggatacacgatgctcgtgtccttctagcacataagtcatggctgttgcggttagcagagatggagagaatgcaaatttattgttggaataaaatcactttggttttgtgtaataataatggatcaatatagttgttcatttatattatcatatctgacgttaacgttgacaactagtgggcacgtcgctaccattcgtttaatttaagcactatttagtattgattgtcccgctaagtttgtgtatgtcatgttaatttgtttatttcaaatttaattaaataacaaaaaaatgttgccctcaaggtaaaagaagatttgatatcattataatgggaaatctgtttttttatactttcataattgtactatgtttaaatttatacctaaattatatcgttgtttagaatatatctcagaagataatgtgtatgcaggatttcgtatacagatcctcgaaagagagtgataagttttcaggattatgatggttttatacatcatcaaatgacgaaacatcaagtatgggcgctgttaatctccgtagaagtctctcctactccatcaaaagtcgaagctcttctttgggcgatgaagtgtatgatcggtgcagataatcaagatgtagcgttctttacagactgttcaaacctggtgaagatggtgtcttccccaactgaatagccagcattttcaaaataaaaggaatttctgagcgacaaggatgagttttcatacttctctttatctttattctcttgaaagagaatcgcaaatgtaaaaataaataatttggcacggaaaatccgttctgagccgcatcaaattatctatgtaaacaatatttcacataaataactcttttgagtttttattaaaagcagatgacaaaaaaaaatgagatatctctcgatattaatcaatcgattaaagaaataaactgagtttgtgcttcaatagaatttgaggctcgtgttttagttctagggaagtgaaactacatcactttaagaaagaaaaaactcggtgggtacccaaaattttttatagggtaaatccgagtaaaattatattttttttgggtatccacctattttaaatctgttttttttttaatacaaaaaacaagtctcatgcatgtttaataataaacatatattttgggtatccatcggattttaacccagttttaacaatcctaaatatagacatttatataaaaaaaatttaaattaaaacatgaacaaaaataaaatacaaaatccgaagaaccataaatacttatattgaaacaaaattatacaaaagctatatgcagtgtaaactatttattagatttacctcatacatgttgttctctaaaaaccaattgatatcaaacaactttttcaaaaataaagaggataaaattttttttgtaaatattgaattataaaacagagtaatttatattttgttatataaagttgtactcagtgtgtatactatttgtttaaatttgattggttgtttttctaaaaataatgtgttttaataaataaaatatttatgtggtaggaaagctgatatggtaaactgaagcacgttgatttgtatgaatgaaaatgttttctattgatgataattaaaatgagatgtcaacttgaaaaaaccatactgtattgattcctattttaatatttgttagtctttgtttaatttaaacgctaatatcgaagtttggcctgccatgttagttagtttactttgacttattcatttttgtatctttgctcttctaagaactctcaatagacaagttttctttctttctttttaattaaataatagaaaatcattacactgaagataaaagaaatatttatttcagcagttgtatgaatcttgatcattgaaggaagaagtcaatgtcatgacagctaacattgagccgtcgataacacattcgagattagtcattaaataaagaccatggtgtgtgctataataatgttaagaacggtattaaacggtgtgcttaataattggcttttttgtgggttaacttatattttacacgaatatactattgggccttaagtatttagttatcggcccataagcatttaacgataacgggagtttggtgaatccgaagctaatctctaaaatctttcagtttcgagatccaaagtcactcacttttttctgaaattcgctactcagaattttcccgctccactgcatctctacggcga

SEQ ID NO: 2526 - DNA, 3000 bp, Unknown
  misc_feature (1)..( 3000): cDNA_ID_2162876_gDNA_ID_1620551_Annot_ID_160298 3000 nt of promoter + ATG
aatttgctttgttgtggtgagtagatacttttttttttttttttttttttttgagtagatacttcagagttcaactgcaagtggaaggaaattttgatattttttttttccataaatatacactgaaatgtatgtagcttttgttttgtcttttctgaataacatatgttttttggggttgaaatctaacctttttttataaagaaatatgatcatcgaataattgatttttaaaatttctgatagattaaaacgtgataccattgtaactcactacaaagaaaaagtcgaattgaatcatttatattgaatcacaaaattaaatgatattattttaaattacttattaataattgatgcaaatattaaaatgtaacatcagttacaatagctgatgctgttattaatttgtgtcgcatcaattaattaaaactgatgcaaatctaagttagtttgtatcacttttacatattgatataaatatataaatttacatcacttaaataactgatatgtttattaatttaattaacatcacttaaaaaatgatatatattttacatcaataaaaaagtgatgccaataaataatttatcaactacatcattttttttttatcgattcttaagttaatttaattagcatcatttcttttatgattttacatcacttcattttttttaattgccatctttaataacttttgtagtctaatattcttttggaaacagaatatccatttacttttttccccacgattatgaaatcttcctagaatcctaacttccctaatatctctataaatctacgtttcctttgctaatatgatagatttttctttttctttttaatataacttcttcttcttttcatcatctcttcttccctagaagaacaaaacaccaaaataatgaaacaaaaactatgtcgccaaaggtaaaccgaacctacgttcgtgtaatcggttaagaagtcggagacacaagttctttcggtctctcccctaattaagaaaaccagggaagatatcgcaagaaaacgccaacggtgtacaatcttcagggtaaaatcatgagaagccacaaagagatcatgagaaggttaaaaacattaagcacaatgaaaacatttttttgatgcttagatatcttgtaaggaagatgaccgtgaggaaaattatggagacatatgtggtatgtctctgtgtgattacaagagaatcaaagaacaaaagtagtttatagttttgaagtttaatttgtagtattttacttttgaactatgtacgtggtttaatttcttcaatgaatttaagattttttgtattattttatttataattagtgattattgaaaataaaacaattattaaaaaatatttatgaaaactaaaattaattcaatcggttattcagtatttgacaaaaaaaaattaacatccattattttaaatgatacaattatttgaatcatttattaaaactgacattaatctttacatcagtaatttacaatcaatacaaatatttaacatcacttacaataatcgaaacaaatactaacatcatttttattaatcgatgcaaaattaacatcatctatttgcaaatgatacataataacatcggttataataatcgatgcaaatatttattttaaatgatgtaaattatttacatcaacagtatataaatcatttatttaaatgatgtaattttcttttacatcaattataagtaatacaaatatttaaaataaatgatataaaatgatcacttttttgtagtgactggctaaaccgatgaaaacaaatatgaattgaaatcaaagaaataatgttatcttgtgtaacaagactttgaaaacttaattagcttattctcttttaactttggtataaataaacaacttttatatttgctatgaaatataccaaaaacgggctttgtaattggtcgactctcttatcagaatttgatgtcaagaccgcgtgataaaacatcaagaacatggtctaacatagtggaaagaaaaaaatatttgatagtaatagaatcgttgaaaattcaactatcgtcaaccttattcaacaggaatataaaacgaaaaaccgtaattggctcgaagtttggttgaaaaatcaaaagccaaaatctatgaacgagattaatcgcccactaaagtcccttctgttattggcacacgctcttgtcgttatagttaaaaagttcttcaaatacagagacattttgtttatgtactacatacgattcggtttggtgaacaaaatatcataaaacttggttcatgttgatatatagattcataagatgtatttttgtcttatatatgtttctgtatcatgggttaaaatgttttacaaatatgtttttttttttaaaatatgtatttatgtatatatgaatccgtacgcgtagtagtaaaatgaattagaaaggaataggaattgaaaatttcatattatgtgtatgtgtggaatcaagaaatgaataaaatgataagtggtggaccttgtaacctaagatccaggaaactacagaggagagccactgatagtgtgtcaataattattctcccacccatccacaaagaaaagttaatttaatttatcactctcagtaaattataatcaaaataaacaccaacagtagtcaactttcaacaaatgggtctgagcctatccaatatatataatcgatcgaagcaatctattcgacattaatgaatctcattcataaaatcataacgtaaaataataaatatattaattacagagacagacaataatgaaaggtgtgaaaaatgaacactacaatataaaagatgacatttaaaataaaataaaagagagaaagggattaggtgtgaaatgtggtgtgtctatttaagtggagaagagtccttgacactccatacatactacctttggcctcttcttcttattttatcatagctaagctcaaaaacaatcgatagatg

SEQ ID NO: 2527 - DNA, 3000 bp, Unknown
  misc_feature (1)..( 3000): cDNA_ID_3068304_gDNA_ID_1620551_Annot_ID_160302 3000 nt of promoter + ATG
gtagattaagacaatctagtttttgttggaaattaacatcattttaaaggtatttaaatatttaaggagagagatcatatacgtttcacctctcgaattcattttcatctttataatatggtattgtatttactatctatggtttctaaatttttttgaatatttaatcacttcggataagaaacgatcatacattagagtttggtataaaaaaccgtatgcaaatagttcatattgatttggcggttttctcgacatatttacacatataccttagccaaaatggtcttttcattttcaaacaaccttttcttttcaaatcctattaatcctcctacttcttcatcaccatatttgaatcaaaactatctaacttctaatgtaataattgttcaagaaaaatataaatataaacatttcacttttttgtattttattaatataatttaaaccattcatcgacattaaaaaaaaaaagaaaaaactaacacataacgagtttacaaatataaattatcaataaaagtctcatcgtcaatcccaccaaagacgaagaagggttatctccactcaaacatgtgtcatgcaattgaaaacgataaaaatacgtactgtgggaataaagtgatacgtttttccggcattttttgcaacataactccagttttagacatcaatttttctttgacgaaaaaacaaaaaaacatcaatttttcattgacgaaaaaaaaaaaagacatcaatttcattttttttctaaccatgataaaactactacaaaacaagttaaaagggatacgatgtacatcaaactcataagcttgcgaaaattatcaataaaaagtgatccaagaagataaaattatgataatccacatgtgattgctaacaaattgaagattcgattacttgaaatagaagctaaaagccaatcccaattttccaaggaacaaatcttctttgatttttttgggtaaatcgttgaaccaacgacacataagtaaagagaatctgcatataaggtagaagaaagtcatcgaatctacaacactaactcttgcaataattatttaatactaaaagaaaatacgtactgacaaaaccgtgacataaaccagatatattggatggcaaatttggatctcatccaaacttgaaaactgccaaaacatactggaaaacgaaataaaatagagagaatatccggtaggagatatttttaaaattttcacattaattaacttttttgcgttttctttttttttgttactggaattttattaatcaagccaaacatgtttacaaaaccggataaaccggaaacttagccagagactttaacaggaaacagagcccgactttaacgggagacaaagccggcgaacaacaagatgtccccggaaacaaaagctcaaacgagagaaacaaacgagggagacataaccctaaagtacagggaaccaacttacaaccaaaaaaattagctcactaagagaagtctacaaccaatgcactaaacatgaccacatgttccaaagagaagcctactaaaccttcctatagaaactgtgaacgccagatagcatcaggaagaccagataagacacaacaccaaagcctaaccaatcgcaacaccgacaaggaaggcaaaaggcttcacccgataccaaggaatcatgaaccactagagccaagtcacaccatagcagacggagataaagagacaggctaggaacaaggagaaaaccttgtgattcggcttgagacaagtcaaagaagaccaacagctcttacacgcggacactcgtcgacccagtttcagccatctaccaacaaaaaactggtaacctcctcgcaagagaagaacatgtgatcgttccactgtgacgcctgtagcccaacttcaaacctcaaagaagctagaaaggagcttgtagatgacgctgcaacgaaacaccatccaaaagacaagcacaacccgtaacctagccaaaaacaaaaccaccaaacgcccaagaggacccagcaaagcagaagagcaaaggacataaaggcaattccataaccagagagaaactgacttgcgcaaaacacaaaccaagaaggatctctgagcttagctaattcaattggttaaacgcaacaaaacaaacctaaaactaggaaaattaacacaaacgagccaagacttagcaaaaccaaggacaaactatgagcagagactaaattacccaaccaaaggcaacctaatattagcctaagacagaatcgagactacatagcttccactagatcaggtatgtataagatgaagaaaccaaacctccatctccaaaaacaactgccgtaacagtgaagaaccacacgggctccgacaaaaacaccaaccacccacggagaaccaagcgacaccatcactagaacggaaccaaccttccaatcgaagcacaaccatctagaatctcgtctttaatccgccataggaggagccagagaagacccaaaacaaaggaaaagcaaataaaagacaaacagacacaccctctctgactccggccaagggcaccagataatcagaaaggtaacgtcagaaatttgagaagaaaagtttggtggtggctagacctaaaaaaatcgcctctcaaaggccgtagagccaaacctttttatgttatagaaaacttttttgcgttacattgatattaaaattcttctaaacgaaacaatataaattaatttactcatgatttgttagaaatattttttatttttattttgtgtacatgacgtggataactaattaaggttagaaaacaaaatccaacaatctgataacaattagtcactaaatattcggagtaatgactaatgacctccgctcttatccaaaatactgattagtgtctgttttaaatgatcctaccttataaaaacgacgacacatctctctctcgtcttcttcttcctctaaacctgtgaaaaactttggatcaatcaaca

SEQ ID NO: 2528 - DNA, 1725 bp, Unknown
  misc_feature (1)..( 1725): cDNA_ID_3068401_gDNA_ID_1620552_Annot_ID_160308 3000 nt of promoter + ATG
tgagaaagtactcttgtgtggtaataactgtgatgcgaggacgtccaggaacccgacgaataaggacagatgtattctttgggattaacattgcttcatccagatactctgaaaattcaaaacagagaacatataaaggccacagattgcaatcatattggcacgagacacagtacactaaagcttcctgagaaattcaagaatcatattccaacaaaccatttcctaatagttcacaaaagtaaaaaaaaaataagacaaagctcagctagtaaacaatcataacataaaataaagttcattgtatcacagctgcaagcaaacagtctaataatacgaaaagcgcagcacaacatttgacatagaagacaaaccttcgttagtttgggcattggagacgacaatatcaaggtctttaccagtgcccaaatgcttagtttcgaaaattttgtctttgagaataccgacggatataaaaggaccatccatggcaatggtatcataatcccttgcactcttaaacttgtaataaattgccattgaaaatttgtatctgatataaaaagcaaaaaaatacatatatctattacttatcttataaagatcatgacacaaagctactagattttgaaaaccctaatcaaggcctccggattattaaaaaaaaaaaacgaggccagagatttgatttccaaaacaaaaaggtaaatacaaactaagaaaaccctaaagattcaatttttacttcgctgattcgacttcacagaaggaaactccacgcgtgtagcaaaatcaatccaaatcaacgaatcctggaaaagttcctgcagattcaaggaacgagaacgtccgtgtgatcgccgagctgagaatggcgccggtgatgtctccaaatctccttctccgaggaatcttcgcagctacaaaacgacaacttgtaacaaagaaacggatgatcgggcttcactccataagatccggtagctccaagctccgatttgggggatcaaaatcgagaaacctttcggggggaaattgaaaaggatctagagagtaatcataggaatcgagtagagagcggtgtcttcacgagaaagaagatagatcgatcttgaaatctagggtttggacacaagagctctctttctctcgtatccgtgtttatgtaaatcccgtaagagaattttcctttaaataatgaattaaaatcttatcttatgggcccacttataaagtaagaatatggacagaaccacggttttgtttttatttattttccttcttaaaagttaaaacacattaaattacctaacttttgttaatttgaaaacgtaaaaagttgattttagtatattaataatattttatttgtgtaataaatagttttgacttttaataagctaaaatcatacagtaaaatcaatttttgtgaaaatatgtaaatttggtggtactttatgctatcaattttaacaaaacccatttcttattgggcccattttgattttgatttgtttattaaatgcccattttgatattttcacccgagtgaaaaatccagattttttattgctcaatatttacgggacgacaaaaaaaaaaagattaaaaaaatggaagagtggagcgcgatcctttggggaatcgggacggaccgtgattggtcggtctctctcgttacggtgaggctgaggctgaggcggagattgagagagaccaaccatg

SEQ ID NO: 2529 - DNA, 2707 bp, Unknown
  misc_feature (1)..( 2707): cDNA_ID_1029535_gDNA_ID_1620552_Annot_ID_160338 3000 nt of promoter + ATG
ctgagagcaaacagtccttaatatggtcaaggatggccatcctaacttcaactaccctatcggtcagccttttcagaaactccaaaaaaattgaatcgaactcttcagagatgacacgtccaggcaaggaaaacaactctccaaccaatccaaccactttcaaacgagtttccagtttatccgcctgtatatgttaatagtatgcattatgtattattcaataccaatctacttgaaaagatgggctcataccacatgaaaagtattgaaacaacaaatggataagagtgattattcaaacaaaatacataataataaaagtattgtgcatggcagagtcatgatgacatttgacgtgcaagatagtggcagaagaccaaaaataaaattataccaaaagctctccagtgagatatggtgcaactccagatagggcctgaggagcacagcggtacaaatcatagataacctcatggtagtcaatttgactgctggaaaatcggctatctccagacattgaagagataaggaactgctttatgtcagattcaactttgggcgcacaatgctctatgactttcatagcaagtcttcttgcagcatctctaacgtcctgccatcataaatgcagaatatgagctgtctgatattccataaaacaacgaatcctaaattggattataatcagtggccagagccagcaacgtgagtatgctcacacttctattgcggcccaatttagagagtaaaattagtaaaaggtgctcttgcacatcttcgctttcttctaaaagaacaatcattatattttgcattgatgagaaaacaatctccggatggtcatctctgcacatacagaaataaaacaatctttcagtatgaagcccaaaagaaaagaaaaaaatcacagaaaccattcatattttgtattactagccaagaacaccaacgaaaagcacaactgaaaatcagaaaatttgaagatgttttgtaaatcagcggaacttataatcactcagaaaagaaatctaggttgaaagtgaaacacacctagcaacatcaagaaatgtagtaaacacttctttcaccagatcatcacattcaagatccaacatcactacacatgacctgtactttgcaaccgtttctaaaatgagaaccctccttccaaatgatggaccactgacatcattcaacccagcaaaagcgctcacaattagttgaaaaatatcctgaaacaagataggaaacagaagaaatcagtaatggacatgtctgtgatcacggtgccagaggaaagtcaggacaaacaaccttcataatattatcactgtaaggcgcttcaggtgctgtaatacgagttatctcagaaacgcagcttgcaacaagaagcttgacatccttgtcttgatggttgagaatttcaggtttaataactgcatcaagaaaaggctgaatggacttgagcactgcaggtggtggagactgctccaactcagaaagacaaacagcagcttcctgcatgtagcaacacacaagttaaggaaagtctttttgataaatcagtcacagtattgcacggaaaagtgtttaaggagagagatatcttagtaaactaacccgaccaattcaccccaatgaaaccaatcaaaagcaaatcacatttccacaaaggtggttgataaagaaacatcttagtcaatgtagaaactgaacattggggtaactactgcatcagtcaaattgctggtgaagatagcgcagttcaattccatcatgaccagggacagaaaaatactagggccaaccctaaaaactcgacattctaacagcagacatcataaaagtcgcaaatctaagcaattatagacactgaattggttctcctaggaacagtcccgagttttatgcatgacctaatttcgcaagaacaatctagcgtagacgaaaaagatggtacaaactaaccctaacgcagctcgaaagaagaaaacactggctcaattaatgagcattacccagaacggaagaggatctacaaagctgaaaactttattcggttccaatttggcagaatttaaacaggggacaaagatggaaaaaagttccctccaaacgaaaaatcgaaacttggagaaattgtagaagagacaatgagaagtagagatggggaatcacacctttaagagtttgagcaatgaatctttagaaacaggagctaggtcaagcttcgatcccagctctttcaactgttcctccggcttctgagccatggggagtgaaacagagaactcttaaaccgaagctgttagagacgagccacaataaacgaacaaggaaacaaaaagggtattttcttgaataatctggttctcagagtcactatgcggaagaagaaggagaagaagaagaaagccacatctgatctgagctctctctaacacaacaagagccccgattagctgacttacgacggctttgtgtctctcatcgcttcctcattttctcttattttatattgatggtccctcactttctcttctctttaccctttttccccattcttaaagcccatcgtttaacaggcccctttttaaacatccaggcccattagtgtaagaataccgacgtcgttttgagtggagtttcaattttagttttttgacccttcttctttgctctctcgctttgctttctcgcggcaatg

SEQ ID NO: 2530 - DNA, 3000 bp, Unknown
  misc_feature (1)..( 3000): cDNA_ID_2992170_gDNA_ID_1620552_Annot_ID_160335 3000 nt of promoter + ATG
ggtttttattgatttaggttctcactgtgaaccaagttttggagatactcgtcaagtttctggagactagggactggaaaacagccttcttcactgtgattcctcagaggaaaagaaccggacttgatcctgttgattgttcgaaattggaacatatatctgaagagcatcaggagaaagatactgaggcaaacgagagtgcagacaaacatgatcttctggagaggaaaaaggtatgcgttgaagttcctttggaaagtagtagctaaatgaaatgaatgaagattgtgagagttgtttctgtatccgttaaacactcatttctgtagctgagaattgaaatctggaatgtttagtctctttctattttgaaccaagacgcattacgaattcaccgtgaattttgtaatatcacatgcatgcggtttgcaaaactaatgctttattgacatactttaccacaagacagatcagatgaaaaacacaatgttctttcaactagatagataataaacaaagaaaaagcagcattgttttcgcttaaacttgaattcataagctacagcttgcacctactaacagttatgactctgtcagctgtctatgttattagccattgttctcagtacttatgttgttgagtcggaaatacttcaactctggcgccacttgctcctgaagatgaaccactcatcttagaattaggttcgttaccactgaaaacaaacccgttctgatgacgataatggtactgcgccatgtgaatccctggcacaggcccgtaggctccatactcggtcatggtcccattaggcctcttgaccaccaagccgttggtcatactaacggacccagcactgcagctaacccctctttcaccttccaactctctgtagcggtggaggtacaacgtgaggggttcgatgtagtcatcaaaaccgagcttgctcattgcccacaagacgtcctcagcagtgatggtcttgcgctgttcccgctggcaccgctcattagcctcccctgttatgaagctgatgtactccgaaacacactcttggatcgtctccttggagtcatctgagatcttggcgtgagcaggtaagatcctccgcatgatccgtatcacgttggcaataggcatgaacctgtcttgctccctcaccgtgcactcctcctcaccaccattactggttttgttaggctggttgaattctggaggacgcatactgccctctgccatcagaaaattcgctgctaatcctaacaaaaataagaaaaatggaagttttagtgcataatggcttcgatgacgtctgcatgcgcggtttataagattgaaaagctatttcattaactgttcgtcatgaaaagagtacagacatgacaatggagggattgcagagaatggtttcgcatgcaactgaaatgaagagagcctgtgaaaagagggggtatagagaatggcactacctggtggagaaggagtggtgttgttcacggacagcttgcggtagccatggaagcctccacgttccatatctttcttgttctaaatacacgacttttgtgtttgtgaatatccctataaataataataaccaatgcccgaaattaagaagcatttgaagaagagaatggaatgagagagaagaaagagtaattggaataaagctaatagtgttggcaagtgtcagcatttgtaatttcagacctcacaagttcaacaacgtggcagccataatcgatgtgaccgaggatccttctcctcgtctcccttagccgttacaaaatcccaatcaccccaacgtatttgtcttttttattcgaaccttctacaaatacagagccgtagagttttaaattataaactacaccaaagatataaaaattaaactcgaggtaatcatctacaagttctcccgttttgcgtgccaaaaacacctaaatttaaaatctttcactcatttttccctctctcccgaggaaatggtcttgtaaaaatttccaagtttctcaaagtatgagcgagtcttgctgtgctcaggctgtttctgcccaccttccgtcactctcctatagtacttgttcatgttctcccacttctccttacactttttcgcagatctttcgtaccctctttctttcattcttgctgatatctcatcccaaatcgctcccttgttgatccccgtcttctcttccacatcgcttctcgaacttatcaatgcctgcacttcctcttgcggccaccttctaccactgctgccactgccgcttgagtacctaaactttatctctctttctctctgagcggattcacatttctcgtctttacattgttccggaagaatctgctggagtggttgcgggaattcacactgtttagggatctcgatctcgtcaccagtaacacttctgatgaaagagatgagagacaagttgcgtgccatctcttgcttccgtgcttcttcattctgtgtcatcctctcggtttcctgttgcctccaagcttcctcacggcgtattctctccacttccatcttctccatcacattaatcaactgattatgcatcttctcctgccgcttcatcatactccccacaagcttctccaagaaatgctccagctttacccttgtttcccgctttcttttacccgtgacggtcttgcgaacgtctggagatgagtcactatcgctgctatcaacagaggagctgcaaaatcaaaaattggaaagtacttatcaaaaactcaaagcttccaacatggttacactatctaagaactaataatccaaaagttccgcagaatatatagacaaacactgcttagaagtggtataaaccaacactgtaaaagcttgtaatgacggcacaccaatctgattgatatctgcaaagtttaatgctttaagctgagagtgttcagtgatgcaccagtcaaccaatctagaatcaaatgataccgcaaagctcaaatatatcaagaggaagagaatg

SEQ ID NO: 2531 - DNA, 3000 bp, Unknown
  misc_feature (1)..( 3000): cDNA_ID_2105937_gDNA_ID_1620552_Annot_ID_160331 3000 nt of promoter + ATG
cagccagtttgacctccaccatcttaccattgagttcgtggaatgtcttctgcagtactttgtcaacagcttcctcagagtcatatgaaatgaacccaaagcctctaggccgctgggttctgtggtcatacatcaccacaacatcagtgatcatcccaaactgagcaaaatactttttgaactcagcctctgtcacggatgatgccaaacctcccacaaagatcttcttggagtttgatgggccaggtgatccctgaaggctgctgttacttttattaaatactacgtgatcatctcttggaacagccttctttgcctcaacctgtatatcatggagaaaatcaacacacgacacaactcaaagaaagcagtttttcattcattgtgaaccactttctttcacatgaggatatgaaacgatccaagttttacatttttatttgtgagtgtgaaatgaacaacttctgacaaagatatgcatttatcagagcggcaaagctgattgtaaacaatagagtctactaactaaaacaggaaggaataaaagtgagtagctttgctttgctttgagaagcagcaacctcaaaatgaagcaagtaagcaggaagattgttgaaattggaagcaatgtatgttggtatatagcaggaggaaacttacaattttaccatcaatgatatgtttaagcaagacgactctttcagcaacattaggatcagcaaagacaacgaaaccaaagccacgagcacggccagtggcacgatccttcataataacagcctctaaaacctcaccaaaactgtgaaaatagtcacgaagacgatcttcactggtttcccaagatataccaccgatgaagagcttacatgattccatttccatttctgccaaacaaacaaaaaaaggtttgtttttggttccagattctatatcgatctaagtgagaaggagaatggaatcgatagaaacacctcaagggaagcaaaataggatgaaaaagagcagatgggtcgtgatcggattgtgtaaaaaccgatcgacccacgatcttggattcctgcagaaacaaaaaaaaacacaaatgatcaataaaggtgtaagcttggaggaaggaaggaatgaaaaacccagaagacagagaatctatgtatgtgtgtaataccgaaaataaagaaacggagaaagaggaaaaaaaaaagattttaggattgagaaatcttcagatttggagaaggcaaggttttaataagagggcgagaggccctcctctctcttttctgcttatcgtccaaatttttagtcttttcttttcttttctttttctgcaatccaaatcgaattaaaaggaacaaaaatggatggaagcaaataagcaatgctcagcacaaatttcagaaaatggaaaaaaaaacactcacaaaaaagaatactttctcttacgtttttgtttttatatggcaatgtttggctatccttgtaagagacgagggtattttcgtcacttccgtttcttctctgtaataagtaattaatttattaataaccaatgcgtgcacctttttacccataagttaaagaataaaatctatcgttaataaaaaatggctaattggcttaagttgatcatgatttcttcctagttctagattttagttgatcatcataactttaatttgaagagaggtctatgttttttaaatggttcgttaatcagatgattatgaaagatgcaacatgtgacaattatttgattgcatgaaattttaagattaaaatgaaaatggcatgaaactctaattagagcttttggggaatcaaagtgggcaggaacatggggaatggttgatgacgacgataaagattgccatcccacagttttttttttaattatgtcccttcattttgctttcaaataaactaatcaaatttgttatgaattgaataatcatttttaaaatcattcatcaaccaagtggaagatgtttacaagtacacaaggcattacttgtgcatccaaattattattaccaactttcataagcttacttttcttctttacattaatcactttcttgccgtccaattattttatttgggtttttttacactctttagaaaacaaaaacatcatgttatgtcggttttatcctattagaaaacacatcgacaacatttaaccactaaattacatatatatatatatatataaaattacaactattgatcgtttttgtattattctttacaagtcaaatttccaccgttgaaattttgatttacaacattaatccagagtttaaaaattcggatcatctaattcatacataagtgaattaattaattaaaagcgtgacatcaaacgttagacacatgtggagatgagattgaataatgaatatcatccactaaccattataggttagagtcttgtagcctatgtaccaactatctcttttatactatttaagtttaactctcatcttgcaagaatccaagattaagcagccttactaaatcggggaaataaacttaggtttataatcagtgcaatcacatggccataattataaatgagcaaaacaattgtctgaaaaggccataaaatttgttgggcctacaatttgattaaaaaagacgaagcgccgcatatattttatcttaaagcccaataatgttttcggcccagtaggtgttctctgtactcctattctctgctataacttatcattgtctcccgcttcagaggaatcagacctaagaagaatcctcactcgtaaagtcgcaggtatggcttcgaagagctctcgatctattttgtggttggaaattaatagtccgtgtattaaagtttcaatttttatgtccttgaatttgatttcttccatatcagtgtcgaaacattaggcatcaccagagggaatatttaaggtttttctttaaaagctgaagacttgattagaaattagtccactttgattgaaatgttcatgtttgtttcag

SEQ ID NO: 2532 - DNA, 3000 bp, Unknown
  misc_feature (1)..( 3000): cDNA_ID_3068365_gDNA_ID_1620552_Annot_ID_160330 3000 nt of promoter + ATG
tcgttgagacaacatttcaaccaaaagatttgaacacaaacagctgattcttcaagttccttcatgtgaaaagcattttttttgttatggtcctcgtttgcttagctggcgctccagtcacagaaccgagttagagtctctctacattgtgtttcatgttcccaaagtgtaagaacaaacaactgtaagcatcatgtatataaaggctcccatgtttttggtacaaaagtagtgtgatcacattagaatatatatcatataaaatgtttagcagcaaaaacccaaatgatcatattggctgaagcaaagacacactgacacagagcatgtctctaaacttgcattaactaaacattgaaaacaagagagacagaaaggcagagatacaactcaggactcagacgctttggtaggagtttcagagagtatgtatgttgcaacatcaccacaacaagtaagcttatcagctttctcatcagggatctcaatcgagaactcttcttcaatagccataactagctccgtcttgtccaagctgtccaacgacaaatctttctgaaaatcagccctttcagtaacctgcaagtaaacaagccccgtgttacaaaacaaccattcaccaaaataaaaggttatacacaaagaaaaagcagcagttttgtaatccctaacctcagaggtgttggttttgtcgtatttcttcaccagttcaataaccctgctcaatatttgatcttggcctccatctgcagctgcttctgatgtgaaattaaaaataccaatactcttgaaaccattctcgttctgaagaagcgaagtgggtctgacagagactctcagtctcaagtgttgcaggattgagctcctaatgcaatgcatctgaaacaaacatgaacatttcaatcaaagtggactaatttctaatcaagtcttcagcttttaaagaaaaaccttaaatattccctctggtgatgcctaatgtttcgacactgatatggaagaaatcaaattcaaggacataaaaattgaaactttaatacacggactattaatttccaaccacaaaatagatcgagagctcttcgaagccatacctgcgactttacgagtgaggattcttcttaggtctgattcctctgaagcgggagacaatgataagttatagcagagaataggagtacagagaacacctactgggccgaaaacattattgggctttaagataaaatatatgcggcgcttcgtcttttttaatcaaattgtaggcccaacaaattttatggccttttcagacaattgttttgctcatttataattatggccatgtgattgcactgattataaacctaagtttatttccccgatttagtaaggctgcttaatcttggattcttgcaagatgagagttaaacttaaatagtataaaagagatagttggtacataggctacaagactctaacctataatggttagtggatgatattcattattcaatctcatctccacatgtgtctaacgtttgatgtcacgcttttaattaattaattcacttatgtatgaattagatgatccgaatttttaaactctggattaatgttgtaaatcaaaatttcaacggtggaaatttgacttgtaaagaataatacaaaaacgatcaatagttgtaattttatatatatatatatatatgtaatttagtggttaaatgttgtcgatgtgttttctaataggataaaaccgacataacatgatgtttttgttttctaaagagtgtaaaaaaacccaaataaaataattggacggcaagaaagtgattaatgtaaagaagaaaagtaagcttatgaaagttggtaataataatttggatgcacaagtaatgccttgtgtacttgtaaacatcttccacttggttgatgaatgattttaaaaatgattattcaattcataacaaatttgattagtttatttgaaagcaaaatgaagggacataattaaaaaaaaaactgtgggatggcaatctttatcgtcgtcatcaaccattccccatgttcctgcccactttgattccccaaaagctctaattagagtttcatgccattttcattttaatcttaaaatttcatgcaatcaaataattgtcacatgttgcatctttcataatcatctgattaacgaaccatttaaaaaacatagacctctcttcaaattaaagttatgatgatcaactaaaatctagaactaggaagaaatcatgatcaacttaagccaattagccattttttattaacgatagattttattctttaacttatgggtaaaaaggtgcacgcattggttattaataaattaattacttattacagagaagaaacggaagtgacgaaaataccctcgtctcttacaaggatagccaaacattgccatataaaaacaaaaacgtaagagaaagtattcttttttgtgagtgtttttttttccattttctgaaatttgtgctgagcattgcttatttgcttccatccatttttgttccttttaattcgatttggattgcagaaaaagaaaagaaaagaaaagactaaaaatttggacgataagcagaaaagagagaggagggcctctcgccctcttattaaaaccttgccttctccaaatctgaagatttctcaatcctaaaatcttttttttttcctctttctccgtttctttattttcggtattacacacatacatagattctctgtcttctgggtttttcattccttccttcctccaagcttacacctttattgatcatttgtgtttttttttgtttctgcaggaatccaagatcgtgggtcgatcggtttttacacaatccgatcacgacccatctgctctttttcatcctattttgcttcccttgaggtgtttctatcgattccattctccttctcacttagatcgatatagaatctggaaccaaaaacaaacctttttttgtttgtttggcagaaatg

SEQ ID NO: 2533 - DNA, 3000 bp, Unknown
  misc_feature (1)..( 3000): cDNA_ID_2162979_gDNA_ID_1620552_Annot_ID_160328 3000 nt of promoter + ATG
cattccacgaactcaatggtaagatggtggaggtcaaactggctgttcctaaggatatggctctcaacacaatgcggaaccaaatgaatgtaaatagctttggcactagtagaatcagttcattactgaatgagtacacccagggattcagcccgagtccaatctctggttatggagtgaaacctgaagttaggtacagtccagcagtaggtaataggggaggattctcaccgtttggacatggatacggaatcgagctgaattttgagccaaaccagactcagaactacggttctggttccagtggaggctttggacgaccctttagccctggatatgctgcgagtctcggcaggttcggtagccaaatggagtcgggaggagctagtgttgggaacggttctgtcctaaatgcagcaccaaagaaccatttatggggaaatggtggtctaggttacatgtcaaactctccgatatcaagaagcagcttcagtggaaactctggaatgtcttcactaggcagcattggtgacaactggggaacagttgcacgtgcacgcagtagctaccacggtgagagaggaggtgtaggattagaagcaatgagaggagttcatgttggtggttacagcagcggctcaagcatcttggaggcagactctctgtacagcgactcgatgtggctttcgctgcctgcaaaggcagaggaaggattgggaatgggaccattggacttcatgtctagaggaccagctggatacatcaacaggcaaccaaacggaggtatgaataatgaatgaatgaacgccttttttctatccgagaattcaagcatttgtagaaaatctgatgatatcatatgaaaatggtgttgttgcaggaattgcagcttagagaagtgacaaatctataccatggagatcagatgattgcagaagagagtttttagaagaggaaaaaagtttattaaaaaaaaaaaaattattggtaccaaaaagcttaaagcttttatttactttttactattttgatttgttgttatagctttcttttcacccttttttctaatttggggttttgtttcttttgtttttatcgttaaagaaaaaagatgtaaacttgagtgatataaaaagagacaaagaaacaatgaagtgtattttgttcttgtctttctctctcttttatcatctaaatccatatattgacaaattcaaacatgaaaacgaattaaaaaaagagcaatttgcctagaatgtaggcaacgtagtgtgaggacgacgtgtggcaaacatgtggatgatgataagccacaggacaaagaaagcaatccctcatccatcgcaataatatccattaatgtgaagtggaccaaaagagagagaagcgagtgttacagtcctcaaaatagagacgaaaccatcctaatccttcaaactctctcacagcttcaagactccactggaagcgccactattgtccctacactcctctcctttataaggtctcttctcacgaggctctctctcaaaccattaaaagatgcgtttgctagtagcagaagcagcttcaccattgtcctctgctgcaactccaacatgtaactctcatacttgcagatggaagccttactcaaactctactgacttcacagctaatgcatcagtccttctcatccttgtcatctctgctctcatttgtgctctctctctttacgctgcaattcgttgctttctccgaccaaccctcgagactgaagacgaccacaagcctgaccctgaagcagctgcttcatccactccaacaactcctacacttgtctactcctccgaccttgaactcgcaggagctgaagcagagtgtgccatttgcttgtcggaatttgaacaaggagaaagcattcaagtgctggagaaatgtcagcatggtttccatgttaagtgtatccacaaatggctctctactcgctcctcctgtcccacttgcagaacttctatcttctcacaacactctgaaactccttcaagccacatcaatgcttagcttctttttttaatcttgtttttccaaaagctttagagttgtatcatgttttgcttgagattaccctgtatctgctctgtattattaggtaacgtagaccaaccaaagtatttacttaagtacttgtattgtatcaatctaattctacatcgccacacaatgaaacagtgtttttttttgttttgaaacaagagttcattgtactaggaaagtttctggaccaatcttcagtaagaatcaaataaaactcagagcaacttaaattataatgtgtatggaggagattagatggaagctgaataactaacatatactgcaccaaatcaaaagcagttttcgaattttaaaggctcaaacactcattgggccgatgtatgggccaaatacacaagtaactaacatatacatacttgtgtttgctatggtacccaatgattcatgtcatttgttttcacaaacttttaactctttttttttcctctaagccgattgaaacaaattgggtccattgcataatttacctaaagctaagctgatattgaatattagtttcttccatcaaatgtcaattgtttataattcatcccccgacaaaactaaatgggccgattcttaggcccatattaggtggtcactccggttgtgctaaaaattgttcagagaagtcaaagtctccagattgatgtcaattgtcaacactctacaagatcactcctttccatggagttcaactagaagagcttttcgatcaatttcaccaaatcagaaacaatttcgaatttttaacactccttgggccgattaatgggccaaatgataggtcactccaggcctttcccaaaccctatagtcctcctcggctataaatagcaagtggagtagagcgactttgctcactcagtttccttccaaaagaaagagaaagagcatcgttttgagcaaatgagtaggaacatg

SEQ ID NO: 2534 - DNA, 3000 bp, Unknown
  misc_feature (1)..( 3000): cDNA_ID_3068382_gDNA_ID_1620552_Annot_ID_160317 3000 nt of promoter + ATG
gatctcgcaggttttgagaagtttgacattcccttttcaagaacaatggatgaggcaacaaacaatttgttaaataatttcatctacagtttaaaaggccgaaaatattaccactccagagacatccaatatggttgttgttgacgaaacatgcttatctgaagcaattgaacatgctggatatctcaagctcattgttttctcttgttctttgatatgatagttaacatatctctcaatggtggttgctttgagaaacgcgttaaggtcagtcatcccgagtctctcaatgtaaataggcctaccagttttgtctaccttatgaaacccatgagggtaatgtttcttgacttcaccatattcctcaaacttaaacttctgtcagacatttcgtcgaacaccttgtgagtaagctaataatcttagttaacgaaacataaacaagaaaaagtgatcgcctttttaactcacctgagagatcaaatccactttatagtccactcgccacttcatataattgagaaaagcctctttagatttctccagatcaaaatctctcattttaagaaacctaacattttgagaagaaaaatcaaccagggtgattttggggttataggatgattttgaagattacctgcgaagtgtattatgatccccgtgcttatcaggtaagtggccatggaggagaagcaagttacgaaacgcttcaaccatctcttcattatttgggctctgctcttccttgttcatggtaccatcagagatgtgaatatctctgtctgtttcttgcatcatccgcaacgatagattatgcgactctgtttccagaattcaaaacttgtaaagaagaagaattgatgaaatagatgcattgaagtgctgaggaagaaaagaaaagttcagtgagagaatcgaataattgatttctctcggcgcgggaaaagttaggcgagaaagagaaagagagagaataacggtatttttgtgttgttaattctgctttacggcgtcgtttttgtttgtttagaaaacaaggaaggcccacttacgattttattagataaaatgggcctacttttattacttaataatgagctgagccatctgtgatctatgtattacactggttatacatttctccaaaattagttttttttttctttcttttttgtcaactgctcttgaataaacgagaaaatataaaatttcaaaccaagaaaaagtattcatttacatatcttaattatatacatcaaataagattttaaaatagaattatatacatcaaataagatttaaaataaaatgatatacaattttcaaaaagacatttttaaaaggccaactttcacaaatatcacaaaaataaactttgtaaccaaatttagcacacaatctccaaattttcaaaatagcacaaatttaatattaaaaagactaatataagattttgattgacgtttcatgcgatcatattgtaatcgtgattgcaaattgcaattaactttttattttacataattaggtaaaaatagttattttgtatatttacttatgctaattttagagaatgtgtgctataattatccacaaacttgttttattgctattctagggtatttctcattttaaaaacagacctaggactaggagtaatgtaaaaagtagcttttaacaaataaacaaaaaaaaagaagaagtaaaaacaacactgggtcctttgatatgtgatatgtcacaaaatataataacctaatattcatgtaaatcttcgtttaaaaaaaaaaatattatattaatttgtaatttaccgatatttagacatgcataatatatcctcgtaaattttatcaaaatgtcattcggttcattctaattaatgaatagaaaattatttggttgtagcattttattgctttatggttaactataaattttagatccgtcgaaataaaaggtaataatgaacgggatcggatatcaaaggagtctatggactatggtccccttcggatttaaccaaaaaggtttggaacaatctccaacgttcaaaatatatctagctaggttgataggtttgtggattgatgaatgatgatgagtgcaacttttcaaaggaagtaggaccccaaaaggaggttcacgtgatgcttaagaagcagtgtgtccgcactatcataaatttcacgtccttattttctcacccatctttcttctttccctcttttatatcccattttgctttagatcgttttcaaattcatttttcacctcaacaggaccgttttattgtccatattcccattttacaccgaaactacttttaaatgtcaatagattggtgtgcatgtgtatatgtataaatagaaattaaactaagaaagagagtgtgagagaaagagtgggttcctcatgctacattgtggttaattaagcatgcttcaaataatcttatcatgattatgggcattctccaatagtccaatatacaattcatggaagcagtaaactattaatatatttattatcaaagttatattaaaacaattatcatgggcagctatttatgattaccaataaagctgttacatcattggttgaatctgaaataaacgcaaacctttataaactcaaaacctgaaatagttagccaaacacgtaattccaaatagaaaaaataaacgacctaacacgatataggcaggcaggctaccttttattaaaattataataaggactctcaattccttggtttaaacagtaaaagctaatacatatgaagacaaaaacatttagatcttgttgtgtataattctttgcctgatgtcaacaaaaaaaaaatactttgtctttgtttccttcacttcaccacaaaaaatatgaccgttgagacagaaaggtaaaaaggaccactttagtacaagtacatatataaaacctatagatcctccatcgtaatttacttactccgaccgtttcctttctcacaagccaatg

SEQ ID NO: 2535 - DNA, 3000 bp, Unknown
  misc_feature (1)..( 3000): cDNA_ID_2162951_gDNA_ID_1620552_Annot_ID_160321 3000 nt of promoter + ATG
agagggaagacaagaataagtagagttggcataggaaacttgagaaacagtaaagattgagatctaagagaaacaagagaatctttaagatcacctgtctacttgaggtagcttcctagaaggttcagtggaacaaagttgactaaatatcaaaactttcagctctcaaccaccctaagaaaatctatcacaagcaaagtattcagcacataaacgcattctggatccaaagtaagacagcaatacaagttacctcttctgaaagcttgatctggctctttaacacctcctagagaaacttgttatacaagctcatgaagcctatatacaacaagtaaagctaactttagttataatctcaccctaagaatctaagttaaagtcggtagatactgactattcacaaatcatgaaagccaccaataggaaagcagagaaatattctctctatcataaggagaaacagaattgagacagaaaagacaagcgcgggcccaattcaaccaacaatactcattcacttgatcacacaaagtgcaatcttaaacactgatagaaaattctcagtcttgtccttagggctcacattaaagatgaatcgagttaatgattgctgcaggtttataatatctgcctgaatatgaaaatcttcatatacggcattagaaaatgaaagtaggccacacatttctttctgaaaaagatgatgagacatcaaaacttataaaacaccaattcaaaaaaataatcgaaacttcacctaagaaactaaacccaagtaagaacccattttcgcaaaagagaaggaggagatattgtaagaactctttaaagcaaaaacagagcattgtaatagaaacaatcaaaccaagtaaaaacagaattttacatgagagatcatcacattacattcccgtcagatgtaagatcacacacatacatacacacacaagacagagaaaacgttgatgatcacgaattatgaagacccattagacaaaacaggacaaaaaactcgcatttacagggataatcataaggggaaaattgagaaaaaccttctctttattctcgggaagtgcagaggaaaacaaaattaccttgtggaagcaacaccgattaaagaaattggggaacatgggaatggaatggatccaaagagaagaaaacgaaacaagagatcccaaaaatggaatcggaaaacgaaaggattcaacgccttcttctgggaaatcaaagacacgcagtaactctggcagagagagagagaaagaaagagaccggagtttttccatttcggttcggattggtaataatgggctcagcaaaaataaaacatcttgggcccttatggaccctcttaccctattttaccataggctctacttttttttaccacctttgttttagtttcacttaaaattttagttaaggaaaaaaaagttaccgattatgtacactctactgttatttattagacacaacaaaactttcaaatatgatggattttccatcctattttatttataaaagaaaatatttatatttctaacatcaacaaactctacccaaatcagattatccttctgaaactatgcaatttgtattgtttttcaggaaactagtgattttttgaataattgtaatacttttcattcatcaaaaaaacatattatatctttcctttttttccatcaaaaacatattatatctaaatatctcattttgggttgttttttgataattaacacttaagcccatataaaagagtctagttcaaactgagcccagctacaccaaagaatctagtgggggacatgtggcaggtagtaatttgagcgttgaccaagaaaggacattattatacatccacctggttagagcatgcttataggtgatattctcaaagtatcattaaaaaaattttagtattatttataatgtttgtttaatagataaatattttttttcttacttttaataaatgctaccaatcaggagatgtcacgtagatgatactgatatcaagaaaatcactggaatgatactaatcaaactcattctaattgtttggttaataaaaaaataatttttacactgatgatattctaaaaatatcactcatgtacatggtcttaaccgttgaaatgttggtcgcggcctatatatagaagaacataactctaaaaatagctaaacccaaccacttcccttggattggaatctctcataaacagtttgttggtctggtccgctccagtccatactcataaggtggtagatgtttacttagggtacatcatacatgcacaacgttagtagttgcaggcatagacgtgtttgccctttattacgcgaaaaccactactcccttcgctagtctactttcgtcaattgaaccactaaacccaatgaaacctaatattttagtgtgctcaataatttatcatcatcccaattcccaagcgtaccaagattataatctaacttaacgcgcaatgtcatgacaaaacctatatacaatgaaaaagatttttcatgacaaacaaagaaaaaataaacacgagaaatgagttctcgtaataaagttggtgtgaactggtttttgaacgtgaagatgaccccttcatatttttatttcttggtttttgcttgagagggttaaagactcttaaggaagaaatacattacacgtcaaacctttttgggaaaacaatgaacgcttcatttataatgtttctattttttactcttaggtaaaacattgcaattgatagatgaacaagaacaaaagcagaggattaaaagaaagattaaactatgaaaaaaggacacgtgtgaagagaattagagattctgtattaagacagattaactaacaaaccaaaccctacttgttccactttctattcatacttaatctcattctcctctcttccccttcatacttaaatcttatcattcatccatcttttaatcattactcgagattctgtttcc

SEQ ID NO: 2536 - DNA, 3000 bp, Unknown
  misc_feature (1)..( 3000): cDNA_ID_3068373_gDNA_ID_1620552_Annot_ID_160322 3000 nt of promoter + ATG
cagcttcatacttgctctcgccgtcgaacactacaacatccatcgccggcttgcccttaacgttagtctttcctttatctctttatcttcttcttcttcttcttcttttttctacataatttattcaatatttgattctttccgattgtgtgcgggtccacgggtgaattaattacaaaatatgatcgttaaataggtggattgcttcaattgaatccctacttataaaattaaacattacaatgtgtagtggtccatgttttatacgtggtgatgccagattatatgtttttccttccccatacatttttttccccacacacatttatttcgttttaattcttcttcaataatttgtgtgttcaaagtctaatgataacttgatcatttaaagttaagttattaacatacaaagagtcctttatttcaattttttaaacaaaatctttttcatatgcattttattttattttatttgtatcatagatgagatgtcatttcatgaggccctaggccaatccataattccatttatatgacaacccaaaaaaaaagatgagagacacgtaaacactatgtttctccagcaaaagcaatgatagtgagtatgatttaatttgtgcaagtgcgggctccaataattagctcacaagtcacaactataatcattgtttacttttatcatgtttttaaactataattaatcgtacgagagatatcctatgattaagagaaaactcaccagtcaccacgtatctaattatgataagctaataccataacttaatggataatctaattcttgaagataacgttggtgttctgcgtggagccgctaaacgcgccgctacttctgcttggcatctgcgccacaacagcgttcgtaagcatgtggatgcataacgtagcagctgcagtcatgatgatgcctgtcgctacggggatacttcagagactgccctcgtcatcatcgacgacggaagtggtgcatccggccgtggggaagtttagcagggcggtggtgttaggtgtgatatactctgcggcggttggtgggatgagcacactcactggaacaggagtgaatctgattcttgttggaatgtggaaaagctacttccctgaggctgatccgatcagttttagccaatggttcttctttggcttcccattggctttgtgcatattcgtggtgctttggtgtgttctttgtgttatgtattgtcctaaaggagcaggacaagctctctctccttatctccataaatctcatctcaggagagagcttgatttgttagggccaatgaacttcgctgagaagatggtcttagccgtgtttggtgggttggttgtgttgtggatgacaaggaatataactgatgatatccccggctggggtcggatcttcgccggccgagccggggatggaaccgtgagtgtgatgatggcgacattgttgtttatcatcccaagcaatattaaaaaaggagagaagctaatggactggaacaaatgcaagaaactaccatggaacattgtcttgttattgggagctggattcgctatagccgatggagtacgcaccagtggcttagctgaggtcttatccaaaggacttgtcttccttgaaacggctccttactgggccattgctccaacggtttgcctcatcgctgctaccatcacagagttcacttcaaacaacgcaaccactacattgttggttccgttactcatcgaaatcgcaaagaacatggggatccatcctttgctcttgatggttccaggagccattggggctcagttcgctttcttgcttcccacgggaacaccctctaacgtcgttgggttcacgacagggcatatagagatcaaagacatgatcaagacaggcttgcctctcaagatcgctggaaccatctttctctccatcttgatgcccactcttggtaatttactcaaaaccttcttctttatataataagattcattgtagtttagttttcttatagatattgttacatgatgccaggggcttacgtttttgcatcaatgggaggagtttagttctacaagccaagcacaagaccatgtacacaattgatttattgtactatattgtttactaccgtaatacatatgtagatatatagtcaatggaatgggaaatttagatgaggtcaaaattcacaaaatcggcccatttttgtaacccgcccgattatagtttccggtaccattgctttcttttgtgcttccaacgtaccggtaactttggtccctttttttttttgtttggtgtgtatatgaaaaagggttaatacagatttgtgtgttcttcttcctaacaatagcaactagtggcaaatccagcgcgcggtccaacctggccataccataccacgtcattgtccagcgtgtcttcttctgttttcggttttctacaaacacaaaaagcaaagaaaacaaaacatcaatgcatggtttataacgtcttgctttttaattagtttttgtcctttacactcatttatgttctttctttgtcctttgctatacactacttgtctattgaataatatgcttataatcgtaaaaaactacaagtagtcataatccttttggatatttattttcgtaggtagaagttggccattgcaaattacataaatgatatccaacctctagaggataaacctcattaatttgtctatattatgctgaattccataacatataaagaattatgtgagtgttaattatttaccaataaattagtataaattttgaaatacaaagcaaaaaagtttttcataaaagttcattaaaccttttgcctaaattatggcatgtgttattaagattagaaataaatattctgctagaaatctagaattctgccacacgtcatgccacgtggcggacctttaatgtatttaaaagcccttaaactcaatgccataatcaattttgaggaaacaacagttacaaagcaaaatg

SEQ ID NO: 2537 - DNA, 3000 bp, Unknown
  misc_feature (1)..( 3000): cDNA_ID_2162975_gDNA_ID_1620552_Annot_ID_160327 3000 nt of promoter + ATG
aataatatccattaatgtgaagtggaccaaaagagagagaagcgagtgttacagtcctcaaaatagagacgaaaccatcctaatccttcaaactctctcacagcttcaagactccactggaagcgccactattgtccctacactcctctcctttataaggtctcttctcacgaggctctctctcaaaccattaaaagatgcgtttgctagtagcagaagcagcttcaccattgtcctctgctgcaactccaacatgtaactctcatacttgcagatggaagccttactcaaactctactgacttcacagctaatgcatcagtccttctcatccttgtcatctctgctctcatttgtgctctctctctttacgctgcaattcgttgctttctccgaccaaccctcgagactgaagacgaccacaagcctgaccctgaagcagctgcttcatccactccaacaactcctacacttgtctactcctccgaccttgaactcgcaggagctgaagcagagtgtgccatttgcttgtcggaatttgaacaaggagaaagcattcaagtgctggagaaatgtcagcatggtttccatgttaagtgtatccacaaatggctctctactcgctcctcctgtcccacttgcagaacttctatcttctcacaacactctgaaactccttcaagccacatcaatgcttagcttctttttttaatcttgtttttccaaaagctttagagttgtatcatgttttgcttgagattaccctgtatctgctctgtattattaggtaacgtagaccaaccaaagtatttacttaagtacttgtattgtatcaatctaattctacatcgccacacaatgaaacagtgtttttttttgttttgaaacaagagttcattgtactaggaaagtttctggaccaatcttcagtaagaatcaaataaaactcagagcaacttaaattataatgtgtatggaggagattagatggaagctgaataactaacatatactgcaccaaatcaaaagcagttttcgaattttaaaggctcaaacactcattgggccgatgtatgggccaaatacacaagtaactaacatatacatacttgtgtttgctatggtacccaatgattcatgtcatttgttttcacaaacttttaactctttttttttcctctaagccgattgaaacaaattgggtccattgcataatttacctaaagctaagctgatattgaatattagtttcttccatcaaatgtcaattgtttataattcatcccccgacaaaactaaatgggccgattcttaggcccatattaggtggtcactccggttgtgctaaaaattgttcagagaagtcaaagtctccagattgatgtcaattgtcaacactctacaagatcactcctttccatggagttcaactagaagagcttttcgatcaatttcaccaaatcagaaacaatttcgaatttttaacactccttgggccgattaatgggccaaatgataggtcactccaggcctttcccaaaccctatagtcctcctcggctataaatagcaagtggagtagagcgactttgctcactcagtttccttccaaaagaaagagaaagagcatcgttttgagcaaatgagtaggaacatggaagttaacgcaggcagttccggcgaaattccgtctccaagtaaagttttcatctttcactgtcatttcttataaaaatcaaacctttatagtttacacgtcaaatctctctttctaataacgaatttgtgtttgttttatcttatgtatgtacagtaaggaaccgatttcagaaaagtgggagtcaagcggtgtacgaggtgacagagacgaagaaatcttgcgtgacgagagtcgacatgcctggttgtcccgagtcagatctcacctactgggtcgacgccaacaacgtccacttcttcgccgacgaaccagcaatgcctgagtacgaaaacgccggacgcaaatacggaggctccatgattttcaaccctgaggcttacgacgtcaagaaaactaaagtgaagcttatcaacggagtgctctggatcaccgtccctaagatcccaggcaaaaacgcttccattaatgtcaaggagaggatcctccattactgatttaacaacaccttggtttgtgtctcgtaatggtacttgtgtctagcgtctctatctatctatgaactttgatgcagctactgctttatgtttatcattttgtggtttagttaagaacgatcttgcttctatatgtcgtgatctcaataaagaaaaagttgtcagctttctttgttctatttaatcttacattaacctagctattcgataagactatatagatctttgccattattaaaccggattacgagtatgtaacctggacatgttaatagatatatgttgttgtaagtagggatcaaactttttaatagcgttgtcgtaataattggataaacactaaacgacggttgaaaccttatttgatctttgatgaaaaaaaaaaagataattgagagctcataatttttttactcttgaagattgctgacgtcagcgtcgtcttgtcaaaaatgtttgaaaattaatgaagagtgaagagtgtgggtacggttttacttttgcagtcatttttgtcgtacataattacatataaacgaaaggagtaaaaaaagcgtgggatagctcacagagctggtgacgtcagcttattctctaccgtaaaaaaaatcaaaagagtaaaagcaagttttttttcttaccgagagagagagtcggtgacgtaggcaagaccagtcaaacttatgctatgaaggttaaaaaaaagccagctggagcgtgccacgtcacagtctgtaccacaagatggtgcttcgtctatatttatcaacaggagaacaaaacgccatttttacgcaacctaccttgaactagaagagaagagagagcaaaaaacaaagagagagatg

SEQ ID NO: 2538 - DNA, 3000 bp, Unknown
  misc_feature (1)..( 3000): cDNA_ID_3068369_gDNA_ID_1620552_Annot_ID_160323 3000 nt of promoter + ATG
taaactttgtacaaaggctatactataatgagttttctttaaaggacttcgagttatagaagttgaacaccacaccggggctaagaagttgatctatgtcttcttgtctatacatgagttgaattgctgttcttctttttactccaaatgttacttctcttagtgtccgttggccaagaatcatagactttgtatcaaaggctattatgatgtgtcttgttttgaagaacttagggttatagaggttgaacagcactccaaggctgagaagttgctctatatcttcttgtttatacatgagttgaattgctgctctcttttactttagaatttgttctgtggcatatcatctctctgcttttgtgtcattgtggaacttgttttccatatcatgttaatctcttactgtgttgttgcagacaccgagagtgtatccatatgacaacctgagagttgagcttggaggagagccatagagacccatctaagtgatctgctcatcaaaacaggaagcgtgttttcttcactgctttgttctttaaaatgtttgttgtttcctgcttagaacttgaagacaaaagaataaaaagaagactttgtttttattatatgcgttgtctctgtaattaacagtgaccagtgagagagatccataagagaagacttctggttcaggaaatcttgagttgtgttttgtaacttttagaaaacaatcgtctcgcaattcagttagcgccatgtgtcgaaccaagtttgagcctcgtacgacttcaatcaaacaaaggctacaataaaaagaaaaaagaaaaaaacagaaagacaaattaaacctaatggggcatgtgagtgggacattgagagaaactcgaacttgttcgtatccgtcttggaattgaaactttggttttatatccattacgtattcggtatttctttcctcttctgtatattattcatatcttatacgcatttatttagttctctttgttttctctgatgattatctctatcaaaattcatcacgacaagtagtttagtaagaaattcgtatttgtaaacatagatcttattcttacgggtaaaaattaatatgataaaagattggtgtgacttgtctaaaatttttatactaagaagaatactttaagaagctctaatttgaaatttgataagtgactgtgggatgatgaattggatttgacttgtacaaatacacgtctaatgtagacttgtcacaataaggggcaagtttagagactacatagtctacaatgcagatgattaaaactatagttgataatcatagaatcttaaataaaaatcatagaatctatggactgaaactttccaagtgatggaatcaaagacagccacatgagtcaaggatttctttcaatcttttcaaatattccataagagtaaataataatagtttcatgatcaaaatcatcaatgtgatctgcctatgtgtcatttgtaccggctcttgttcaacctgactgttttggaccccttcaaaacaagattgtgattggtaccacacctctatttttctctcttattatgttatatccagttatatttgagggaatagttcttataagtcttccttctctttgttggcaaactggatatagcaaatctcatcgtacgtatatctttacatgcatgtgtgtatgtgtgcttatcttctttagaccaagtgcatctatatctcttagagagatttgacagacaagttaaaaaatccaaatacatgtcgattcttgaacatttctaagaaaatttgtatctatatgattattacaacaatatgattattattattaaatttggaggaaaaaggacaaaaaaaaaagagaggggagggtaagaaccagggaagttgggctctggaggagtaccaaaggctgcatataataacgtgtctcactcgctctctttactcttgccaactatcaatttggctttcaattctttctcttttgtcctcatttatttccatatttttcaacatttctatatcctcttaattctaaaccataaaaaaggatttatatatcaattcgaaaatgattatgtttttctaaatatttcgtaatatgtagcttatttagcaaaagaatatactttgaaattttagttattctactatccatttgacatattaatcaaagttacaggcttatggattgtggataaaacgaaaccaataaatgttaatggagaagctacgatcaatattatctacaagttataactcttaagtttacatatttttaatgattaattccctataggctatagcacttggattatatgactactgaataatttattagcaaatagattgttatgattacttgtcatcttaatctctagtgtccttttatgggtcatcagattctagagtccagacaaaattacaagccatcacagcgtcgccacttgtaacttgtaatttgcaagaccccatcattttcattttcatggccgattattttccttagataaactgaaaagtcatcaatcacatattcactgaagaatgacctttctttcgtatattaacccattatctaataattcgattttggcttccaaaaaaatacattatttgtctctttaatcaatcttaccccatacattgttaattttatttgcgtgaaccagcaaaaatttgtgattgaaaatacaatttttttttacaggaaaaaaacacaagtttactaaaaaggccttcacatactaaaacatgtcacatgtgtcactcacggtcttacaccgaatattttcgtcatatgaccacaaactttaattattctataaataaccttaatataaacacatttcgtatatttatttttatgttttgcccaaacacattataataaaagaaataaataaatttataaaaaggctcatttctcttcttctttggttcttacatttctctatatcattttttgtccttccattaaaaacggaataaacagaatg

SEQ ID NO: 2539 - DNA, 3000 bp, Unknown
  misc_feature (1)..( 3000): cDNA_ID_2162934_gDNA_ID_1620552_Annot_ID_160316 3000 nt of promoter + ATG
atcatgctatttcccctatccagctaccccacactcagatatatcactggatcgagtagtcctaaggaggctttctaagtataccaaccaatacgcgtcagaaaaccattgcttattgcttaaatgtttgtcttttctgataggatcagactgactcctcaaaagacaaagctcctgatggggtgacacaggtgaaatcaactcggaaggtgccaagttctcggtttagccgctttggtattggcatattgaagaacactgtagggaaggtcttcccatctcgatcatctaatgaggtgcaccttactaaatcttgaggtcgtgaggagtcttgttgaacttatactaattgttttgagtcattctttgggtaaaggcaaaactgggtaatgagaatcaattctactatgacgataacctaaagagatgggtggaaagaggtgtggaacccccagctgaggaagctgcactacctcctcctccaacgtcagtcccattccgaagcaactcattgggtcatgaaaacaagtctgagataaagaacgagatgtctccatctagtgggagctggagtagtggcagcccaactccgtcagagaattctccgggaatcccaccagtctcacagggctcaaaccaattctcagctcgtggacgtatgggtgtgcgtgcaaggtaaacaaaccacttgagacacttgagaattatatataatctgtggaggctatcctggatcctaagttagaatggcaataaggaaggaatataagccaccattgatttacgggtacaaaagagcttttgatgtgagatgggaatagttctcctgatggtagtgtacggttgtgcaactgatagctataatttgtctgatcgtttattaaaaaagctactggatataatattccctcgttagtgttttactgtagataatgtgcatgcttagaactgatcattttactctttttcgggggcaggtacgttgacacctataatcaaggctcctcgagcatgtatcagtcacctcccgtgcaatcttctaaaccaccgattcctgcgaaagcaaaattctttgtcccagcagcaccggcatcgtttgcaaacgaccaggtaatggaatcggttagtgctgaaaccagacaagagaactcaggagatgaagcagtagtaggctctgcaggcgctccaggaccaagccaggcttcattccagtccccgacaccatctccaattgcaatgcagagatttccaagtgtagacaacatcagaagaagtggatcaggaacaagccttaatggtgatcttcctcagtcagtatcaagaagaacagcttcatggagcggaagcgtcaacagctcgtcgtttatgtctccaacgagtgcatcaacattcagaccaagcccactgaacagtagcagtagcagcttaggagaggagcttcaggaagttgaactgtaagttgaaaaatctgtaatatcacaaaagaaaaaaaaagttttgctcactgtcacaacaggttagatcgatcaatcaatcaaatgttaatccatgagttaccccaaaattacatgaagcactttctctgcttctgtcaatgacagggggcaaatatgtattatgccgtttgtattttttttttattttcttactaaatataaattcattaaatttctttgttaacagacttgaggaattacacaataatacacattaatatttcgttcatgagtggtaatgaaatttgttcaccatgtgttggcctctaatttctgcatccctttgattgtgtggtttcccgtattcatagtttagatggagtatgcattttggaaagaagaggatggaaccagaacataattttggttttgcctttaattatgtttagattaaaaataataataatagttattagtataatgatttacttttaataatatagcataataaattttaatttgatacacggctgaaccaaattttgaattatgcatgatttcttttggtaattcggtttggttcaattagattcgaataaatttgcatcacaattttttttataacattagtgaccgaaaatgtggctctttggaccgggaacgcggacttttaagaaaaaaccccgctggtatcggcatgtgccgattcatttgtgtttttgttttatgtgggctggccattaataataattgggccgataattcgtgttttatgattaatcgtccgatctgaagctctaattaattaattaacggatgaagaaccggtttcttaaagcatcttgaagagcgatccaatggctaccgttggattcatcagatctctgtagcttctttagaagaaacaaacagagggagtcttcttcttcctccaacgtaaaaaccagaatttcaatatcttcattccctgattatatcacatctggatcaggcatttcgtcaaacaccttgtgagcatcttttagcgagccgtttcttttgtagaatctcagcaaggaatttggaatcaaagtgtacatgtggcaaacagacctgtgtgtttatgaccgtagctggacatgaagctttcgtcacaaagaaacgtagccattgtcgccggaaacgctcttggtttgtctccttcattgagtagttacgagatatcggaaattttgtaagtttcttagacacagatctttgcatttaaaacagatcggcgccaaccatcctcgatgcgtatagaaatgtcattaagaagagataatatgaatcacattgtatgatacttttgttgagaatgacgttgaaggttgagatggaaaagcttcgaatagacgtttaagttattaggaaagtagcaaatttgggacgaatcctttctaggttttggatcggaatctatggcatcgtgctccacttgatcgctgcgttctatagagcttcttccgatcctctctcacggcgatttttgttggggattagattcgggttaatataattccgattttcatctctttttcgattg

SEQ ID NO: 2540 - DNA, 3000 bp, Unknown
  misc_feature (1)..( 3000): cDNA_ID_3068389_gDNA_ID_1620552_Annot_ID_160314 3000 nt of promoter + ATG
ttttcttacagaagcaaaacctgaggaatataatgatagagtaaaggaaagagagagaaaggaagaaaatggtgattccagatatattttctggatgaaggtaaaggagagagatagagagagtaattcatttgttttattgcaatcttatcctaacgcttacaagggaattcatgccatgcaatttttttgtgtaaatttgtatcgatcggtgctcaatctccttgaggagaggatgaagacggagatgatagaagagatggtgatagtaggaggtttagtaatggttcaatttgtatacgcaggcaattctttgctcatgagttatttgatgtcactcggtcttggccctttcaccattgtcatcttttctacattcgccactttcataatcctctcccctttcgccattctcttcgaaaggtctgtctgataacattttcacatagcctagaaaaccaaacttgtctttttttcttttcacgttgtaaatgttttgttttgtttttgttgttctaaaggaagcaatggccaaatgagcttagcttgaggctgattggtaagctagttttgatctcctttgcagggtaagctatttactctctttttttgtgttaaaattagaaaacttggtttaaattttcacagctttttttggttctgtattcgaaaacaaaaacagggttactctgttccagtctctgtttctagaaggaatcaggttgacatcaccagcaatggcaacagcgatgccaaatcttgctcctggtctcatttttttcatcgcttggatcgttgggtgaatcactaaatccttgttctaactcgtaatttcacgacgtgttccaacattaagtgtggtcttattttatggataggttagagaagatgaatctgaaatgtgtgtacagcaagttgaagatcttagggacattgttgtgcgtatttggcgctttagctatgagcgtaatgcacagcacttcgatcagtcacaaagaagaagatgacactccaatattcgtctttgatcgagacaaggtcgttggatgtatctaccttcttggagccgtctttgttttatccaccaacgtcgttcttcaggtaagtaaacccggttcgtcataaccggtttggttcggtttctaaaatgtcggttattgtaggcgtcaacgttggcagagttcccggcaccgatatcgttaagtgcaataacggcattactaggagtgttgataacaacggtggtactactattacaaaaccgaaaaacaaaagtacttgccagttcattaattagtttcggtaacctcgttggttattctgtcctggtaagttcaagtagatcattcgtagatataaaacataatcaattggtttatggttggttggttataatgtatatagtttttgaaatggtcaggcaggggcagtgagtggagcatgtgttagctttaatggatgggccatgaagaaacgtggaccggttttcgtttcaatgtttagtcctttcgctaccgttatttcggttgctttcgccgttttgacattaggagagtccgttagccttggaaggtgagcattattaacacaactcttttaacaatattttaggttttcattggtaacattacacatttggtcttcaaactaagaaacccatcaaattagtaggaaaacatacaatggtaaaacttactcatacacggttatattaccggagatatgctaattgttaccggattctaatcaaaccgtcaaaactaatattcgattttccgaaggttatatttgattttgtttcttttaatgaattgattaacaaaaaattgcagtgtgggagggatggtgttgatgttcgtagggctataccttgtgttatgggctaaaggcaaagaagggttctctgaaattgagagttttgagagtgagttcgactctaagaagcctcttttgtcttgattgttttctttttgttcatcttcttcttctattaaatttatggaaaagaaaaaatggtcgaatatttagatatagagttttagtctttatttctagtcaacattttagacgaagaaaatggaaatctatatatgttccatttttatattgttttttttcgcagaacattgatagaagatctgatggatgaagttacaaatcatatcgaattacacaagttttgttccataattttaatttatttttttcatgagttagagcaattatcttataagtccaccaaagattacaagttaggttaacatataaatcatgttagaatatcaaacctataagaagttactgagcttagatttgtacaaagcattgtaaataattttaaatgtcgttaaattacttgatgacataatttgtaaaagttagctttgtgactatttttcaacatactagtgttatagataccaattagattagatatatcatcatttatggaacacaatctattattatgtctgatctatttattacagtgataatacataaattaatttgttttttttgttgttgttgtttaatcaagcatacactgtattctttatattttgttcgaaaaacgttatataaaatattgttaatctttttaggacataaaaatgcggtcaataatcgatagttattggctcataatcgtcactatgaaatatttatgaatcttatggaaacatacatataagggtaaatccggaaaaaaataataatcaaagagtctctctctctctctctcattcgatctcgacgatttcaccgactaatcggagtttggatcggagattagatccgggaaatcactgacgaatcctttctggattttggatcggtctatgcttctctactctacttgatcttgatcttctagaaatttaacttcgttttgcaattgatcgtctcgctttaagaagcttgcagatccgttgatctctttctgtgattttgcggggtttagggttagggttttaatttcgatttcggttgtcaattttg

SEQ ID NO: 2541 - DNA, 663 bp, Unknown
  misc_feature (1)..( 663): cDNA_ID_2163072_gDNA_ID_1620553_Annot_ID_160359 3000 nt of promoter + ATG
gatccaagcttgcggaaatcaagtgaagacgtggagtatccgacacgtaccctaagttgctgtctactgggtcggtactccgataaagatccttgttattgggccagtcttatttcggactctttccattcttcttcggataacattggtttaatatattttgttcattggtcatggaggattcaatgcaactaaccaaagtttatcattagctttgtttcaatgaatcaataggagaaaattttctttgatgccctacacataactaaggacgtgataaaaaatggccgacatgatagaagagaagagacagagaaatactcttcattctttaaggtctctcgttcaataatatgactcgtcgtcggtcaatatcttcaagcgtgggaaccgaatattgtcgcacgtgccagaattacatgacaacaatgatacttttttttttttttttttttgttctcactcattttcaagttacagtctttctctgaatttattatcacacaaacaaaatctcttctaatgtcctgaagacgcaaacattctcgattccacgtctttttgcttttccacagaaacccaatttctcggatctgggatcttcgtatgagctggtgttgttgatccatcttttgtgatacgaatcacacaggatcgccaatg

SEQ ID NO: 2542 - DNA, 3000 bp, Unknown
  misc_feature (1)..( 3000): cDNA_ID_2992000_gDNA_ID_1620553_Annot_ID_160369 3000 nt of promoter + ATG
cttgtaagactcatatcttgaaacctcgataagctctaaatgaaaatggagatgtgctgtgaagagaatcagactttgaattgtttcgtgttgatttagttttgtgttgttgttgttgttgaaacttgcaggtccttaagattctaccttgcaggtctttaacttgtaaaagagtagagaagaggtctggtttatctttggaggggtttctgcgtgattattatctgccaggtacaccagttgttataaccaattctatggctcattggccagccaggaccaagtggaatcacttggactacctcaatgctgttgctggtaaccgcaccgttcccgtggaggtgactgccatcatttcttcacttagttcttagttagcttgtgagtgttgattagtagtcattagacgatggttttagctttagttggctcctacgctgctctaagttgccatgtccatatttttttagggttcttcttaagaatgttgaatctcatagagtcgtgtcaactgtatgataaaagggtttagggtctaggtttgaaataagatttgtatctaggttagattatcacataaaatcagaataagaacatgacaatttcacgagcgtaagatttctcatttttgcttcatagagatatgagtcttattaccactatttagtctgagctaataagaagatgggttggatcagaataattttttccgtagctgaaagctggtgaagtttaaaatgctattcaggtggggaaaaactatttgtgttctgattggaagcaagagcttgtgacattttctaagttccttgaacggatgcggaccaataaatcgtctccaatggagcctacttatcttgcccagcatcctttgtttgatcaggtatataagtaccgagatgtttgatgtatatgtttgtctgtactcggtgtgtgtcatactaaacctatggctattggtttaacacgaatgggcagataaatgaactgagagatgatatatgtattcctgattactgttttgtcggtggtggggaactccaatcacttaatgcatggtttggcccggctgggacagttactccgttacaccatgatccacatcataatatacttgctcaggtaactacggtgaaagatcttttccttacgtgagctgagcatggctcttgtctgtgctcgctgtctttaatgctatccaatatatatatatgtatgttctgtaagtgtttaacaacctttttcttctttgatgttcttgcataataaagcctgatcttctcgctggattgaagtttgatgactctttgactaaccaaagaaatcgtttggcctgcaattcatatgtttctagtttacggaaacttctttacttagatgctttctccttctactgaagttttgatatcatctgttcttcaggttgttggcaagaagtatataaggctttacccatccttcctgcaagacgaactttacccttactctgagacaatgctctgcaactctagtcaggtaagctttttcattccgaagtcaaatctcattttttggattaaacatacaaccgaaagctgactcgattcttctgttccaaaactgggtggtttcaaactatggttgaaggttgatctagacaatatcgacgaaaccgagttcccaaaggccatggagttggagtttatggattgtattctagaagaaggtgaaatgttgtacatccctcccaaatggtggcactatgtcaggtccttaacaatgagtctctcggttagcttctggtggagcaatgaagcagaatcttctagctcgtagcgaatggatttatttttaatctctgtttcaggttctaagttcacgttgtgtctttatgtaagaagaaactatgtagagaagaaaacaactgctccgagcatgaagatgtttgtttggtttacgtctatgttgtaaaagacaattgagagctcttggtacagacattttttaggtattggtaatgtttgtctttgtttcaagtaagaaatggtttaatcaaaatctaatcttcaattagtatcttccttttagttggcttatgtcattgtaattgcacttatcttgttgatatcattcattttatatataacttgcgacctaaccaatgctttggagttcgtgggtgattaatatactcatgccaaaaccaataattaatttcttgacacgtaatacccgcagcaactgagctgtcgcatgacaagccaaaaaaccatcaagtttaaagaaacaaaatccaccaagatgagatttttaactcgcaaagatttttgttctttgggatgtaacattaaatagtagacgacagattttatgcgaaatacaaaaactttgagaaaatagttttaaaaaagacatattgtacccctccaggtaaaaaagatctagtccaacacctataaactttgaaaactctactagcattaaactttggacattactatgtctcgcataatcgcctttaggaatgctaaggacaaaaacatgttttacagttattgtctgtgagcagtagtttcatgtggctgccgtttattacgaaaccgtcggtgctgaattagagacacggacggtgaaaaatcataaacggtaaatgcttttacaaccatttatctatatgctttgaagcccaatcttagcccaagccatgatactagaagccgaatcaaaagctaatatagggcttgattggttctccctctgccacccgcaaacgcagcgtttgcgggtggtagcggttattagcggttggcaccaatcatagaaaccgctagataccgctttggaccgcttgaaatcaccagatttcaaaagctccttcccgcaagcgtttgcggttgcgggcggtagcggttaggttaaaaaaaaattaattaattaattaaaataattatgtcttccacccaaaccttatacttattcttatcagaaaaccctaatcaatgaaaccctattctctcaatt

SEQ ID NO: 2543 - DNA, 3000 bp, Unknown
  misc_feature (1)..( 3000): cDNA_ID_3068429_gDNA_ID_1620553_Annot_ID_160375 3000 nt of promoter + ATG
cagcatttcttgggaaccacggtattggtattgggtccagctcgactgttggatcgaccgaggagtttccaaccgttaaaacagattacgatatgccttccagtgatggaaccggagggtatagtggttggaccagtgagtctgttcaggggtcaaaccctggtggtgttttcactatgtggaatgagtaaacaaggatctctttcttgcggcacaaggaatgggtctgaatagtaactattttaatctctactctcaatttttatttctttcttgtcttggaagtaataggatcaatttagagggggccttttggtagaagaatttaggtgacgcaaggagttctttctatatttacggcgaaggtattctcagactggttaaatggttcttgagggttagggttttatgggtactcaattaagtttgtgtacccaaattttgtttacagctaacccttttgactaatttccaaatttgtaattcgtttataaagatgttttctctagctcttattttattatctatatatataatataccaatggtagccgacaaaaagtcaaggattagtaaaatagtttgttaaatttgcttagaaagcatcaaccaaatcaacatatatatcatataatctaagagtaatttgtgaataaagtcagtgtcgaactttacttgtataaatccaaaagaacaaccgttctcttgatattttaatactactacttaagtaagcttactatttagaggaaggcgtcaattgattaggcaaagaagagaaattgaaaatgcaaacaaaaacagcaaaagccgctcaatatatacttaagaactacaatagaaaatgtcctaaaagttagtgggaatcctctaactctctaatcaagagcttccaattaatggattaattacattataaaacatagttatgtcaaggattttaacattatcattgaacaaagaacacaactactaaaaatggtgtcccaaggtatttccttaactctagtttttctcttggtaacactaatcacacttggtgaagccaataacaaccgtaagctcctctacacttacaataactaccaaccacaacattctcctcttccatctccggtatattcttctccggctgatcttcctcctcctcctactccggtctattctcctcctccagctgatcttcctcctcctcctactccgtactattctccaccggctgatcttcctcctcctactccgatctatcctcctccggttgcttttcctcctcctcaagcttatcaagcctactattacaggaaatctccaccaccaccaccttctaaatatggaaaagtgtatccacctcctccagccaaaccatggtggtggttgttgtgaagcgtcaaagacattagtccattaattatgtgatgtctttgatgtctcttaatttccccgaggtttcttttatatatttcagttacgattttttttttttttccttctcttttttctcttttgtaatgtgagtgaagtttgaaaatctttgatcactaacggtttgcttaattttgtgttgtattgtattgattctttgtcatattttcaaatcttctcgactgaacataattatatgttgaatattaagttttgattcaaattttatttacccttttataaatttaattaatgttaaaaatgaatttctccgcaacatgcatggcgagaaacctactatagttaaaagaataaattttttaaacgaaaaaaaacttttaatcccgtaaaacaattcaaaactgcaagcattttactttgagacaaaaaaaaagaacgaaaccgagattgaacggatttggatagtaaaattacaaaaatatttctaggcttacacacacgtcatagtcgactcatagcaccatatattaagaaatggtccaaacttttcaagtttgacacccataaattgtcatctaatatcctcttgttaaagatttaactaaagactcttatctcgaaaatgttgtggtgttagagtccatactctgttactacagagaaaattctttaaattatgctaatggtaactgatgttcttgagtcttcatatgaaccatacatgtcacttgactcacttctaaacctttacatatccaaaaatatatataacagtgtatatattataaaagagtgatttcaatatgagactttctatagaatatttttattatttggttgttctaacttctaaccaaaacagttaagatatgatccaaccaaaagatttaagaggagatcttgagacggtacagattttctttggttggtacaacaataaaagtcatgaacttcacatttggtcaaataaataaactctcaagaattaagtttgacaaaataatcttaacgacccaaacataataacaaaaacaaaacatcaatcaaaactcagagaatgttttttttttgtcaaaaagtataaaagtgagaaagagacatgtcaacaataataaaaaagcacttgaatgtaataataacaacaaacatgtcaacaacaacaacagtctgaaacctcaagcaaaattgctttggtgcctcttatctgtcaattgaatcttcttccattctttttatttcttaattcatttaaataattttccctctctgaccaaagcaaagaatataatttccttcactttctctgtacctttctttgcttcatcttcaaatcttccctccccatcttgttcaaaagaagaaaaagaaattacgaaactttcttcttcaagatatttcaaaatcaaactttggtttaagggtcccattttttttgtttttgtttttcttgcctgattctttaattcttgattctcattaatgcttcatgggttttatatgaatcccctgaaagcttataggctccgttgaacagttataacttgtgaaagttgaatccttttaaaccgacagaggaagatctcagatggcaaacaagataagtgaaactgcttccaag

SEQ ID NO: 2544 - DNA, 3000 bp, Unknown
  misc_feature (1)..( 3000): cDNA_ID_2163126_gDNA_ID_1620553_Annot_ID_160378 3000 nt of promoter + ATG
aatttttgcattgaataagctagtggcagccattgtaaataagttacaactccatgatttatttcacaaaatggctgcaaaaatgtatatgtagatatactttggtcttcaagatatgattttctatactaatgatgatttagattctatcgtcgtgagaactaataaacatatgaatatgatagataaacgagtaaattatttttcttttatcattttacgacataagataaagtaagtatccaaaggatttttccatgatcaatatgtgaaaatggtgaaaaaaaacaaaataatatgtgaaaacatcttgcactgtaaatcattcaaataattactttagaaatctaaaaaaaggttttaaatataaaaataacatcatggcgaatcccaaagcaaatagattggaagaacagatatactaaacacatacagacatccacataaatacaaacacacatccaaagactttacattaaagaataaataataacatttttaaaaggaaattaacacaaaggtgcatatatagataaaaatgtttgagaagagagaacaaagtatacacaaaagacacgctagagagattaaagaacgcacttaagaacttacaaaaaagcttcaaatacaaaaatccatccacacaaacacacactcgtgcttgcttgggaacatctcctgttttatttatactaatataatctaatacgaactaattaatagcaaatcaacatgttctctaaattatttgactttctggcccaatctttccgagttcacacattgcgaccaatgcactttctgatcaaaacccactaattttgacccccttgatcttacaatgtcgcattttactacgacaacatttgaaattcttaaccttggtttgtatgaaatataccaaaatgtcataagaaatttttgtttttctcaattctaactcttataaaaacatagttacttggtcataaaactattttttttttaataactaaatattcgtaaccacaatccaaaattatagaaaccatgcaccgccagtatttacgaaataattaacaaacataaactgatcataaggatttgtccatcccaaccgtcgtcaccattcaaacttttagtactaaatataacccgtagatagacttaactttataaaaaaaaattagctttaaaaaaatgtataattatatactactgtaattttttcttataacattggccattcacatgtgcaaatggtatacccggaaagtactctatagaccccaacaatgatgaggccatcttatcaatcaagtggttgtagacttagtttgggttttcttcctactcaaaagtataacatctacaaagataggagaagtagcaaaaggatatttaatttaattagtgaacaataaagggtcttttccattcttttgaatcactcatataatttgtttatacccaaaaaataagccaagtaccaggccatctttcaggtgtatattttacatccaagaaatacattgttttaaaaaagaaaaaaaaaacgagcaatcttatttttggataattggaagaaaaaaaagaaagtgatgatgatattccatcttttaaactagactatttttttttaacatcaaacaaatagactatttttatttataaaacttatactgtttttaaaaaaaaattatttaaatttacgataaatttattaatttctcagtcactttatcatggtaagcacctattaaaggcaagaataagaatttgcacatagctagggatgcatgaagtaaacaagtaacattacatgaacataaaaattaaacatccaagatggcaacatcataatatttattttcgtcaattattactatttcttgtaaaaatccattagttaactatacgttagttcaattaattaaataaagatttggggttcccaagtaatatgtttctgaagccgagccgacatagagatgaggccaccaacgcaagtgctgtcctggatcacgaccatctctttttccaacgcgatcaatctccccacaaaaccaaaatgtttatcatcttgattctatgcttcatcactctatctctctctacatacattttgtaattcaccgttagacattaaaggagacaaacttttatccttgattgccgatcttgtccatttatttgatcctttccatactatgttttgtctaatggactctcatttgcccagagatttaaagctgttattggtatcaaaaatcatactaatcaaaccaacaacacatattaactatacaacatttaacctaatcagtaatatattaaaatcgatcgatgatcttaatcaatagattcaaaagactatgagatgtagatgtataacacagtttacatataatgattaaatatatttagatgaataatttatccctcattttttggactacccataggttttttgccattggctacttcttaatttgggccatggaccaaaacatgtcaataggtttatttccaatagcaaaacctcctggtacaccaatttacacacgtccggtagaacatcttacatatctactacacttagtgacaataaagatttacacacgtcctagtaatactcatgctagtttataacgttatatggttgtttcataaagatttagtaattagtaattgactttaatttagtaaatacatgcgtgcacttcgagtcccaagatagcaagtttctttttcccttcttcaaactttctcattgtttcttttctacctactatcttctccgtacccttttctatcaattaacatatgctattttccactgttttgtcacatcgcaccttatatatactcacatgtcctaatacactcatacactcatacacacacccacatatacatgcatatctagctttcactggtttcttaacacaactccatcatctagagatatcttgccttcttcttctttttttctcactatcttctctcctaaagttaatg

SEQ ID NO: 2545 - DNA, 3000 bp, Unknown
  misc_feature (1)..( 3000): cDNA_ID_2163112_gDNA_ID_1620553_Annot_ID_160373 3000 nt of promoter + ATG
tcccaaaatctttgatataggaaaaaaaagtaaccaattttggcagcaagatgtgacatcaaaggtaacagattattctggattttatttatttatccttcttaaaaaagtagttcagaaaatgtcatttgattattcttctgggtttagattctacttatacgtagcagactgaaactctgagtggtacagtctggaagaaagccataaaaggaagctttcttctgaactttctattttttcttttctcacttgtagaaatactgcagataaatttttagttatattgtattaaatgataaaagtgagaaggatataataaaatctgaaaagtggaatgagaactttcctttagcagacctacacctgcttgatattgtagtatttattttttaatgtgtatttgaattgataaatccatttgttgttttagtatcatactatatcatctgacatgtgttaacataaaaaatatatttgtgtgagtatatgtaatatgtttaaatataaacagaagtaacaacatattatcattcaaacatgttttttttttaactaaatcatctcttttaaaaaatgtttcagtttcacttattcgaattttttgctaaattatttttgaaagtaagtatcacgtatagtagagtacaatgaagttgacgaagatctggaccttttgggtatattgatatgttattacaaatgcctgtatgatgagtatacttttatctttttgggaaatttccggaatgagtattctatgatcacattctgaaacataatctagttttttttggcaacctaatgaagtactatagtggatactaaaacgtatttgtgccatactaaaatttcatatgtgaaatcaagtttggtacacatgtacatatatatcgacatatagatttaaaatacgtacattgtaataagaattattaaatgaatatgatgttaatggatgacacaaggcatgcgattaaaaaagagggctggctcctagcacaatacaatgcaaaggacataagcaataataacttttaaacttaaacatgctctttaatttaattaattcgtaaaaactctctcttttgacgggtacgaagaccgagtaagcggtcaacagatttttactcggggagacaaaaacaaattcccctaccaaatttacgatttttttgttcctgtttgaactttttttaatcttcccttctccatgagaaaactttaaactaacaattaaaagaagagtacttttctcttgtcaatcttgtatgcaatttgttttgaacgaagtgttacttttactatatatctttctttccatatgtgatcttaatatttaatgcccccttattgaattggctcttataatattgcatgaacgtacacatgcagaagtgagagaattcggggatctacaataaagtatcgcttttttagagtaacccatttgctgtgttttgtaaagttatacctttaatgcatagactagggaatgtaatgtatacgtaggcgtatgctttaaacatgcatatactggatcaagtatgcaagtatacatggtaaagcagagcagatgtagagagagggagagagggactttacgtagaatggtcaaatggtaattaaggcgaagaggtgatttgcagagtgtgggaatgctgggctttgtggagtcatgaatcgcattaaacgaggacgtgagttcccataatcctagtggggtttagagagagaagcttgagtgagagagaaagatagagagttaaaatctgcttttacaaaaagtttataagtcatttcattgtgagtgataattaatttgcctaaaggttggattttttcggttggaatcttaggtttggcttactatacgaaggtgacaccgcccattttattttattgttttagattttatagaaatgcatatgttttttttttgttttttttcttaaaaatctttcgtattctgcaaaattagttgtcactagctcacaatatattacccatacacaattgtttttagctggctattaaatgatgttttcagataaaaaaaatatatacaaatttgtatcatttgtgtaatttctaatgttgtgcgtttaaccaatacgtaatagaaaaggaaacggaggagcatatatagttaacgttatactatagtaaaagatattttatggcacaaaatattttaaattttgaagtttaattaatcgtatgaaatatataatttcacaaatgtctactagtctacgtagtaaaagttttaatagagtttattaaatctatgcttattacttactgctgaaaaattagacataattaattatggttatttagataagttttacagaatggaggaattattcatgagctagaacccgttgcatataattacgtcaatcgtgtgcacctttctttatagcagataactttttgtgtggatgattttctatactattaatgttatcgccgtatattcactgaggtttaaatccgacaaaatacgttggtatagtgtaagaaaacaaattggatgctggttttagttgaactcctataataattataaacaataataatgtatagtgcatacataattatttatacaacaaataatattctaaaggggtctctcaccataaaacttctctggtcttcctcaagattcatctctcacaaatatcttctcctttgttaaaaccctaaagctagagtttatagcttttgagagaacgagaacgagaaagagaaagagaaagagaaagagagatagatatataaatctgaagaatacatctacctatataaatacatattctccaatctttgaaagcagtcttgatcattaaattatctttccccaatccttgatagttgaatcttcctttcttctctgattggcttagagcttggtatattgatcataccaaagtggtagtgatttattgattaacccaaacacaaaataaacagatttgactcaaaaagaagaaa

SEQ ID NO: 2546 - DNA, 3000 bp, Unknown
  misc_feature (1)..( 3000): cDNA_ID_1377706_gDNA_ID_1620553_Annot_ID_160368 3000 nt of promoter + ATG
ggtacaacgggatatgagctgtgcacaagaacgaagaaaaggcataacaacaaattcatcagttgtattgcttcacgaaataaactgaaaccatgcaataaatatacaataaacagataaccccactaactcgtatcaaatagacaagagcatataatagacatccccaatggtacatactatataacattaagcttagcctgatgaaaagaaaaagaacattacccttgagaaataacattctcgtgtcagaatgagatgctacgcactgcagagtaaaacaacaagacagaaaatcattagaaatctgatggattcagcaaaatatatgaacatgaaataaaacatcctaaataagaagacgaaatctccatgtgaacctgaagaagagcgagcgagttgcaaacacggttggactgagcaggagtcagatttggaggtgcaagaacagagtagattgatacaatctcctgcaagcacaaatagacgaaacagtcaaatcaaaaccacgctactaacaccgaataaatagcatttagatataaaagaatcatttgcattcaacgctcatcaatttaacaagaaaggaaaagcatttaagtaactggagataaccgaaacagatgcatttaagtcattacctgtaacaaggcagcaatggtaccaaaagagttccacaacaaaggcgccagatcctgaaacaattctcttttctacaaaagaaaccactaattcagatactgaaccaagttcccaaattcacatactcaacacaatttgagaaaagttctcaactttagcaaatttcaagagtaaccctagcgctcgttgacgaatcagacaaaaaaaacgactgcccagatggaagaaatgaagaagaaaacatgagagattataagaaaaccttggaaagctcgagaagagcattttctctgagttcaggattgctgagatcgagtaccaactgttcagcagaggccaaattgcgatctttgttggccggagctccggtaggattttgtgcggaggtgctaggaccaccgaaaggtgtgcccatggagagagaagaaggtagattcgccattctccagagttggttttctcgtttgtttgttaatgggacttttcaaggattcggtttctcccttcttctctcttctttatagatggcgattacgcccctttcttccttatttatttattttcatgtcaaaacaaaaaaaaatgtttagtttcaaaatagttttaatcatcactatttacgacttaaaccgttttttatttgttattcataaattataatatgtagtgatgcatatggtaaacaaataaacaaaaagtagtgttaattggtttgtgtacaaaattaagttataagttaaacaacatgaatgtgaacggaaatcaatttatcaaagcaatggcacataagcaagaaatagttctctaataatatcattaagttttttaatcattgatgtaaaatatcacatatgagtccaacataagaaaatatttttaaaaaaaattgttgactgaacgaatttagacggaccaaaacgtaagaactcgaacactaaatgagatttaaattttcaagataggcgtaaatgtaaccgatgcttctgaaacaaataataaaagagttagaaagctttataagaaaagtacaagcggaaaatctgcggttttccaagtgtgacgatatctttaaaaaaaattctattaattttcaacttttttttattcagaatatatattaaaaaactaataaaataatgttttgagtcaaatgtcactatgtttgtagtttaatttctgcatattacgtaaattttaaccttaaatctacatataaatttttgcagccattttgtgaaataaatcatatagttgagacttatttacaatggctgccactgaattttaatgtttgtttttgataattagaaagagagtcggctatggcctatgggccaaactggccaagcatgggattgtagtggttatggctcatagtgggaaggtgtttgagtaaccatgtttacatatttttttaacttgtaaacatactattactgaaccatatattattttgggcttgtggtcttcattttgttagggccatttctgcttataaacaatttactgagtataatttcaatattatttcgcggtcaaaaaaaaaaattcaatattatttctgtgtcaagtttacattttatgaattgatttccaataaagcatagcataagcaaaacaaaatacttgggacttgaatgtttcattgcattttaatttttggaatatcagtgtcataaagcatagtgtgtttgcagtaagcccactggaaaaaaaatcatatgtaaagagtgcttttactaggcccagcgggaaaaaaatattttgacccaaaagttaacaaaaattaggactgtttttatgtgagatttcatttgttaattgagcatccattttgtaagtgctcaattaacaaatgatattttgacccaagttaacaaattaaaatgtgtatgtcacaccaatcaacaacataatactataattcttatctaccaaactaaaaccacaaacatagattttagcataaaatacacaatacaaaataaaactaaacgtaggcatattataaaaccgattcagagcataaatttaggtttattctatgttgaaaatagtattttgattttttttattctatgggtttatgaaaagatttatccaaaatagaaagaaataaacaagaggagtggttgaataaattgtactattttggagggttcgttttcaaaattagaaagaatacagttatagatacgaaaaatatctgatcctaatcatcacttcaaaatatctttctttccctttccactttttcgcttacactttccccaactcatcatcactctaaaatatctcccaccacataccacttaacccgacccgacccgaccggaaaacccgacccgatccatccca

SEQ ID NO: 2547 - DNA, 3000 bp, Unknown
  misc_feature (1)..( 3000): cDNA_ID_3068442_gDNA_ID_1620553_Annot_ID_160365 3000 nt of promoter + ATG
aggtggctgcaacagttggtgcacaatgttggagttggtcgcgtcccaacacatcaaggtggaggatttgagcacatgctttgagctgaatccatctcaaacccatccatggagtgtgtttcttctgtttttgtttctaattatacatgtgctttttaatgccttaacttagatgatgggttataggctttttagtctgtttgaaattcttattgtaattatttttaagctctagaaccaatcccccagaatgcataagtcttgggataataaaagattggttacaaaagaaatattatagagtttgtattatcatgttgaacggtaacaatttttattccagcaaaagctttagcggtatgttggagtctaatcgtacttaataaaggttcaaagctagaatttgttgacagggactacggctccatttttcgcaccagactcgagcattgcttcaagaactgcaacgtcacgagcaccttccacatatgatagacgaggctcttgctcctgaaacggatccataataggagagtttaggtaatagaatactcatgttatgagttcctgcattccaaggctaagattctaggattacctttgaagtttctgaaatatcattgaagaacgcttttaactcttcagtcactccgctgaatgggtaaaagatggtccttgatgtccctccttccccgtaaatcgtggcctgaaaatttcataagatcacagccatttgagttgagtagtttcaagcaaaatctggatcattcagatggtcacatgttaaagtatacaaaccatgtaaccatgtcggccaccttccactccacgctctagttgaacagtgccctttagtcctacgattctccatagtatctaacaaatagaagttatgtaagaaaaactatggttattaggctaaaccggtgtggaaagaagaaaatctaagtcttactacatgcctttggagaccttgaagacacaaccataacaaaaaccccagagcatccgttctcgagctgactatagagcaaacatcctggattagtatgttcatgtgaaattagtgtgctaagaaacaagattgatgtatttacacttacaagtttgatgttatattgtctggtccaggtaaagtcttatccacatgggtagtggtggctgagactgatgttacctcacatccaacaagctgttcatgaaaaaccaatatatcatacttgggatccacagcaagataagcttatcagctaatgaagttacacggtaccattcttaatcctgcaatgtaatgtacacccatatccaagatgaaaccaccctgcatatgaagaactttctgtaaaatattaacagataacacagtttcttcaagatatatatgggtgattgatatatatgtcagtgtaattcttatgttacagtctaagtaagcagcgtgttaggaagatgcaatgcaacagagtctgacaaaataagaatgtgacggaatagaaagtattacatacactcaaatttcgcctccaggagcttgagaaataaggattagaactgttcattgatccctcaataataagctggacgttcatcatatctccaatttctgctatcagtttcttcaactgccgaaagcaaccatgaaatacttcaatttttcaaggacaatattacttgctcaaataggtagtgccaagaagacaataagtaacagttacctcaacaaaagctggctcaaaacgataattttcagccacagcccaaattggacggcatggggaatcagcagaaatatttctatagcttgacattgcagtttctatctcactgattgctgcaacaaaaaaacttgtaaaacaataggaataaagcatttcatctgcactttagagtggcataaccaggaagactatagtttcacgttaaatgggtcatgctcaacaggaaaaattgactctgggctagagtagtggaacttaaacaacatgccaagttggtttaaacaagagcagtgatcaacttacaagcagcagctggcttctctgcagaccgatccaggacagcaatatacatatcaagaaaaaagaaatatctttagctttttaagttgggacacatttccaagaagcaataacattgctaaagaagacgatcataaaagcagagcagaaatgaagtggacaagtcaccttgaaggacgtgctttcctgccttgagcatcttcagtgacaattcaacctaaagcacaagactttgagtaagaaatatcctatgcactgtcccaactagattcatacgcatctctcaagtctaagatcaaacataccatggtttctgcagctacaactacagcaacaccaactattgaactgtcttgaatgatctcattgagaccctcatctccccatttgcacttcacttcaggaaaatgctttcttgctatctccacagctccttttgcagattccttcaaccataacaaaaatcacaattcgccaaagttttcatctttttagacatttggcataaacatctcccaaaaatcaagcgcattgatcgaaatgtcacctcagtacggctccaaatcgctttcaggtcgacgagatcggagatctcagctaatctcggaatgtattgagttttgacgaagatcccagctccgagtatggcaattccaggtgaagaaggattcaccatttttttcctttctcgtgtaatggttttctctattggatccaaacagaatcaagttaacttacaactgttgctgcttatagtcacaccacacaactcatgaaacactaagtccaatcgcaaacgctataatttagtaaaatgaccgatataaccccagcaaccaatctctttgatcgagtttccttaacttccctccataaaaccctagatcctgctttgaattttgattggaaacttgtagtgttgtactctgagacatttggtttgatctgactcaaattttcacaatttgttgttgtttcaatg

SEQ ID NO: 2548 - DNA, 3000 bp, Unknown
  misc_feature (1)..( 3000): cDNA_ID_2163093_gDNA_ID_1620553_Annot_ID_160366 3000 nt of promoter + ATG
atacttatgactgaatttgactaaagagatagcacaggcttagtaaatataaaaggcatggatgattttctcagaataataaccagcaaaatgaagcagaaaattgccattcagaatcagcaaacatttttagtgaatataataatccgtctaatccatcaggacatgtgatacagaatttcttaattggatatcagatcatttccattggccaagtaaaagtactgccaaatgtgatgtgagggggaatattaaacaacttcaaacttatgtaacaaatgagattgatgtcatattaccaattaatcgtgctgcaagggttttgttaatattcacaaattcattttgaagaaactgcagaagggtctttttggaagtgtctgtaataaggcgcttgataagcagcaagtcaactgacgatggatggtgctttgtctcgataggaatagggggcatcacatccgttcttcgagtaaacttaatagtgacatttttcctacatgaaaagaagatttaaaaacccgataatgctgcacataaagagctatgtgacagagcagcaaaaaaacagaaagatagtgatcttactctggtgtctctgatataaatctaaacagaaactgcgcataaggagtaatgacagccatttggcgcatatagtgcaagatctttgactggatacaacaaaaaaataaaatgtgttaaacaagtttgcgtgcatatatgtctaatgaacacttaagaaataatatacagcagaaggacgagctagaccacgtactctgtatgttgtccagtttccttcgataaccacctgtatttcagccccatgccatttctctttgttgcccttcttttcgtgcagatgaatatgaggaatgttcctgaaaattttaaccatttgaagacaattatacggcgtggaaaatccgaaggattcatagctattatgtcaaatgcccaaacataaaaaattagattgatatccgctttcgagaagctgctcatgtattcagatgggtacctgtgaatatcaatatccagtctgcagaaagtaacatagttttggctcttcatagatgacgagatctctatggggagacctgtactcattttggaccagattaaggcctgcacgccaggaaaatttagagaaactagaagggttaaacaagttctctggaaaaaatatcgatatgaagggaaacatagatatgttatgaatatgaatacaaaaacaaaagaccagctgcaaatcaaagccaatgattaaatcctcctaaagcaacatatacaacatatattccttttgtaaacctaggaacgagccatctaaaggctgcaaatttgaaactgataaaccacttcagcatttcatgcagttttacaggctaatctcagatatcaaacttgataagaatagattattaccatctttgcacccagaccaaactttccacgtgtttgcttcagtccatacttcgtcccggataaaactgtaagaagaacaatttgtaaacttagcctcaatataaaggtttattataaggttgatatgccaggctaaatcaatagaggaagtgagggtggtcattagctattttacctctcccaaacatatttggaatgtcatcatgtggcatccccttaccattatcctacattatgatcaactcaattcataactcaaaaaatgtttaagaaaacaattaggatctccatatatttatacatatacttaaaattgcatatataaatttctgttgaatcaaacaaatattattcaaactctcaccttacatgtcactttgtaatatgaggcttccccacgggcctttaaaaccttcgatactccaggctctttgtttttctttcccgatgccaaatttttagcttgtatctcactggctcgagcttcctttgctaaccttttctacataacaggaaacaacaacaaatattagaatcacaaggattacagaacagtgaaacttcttgaacactaaaaagtagcttcttaaaagcacaaggatttgatcagaacgaagaagagagtaataaacacagaattcacgcaccccacgggccttttctgtctcataatcatcatacagctgtgtgtcaacacgttcccgatcgataagaccaatcatggagttgaacttagattttacaatctcttcgcttcaaaaatataaacaagacagtcagtgaactaaacccctacacagtttctcctaccagaactaacatctcgaatcagcacgaagtaaggaacgtacatagttacttcaacctcagggagctctgaaatagactctgcagaatcaagagcattttcaacaagctctctaactgtagtataaagcgacttccctggctgatgagatccacaattcaaaattcgtgtgatacagaattgaaattacaaagatgcatcgtttgaattgaaaccaacaaattggggactcacattatcaaatccagcaatgttcttgttctccgcgaaaaactcagctggagattctgcaaattcacgaattcaaaaaagagagtcaattgagcttaatctcaattgaaatcaattgtgcagcaaatgatacatagagcattactttgcttgagcttgctctcgttgctgtccttagagttcttcgagcttcccttcttcgtttcaactaaatcatcacccgccattgaaacaacaacaaattgtgaaaatttgagtcagatcaaaccaaatgtctcagagtacaacactacaagtttccaatcaaaattcaaagcaggatctagggttttatggagggaagttaaggaaactcgatcaaagagattggttgctggggttatatcggtcattttactaaattatagcgtttgcgattggacttagtgtttcatgagttgtgtggtgtgactataagcagcaacagttgtaagttaacttgattctgtttggatccaatagagaaaaccattacacgagaaaggaaaaaa

SEQ ID NO: 2549 - DNA, 3000 bp, Unknown
  misc_feature (1)..( 3000): cDNA_ID_3068438_gDNA_ID_1620553_Annot_ID_160367 3000 nt of promoter + ATG
acctagatacaaatcttatttcaaacctagaccctaaacccttttatcatacagttgacacgactctatgagattcaacattcttaagaagaaccctaaaaaaatatggacatggcaacttagagcagcgtaggagccaactaaagctaaaaccatcgtctaatgactactaatcaacactcacaagctaactaagaactaagtgaagaaatgatggcagtcacctccacgggaacggtgcggttaccagcaacagcattgaggtagtccaagtgattccacttggtcctggctggccaatgagccatagaattggttataacaactggtgtacctggcagataataatcacgcagaaacccctccaaagataaaccagacctcttctctactcttttacaagttaaagacctgcaaggtagaatcttaaggacctgcaagtttcaacaacaacaacaacacaaaactaaatcaacacgaaacaattcaaagtctgattctcttcacagcacatctccattttcatttagagcttatcgaggtttcaagatatgagtcttacaagtaattgtagattagccaaaacatgtctcacctcattgacgtcgacgggaacttccgggaccaatctctcacctttgaaatctccagaagcttcttcaagactcttcgtcatcttacgagcttcagaggagaccaacaaaacagaatcatgaagatccttgcggagaagcatacctcccatgataagacccatatcaagcgcaccaagcgcctcaccaaactcgccggcggcgaaatggattttagctacgtggagacaagccattgagtaagcgtcgcgccaaacggggagaaccgagtgccacggaccagagtgaagttgctcccaagccatatcacgcgccgcctccgccgcgctttggtcaccggccaccgctaacaccgccatgcgagcataagcgtaacccccttcagcagaaatcgattgcagcagagtttgcgattcggcgtcaagcgtcggagttgggagacggaggttgttgtggtctccggaggaagcggtggtagctcctgacattgggatggatcgggtcgggttttccggtcgggtcgggtcgggttaagtggtatgtggtgggagatattttagagtgatgatgagttggggaaagtgtaagcgaaaaagtggaaagggaaagaaagatattttgaagtgatgattaggatcagatatttttcgtatctataactgtattctttctaattttgaaaacgaaccctccaaaatagtacaatttattcaaccactcctcttgtttatttctttctattttggataaatcttttcataaacccatagaataaaaaaaatcaaaatactattttcaacatagaataaacctaaatttatgctctgaatcggttttataatatgcctacgtttagttttattttgtattgtgtattttatgctaaaatctatgtttgtggttttagtttggtagataagaattatagtattatgttgttgattggtgtgacatacacattttaatttgttaacttgggtcaaaatatcatttgttaattgagcacttacaaaatggatgctcaattaacaaatgaaatctcacataaaaacagtcctaatttttgttaacttttgggtcaaaatatttttttcccgctgggcctagtaaaagcactctttacatatgattttttttccagtgggcttactgcaaacacactatgctttatgacactgatattccaaaaattaaaatgcaatgaaacattcaagtcccaagtattttgttttgcttatgctatgctttattggaaatcaattcataaaatgtaaacttgacacagaaataatattgaatttttttttttgaccgcgaaataatattgaaattatactcagtaaattgtttataagcagaaatggccctaacaaaatgaagaccacaagcccaaaataatatatggttcagtaatagtatgtttacaagttaaaaaaatatgtaaacatggttactcaaacaccttcccactatgagccataaccactacaatcccatgcttggccagtttggcccataggccatagccgactctctttctaattatcaaaaacaaacattaaaattcagtggcagccattgtaaataagtctcaactatatgatttatttcacaaaatggctgcaaaaatttatatgtagatttaaggttaaaatttacgtaatatgcagaaattaaactacaaacatagtgacatttgactcaaaacattattttattagttttttaatatatattctgaataaaaaaaagttgaaaattaatagaattttttttaaagatatcgtcacacttggaaaaccgcagattttccgcttgtacttttcttataaagctttctaactcttttattatttgtttcagaagcatcggttacatttacgcctatcttgaaaatttaaatctcatttagtgttcgagttcttacgttttggtccgtctaaattcgttcagtcaacaattttttttaaaaatattttcttatgttggactcatatgtgatattttacatcaatgattaaaaaacttaatgatattattagagaactatttcttgcttatgtgccattgctttgataaattgatttccgttcacattcatgttgtttaacttataacttaattttgtacacaaaccaattaacactactttttgtttatttgtttaccatatgcatcactacatattataatttatgaataacaaataaaaaacggtttaagtcgtaaatagtgatgattaaaactattttgaaactaaacatttttttttgttttgacatgaaaataaataaataaggaagaaaggggcgtaatcgccatctataaagaagagagaagaagggagaaaccgaatccttgaaaagtcccattaacaaacaaacgagaaaaccaactctggagaatg

SEQ ID NO: 2550 - DNA, 3000 bp, Unknown
  misc_feature (1)..( 3000): cDNA_ID_3068446_gDNA_ID_1620553_Annot_ID_160361 3000 nt of promoter + ATG
aagaagagatggtggtatcaatagatctctctaggattgattcatcagatgaagatttttcatatttattcatgctcatatcaataaattatagtgaaaaaataataataataaggaataaataaatgaaataagacctgatcagtggtggtggtgggagggcttaaggtcagatgtgtctcaacagtcgaatttggcaaacccaacttcagtgttaagtccagttccggctccatttttcactatagaaaagttcaagaaaatcaattaaaacaacttgatataaaagtttagacagtagttttatgaatacaatttacaaaaacatttttcgagaatcacatatagaaaaacaaggttcctataaacaacaaacaaaaaatatgagtagggcatgactatttgagtttctaaaaaaaaaaaacacttacagagattaagcaaatcgatcaacaaaagttttagtttttattttttcagatctgaagcagctaatcgatccactaatcttgtggagatcgtgtgttgctttggtgcatatatatacaaatagacaaatacatatgcgtttacatatatatgtaagcacgtatttagagagcaacaataaggcatgagaaatgtgattatcgtcaaatcatgattgctacatgacaaatcgatcttaattttgaaaaagagacatttaaatattcaaaaaacggtaaaaatttctttaagaccaaccatggaaataacatgagaagactgagagggagattagaacttacaacaagagaatctttttccttcaatattttttttaaacacttttcttttgtagggaatttgataatatgaaatggatagattttactgcttaatttttaatcattttttatcagaaactttttcgttttaaatctacggctagaattttcggtcggttttatactttatatagatgctagatttttttcttctagtcatcgtttattagtacaattttgtttttatatattgattacttgaatttataataggattggtacaaaggtggtaattataaagtgcatttttttggatattgttcaattcaaatatttttacttagattctcaaactattgaaaaatatccaaaatatccggaaaatttcaatttaatcgaataaaaaaattagaatggaaagaataaaaaattatcgggtacaattagaagagtaatgtgtttagtttggtttttactcggataccagttcagttttcacgtattattcgatcctataggagcaattgtgaattagttgtgagattttgggagcattcgcttccagaacttagtgctaggagaaatgctattttcctataagagttgtacgaggaagcgagcaagtacacaacaaccacaaaagctttcaatacttgtttactcctagggtttaaaactagaggttctatagatctctaaatttttttgaacaaatgtgttttccacacgtgatattctacaataccactcgaaaattatccataattgctttaaactatttttttgtttaaattatataatttgtaccgttgtaaactgattatttcaaattataattaaagcactataatttcatatattacattcaacatatattaaaataaactataaccatgtatttttttgtcttcctttcctataaacattgattggactctatcgtaaattttgtcgttatcgcaaattttgtcgttatcgatgagtttctcaaagtttggaccttgattatcttgtttggagatgttcaaatcgttatatccaaatagtgaacttctaattttcttttttgataatgtgacttatttggaaaagtattccaaagtattcaaataaaccctttaaaaatccattaaatacattttaaataagtaaaatgctctcaacgaagagatatcatggtaaataacaacagtgagaggataaaatgttaaatcaatttatttacaacttcaaataggcggacatcaaacctacttagcacactttctattttcaaattggttatggtttgtctattagttgttgcatctatgttttttaattcttatatcggtgatcttgattttgttttggtgtatctaaaatctattttagttaaagtgcaagaaaataaaataaaaacttaaggtaagagatgaaagtaagctttaaataaaacagagcacttctatggtcgattatagagccaagttcgttcctccattttggcttaatgcaatattacaagtaaatcttataaaactttccataagtatcgtattacccatggatactatgatatataaactctcggaggtgtagtccagaagaaatgatccatatttgcatacagtaaacttgatggaaaaaatatgtggtactgttggaattgtagctattgagtatcaaatttgagaaaaaggtaaaaaaatatgtaaaatttgggtggaagaaaagaattacataaaattgagaaatgtatgtaattgacaaaataatgttttcaaaacataaaaacgtgataccatttaaatccaaaccttatatcatttaaccatttttagtaaaactaatagtaatgaatggtcaataatataagattacatattaaataattactactttcagaaaatttcaatcaaatctataatattcctttgaaaaaaaagaaagacaaataggtaaacttcgatcgtatcaatcaaagaatatatttatttttcatcgtaacgtttaattctaagtcctattaaaaaacgttaaatttgatttttcttaccatttttttctaaaaggtgagttgtgtgttgtgtcaggtccaaaataaaagtttgtcgtgaggtcaaaatctacggttacagtaattttaataacctgtgaatctgtgtctaatcgaaaattacaaaacaccagttgttgttgcatgagagacttgtgagcttagattagtgtgcgagagtcagacagagagagagatttcgaatatcgaatg

SEQ ID NO: 2551 - DNA, 3000 bp, Unknown
  misc_feature (1)..( 3000): cDNA_ID_3068480_gDNA_ID_1620554_Annot_ID_160396 3000 nt of promoter + ATG
aaaaagtaatattacgttatatgaataatagtttgggtggtaatatatagagatattcttccttgggttttctgaactattaaaaatgtaaatgattaactaaaaaaactttaaaacaagattattataaatttagttttttaaattaacatggttaaaaaataacaaaaaattatatgtagcttcatttgtaataggattagcggatattgatatttttaaaaactaatatctaaaattattgatagttaggaattggtcttacaaagtttgaacgtaatctaaaattatctaaaagctattaacattactaaaattatccataagttcgtataccatgtttttaaaaatgatccgtaaaccatgttcgttcacgtagtgattcatatatctgaattacctttttacgtcctaaatgccaaaaatatgtggatattaaattgaaatgagtaatgaaataatgtaacgacaagttaaatgattctcccatctagaaaagttaattaaggggaacaatacaaagcctctttgacatcgagaagttagcgcgcgattaacaacatatgattaaatagttcaaaatacaactcccaaatgtgagatggacgctatatacgaaaattacggacgtgcatgagtgggaggtttaatcagaaagtttgttgcatgagagctccaccaatttgtttttttgtcggacaatatcatcaatctgaaatcgggaaatatgtgtttatctatgcggggaatatacatttcattctttgaaagtatgtttctaactcttttggattgaaatgtatattgggaatacttattcaatcaaatgtgacaaatactcctggctactacgaatattggttactatatctttatatatagcttttttttttttttttgaataccagaaggttctgggccgaagcccgtaatccctccaaacccgaaatcacaacatgtaatattaattttgtcccaaacatcatatatatagctattaactaatctatatatacatttttgcagccattttgtgaaataaatcctggagttggaacttatttacaatggctgccactgacttttaattattggttttttcagcaataaattgattaacaaacgaaaaacattccaaatatattccaatcccatatatcacgcagatttttccaaaatttgaactcgatttcggcaactatttaaaacaaaaaatgtttgacaacccaaaagacaattgcaatcccttaaaatgagcaaaacgcaactaaatatatttcttatcaattcactaaatcttatttctccaaaatttgaactagatttcgacaactatttaaaacaaaattttgtttgacaaactaaaacacaattgcaatcccgtaaaatatttattttaattataaatttaaattagcggggtaccgcagtttttttaacaggacgggtttggtggaacgggtttggaaggacgttacttaataacaattgtaaactataaaataaaaatattttatagatagatataatttgcaaaattttatatatactaatttagaaaaataaattgtcttcgcggtgtaccgcgggttaaaatctaatattagtttacttttgtttctaccataacatctacacgatttattaagatttgtcatctcttataagtcgagtttaagaaaattattcacacgattcaagttctcgatttgactacgataaaaaaaatgacacatctattgattttgtaatgttttcttcagtttatcatgctttggtttcactaatgtgaattactctattttccagttctatatataattaattaatgaagttttcaataacgttgcatcatcatattgtttttagaatcttggtacattagtaacatatattattctttattttttcatttataatattgtaactcagtaagatttacgtttacatgcaatcaaaatagaacacacatagctacttatgtttgacttcacattacttaccaaaatagtataccgatagataattgtcatttattcatttatattaacaaagaaatctatgaagaaaaacctaattaaagcttgttgctgatgtagcaacagacgccacttaagacagttactaatgtccaaacttgtatatgtgtgtttgcttcgtccttcactctataaattcacttcatttcttctctactttcactcatcaagtaatatttttatttcacttacttttaatttagagttcataataagttgtgacaaacaaaaatcgtaaaggagtttggcttttggttgagtttttgtttttaacaactacttattattatatatctctttggcctaaacatgtgtactggaaaatcatcatacacaaaatcctctcccaaggttattcaataattggttactttttctttatctacttcaataagtggttactttcgttgttacttttgtgcacgtatatttgtatacacacatttcacgtaaatattttcacacgtttatgtataattgggcacgtttgtaataatatatacatgaaactaaaacaaattaaagaggcttacatattgacaaagtgttttgtttcgtgtcttcaaagtttgggaaaacaagtcctacttcttctgtactctccctgggttccaatggtaaaggaatggtgaggatacgattccatttttaatttcttttcttacattatttttctcctattgaggcatttttcacattaatccaacgatcacattttcatcaaaaacttttttttttactgtagtctaagtttggctatataacgtcatttgccaaaattttatcctaatgtccatcacattaaaaaaaaactcaaactatgtaacgtcatttgccaattccagcattatatagttaccatttgatatatatcctaatgtcccaacaatttctacagttttcacaatgccagaagtgtaagtatgtgtttttataaaaacattgttgtgtaattcaagaa

SEQ ID NO: 2552 - DNA, 3000 bp, Unknown
  misc_feature (1)..( 3000): cDNA_ID_3068470_gDNA_ID_1620554_Annot_ID_160403 3000 nt of promoter + ATG
acgaagaatggatatctgacaaaacccgattctgttatgacggcctgaaaagacaaaggctgagcgaccctatgatccgagattccgatggacgattcaaggcagtgagctggcgtgatgccttggctgttgtgggtgatatcattcatcaggtgaagccagatgagattgttggagtagcaggtcagctatctgatgcggaatccatgatggtactgaaggacttcgttaacagaatgggctcagacaatgtatggtgtgaaggaacagctgctggtgttgatgctgatcttagatacagttatctgatgaacactagcatcagtggacttgaaaacgccgatctcttccttctcatcggtacccaggtgagatttccaccctgtcttttttgtatggtttctggtaccggattagacagaccgctctgtatttggaacaatgacataagaaaaaccaaattgtgtagtttgatactttgatttagtggtgtggcttaaggttctgtgcataatttggaatacagaggcaaatagaaaggagaaacaagcaaaattaagtttctaaaaaacagatcagatgttaacatttcgcttgtattgaatattcctgatccagaccaatctagatcaagcaaaacttgctcttccagatatcaaagttgtgaaggttttttagcagtacattcaccagtttttgtctatttttaccagcctagggtggaagctgcaatggtgaatgctaggatctgcaagacagtccgtgcatcaaatgccaaggttggatatgttggtccacctgcagagttcaattacgactgcaaacacctcgggactgggcctgatactctcaaggaaattgctgagggacggcatccattctgtacggctctcaagaacgccaaaaaccctgcaatcattgttggtgctgggctcttcaacagaactgataaaaatgctatcctctcttctgtggagtccattgcacaagccaacaatgttgtccgaccagactggaacggtctcaactttctccttcagtatgctgcccaagcggctgctcttgatcttggtctcattcaacagtccgccaaagccctcgagtctgcaaaattcgtctacttgatgggagcagacgatgtaaatgttgacaagattcctaaagacgcctttgtggtttaccaaggacaccatggagacaaagcggtttaccgtgcaaacgtaattctccctgcatcggccttcactgagaaagaaggaacctatgaaaatactgaaggatttacccaacagactgttccagctgttccaacagttggtgatgcaagagatgactggaagattgtgagagccttatccgaggtctcgggtgtgaagcttccatacaactcaatcgaaggtgttagatcaagaataaagagcgttgcaccaaatctagtccacacagatgagcgagagccagctgcttttgggccttcattgaagcctgagtgcaaggaggcaatgagcacaacaccgttccaaaccgtggttgagaacttttacatgacaaactcgatcacaagagcatcaaagatcatggcgcagtgcagtgccgtgctcttgaaaaagtgagagctttaacttgggttttcacattttctctcttttcgcaaaaataaagatactgattcttcgtttgctgtcctctttatagaccttttgtttaagcctgagtatcactgtatctcgggtttagcttgcggtgaaatctataagcaatttgcaataagcacattgttagattcaaaactttgcagtgttaattggatgctttgtggcatcttgtattgttcttattaggactcccttttacatttgcatatatgaatttggaggcatggcgatatatacaatctctacttttatcgtttgttcttaaccattgtgattgttacaaataatgcaaatcttgaaaggattagatggtttccaatgtgagatgatcacttgtgaactaaactgtttttgacaagttatgttacctaaaatcatttcagtttcaactttgtgattggtcataaagaaaatttcagatagattatgaaagacaatcacaagtaacatataaatttattttagaaaaacttacctaaaccaatcaatttttttttatagctgggataattaatccatccaactttttttatctttctcaaacaaccaactttttattatcaaattgctttcttactgattaggtcttatatctaaaagtataatataagcaaaaaaattatttaatttaattaattttaaataacctgtttttttttttttttgaacttcaacacattgtttattggttaaaatccatgctaaatggataagatttttttgatacatgtccaaatcttgttgaccaataacacatgtaaaaaacattttgttagttttttttgggtaagaataattagtatatgtaaatattcttttaattagtttttattttctgtaaaagaaaacaaaaaaataaaacagttgttgatatctaatcgagaaagttacccgtgtcgcaatcatgtgagttactaattttgaaaaccaaagtttatataataaaataattataccaagttaagttcataagttagtaatctagatttacacatttttatacagatacacaatacatgtaataacaataatcatgtaccataacacttaataaaaaaatgagttaattatatagttcaaattttatgaaaaagaaatcatgtgtatctagaaaatattaatgttatttatatttctctttatctcatttattttgatattattatataaatctctctttactctttgattgccactccaaccttatttcttagagaatatgaaattaagttttccaggaaagttgttcttcttgttaggttatatcctatgtttcagcgatatatcgagtttcaataatcattttgtggatgcagaaacattgcaaaatttcacctcatttgaa

SEQ ID NO: 2553 - DNA, 3000 bp, Unknown
  misc_feature (1)..( 3000): cDNA_ID_2163029_gDNA_ID_1620554_Annot_ID_160399 3000 nt of promoter + ATG
caggcttaggagatttctcaacctcaacaagacacatcctgcaatttccagcaatagataaacgagaatgataacaaaacctcgggatatcaactccagcgacctcacaagcctgaagaacagtgaatcctttagggactttgaccgcgtaaccatcgacaaagacctcgatcgcatcttcaggattcgagaagtggacgcgtgctccacctacagggtttctaggagggagaatctgtgtcggcggctcaggctcagagacagcagcggattcaggagattggagctctggttttgagacgattgtgcggaggaagaaattggaggtttgagattgaagaagacgtgaagctggtcgaattgttcgagaagctaagatgcctaaacccatggcgttgtggatctgtatcgtcttcttcttcttcttcgtcttctatgtgtgtatttctcgatcttgttgtgagaactcctgaagcatttgtgcgagagagaaggagacacgaatgagtgagttttgggctttatgggcttttattttggatattataattggcttatgaatgagtgagttttgggctttgtgggctttttcttttcaaactgaattaagttaattttgggagatatagtttaagagttttgatgatctttctctaattcacttaatgacattgagtttaaaacaatcttgcttctagttccatacaacatattagaacctctagcaaaataaacctctaatcaatcattagtcctagagacttttaggtcaatgtactaattgaacatttgtatatttcagataaagacaacttaaaatatggttataaatgatgacaattttaaacatctcaacgtcgtctatttaaataaaaggaaagaaaatattgtcaacacctatgctgcatcggttaaggtttacgtgtaagagttagtttattttcctcgtttgtttaggtttacgtgtaagcatcattatcagtgatattgttattaatctaacctttgcaatgacaaccaaaaaaaaaaaaaaatgaagtttcataagctttgatatatattatcttatcattacaggcagacatgataagtataatttaactcgtttaatttgatagttttagttataaatttacatagtaattcgttataattttaattatgggtttgaatggttacggcggttcgggcggacaaaaccatcaacggatcagactgttttttatttaccattaatcaattatagtgcacagtggtccggacaaaaaaaaaagaagaaaaccgcaacagatcatctgtgaatcatccacgaactatttttacatataaataaacttggtccacagcggtttattgtccgcctcaaaataaggtagattaaaccgcatacaaagtataccgctttgtccactgcatccattcaaaacttataaagttataagttatagctaataaatatgacactttttcaaattgttatagatcactttaagagtgattacattcctctcttgtttttttttgtcaaacagagtgattacattcctttctttttttttgtcaaacagggtgattacattccttctttttttttttttgtcaaaacagagtgattacattccaaggcaaagaaacataagggagaaccactaactacaataaaaattgttgggttaatggcaaaagaaaaaaaagaattagtggttcttctatgaaaaagaattgcatccaatggaaagaggatgtgaccgagttgataagatatgaaacacaacatatatagctttttgttatcaaactatttatcgtctcgtatttgttctaatctaaaccgaaatactaatattttaaggaaatactttgcgaaaaataaataaaaattctcacctttattcaatcaaagccaaaaatgaaaaaaaaaaatagaagcaagacaatcatattcatacaactcgataaggtagtacctctaaagtgcaaaacgaaaacaagaaatatctctgctatctcattctcgtcaactaggaaactctgcataatctctcttttacacaatgcaaagaataaggtgaagatgaactgattatctctagcgtactatgaaagtcaatatttagatgcaaattaggtgatttttattgtcgatattcttctttttctggacacgtcctcatattcgtgtatatttaatttcttctcttggttttatacaaagccgaccatttggaaaatttaaaactaaaaatctcaaaacctgatgtaaattttgattttactttaaacagaaatcctacgttaaacatataggaaatgctgttacacacccattaatgtctataactagtacatcaatttacaacagatttattgtcttaaaaaaaaataactcccccacttaccccgtgaatgttcaagtacactagtccagattaacttaaattcgattatgctagaaatgattcacaaaaaccggtttagggaatcatcatccagatttggagcatcgtaatcttttggtaaatttttattagccgttcgtacaattcaattccaaattttaatttagatgagattttttatattaaaaaaacaatgatatatgttcgacaatcgacatgttctgatgtcctatataaattcggtccttctagacaaaaccttacgttatacacttcaactaataaagagtccaaaccaaacaaaaaaaaaacagtagtttctcgacagaaacaaaatcaatatagctttaacatcacgagaaagaagaactaaagaagaccaaacaaaaaataatttggaaaaaaacagagaagcagctctcgtgatcttcccgccttttctcttcaacttgtaaaacattacaagatctatcttctaccaaaaagacgaagtttcgagtgtcagattcaagagttgaatcgggtattaaactctgtttttctagatctttgtgtcgaagagatcgccggagatttcatttaaccgattcttgaaaacatg

SEQ ID NO: 2554 - DNA, 3000 bp, Unknown
  misc_feature (1)..( 3000): cDNA_ID_3439420_gDNA_ID_1620555_Annot_ID_160417 3000 nt of promoter + ATG
gtttaccgatcattaaaggaatataaagcgattatacaaggaggatccaggaacaatcaaagatctgaattaggtatgtgatatagattgactagtttttttactcctattttctatctgagtgtacaatttgtaaaattgaaagtgaaatggatatgtttctaagtttcttatttctcttcttctgttgcttttttctgctctgaagcagagacaccaactaatggcgagaatctaaaatctccacttatctatttaatggattgcacgttgaatgattgcagcttgatcctaaaatcaataaatcaggtacctttgatgatagcttgtctggttcgttttatttattttagtatttgcatatcacagttttgctattgagtagttagagcttatgattgtacacaccgtattctcatttctgaatccagtattcacttgctctatgaatctgtaacattgcagagggaagtgtatccttctctgatattatttccagccgagagaaacaaagtcactccatatgaaggggagtcatctgtaactgacataacagagtttctagctcgccatgcgaataactctcgcgagtttttcagtaagtctttcagttgtttacacatttatgctgaatattatctctaaagtgtctgaccttccagaaaaatactgttttctgcagaatcttaatatgttttacaacttgtgactcaattttttcgtagtaactcgtttttttcctgcctaagctggttactgaggaatgcttttggatttttattattctgttttgatctggagcataataaacaaagttatgaatctttctctggcaggactccttcctactctgtctagaaatggaagaagaaactcaaacaaggtggatcagtcttcttcatctgcggtaaataataaagtgacagatggtgataaacttgttgaggtcgttttaaggaacagagagcccgctgaaagagaggtaaaccacgaccaggtcaattcccaatcgcctccaatacactcgctcacaaacgctccccaagtgaaaactggcacagtcctggtcgctacagaaaagctagctgcctccctaacatttgccaaatcaaagattctgatcataaaagcaggccccgagatcggtttcctgggcctaatctttaacaaacggataaggtggaaatcattccctgacctcggtgaaacagccgagctcttgaaagagactcctctatcgttcggaggtcctgtagtggatccaggaataccactattagctctgacccgagagcgagactcttccacaaaccatgatcacccggaaatctcaccaggcgtgtatttcctagatcatcaatctgtggcccgtcgaatccaagagttgaaatctagagagctaaatccaagtgagtactggtttttcttgggatactcaagctggagttatgagcagttgtttgatgagatcggtcttggagtgtgggatgttgataacagtgacattgactttgcttggccttagaagctcttgcgttgcatctcttgcaatgtttttcttttacgttttgttttagaaagaagaagaaaaagagtagaagatagtaaaacccatcatgtgggtagaagaaatgtttaaactgtaagaataacacttgaaaatgtcttctaaacaaatacaacacagaattagatatcttcttttgagatcattcctcttgcagattacttcaataggaaaacattttaataagcaaaagcaaaggtcagaatcataacaaaagtcattcatctctctttttgccagtcttgttctctaagtagcaaatcttatcctcaggatcagaaaatgccaagaaggcctctctatgagtaacatcagcctgaaaatgagtcaacgatgcacggtataaaggcgaccacatcctaacaccaggtagatcatggagtgccttcattgaatcaaacacaatactagtcttgttggaatctgagggttgcttattgctggttcgtagagcgctaagtgaagggattctagcagcaagaatatcatcgagtccgtctgttaaatcatcatacatctcatcataccactcattaatcatttcagacattagagaatccacaaggttttcttcatcgcttgattcttccgatccgctcgcatcagacatatcatcatcatgctcttcagactctatagaatccaaactgttttccccaacgcttgatcctttcgatccgcttgcatgatcattgtcagcttcctcttgagaaataaccatattgagtgagaatctaccaatttaacaattcaatgttacaacagcatacatatctctaacataacatggaaaatcaaaggggattattcagaaaaaacaaaatctgggactagaattccataatgaaaatctcaaaagccgattacctgatttttttcgggaatggttgtcaattcatcctcttgttgttgaaatctgaaacgaggaattgggaagatgttaaactatttgagcagaaactgattgtgttgtatagcaatcaacgctaaaagagtagatgagtgactagaatggaatctaatgttcgttcgaattactaataaggactcaaaattcaaatcaaaactcagagaagcaaaatgtggaaaaggagacgaagaagaagatatatcagattaccttttcagagaagcgatggagagaagcttttctgggtccgagggttttaagaattgcgcaggtctctttttgtgggttcccagataaaggtaagggtattttggtcataatctcagcttacatacttgtttgacttttttagtatgacttacgacttttgtttctttttttgtaaatttactaataatataagtatgagaagaagacacgtgaagcgccaaaagacttgtggggagtgtataccggataaggtttgcatggtctctaagacctcaggttcttcctcacagtcctttctaaagaatcatcatcc

SEQ ID NO: 2555 - DNA, 3000 bp, Unknown
  misc_feature (1)..( 3000): cDNA_ID_3068520_gDNA_ID_1620555_Annot_ID_160423 3000 nt of promoter + ATG
tcattcataagtttttgcacagcatcaaggcaatttatatttacagtctgtgaataaacttaaggtgatttgtgtaataattcacatgctcttacaacaagttcactgcaataatatagtaactcgacaatcttaagcaacttcatacctattgataccaacaaaggatcacaatcccaatataaggcccggaaaatagagaacttcatcagctaatgaatatatgacatctaggactttacaaaaatctggatcaaattctgacattgtaaaacatcaattcggatatactagaaatgcaaatacgtattatagacacgaactcataaatgacatgtcgtgaagcaaaataggtagacgtgataccaaatgcgtatggaatagacgtagtctcaactaatgaacaagccatgtaatcagcaatactcacctcccctccaaaaccaggaggcttttcgtaggtcgattgccctgtaacggaattatagtagtaaagaactcctgcttctgatttatgtgcagtccaggcatctaaccgatttcctactagttgagaaccagctctgtcatctgcaaaatacaagatgatcctgataaaaaaatatgtaaactcaatagaataaccattaaggtcaaacagctcttacatggatcagtaatctatcatgaaacctcgagcgtaccgattcctgagagttcttctgtctttcgcccgggagatatatcaggctgacgacctggtaatgcatgaacattgccaacacttcccataggactggcaccaagcggatgagaaccagaatatggtaggttaggggagattccacgaactggaaatggatatgaaccaggaaaggtagtaggatgtgaaagaaaaggtgccctgggaataccacccatagaaggaggctgcaaccacattccttgaggcgttccaggcagtgaatgatatggaggatacatgtgcggatgaataccaggattcatttgagcaggacctgcagacatcccaggtcttggcgttgtagaaaaagggttggaaccaggaaaagcaggcggagatgtcattagtccaggaggggcgagtgttcctggtcgaccaaaaggtgcatttgctagcatgggcgaagcttgaggtatgggattaacatttgaggaggctgctgcattagtaccccattgtgcagtaacagaatatggaactgactgagagacaaaacctgtactagcaatctgcacaacagcaaccaaaataaccacggaaccagtttagagactaaaaggaaacaacctgatgatagatgaatcagcatgtgttcaatgcatacaccaaaaaaggttgaatcctgacaaattctattagtgagctaaatcagaacgacacgaaaattcgatagattcaattagagacatgaattcatctaattataaggatttctgctaaatcaatatacgacaagttcttgtaaaaggttctacacaaatccacatcaaaagataagaactagagacaagatcgagcttctttacgagttaaacagcgctcaagataaacaaactatgcaacaatcagaaatgagcatgagcaacatacagacatagagtgtagctccttcagctccgactgagagaaattcgaagtagtagccaagactggagcaattggaggaggacggacgaagatactctgtcccgaagatgccgccgttgtgtacggcggatccgttgtattctccccttccattacctttaaagactaaacaggtggtggtatcgagtaatagtttccgacgagaaattgccagcagcttcgtcgacgcgaacgaagaagttagggtttaggaaaaaactagtgaggaagaatcagaagatgtcgatgtcgcgcgattcaggagaacgaagttcagccgacggtttagatagatcgtaggatgatagaaaggatggacggctgagattacgttccgggggaaaaggaagaaaggagatattttaaattattaccgagaagaccttatattttaaagttaatttatgaaataacccagtattttctttatcgtgatttggtcacctcctaagtcaatttctttcgtgaaaaccccctaatcgatcgaaaagaagacattatgttatacgcacgtggatagtgtttttagattcaaaaagtatataagaagctaactcaaacatatgaaaattgaaagttgactgaaaataatcaatttagtgacattagttattgacatccgacaaaaagaaaacaacacacaataaacatggttgcacaaaactaaaattagtaaccaatgaactatctaatttaacagcaacctgttgaccataattcatccaccactattattttatttttaacttgatggacataaaagggtggccgacccataagtggaagagtccaaaaagcaaaggattacgaacgaactactaacaagttgggtcgccgacctcccaagagtagcaagacgatacagaagcttttcttttcttgtattcggttctttcatttaaataacgatagtataacaacgttagaaattaaactgatctgatagttcaaatgaaataatgaccaaccatatatagtaacgcgcctaacgcgttccacaaaaaaaacataaatggcttaagtttgaggggtccttatagtcagtcgcatattctttggtcgcataggtacaacaaaaggtcacgacgatagactctccaccgatcacttacttgccgattcacattctcccatcttctgcgcatcccttgtcgctactactttcgaaccttctcgattccaatttcttatccgaaaccctacggaagacagacctaagtttctcagctaccgacctaccgtgaacactgactaatacattcgctattcctctgtttctctgtattctgtctgctgttgtaacggcgaagatatgcgtcaattaggttcacctgcgtggagtttccggtgaattcgattgatgataaatg

SEQ ID NO: 2556 - DNA, 3000 bp, Unknown
  misc_feature (1)..( 3000): cDNA_ID_3068516_gDNA_ID_1620555_Annot_ID_160425 3000 nt of promoter + ATG
caacactttcacgagctagagagctaagttcaaaccaataaaaccctcaaaatcaaaataaaaattcctttgattaagagaagtaccagattgtgatcgaaaccctaaataggacgatgaattcaggacgatcaaattgaagaaaacaataaggcagagattcaccggcgggaagaatcgacggcgacggagagattcgatgagctaagagaagacaaggtggttcggcgaagatcgattctcgattctctagcctcctcgctcgctctctctctctgctcacaagcattattccattttctcttatccccattttttcaattattttaattaaaaaaaacaatattcattctatctacaattctgtatttttaaaaaaaaacaattgtgtagaatttaatatgtccaacttcgcaaaagctggaattgtttttttcttttcactccaatttatgcatttatcaaaacagacactcattgttgattttaaaagattcaattgtactttttatccaacacaattataaagtttgaaaagtaagtacgagatttttattgtgaaactaaattaactcttttatatcttgaatcgagatggtgacataattgtaccggacaaaatatcgaaaattttaaaaaatatttttacataacctcgactatttttgtgtaataatcaaatcatttaaaattgtcaaattataaaaatagttttcacaaacgtaagagatacgtacttctagatatacatactttctgcaagcttttagtatatttagaaattgtaaaaaaatacgtactttatgttcttacaacttgactgcaaagtaggtgtactttgacagtttcttcttccactacccaattgaatccatcaacaaatattttggccaaaatgcacatcaaattttaatgttcgtaccgcgtttcgaatgatttgccgctctgttgtaatatttgaattataatcagttcgttgatgaagcaaataaatcatggttcttgaacagtgttagccgactagtttttatgtcttaaccatttttttcttgctctctagagcactgcttgaacattatgatattgtataatttttggcatagaaatgtaaacttgacaaaatttttgatgattacttaagttttggtctcgagattctaaagatttgcacaaaaaaacaaaggattgttcttctaaaagaaaaagttaaatcgaaaaggacacaaaatttatgtaattttattgtatcctctttttgggctagctttagtcgatgaggccaaatgggcctgttaattatttatttttactttagtattttttaagtgggcttcttcctttggggctttacatttttgttggtccctgtaaaatcctgttaaagggcttaaatactagagcacaaaaattttaaaacaataaaacctaaatcctctcgtcgccttcgtttcttcgtcccactcccatcccattgatgaaccctcagaagactttgccctaaacctcacatactattcataatttgtatggatattaaaatgatattttatttggaaacttcatttttaataataaataaaaactattatcggaagttagtcatatttttttattttgtactcaaagagtcgtaatgtatatcgacattggtgtatcttttttttataacatttttgttacatatatcgttttcaattacatatattttacatggctggatttggataatgatgaaaagcaagtagtcgactttattcacaaacgttagagtcataaaaccctacccggcccattcacatgcaatgaaagtgaaactcccaactttacaagcaactgatatataaatattctacaaataaaaagggaagaaaactcttgaaattacatggaagtggaataatagtattacgaatttataatgtaatgccaagaaagggagaatatttataattcacataaaaacaaagggggcacattcatatatacgttacgtgtgtataaaacagcatataaatacagaatatatatattacaacttgagtagcatagtccttgagctattgacaagtcataagtgagagttcatgaagcatcattttctgtgctactggaaatatatatttgatattagtcgtgacctatagttcactgtctaaaatgtaaatcttatttgatttgatgcaatacatttttactttaccccaaataacctgaataatgttggtcataattatgaattattctcaacaaattgtaagctatttccctgctgtttgtttacccacctactgtattttttttttcttcctctaacaccaatttttattttattttttggccatcctgatcaatgaagcattaaggaatcaatctttgcacctggttatttttagtaacaactaacaacgcctcgtcatattgatttgtgctctgcacacaagattatatggatttcaaaataaacatgcagtcaattaatgcagtttatataacttttcttaagttcgatgttagaaaaaaggttttctaatgtaaagaagtaaactatgcatgtcaagctaattgctccaaaattaatatcatatagtacatttcgattaagcaatgaatcttattatctaataccaaaaaaactaaacaataacgaacaataattttttcattacaaacggcaacaaattattacattttcactattttagatggtctacacactagggttacaagttggtccatgcgaccagtttatacaatttttcgatgacgtttgtatataagttccttttgcataaatttatatgagttataaaggatgataaaagaaagtgtacattagataattgaaataaagacgccgaaaaagagatatataaatagccgtttccatgtgataactattattgctctctctctctctctccaatccaaaaggaagaacaagaacaagaaagctcacaagaagtttcatcttcaccaaatgcaaaagaagttgatacaatg

SEQ ID NO: 2557 - DNA, 3000 bp, Unknown
  misc_feature (1)..( 3000): cDNA_ID_2163206_gDNA_ID_1620555_Annot_ID_160428 3000 nt of promoter + ATG
ctgttatggtggaattggatactaaaatatgtctaagagtgggactgcaatatgaccttcttagtttattcgatgttttggttgcagaagaggaggtcatggacgtttctgctagaaagtcacaaaaagctgggcgcgaaaagttgaggagggaaaaactgaatgagcattttgttgaactgggaaatgtactcggtatagactcaatggttatgtggatttttctaaacagcagatgatctcactttgatcctcacatagctcttctgtttgcagatccagagagacccaagaatgacaaagccacgattctgactgatactgttcagttgttgaaagagctcacatctgaagtcaacaaactgaaatctgagtacaccgcattgacagatgagtcccgcgaggttcgtaccttatcccttacgctccaggcttttcctaacagaaaaaattagcagtctacatgacgtaaagatatcgatagggatcccaatatagataactcattgtctttttgcttttacgatatggtgactacacctatttcgtaagatgcaaactcagacgggctatataatgtaactgcttataggacttgttgttatcatcaatagcaacacttacaaatttactggtacttgtataacaacggttctttctgtagttgacacaggagaaaaacgacctgagagaagaaaagacatcgctgaaatcagatatagagaatctcaatcttcaataccagcagagattaaggtcaatgtctccatggggagctgcgatggatcacacagtcatgatggctccaccaccctcctttccataccctatgcctattgctatgcctcccgggtcaatcccaatgcatccatcaatgccatcttacacatactttgggaaccagaaccctagcatgatcccagctccatgtcctacatacatgccctacatgcctcctaatacagtcgttgagcaacaatccgtgcacattccacagaaccccggtaaccgttctcgggaacctagagcaaaggtttcaagagagagcagatctgagaaagcagaggactccaacgaagttgcaacacaactcgaattaaaaacccctggatctacttctgataaggtagagagacttaaaactagaagctagagatctccaatttttttcggatttattatcttcacagttattcgcgaaattgtattttgaaggatacattgcaaaggccagagaagacaaagagatgtaagagaaacaacaacaacaactcaatagaagaaagctctcattctagcaagtgttcatcttctccgagcgtacgagaccacagttcttccagtagcgtagctggtggccaaaaacctgatgatgcaaaatgattcgaaagaatctgatgttgatcatctcaagtatccaagtatcgtttcgatgagtactgtatatagtgcgagtacaaaatgcacttagctgtttaaagcagtgttttgatgcaccgtggcattcgttttcctcggatagtcatttctcagatgattttcatccttaataggtctgctttagttctaaaactcggatgatttgtaatttccagtgtccaaatctactaattttattaatcctataaattaaacaaacttatatcttgatttttttttaaaaatcatagattatttatactattgtacaaaaagaattacatttaaatcggtaaatatagtttcaccataaatatatggtttcattaatatcataaattagtaatgatatagatatatcaacaatatatatttatatatatattatatgtaagaaatttctttgaaatatatttttaatatttagttctcatttgtacttatttgaatttagttctaatattttactgtatcaaaaaaaatttggtgttattttttagacatgagaattattttttacttataattagttataaaaaaaatattttttataatgaaagaaatcttatagtaaaaaattactatgaaaaatttctttataaattaataaaattttagaatcccaacattattaatttgtaaaggttttactgtagttaagttcaagttcaatttaagctggtgctaaacgttagctacgtgttcgtatgatgtcaactgtctagatacaggaaaatttctccgaatatacagcgactacacatcaaccatagagaacagtatgaagtaaatataccctctatccatcgcatatgtagtttgtgggagtgctctgttggtttcgctttcctctgatgttgtataccctgtattgtcaaatatgactgcgacacggttcccactcatctcatagaccgctagataatagtctgcatgtatataaaataattgttaaagacaaaacatagggcatacccaatatcctttgtgcatagtatttagtatgtcatggaagttaactaggtctttgagagttcgaacgccatgaagagcaaaagaaagagaggaaatacggaagagaaagacaaaacaaactaaaaaccaaaagacatttgacctatcgtttctgtttcacaggacgaccataagatgtaaaagtcttgcccatccattccacaacccattatcgattcacaaggcaacataagaagaagtttacatttcgatgagctagagcaattctctagcgcagatcacaaacaaccaactccaacctctggttatactatccaagatttttacaggatggtgcctgaggctgccaggtttcgaaggaataaagagttttggtgtagcaagaaaaattaagttacaagacactaattatattgtagatagagacagaattgaaataaaatatggaacataaataaataattagataaatgagtcagcagcttcggtgaattgttctgtatctcggagtattactgccggcgacgaggatagtcttatcttctcctctctaatgactttgattcattttcctcttcagattcaaatcctagattcaatcggaga

SEQ ID NO: 2558 - DNA, 3000 bp, Unknown
  misc_feature (1)..( 3000): cDNA_ID_1387960_gDNA_ID_1620555_Annot_ID_160434 3000 nt of promoter + ATG
gaaaaactgaaaaaggtttacagctcaagataattaaaggatttttctgtagtgtaaggagcctacctgagaagtatgactctcatcctctagatcttcaaccacccctgcaaccaataacagttagcataatccaaaatttattttagaacgcccctcaaagagaacttgaatgatagctataagtgtgtactcacggtttgctaacccagataaggcagacaatctagcagccatatccctttcttcagcttcttgaagagctctagcataggcctcatcatctgtataagcaacttcttcaatgtcagagttaccgtcatcttcttgatcatcttcattggcgtgcacattgacatcaagcccatcttcctgaggatcatcatctgtttcatattcatcttcatcatcatcctcatcctcattctcggggtcatcaaactcatcctcatcgtatacatagcttccagtttcccagctcccatagtcactgatttcactattcatggtcaacatcatatacgcccgctcctgaaacccgaaacatacacgcacacatacaaaacaacaatttttcaatagacaatcctacataataacattgcaaatgcaattagaaagaaagccctaagattttcgcctatgccggagaagtagcactaacaaagccctaacaagcatggaataacctaaaaacggagaaatccgaaatagagagatgagaaagaaagacgcacctgttcttggagtgtgcgagcaagagcaagatccgcatcaatttggcttagattagtaaacggaactctagcagaggaagatcggggagcaggtagctctcccaccgaaatcgatccgctctcctccaccggcaccgccacagcaactgccgactctccaaccccttgctctcctctctcgctaccacttccggtgtcagagacaacaccggtctgccgattctccggcaaccgtccatcagtctcgttaatcttggtcgcttgctcagcggtgacgacgacgttgccaacgtgtgggccattgtcgttctccatgggcatgattctgggaatccgaatccgggagatggaggagtggatgaggtttggggattttggaatcggaagggaatgattattcaggaatctgagaaaacgatgacacgacgagaaagaaaaatggtgcttctctttctctctttagctgagattttcaaattttgaaaactatgcaacattttcttcgaaatcacacccctttaatttttgtttctttctaaactcaccgactaatatatatttattatcatttacacctccacctttccgtttataatgtcaataggtagtatgtgttaatccaaaagtcatcactaggtagtatgtgttaatccaaaaatcatgattaggagtatattcatttttgatcgatgcttttcactatcggcctatttaaaacccctacataaccgaaaatttatatagactttgaatggttatgtggtatatactacaccaaccataccgatattatggtatgctaaactctatattggagtacgttttaattttaaagtaaaagaaattaaaatatagatagtgatattttggtatgtaatagttgttctttgtgatttgtgtactcatctacattgtattcgtcctgtgtagatcagtttaaatggtagaagaaaaaaagattggtctaactttggtcagatttggaatggcttcaacaaccattcaagaccttaatctttgtgcatccaaatatttctttcacaagctaacaagatatagtagatctatattattaatcaaggcagtttatatcttataaacgtatgagatttaaataagttctgcttgttgagaaaaatgaaagaaaacttcgattttgagtcaaaagagttttgggtattcaggtatgttggtttacatattggaatgtcgaatcaatttggtattttatttaattaaaacaaaaacaaaaagatatgtaagatggtttagcttgaaatctcatgtgtcgatgctgcaagaaaaaaattcagataatgagacgagcaaaagaccaagtagatattatgtgtcaatgtgtggaagggccgagacgccaccgtttcttcgctgaagcgtgcaagttacaaaaccttgactttaatggaaaaaaactttggcttacttttgtttattctgataacctatccaatatttaattatttacttttatctcgaaaattaattcatcataattgttgactatttaatccaaatttatatattttttttatatcatagcaattttaaaattaaatatcatatttatctaaactaatttggataaatatgtgtttttttttgtctttttataagtcatgtattttaatttaagacgtttttgtgcatgctatcttttttttttgttctactataatttttagcaaatcttatgatatcattgatatagcgaaaatgaaaactatacgcaaagttttaagagttttatttttgtttcctccttcaccgttcattcactgatatgtgtgatatctctttgtcccccatctattaatctcctcctccgcatcgtcgccgtgcacttccccacctcttccggcggtaagattacgctctccctctacttcttgctaaattcttaaattgagtctctgcttcactggttatctccctcacttgttcatgtttagtcgcttctcgatgaatcctcagataattgctgcttagttagcagaacagcgatttctggatgaatctcttagaatataaaaggagtgagattgattatgatgctacgagattcatattcttaacaattactacgcaattgtctgtgaaatcactttatcaggaacttttgctttggttctctacttagattctgtatcactgtgttcactgttggtttgaggattagattcatcctctattagattctgcaaattgcttcatggtttggaatttcactggtttacaggatatg

SEQ ID NO: 2559 - DNA, 3000 bp, Unknown
  misc_feature (1)..( 3000): cDNA_ID_3068508_gDNA_ID_1620555_Annot_ID_160438 3000 nt of promoter + ATG
gtgaaaatatgctaaccagttaacctatcggaatttggtagaaattttcttccatttcacttttcacatagtgtgacataggtaaaagagggaaaatagcatttggtcgaagtatgtcaaccagttgagctatatatcagaattttgtaatattcaatcgcttatcaaaaatatactgagatttaatttacctaaggcaaatatgttgcaatgtatatatatatgaatcttttgattcaaagtggaatgttatttaatttgaagacctttgtatcgctggtttcggttaatttgttggtcagcagttcagtctttcagtttccgctaaagattacaaattttagaggcaaattatttgcgatatcgagatgtgactggttaggagaaacttcggaaggtcacacgctatctaaaccactataccaggttggaagtctccaactaaagatgtttgacaactttttgtcatcgaaaaatgatcagaaagcggtgtttttaactattctccgataaatattggtaagaatttgatctattatggtgagtacattatccaggtttatatagatatggtaaattatgttttgagttgggtctagttagtggcaaagcatagagcaaccgattgcatatagtttccggtgaatatgatataactaacacatgatggttataatgaataattatgtcgaataccatgcggcggatcatatgttttaggctgtatatgccatacgtgatcttggatgacatgtctttttttcgagatgataacatttattagtcggtcgcttaattgatttcgagttttctgttgccattttaaatacacatttgcgtcaaaaaaaaaaacgagtttgctgtctcgaaaatagcaccaatgcccattatttcttaattgtattttttcggctaaggtttctaattattaatttattatcaaaaccttacatatggtaatggtacactgtacgagtttttggttgtcttgtgtttttcaatttgttcttcctctttatgttttgagttttgttgtcctgtttcattttattcttacttttgttttctctgaattttgttttcagtgaacgtataatttaaaaatctgcaatacaaacaaacaaatatctaaaagtcaagttggctttacgcatgtgatcgacgaaacacctaattgtcttgttctttttcattcgtctgaataatttcatgaaattaacaagacaaaggttcacatttataaaaagggaacgagagcaatcaaactacagaagatcactacatcaaaataacgcatttctcagattctcagattcaaacacattcacctaattgttttgttctagctaggccttttagctatacaaattttgcattaacattacaatttccatcggcatgtaaacaattagcactaactaattaattagtactgcaatatatcaaacataaaagatggttaattaattcagtgtcaagttgctgatcctaatgagaatgcagtgctgagacaagatctgatgagtctaacaaaaatgtgactaattcaaatcacattaattactgtatgtagcaaacataagattatatatataatatatcacaccaatttatatagggaataaaacatatccttgtatgcaatgcataacgtagttattaatatagccttacatgaataacgtcgttaagataacgatatgacactataatgacgaaaccttatgggaacatcatgaaaataatgtaacgcgagttttgactttccaatgtaaacgaaaggagtagaaagcaacggaagactacgaatgaaagtatggagctacgtatagtttacgaaataattaattatacatatagaaaagtagtgagtcaacttttctttccatcgtaatcaatagcccaactgtttactatcattgtttgaaatatcctctgacacagaaatgttatcttatagtcaatttgacgtacaatatgctctcttaataaaatcaagaaatctagtttttatcaaaaactaaattttgtccccattccatggataatgttaaaacattacattcattatagatccatgcatgtgaatgaaaaggctcacgggtaaaaaggttattaaggtatcaatatgacctcaaattttggatagatattgaagatttcataccactttttttagtgtcaaaagacggaaaagtaataactaaactatactacttttaaaagtttgaaaattgaaaaacagattttacacctaatttaaaatatcagatcaaagatcttatctacaagactaaaattaaactagtagcggtctttgctgtccattgaccgagttttgcgggtggtttactcatttaagtaccacagcatcaaattaaaataactgtcacttgtcgaaagtgactagataaaaccaaaaatagctttaattgagtcaaaattgtagttctagtgcaaagtaaagagttatcatcttacaaaatgcgactcattagtgtattaattaattaattttcagtccaataatctggttaatttggtaaactatccaaagagtaattaaatgattcctcgtcataaatactaattttctacgttttaagcaaaaaagacaataattatttggtctgaaaactaaaaaaagacacgagattaagggaagaagataacgatctagaggaataggcaagtggaagaaccagaacaacagctgttcttttcttctaaacttcagaagtcagccgacagttaatttctcctttttttgaggttttgtcgaatcctataaatttcaactaaactcttcttcattttcaatatcaaatcttgtcttcttcttcttcttcttcttctttttcttcttcttacatttgatttctctgtctgaattcgagaaccagatctactaattacctgagagaaaaaagatctgctctgtttgtctgaaacagacagaagtcaacaaatctttcatttgttttttagcaaatcaaagaa

SEQ ID NO: 2560 - DNA, 3000 bp, Unknown
  misc_feature (1)..( 3000): cDNA_ID_2163233_gDNA_ID_1620555_Annot_ID_160437 3000 nt of promoter + ATG
aagaacagctgttgttctggttcttccacttgcctattcctctagatcgttatcttcttcccttaatctcgtgtctttttttagttttcagaccaaataattattgtcttttttgcttaaaacgtagaaaattagtatttatgacgaggaatcatttaattactctttggatagtttaccaaattaaccagattattggactgaaaattaattaattaatacactaatgagtcgcattttgtaagatgataactctttactttgcactagaactacaattttgactcaattaaagctatttttggttttatctagtcactttcgacaagtgacagttattttaatttgatgctgtggtacttaaatgagtaaaccacccgcaaaactcggtcaatggacagcaaagaccgctactagtttaattttagtcttgtagataagatctttgatctgatattttaaattaggtgtaaaatctgtttttcaattttcaaacttttaaaagtagtatagtttagttattacttttccgtcttttgacactaaaaaaagtggtatgaaatcttcaatatctatccaaaatttgaggtcatattgataccttaataacctttttacccgtgagccttttcattcacatgcatggatctataatgaatgtaatgttttaacattatccatggaatggggacaaaatttagtttttgataaaaactagatttcttgattttattaagagagcatattgtacgtcaaattgactataagataacatttctgtgtcagaggatatttcaaacaatgatagtaaacagttgggctattgattacgatggaaagaaaagttgactcactacttttctatatgtataattaattatttcgtaaactatacgtagctccatactttcattcgtagtcttccgttgctttctactcctttcgtttacattggaaagtcaaaactcgcgttacattattttcatgatgttcccataaggtttcgtcattatagtgtcatatcgttatcttaacgacgttattcatgtaaggctatattaataactacgttatgcattgcatacaaggatatgttttattccctatataaattggtgtgatatattatatatataatcttatgtttgctacatacagtaattaatgtgatttgaattagtcacatttttgttagactcatcagatcttgtctcagcactgcattctcattaggatcagcaacttgacactgaattaattaaccatcttttatgtttgatatattgcagtactaattaattagttagtgctaattgtttacatgccgatggaaattgtaatgttaatgcaaaatttgtatagctaaaaggcctagctagaacaaaacaattaggtgaatgtgtttgaatctgagaatctgagaaatgcgttattttgatgtagtgatcttctgtagtttgattgctctcgttccctttttataaatgtgaacctttgtcttgttaatttcatgaaattattcagacgaatgaaaaagaacaagacaattaggtgtttcgtcgatcacatgcgtaaagccaacttgacttttagatatttgtttgtttgtattgcagatttttaaattatacgttcactgaaaacaaaattcagagaaaacaaaagtaagaataaaatgaaacaggacaacaaaactcaaaacataaagaggaagaacaaattgaaaaacacaagacaaccaaaaactcgtacagtgtaccattaccatatgtaaggttttgataataaattaataattagaaaccttagccgaaaaaatacaattaagaaataatgggcattggtgctattttcgagacagcaaactcgtttttttttttgacgcaaatgtgtatttaaaatggcaacagaaaactcgaaatcaattaagcgaccgactaataaatgttatcatctcgaaaaaaagacatgtcatccaagatcacgtatggcatatacagcctaaaacatatgatccgccgcatggtattcgacataattattcattataaccatcatgtgttagttatatcatattcaccggaaactatatgcaatcggttgctctatgctttgccactaactagacccaactcaaaacataatttaccatatctatataaacctggataatgtactcaccataatagatcaaattcttaccaatatttatcggagaatagttaaaaacaccgctttctgatcatttttcgatgacaaaaagttgtcaaacatctttagttggagacttccaacctggtatagtggtttagatagcgtgtgaccttccgaagtttctcctaaccagtcacatctcgatatcgcaaataatttgcctctaaaatttgtaatctttagcggaaactgaaagactgaactgctgaccaacaaattaaccgaaaccagcgatacaaaggtcttcaaattaaataacattccactttgaatcaaaagattcatatatatatacattgcaacatatttgccttaggtaaattaaatctcagtatatttttgataagcgattgaatattacaaaattctgatatatagctcaactggttgacatacttcgaccaaatgctattttccctcttttacctatgtcacactatgtgaaaagtgaaatggaagaaaatttctaccaaattccgataggttaactggttagcatattttcaccaattacatttgtactctttcagactttcacctatgtgaaaaattaaagaaagggaacgacggcgtatgagtcccgacaaagatttaaccgacaagacataaaatgcttacacgacgacgagaacacacacccgtggatcaaaggcggtgcacctcatcataaactttggaaagaagaaatatccaaaccaacctctatcttcatatatatatacatacatagaccgatcgaacattaattaatttcgttaagagagacaacaaaaagagagaacaatg

SEQ ID NO: 2561 - DNA, 3000 bp, Unknown
  misc_feature (1)..( 3000): cDNA_ID_3068512_gDNA_ID_1620555_Annot_ID_160433 3000 nt of promoter + ATG
tgacctttaagaactgagacttggtttccctgtgctttatacactagaattatattaaacagtcaatgtggttttaatccttgttgtacatgaaagcctcaaactctctagttcgtgagattacttagaatgttgatctactcctgcttgatcctggaaaaagtgcgtaactaatttgatttcttgagtccttttgatgtctaaatgtttgtccatctctgtcatggcttagtgacacagcaagtaaacaagcgttttgtttaaatttattggttgcttgatatcatctaatcatttagaattactttttttttctttttctttagcaagcgaatgatatgaatcgggctaatcttgaaagaatggttgggtcagatgattctgcatttaacggcttagatcttgcaaccctcatcagacagaagtatggaaaatcttatgatgttcaactcatcaagaaggtatgcccttctgtattcaagtgtgtttgtgattctgtatcgtagaaagaagttaagacctccaatcatcttcatttcattgcatgaatacagaatcagcttttacgaaattcagttgatcattttccttttcattttgagatttttggtgtgagctttattttatcaatgtggaaagatttgtcgctttagaagctaaaaatataaatcatagttcttagatgtgattaatgtaggagttcatggggaagaatcttcttgcaatgaatgtcatgtggaagtacagagaacaggtaagagaatcctttgctgtatacttgatcacagaagcctaatgatatgatagttcaattgattttagtgtacttgtttggactttagataattatgatcttcgttttccatatcattcagatttggtatgagaatctttgccacatagaaagatgaagtgtatatccatattttgttggtatagttcttgcttttgcaagtcaatccttgtaagctaattcacctttatatatttcttgcttcttcttcaacgcctagaggtcttttcctctaaccgaagaagaatatatacttagacttgacgatgtagccaacatgttgaaatgctggggagcagtctcacatatccgtagcagcctagcaaagtcgaaggagcgacctcggatagggaaggtgagatcaacctaaaacagtaaccttaaaattcagacatatattagctagatcacctaggtcgattagagaccactttgatactttaacatcgttttttctagtttaaaaatcgacatggatggtttctcctcttcatgcaggctgtcagcattttcatagacatggattcgacagggggaagagcaaatgaatggatttacaagtaaaaatcgaccggtttgcagctgctaaaccaagaaatcaaaaggttttgtctctacgtttatcgtcatcaattcattttgaaggctcttcagtgatggttgcctgcagaaaccgaggtttttgctatatttgatgtccaaatcaggtagtatatatgtacatgtgtgtattaagtagacacaaatctttacttgaactctctgtgtaaaatatctccatgtgttgaaattcaatcatctttgtgaatcttcctctctttgtgatctgtaaaagtattagttttggcattcatgtcagtttggggacctttgagttggctttgcccccaaaacaaaagtagctttgggaccattccttgattaatttcatgggtttgtttacttagttttgtttcaagttatatgatttttattagacatatgataatcaaataagttatagtttccggtttctagttgagcaagtcctgctccaatattataagagcaccttaaaatacatattttttagttggaaacttaaaccaacatcatgttggagcatcgtgatacttttttatacaacacataatgataatgctcatcttcatcatcattatcatcacactcatccacctccacgtcctacatcatcattaatttgaggttatttttcttttctcataaaataagaaaaagatcatatcatcattatcataattactattattgatgatgttgtcacatcacgatacacatcatgactcacatcatcaacgtatgcttcttaacttcatcatgaaaattcaaaagcatccctctcttctcatcaccacaaccactaacaagtaaaacatcctcatcatctttaccatcccccatacatcctcaattcctcattcatcatcacccctatatccccttttttagtcaatatatactacattaagtattgattatattattgcccacacattaatgctactaaactaaaaagatttgtattaagataacgttttataatcgcaacttacatcacaatttttcaaatttaatctttcaattaagttttgaccaattaattaaatttaatttcttacaatacatacaattatgtgtagtgacaattttcctggctacatcgcatgttttatttaattgcgttctgtagtaaatttttaaaaaaatgtaaattaactaaaagtaaaattattattattttgccaccaagtaataatttattaccagaatacatcaaattaattagtgaatcatttccaattcgaatatgtaggtagtttgaccaaaaaggtaaaattacaaagcctttaacacaaactcaaaaccagagtctactacattagaaattttcacaattacaattctccggcgaatccaacgtttccggcacaattctccactatattgacggcgatatacccttatacggcgtttcgtggttacaatttgtaacctaactactcatcgtctacccaattcaaaccagtcaggtttccgtacagtagtaaaatcacaattcctctctgtaacaacgatctcaacgacttcaacgagacacgttactattccaatccatttttccgacgccggcaactgaatcagaatcggaaaactctagagacatatggttgattggagtggcgatg

SEQ ID NO: 2562 - DNA, 3000 bp, Unknown
  misc_feature (1)..( 3000): cDNA_ID_2996012_gDNA_ID_1620555_Annot_ID_160427 3000 nt of promoter + ATG
accataacagaatcttaaaaccaagtcgaacccatctgacccacctggaaaatcttcaacctcgatgatgattctactgttcttgtgattctttttcttcttattgctctgttttatcatcttcctcaagaagcctgagtactctgagatcaaatcctaacccaagaaacagagaaacagagtttaattcagaaaatggaaacagaggaagttagggtttgaattagtgtggagatttgatttggtttattacctgattgacgaagaaagtaaattggttattgagattgatttgaagatcacagcaaagagacattgtatcaacttcttttgcatttggtgaagatgaaacttcttgtgagctttcttgttcttgttcttccttttggattggagagagagagagagagcaataatagttatcacatggaaacggctatttatatatctctttttcggcgtctttatttcaattatctaatgtacactttcttttatcatcctttataactcatataaatttatgcaaaaggaacttatatacaaacgtcatcgaaaaattgtataaactggtcgcatggaccaacttgtaaccctagtgtgtagaccatctaaaatagtgaaaatgtaataatttgttgccgtttgtaatgaaaaaattattgttcgttattgtttagtttttttggtattagataataagattcattgcttaatcgaaatgtactatatgatattaattttggagcaattagcttgacatgcatagtttacttctttacattagaaaaccttttttctaacatcgaacttaagaaaagttatataaactgcattaattgactgcatgtttattttgaaatccatataatcttgtgtgcagagcacaaatcaatatgacgaggcgttgttagttgttactaaaaataaccaggtgcaaagattgattccttaatgcttcattgatcaggatggccaaaaaataaaataaaaattggtgttagaggaagaaaaaaaaaatacagtaggtgggtaaacaaacagcagggaaatagcttacaatttgttgagaataattcataattatgaccaacattattcaggttatttggggtaaagtaaaaatgtattgcatcaaatcaaataagatttacattttagacagtgaactataggtcacgactaatatcaaatatatatttccagtagcacagaaaatgatgcttcatgaactctcacttatgacttgtcaatagctcaaggactatgctactcaagttgtaatatatatattctgtatttatatgctgttttatacacacgtaacgtatatatgaatgtgccccctttgtttttatgtgaattataaatattctccctttcttggcattacattataaattcgtaatactattattccacttccatgtaatttcaagagttttcttccctttttatttgtagaatatttatatatcagttgcttgtaaagttgggagtttcactttcattgcatgtgaatgggccgggtagggttttatgactctaacgtttgtgaataaagtcgactacttgcttttcatcattatccaaatccagccatgtaaaatatatgtaattgaaaacgatatatgtaacaaaaatgttataaaaaaaagatacaccaatgtcgatatacattacgactctttgagtacaaaataaaaaaatatgactaacttccgataatagtttttatttattattaaaaatgaagtttccaaataaaatatcattttaatatccatacaaattatgaatagtatgtgaggtttagggcaaagtcttctgagggttcatcaatgggatgggagtgggacgaagaaacgaaggcgacgagaggatttaggttttattgttttaaaatttttgtgctctagtatttaagccctttaacaggattttacagggaccaacaaaaatgtaaagccccaaaggaagaagcccacttaaaaaatactaaagtaaaaataaataattaacaggcccatttggcctcatcgactaaagctagcccaaaaagaggatacaataaaattacataaattttgtgtccttttcgatttaactttttcttttagaagaacaatcctttgtttttttgtgcaaatctttagaatctcgagaccaaaacttaagtaatcatcaaaaattttgtcaagtttacatttctatgccaaaaattatacaatatcataatgttcaagcagtgctctagagagcaagaaaaaaatggttaagacataaaaactagtcggctaacactgttcaagaaccatgatttatttgcttcatcaacgaactgattataattcaaatattacaacagagcggcaaatcattcgaaacgcggtacgaacattaaaatttgatgtgcattttggccaaaatatttgttgatggattcaattgggtagtggaagaagaaactgtcaaagtacacctactttgcagtcaagttgtaagaacataaagtacgtatttttttacaatttctaaatatactaaaagcttgcagaaagtatgtatatctagaagtacgtatctcttacgtttgtgaaaactatttttataatttgacaattttaaatgatttgattattacacaaaaatagtcgaggttatgtaaaaatattttttaaaattttcgatattttgtccggtacaattatgtcaccatctcgattcaagatataaaagagttaatttagtttcacaataaaaatctcgtacttacttttcaaactttataattgtgttggataaaaagtacaattgaatcttttaaaatcaacaatgagtgtctgttttgataaatgcataaattggagtgaaaagaaaaaaacaattccagcttttgcgaagttggacatattaaattctacacaattgtttttttttaaaaatacagaattgtagatagaatgaatattgttttttttaattaaaataattgaaaaa

SEQ ID NO: 2563 - DNA, 3000 bp, Unknown
  misc_feature (1)..( 3000): cDNA_ID_2163192_gDNA_ID_1620555_Annot_ID_160424 3000 nt of promoter + ATG
agttcccctacaaaatccttgttcccttcctgcatttctccagattttaagtcttctgaaacaggcccaacagcttttcccttctggaaatccaagacaattttctttgggcgtacaaataatcgaggcaaatcttctgtcagtagtttggtcaagaacctgaaagagatgaagcaaaggaaggaggaaagaaactgatttatcaatacgtcggaagagagtaaacaatcaacagagagaagaagctaaaacgaatacattgaggagacttacattgataaaacaggaattcctgatgttgtcatccaaagcattcatgcaaaaagaagaaaatgattaaagctattactaatgtacatgattataaaaatcaaaggagataatgagaaagcaacagacaattatgattaactaatacccattagattaaacaatcggaatggtgcaagctcaaatttgatctttggaagtgaaacaaacgcccatgatgctgctccaacccaaggcgctgacggaatcaatcttaatttaacccatagttcaccgtcaatgtcaaaatcccgaataccaactggcacaactactgggatgataccaaattttaaagagagcattaacaacatccgagcaccaccagtataccgaagaccaatctggtacctataagaagaaaaataagagtataagcaactttcaactgagccgtgaacagactgtttggagtacccaagctccaaacgaatcaacagagaaaatttctaagatgcagtgaccattggtgtgttgaatccgtggatcatgtcagaacaatcccatccgtaaaaaccaagtaagaacaatcccagcatttgatccaccaacacaatgcattagctacctaacatataagtaacgtaggcaatcgcaccaaggtataaacttactgcaagtcattaacacggcgagatgtcctcctctcaacatttctaacagacaaaggctcatccccaagagagaattgcttaatttcaactctctgcacataatcaggcttcttcaaatcatcaatcacaggctgcaacaatccaacaagccaattctcaatcccacctctataaactttccagagcttaaccaacaccatgttcacccactccaccgactctttcctttgcaaatccttctcaagggacagcgagaaactggtgggaacctgtgcccatggcccggctcctctttggcctccatcaccagccatttgtctccgcctctttctccaagtccatagcttatcacaaataacaccaacaaagaagaagaatgcgaatagaccaattgcattacgactaatcggtggagacgggattgggtggattacacctagctgagtcctgagcttatccactataggatcttctctaaagttagtgaaattgtttctatcaccttgaattgcagactcctgtgaagatgaagatgcttcttcatcctcaaattcattcgaaaaccgagtaaccacaagacttctggcagctcttctcgccgaatccgctaatccaatgttcttggaatccgtacgaattccgctggaaacaaacctagaattcgaattcgccgcatgaactcgacggagaattctccgcctctttgtgaatccatcggagaacacaatcagaccgtgctcattggagcaaggacagagcagacgacgtgacacaaaagaagggaaatcgaaactagaacaagaagaagaagactgtagaatcatttatcatcaatcgaattcaccggaaactccacgcaggtgaacctaattgacgcatatcttcgccgttacaacagcagacagaatacagagaaacagaggaatagcgaatgtattagtcagtgttcacggtaggtcggtagctgagaaacttaggtctgtcttccgtagggtttcggataagaaattggaatcgagaaggttcgaaagtagtagcgacaagggatgcgcagaagatgggagaatgtgaatcggcaagtaagtgatcggtggagagtctatcgtcgtgaccttttgttgtacctatgcgaccaaagaatatgcgactgactataaggacccctcaaacttaagccatttatgttttttttgtggaacgcgttaggcgcgttactatatatggttggtcattatttcatttgaactatcagatcagtttaatttctaacgttgttatactatcgttatttaaatgaaagaaccgaatacaagaaaagaaaagcttctgtatcgtcttgctactcttgggaggtcggcgacccaacttgttagtagttcgttcgtaatcctttgctttttggactcttccacttatgggtcggccacccttttatgtccatcaagttaaaaataaaataatagtggtggatgaattatggtcaacaggttgctgttaaattagatagttcattggttactaattttagttttgtgcaaccatgtttattgtgtgttgttttctttttgtcggatgtcaataactaatgtcactaaattgattattttcagtcaactttcaattttcatatgtttgagttagcttcttatatactttttgaatctaaaaacactatccacgtgcgtataacataatgtcttcttttcgatcgattagggggttttcacgaaagaaattgacttaggaggtgaccaaatcacgataaagaaaatactgggttatttcataaattaactttaaaatataaggtcttctcggtaataatttaaaatatctcctttcttccttttcccccggaacgtaatctcagccgtccatcctttctatcatcctacgatctatctaaaccgtcggctgaacttcgttctcctgaatcgcgcgacatcgacatcttctgattcttcctcactagttttttcctaaaccctaacttcttcgttcgcgtcgacgaagctgctggcaatttctcgtcggaaactattactcgataccaccacctgtttagtctttaaaggta

SEQ ID NO: 2564 - DNA, 3000 bp, Unknown
  misc_feature (1)..( 3000): cDNA_ID_1396885_gDNA_ID_1620555_Annot_ID_160418 3000 nt of promoter + ATG
acatgtgtgtatacgtatgtgtttatgtgtgcttattatactctttttggattcaagaaactaatctttagtatttttgacattctggtagatttatgctcacttcttaggccttgttgacttttacagtgatggattttgaaactctggttgatttgattttctttttggtttgatgcagtgaggagaggaaatgtcggatcttcagacaccgcttgtgaggcccaagaggaagaagacttgggttgattactttgtcaagttcagatggatcattgtcatcttcatcgtccttccattctcagccacattctacttcctcatctacctcggggacatgtggtcagagtccaagtcctttgagaaacgtcagaaggaacacgacgagaatgtcaagaaagtcatcaaaaggcttaagggtagggatgcttccaaggacgggcttgtctgcactgctcgtaagccctggatcgctgttggaatgaggaacgttgactacaagagagcccggcatttcgaggttgacttgggggagttccgtaacatccttgagatcaacaaggagaagatgactgctagagtggagcctcttgttaacatgggacagatttcccgtgctaccgtcccaatgaacctgtctctcgctgttgttgctgagcttgatgaccttaccgttggtggacttatcaatggatatggtattgaaggaagctctcacatctacggtttgtttgctgataccgttgaggcttacgagattgttcttgcgggtggagagcttgtccgcgccacaagggataatgagtattctgatctttactacgcaatcccgtggtcgcaaggaactcttggactccttgtagctgctgagatcaggcttattaaagtcaaggagtacatgagactcacttacataccagtcaagggtgatcttcaagccttagctcaaggttacattgattcttttgctcccaaagacggtgacaagtcgaaaatcccggatttcgtcgaaggcatggtttacaatccaacggaaggagtgatgatggttggaacatatgcatctaaagaagaggcaaagaagaaagggaacaaaatcaacaatgtgggatggtggttcaagccgtggttctaccagcacgcgcagaccgccctgaaaaagggacagtttgttgagtacatcccaactcgtgaatactaccacaggcacacaaggtgcttgtactgggaagggaagcttattcttccatttggtgatcagttctggtttaggtacctcttaggttggttgatgcctccaaaggtctctcttcttaaggccactcaaggtgaagctatcaggaactattaccatgatatgcatgttattcaggatatgcttgttcctctttacaaggttggcgatgcactcgaatgggtccaccgcgaaatggaggtaaaactaaaagctcggtttcatgattgatcatcttctagttaaagtttcttttgatgttattaacaaaatcatgaattgtttgttctctttcaggtgtatccaatttggctttgcccacacaaactcttcaagcagccaatcaaaggccaaatctacccagagccaggcttcgagtacgaaaacagacaaggagacacagaagatgcacagatgtacactgatgttggagtctactacgcacctggctgtgtcctaagaggtgaagagtttgatggatcagaagcagtgcgtaggatggagaaatggctgatagagaaccatggattccagcctcagtacgcggtgtctgagctcgacgagaagagcttctggagaatgtttaatggtgaattgtatgaggagtgccgcaagaagtatagagctattggaacgttcatgagtgtttactacaagtccaagaaaggaaggaagactgagaaagaagttagagaagccgaacaagctcatctcgaaactgcttatgccgaggcagattaagtaataataagccttggtttgatgtaatggctcgggatgattattgttattcctagtagtgtctgttatgttgttgtttcctaatttcagttttagtgtcttgaagactcttgttgttgttgtttgcttcttgttgttgtttgactcattctggtttgagtggattttagagtttaaaacttttggatttgcctatgaaattgaaggtttccggttttatcgtgttgcttgactgtcacaatgtaagcatgttgctgtaatgaattaattgatctaccaatttgagagatcatttcaacttctctctttataccaccaccaactaggctttagatcattcacgacgtgaatctaaaacactaaaacccgactttgttagttttattggggtgcggttaggtttgatataaacctggaaataccggtatttgaaccgaagttgaccgggtgagactttttaggataaacccaagcagccatttccgagtaagaagagctctgtttctgaaagaagttttacagagtcgatcgtctaaagcgttgttgaagcacttgttagtggtaagtaatttcgatttattaattcttgttgtatcttttgtattcgaagttacttgcttgtttttcgatttcgtctccgtcatgatgtttgcggctctgttaattggaagtggaaaggtctgtcctttatctacataaaatggtgcatagaaggtgttcgaccaaattcctagctcaaattcctttagttacattagctctgactggaatgtaactgtgaagtctcgatacccaattcattcttttcaaaaacaattgaagattattatttcccttctcaagattttctgtcttttctctattgttgacactatatcagcaaatgtttcttgcaggtgctctgtttcaagctggataaacccaatcctattgggatttggctggattttataccatattttagcatgattgtttgataaacgcttgataaattgcctcttgttgtcacctttgctacgaaaatg

SEQ ID NO: 2565 - DNA, 3000 bp, Unknown
  misc_feature (1)..( 3000): cDNA_ID_2105302_gDNA_ID_1620555_Annot_ID_160420 3000 nt of promoter + ATG
acagaaggcacaacaatttaaaataaaaactggatcgtgggtgcattaaacaaagtgattttgttttccattctcttttagcaagaatagtaataaaatggaagtggcagaaaacaaaaatttgaataataaaaagggattaataagaagtgagaaaaaatggagaattagtaataaaattacaaaaaatgaggaagagaaatcacgtgaaggagttgagatcacgtcaggcacatgtggggagtaggacagtcctcgtttatagatttgttatcttcaactctcctctcttcggtttctccgttctcttttgtctttttctttcacctttttttttttttttaatttttttacttcaagagaagtgtttagtcataatacgcttcaatcttaacaaatcataatttatgtgggttgttgtctctggcttcttcacacttttttaggtactaatggaatggacaaagacggtttttgttgatgcagaaatgacgcatgggtttatttggcgttggaccaaagagtaatgtctttgtatttggatatatatataaacaaattggtgtttcttgtaatgtaaacattggtgtgattacacgaccttgtaacggtttaaaactttgtcaagcgtcaaccaaattttcactgacgtcaaactgtcaatgtcaaaaggtgtgattcgccaaatagacatttatttttccatactacaaaaaaatgatttgtagctgtaaatgtgagtaagaaattagttggcatattttaaagagtaaatatattttatgagagattttgcaagagctggatattttctcagacaggccatcatccctgtaattttttttttctttctatgtcaaataaataaataattactttttggcgacaaaaaaaactttttgagcacttcattactttaaagtgtaaccatttttctaaataaatcatgattttatttgcttttctaaatcaactattaaaatacttaggtggaaatcaaataattggttacagtaacagaattatatattgagagcctttttcaccaaataacgtgatagtttgtgtgtttattactgtattatgtaggcactgataatgatacaaatgatttcatatatgaattttgatgaaaagcatggctattgggatttgggaaaacatttctcatcacagccgtagtttttttttttatataaataagaggcattttatataaaattttttactacacattagtttctaaaatactacattgtaatctgaataagatgaaagtgaatgactaattcacaattgttttggcttaaaaaaaacactcatttgaagatcccttaagagttgagagaaagatataaggaactctcattagcattcataatgtataatgttttcaagatattttaggcagtgctttttttgcttcaatcataacatatcaaaactaaatgttaaagattgttgtaataactattatgataagaaaagttgtaatgaactttttgccaataaacaatatataagatcgtcggcttagtaacctcacgaggatggaatgtgctttaggtacatcaacaaacatgtaggaggactgtttcgctaaaagcatttagaaaacaaaaatcaatacaatcaacccataaaatgcatttaaaaaaaaaacgaattggacaattacatttccttcattgggcacatgtcttcctgtaatttattgtgatttacataccaaaagaaagatatatttttctatttaaaagaaatttaaactgctaagatttgttgcctttttttatttatttgcttttacctatttatagcagtaaactcttttcagaaaaaatatccctacaaagaatttgtcctcatattccttttatatgctaactgctaagtaagaaattatattttggaagatatgtctaattaagctctaggttcgatttacatataatttctaaatgttaaaagagttggtaaaaatatattaaatactgatataagtaaaaacaatttatttttattttcttacatcagaattataaactaaaaaattgctcataaatataacacatgtgatttatcaacattacaactaacatcgaatttttaattgcgataacaacaaagaaacttagaaatatgaaaaaccacttatacaaacccatgaaaaatatacattatatatttcttaatttctatatttttgcgttattattaccttttttattttaaaattatataaaaaaatgggaaataaaaaataccttgttttgagcgaaaaatgcaagtgaagcaggctggcttgaatcacgttttattataaagacaaatgctctcacactcttggggacactttcacatctcatcctctcactctctctctcctttggattcttcaggtactctctctacctctctttctctctctgtctcagtcgctgacttatcatttcctgtcgttagatctctcagtacttggttcatagttgtttcatagcacgcactagtgaactatgtgggttttttaattttaatcatctcagtcttggagaatttcaaacaaagtttcaaactttgctcaccaacttttatttatttattttggtggtagaaaacagactttgatggctttgtaggaatactagatgtgtagatctaaagattataaccattttctgtgttcttgttctttcagaacataacttcatgtctttttgtctctctgttcactagctctctgtttccatggactccacactatcttcttcttacagatttatttcatacacatacactgatacacatgtgtgtatacgtatgtgtttatgtgtgcttattatactctttttggattcaagaaactaatctttagtatttttgacattctggtagatttatgctcacttcttaggccttgttgacttttacagtgatggattttgaaactctggttgatttgattttctttttggtttgatgcagtgaggagaggaaatg

SEQ ID NO: 2566 - DNA, 3000 bp, Unknown
  misc_feature (1)..( 3000): cDNA_ID_3068542_gDNA_ID_1620556_Annot_ID_160451 3000 nt of promoter + ATG
ctgagcactgaagagagaacgctcctgcttgacttgttccgcaaacaaaagcaagatcctggtgcatcaactgtagttacccaacttccagctgtgcaaattctgctcgcaagactaattatgattgcagttagttactgtggaaacgattttaacgaggatgattgggattttgtcttttctaatctgaagcgtctgattcaatctgcagtagttgtgatggaggaaacttccgagaacgtcaacgacttcattagtggtgtttcttccatggagaaggagaaggagaatgatacccttgaaggacttgggcatatagtttttatctctgatccttctataaacagtgctcagaatgctctctcagcattttcgttgcttaatgcgttagtaaaccataaatctgttgaaggtgaagacaatctgaaatccttggcagatgaaacatgggatcctgttaaagatcgaatacttgaaggtgttctgcgtcttttcttctgcacgggtcttactgaggctattgctgcttcatattccccagaggcagcatctattgttgcttcatttcgagttgatcatctgcagttctgggagctggtagctcaccttgtagtagactcttctccacgcgcaagagatagagctgtcagagcagtggaattctggggactaagcagaggatctataagctctttgtatgcaataatgttctcttccaatccaatcccgtcattgcaacttgctgcatacactgttttgtctaccgaacctatttccaggctggccatagttgctgatttgaatgcaccactgaatgatgagtctctcaatgatcaggactcaagcaatgctggtttaccatctgaagacaagctactgctaagagatgaagtatcttgtatggttgagaagttagatcatgaacttcttgatacggacttgactgcgccagaaagggtaattcttacttttcaaaagctttatttggtttattttccctctttgggcaagtcattcactgtttaatcacttttaatggcaggtgcaaacgttcctggcgtggtctttgttactctccaatgttaactctttaccttcactaacccaaggacgagagagactggtgcaatatatagaaaaaactgcaaatccgttgatattagatagtctttttcagcacattcctctagaattatacatgggacagagcttgaagaaaaaagatggggatattccgtctgagttatctgtggtagcttcagcagccactcgtgcgattattacgggttcgtccctgtcaacggttgaatcactttggcctattgaaactggaaagatggcttcgcttgctggggcgatatatggtctgatgttacgtgtccttccagcttatgttagagaatggtttagcgaaatgcgtgaccgttctgcatcatctcttattgaagcatttacaagaacgtggtgcagcccatctctaatcaagaacgaactgtctcaggtatgtacaataaaaaaccttttctcatctctgagagttgcagtgaagatccactaatgcatttgcaaatattctgttcattgtttatgtgagccgcagataaagaaggcagactttaatgatgagagcttttcagtcagcataagtaaagcggcaaatgaggtagttgctacatatacgaaggatgaaacggggatggatctcgtgatccggcttccagtttcttacccactcaagcctgttgacgttaattgcgcaaaaagtattggaataagcgaagcgaagcagaggaagtggttgatgtctatgcaaatgtttgttcgtcatcaggtactgtactttatgagtcatatcgatctttgttaacctgaatgatatctccagttccatcatgtagaccatatatgattaatcttgtcctctccatctaagcccaaattgagtgcctgtcttgattgaatgtttttcttcttcttctttttctaatgtgttgttactgaaagcagaatggggctctggcggaggcgataaggatatggaagcgaaattcggacaaggaatttgaaggagtagaagactgcccgatatgttacagtgtgatacacatagggaatcacagccttccaaggcgagcttgcgtgacttgcaagtacaagtttcacaaagcatgtttagacaagtggttctacacgtctaataagaaactctgccccttgtgccaatctccttgctaatacaatagctgaggatatacatttttgtgacattagtctgtgagttttgctttaactctttaacgttcttaggttttactttccaagaaaataaaagggtttaggtggaaccgcattgccattgatatacatatacccgtatcatatgtgaaaattggaaaagtaataaatagagaaatttacttcgggtacacacacacatgtagtagacccggtcgagaatacaagctaattaataagcgaaagatttgggtgactaattttttttttcctttaattattttattttatggtcaatgcatatatcttaacagacaccaaaacacatagaaatacattaccaaaaaaaaggaatatatttaagctggggattcgcggaggtaaatgagaaaatacaaaaggaaacatatatttaaatttaagaaaacaactaaatgttgtaataataaaggaaacaaataattgaaattaaaaaataaagtgcaacgtccttcgaaatcgtcctcactaagaaatgatgggatttttgatatatcttggaaagaaataatcccagtttgtttccaaaatggcgtaagaagaataagtcaaagctattaattgcaatttaaacaaaaaaaacgttcgttattataacgcaaagactagaaataaaaagaatatttcgaaatatataaactctcctccatcgcattcacatatatcaaagaacaaacaacgaatatcaatattacttttgagttttgtatctgtttgtaagagaaa

SEQ ID NO: 2567 - DNA, 3000 bp, Unknown
  misc_feature (1)..( 3000): cDNA_ID_2163280_gDNA_ID_1620556_Annot_ID_160458 3000 nt of promoter + ATG
tctcaagcaagcttggggaagtctcgatgctctcatcggccgtctaagggctgctttcgaggaaatcggcggtggtcttcctgagtcaaaccctttcgctgccaaggctgttaggatctatcttaaagaagtccgtcaaacacaggctaaggctcgagggattccttacgacaagaagaaaagaaaacgtccgcatacagacacggcaactccaatcgccggtgacggagacgatgccgaaggaagtggtggtgctgctttggtcgttacggctgcaactacggtatagtggagacgatccagctactagctagatgctaaaatcttaaaagaattacggtatagtaattcttgagttctttactttttttataaattatatatttcgtttagttaattatttgagatgtaaattgcaatttatatagatggaaaagacgatcaccgattattagtaaaatgagatcttatttatatttcatttattatctttcaccgtgattgatagatagatcagtacgaaagtgtgtaatggtgatgtgtggacgtgcgaagtctcgggtctaacgtgagtcgtgatttctctgaaaagtcataaatcttcaggtgctttcttttaaaagctttaggaatgatgatcatcatcttcttactttcactttattttcatgttcttctttacaaatccaacctctaaaaaaaagatttagttcttgttttgatttaggatactatttacatttggtacacctagaaatgtggacaacttttttttttttccatgaaatttacaaaagaggaataatggtacaagctcaagaattcatttatcttagaatagcaaaaacaaaaaataatagtgggtggtctttgattaattatacaagttcaattttgaaaaggactagtgaccaacctagcattaattctcttggtaaaccaatagtccaatagactgattattaatcgcggacatattattaccaaacaaaagaaaaatggtacattgaaaaaaacgatttaattaggaacgtcaacagcaggattcgaacctgcgcaggcaaagcccaacagatttcgagtctgtctccttaaccactcggacatattgacatttcgtgataattgcaacactggatttatataaacaaaactaaatcacttaaaacacttaaagatattctcatgttcaaactttaaagaaaaatctcagagaggccagattaataaatattaattggatgttcataccataccataggccagcttatttattacaaaagtgcaaaatcgtatatcatatgaaatgtttctgctgcctagagattgtgttaattgctcaatcaaacagagttacagaggtaggtattaagagataaatcctttgcttttaagactctccacaccttccttgatgatttcctccatggaaatgaactttaaccccaaatctatgagcttctttgatgcattcttatctcgaagtaaacccggttgagtctctctcggtaacctaagagatttttccaattcaagttattgaaatctctctctctatatataacgtctgtttcaaagaaaaatttgtggcttacttggggacattgtaattgggatagagctcagcaactttggctacaaaatcaccgtagtgagagatagcctcaacgcacaagtgccttcctttcgaatatggatcctcgtatacaagaatatgagctaaagccacatccttgaaatgcacagaccccataaagaagttctcgtatgtctccgtgcaccctaagcatccatatctattcaaattcaaagatgttccatggaactcaagacatattcaatcaaacattcatagagaaccaaaataccctgaagaaggcgtagaagcatgtgcatgctagcgttaagagacggaggaatcacaggccccatgacagtgcctggattcaccacaaccacatccaatcctttctcctctgcaaattcccaagctgccttctcagcaagcgtcttcgacagtggataccacaactaccaacaacaacacatcatctataaagataaccaataagatgttttgcagtaacaaatcttaaattagagaataacatactccattttgcctgcagtagtcttcagcagcccaacattcctcattcttgatcttatcagcaggccagttgggacttggagtaatcgccgatatcgaagacgtcacaacaactctcttaacactggcttcttttgccgccgtcagaacatttatggttcctttaaccgccgggtcaagtagttgcttctgtgaatacactcatttatttatatacatttgaagtgatcaaattcactattggtcctttttgggagtggagattagaacctggggatcttggacttcatcgacgatacaaggtgatgcgaggtggaatacgccggagcaaccattgatggcggcggaaacggtgtcgtattgtaggagatccatctcgaatagatggaggcgtgtggctgcaccttcgagaccttctagatgtttcgtctctttctcatcctctgcaacacagaaatgtaagggaattaggaggtgatagggtaaccagaagcgtaatcgaagagagaaatttgtgaagattacggaggtttttcacggtggcgtggacggagtagccgcggaggaggagctgatggaccagccacgagccgatgcagccactggcgccggtgacacagactacttctctctcgtccgttaacattgatgattgaatttgagctttctctctctctgtctctctaagtttcagataatttctatttcagagatgatgatgattagggaatgtgaagcccaagcccaatttctaaacaccgtgtcgttttgatagctaaataacagtgagatgctgagtcgtgaaacggcacgcagtgttttgtttttttaaacattgaatttctcggcccgacattatcgtggaagtacgagattcactggatttgatg

SEQ ID NO: 2568 - DNA, 3000 bp, Unknown
  misc_feature (1)..( 3000): cDNA_ID_1393705_gDNA_ID_1620556_Annot_ID_160459 3000 nt of promoter + ATG
catacgaaccattttccctctgactaccactaccatagctaccaccactcctacttccaccatcatatctactactctcatagctcctaccactatcgtttctaccaccacgaccacccccacgatcactgtcacctccacctcggctatatccaccacctccacgatcattagcaccagaactagtaccagaaggagcaagtgcaccacacttgttacattcaactctccttgcaaagttcacgttcccacaactatacaaacagtttcgagggtaaacaatttcaaaacatgctcccacaaaggaattcaacagctaattcaattcattacatatgcagaaagaatggaatcccaaataatttgcaatcattacctggggttgggacaacgccaatctccatctctgcctccgccgccacttcctcttccaccgcgatcacctccttgatatccaccacctccaccgcctaaatcaaaacgaatcatcgaaatagtgagaaactaaagatttaacaaaagtagctcagcaaggaatggagaaatctaaagaatcataaggttatatcaatcagatctgcaacaatctaaatcacaaacctcgatttcctctaccaccgcctccaccgtaaccaccgcgtccgccgtaactacctccgccagaggcaccgcgtccaccatatccagcatcaccacctccataacctccccctccgccgtatccatcaccaccgtacgacggaataggcgcacctccgccgccgtcttgattgtacatcccagccatgacctagggtttgcgataaacaacagaccaaaactcttaacgaatcgtgtgagagcctttttagacgtagaataaaaaatctcgcgttttatttatatttctctcaaaaatagtggaactttattattgcatttatcttaaatcttaaattcttttacatcttatcttttaccgaccggtttcccaaaataactggacttgctttttttatcaaataagacaacatggttctaaggcccataatcatctaacctttacgaaggcccagcccaataacagttattttttacgtagcccaatacagttttgaaatgtggctattagagagaaattagaggcaaaatccaccaaaattttgctataactacaactttaaaagagtccggacagtaggaacaataagaggagaggccagctctgaaagaaatttggagtttgcgaagatgaatgagaagtgtcaagttgaatcgagaaccggcaattatcctcagaaggatcaacagtagtgatcaaaccaagtccaccaaagttgcagctttctgcactgtgatcattttgctggtacaagctattgaacgcgtatgaaacgttgcctggccatctgatgcctgaacacgacccgccaggaagtatcgatgtacagtccgcaacagcacacgcttctaatgctcttgctgacgcgtttgacaagtccttgttattgttcaccacacaccacttaggaggaaggtactgaacattctgcgcgtttacctgattcttatggttgaaactgaaattgtatttggcttgaccgtcgaaagtgaacactccccagtgcctctcaaagttcccagcagataagtttctctgatcttcgtccaagagactttcaatgtaggtttcaacaggaggacgcgggagagaggccgtctttttctccaagtgaactatcagtcctttaaagaacgcctcagcagtcagtgatgttgcattttctgctccatctgtaggccaaccgatctttgacacaacgatatccacctccgaaaacccaattgtgaacaatgcagagacaagtgtgtcatagcttagatcaaagctgtttctgtaggttttacgtccgtctttgtgagcctttgctgtttctttaaagaggctaaagtcaagggagatgttcttgttctggtgaaagcttaggaaaggagagattgtcacaaaaaaaggagagtggtgctttgtgagaaaggagaggagttcaatcatcgtcttgttgaggtcagccctaaagtgtcctgaagaaggtcgaccagattcagaaagaaaggaatcaaagcttgaggggactacaaccttcacttcatttgccaagttcgccttaactaaagcattttggatattcatagctgccccaatcacaaaaggcttatactgattgccatagctctggagaaatggctcttctccaactgctacatacctgaaaatcaattcttttctttaatgataatttcacaataagaagattggcaatttggcattgaaacaaatccgactcattcacattccataagttaaattccagcttaaaaatcttaaatctatatatatataactggataagcagaagagaaggagaaagaagatactcgattcgaactctgtttccaccgttgaagtaacgagtgacattgtcatgtacccagctctctgctacctttacggatgcattcaagctcttgagcatcgaattttggattccgatagtgacaccaatattagaaccagagagagctcggagaacttttgggtcggcatcgaagagcttcactttgacaatgccgtttgatttcagaagctctacaacctttgaaggcggaagagggtgcgacgcttctgtcccccaatttatgccaactgctctgacggttgttcccgtcaagctcaaccctgccgtgacggcgaggaggaggagaaacagccgacgagccatcaaatccagtgaatctcgtacttccacgataatgtcgggccgagaaattcaatgtttaaaaaaacaaaacactgcgtgccgtttcacgactcagcatctcactgttatttagctatcaaaacgacacggtgtttagaaattgggcttgggcttcacattccctaatcatcatcatctctgaaatagaaattatctgaaacttagagagacagagagagagaaagctcaaattcaatcatca

SEQ ID NO: 2569 - DNA, 3000 bp, Unknown
  misc_feature (1)..( 3000): cDNA_ID_3068550_gDNA_ID_1620556_Annot_ID_160464 3000 nt of promoter + ATG
tatgtggtccgttaatacaacattacgctgcaatctcggataacaacagtttcggacctatatactctattacgagtatttttcccaaacggaaggatcaaatttaatctcatgtggatttgtgttgttctatttatagaaattttaggctgtataatatctatcctatcaatctatggctaattaaatttcctacaattttagaacttaaataaatgcaaagtatcgatagctactacacatctatggtcagaaaaattagttgctatcttattaggatttcataattcatctaagttcagttttaaaataaaatatttattcttaccctgcaatttaattcaaaagaagtattcaagtcttcaatatctttactaaatacagaaaatatcaaaatatttgtaatcagaattcacctcacctgtattaattacagatttgatcttcttattaataagtgtgttcaacctacaaatcttggaaaatggagaaagtattaaacagaatactaactatatttagcatctaatttcttttacctaattataattagtaacgctaaaatcacaaccaaatgttagaaaccaaaacaaaaacaaaataaggagagagatttaacaattccaaaaatcttccaaccacttttttattaaccagccctctctcttcttccccaaatctccattttctctgcaaatcccaaatccatcacaaaccctaattttagtctctcaaaatctccaccgtttctaccaccgtcaatgtggcggccgtggcgtaaatcgtcggttaagattcacgacacatactctccaaccaccgcttccttcaaagacattcaccatctctgctccgacgactcaccttccttcccttcttctccctctccatctccaaaaaccgcttctagagtcttccaccgagtccgtgcagctaatttgatcctcaaatcgtggccaactcgtcaatctaatcacctcctccgcgcagattccgaacctatcaatctaagccggaatcaaaatccagaatcagattcgaaacaatcgaaaaccaaaaccgaaccagatgtacggatttcaatcccaggcgcagagaaaagcattgtcgtatacttcacaagcctacgcgtggttcgtccaacattcgaagcctgcaaatccgttacatcgatcctccatagcttcccggtacgaatcgacgaacgagatctctcaatggacgcgtcattctccaccgagctacaacgaatcttcgggaaggatcagaaccagaaccagaaccaggcgaagacgccgaagctgccgcgagtcttcatcggtggtcggtacataggaggagcggaggaggtgaaacagctacacgagatcggagagttgaagaaacttgtgcaagagttgccgaagattgaaccaggggtatgtgagatgtgtggtggtcatagattcgtgccgtgtaaggattgtcatggtagccataaggtgcatacggagaagctagggttcagaacttgcttaacctgtaacgagaatggtctcgtcaggtgttcttcttgttcatttccacaatctcctccaccctaattcctagattttcagtttttttttttcaatttcaattttcgaataccagaaattggaataattaaatattggtttttaatctaatttttaagaagtttccaattttgtataattcgtaatggaaaagaagtagtttcggattattagattcgtcgaaagaaaaaacaaatcattagatcatgtgatgaacgtgattagcagctaagtactatttgctgtccaagagtatatatattttcaaattttaaattatagatctgaaatgttgtacggaagaggaaaaaaaataaaccagaggtctaaattgttagtataaaatatagcaaaagtagcaaagattaataattgatggacgttaacacatttctggcctaagaaagaatgtatatgtacatgtgcgcattacatttcatgttatttttgacattattattactcgatttataaaaattataacgcttcatagatgaacaattgattgtccatatcgttgagttaacgtacaaaataatgttggctgtttgagtttttatttatatcaaattttccgagaataggtgaaaatgaaatataaccattggtccactgcaaatatttttagtatttatttatcaaaaaaaaaagcaaaagattattattttttaatgatttttaatttgtaactctgccataccatgattttaaaataaatattatgcacttgtaaaaagtaacaactctaatgaatacaatttgttttacagaaatgaatacaactagattttaacctgcggtataccgcgaagacaatttacttttttaaaattaatatatataaaagtttgcaaattatatctatctataaaatatttttattttctagtttacaattgttattaagtaaagtcctttcaaactcgtcttaccaaactcgtcccgtaaaaaaacctgaagtacaccgctaatttaaatatataattaaaataaatattttacgggattgcaattgtattttagtttgtcaaacagatttttgttttaaatagttgccaaaataagatttagtgaattgataagaaatgtatttagatgcgttttgctcattttaaaggattgcaattgtattttggtttgtcaaacattttttgttttatatagttgtcaaaatctagttcaaatgttggaaaaacatgcgtgatatatgggattggaaaatatttagaatgtttttcgtttgttaatcaatttattgccaaaaaaaccatcaattaaaagctaatggcaaccattgtaaataagtttgaactccacgatttatttcacaaaatcgctgcaaaaatgtatatatagattttatatatcagttattatgttctaacataagacattgtatatattaggtaaatactgttatttatcttagttaatttatatgtta

SEQ ID NO: 2570 - DNA, 3000 bp, Unknown
  misc_feature (1)..( 3000): cDNA_ID_3068562_gDNA_ID_1620556_Annot_ID_160454 3000 nt of promoter + ATG
gtttcccattttctctgcgtatccaacctgcgtccaattcaagaacacaactctttctttaaaactctggactctttgattactagcaaatttatatattcctatcctctcttctaccgcattatctttaaaagaactcattttcatttgcctacaagagacccatgaatgccatctttttattctacttctccactcttgaaatctcactaagaatgaaatcacacactttgtgcttaaactaaacaatctccttatcacattcttcactctattgggcaattaagaaaggcatcatccttctaatgttaatgtgctgcataataataacgtacctggttaacaacaaaacccttcatcatgttcatgaagtctgcacgcctttctctgtccaacctctcaacctcagatcggttgttttcctgcaatgatacaaatttacacagagcataaccaaaatattcatatcatgttggtaaaacagcacaagttgtgatatgcatagggttattactaaataccttgattcgctcataccctttgatggcaacattttttgcatcctcagtgaccttgattgtttcttttaactcttctatttttcggatccttgatttgtcaccaccaaataccttcgatgatgcagcctctagcttctcaactctagtttgcagagaaggaagctctgatagaagcgtctgaactgtcagtaaagcactagatctatctgcaaatgcgccttggacagccatcatcatgccaaggtactcatggagtgtgtcctgaaatgaacaattaaaataaaagaacagctcttagtgaagctcaaattccagcagcatctccaacataagctgacaatctgccaagtgtccactagttaataatgaagatacttgctacgcatggcgagatttccgaaatcctaatgtcaatcgcttaaatcgaaatgatcatttttttcagatgaagaaaagaaaataacatttcatttgattccaagtaagggaggtagctgtataattctgtagttatttaccaagtgtttgacagtttgggaattcaactccctataaaatctgcttgcttttacagcagcagtggctaaattcttcatatcattagcacgagttctttgggggttgcagacagcttcctcgttctcgaacttagtcagcttaatgaatgctaatcccagttcacccatggtttcacccatgtcttgctgtgctttcacaagggattccgcctacaaaaagaaaccacaaaagggggttgttccaagcaggatactacatactgccagaatgatgcacaattcacctaacaagtatgaaattttacctgctgtgaggcattgataatttgctgctcaagatcatgcatcttctccttcttttccaagaactctttatcttcttcaacaacgggaggttttgatccaccccagtcattagaaactgactgcctcagctccttgaataatctcagcagatccctacctcctcttgcaggctgacccacctcagtcaccggcactgcagaggctccgccttcaccgaacaactgttttgggagcttcaccgccccatccaacatccgagaggccacatcagtactcattggtagtggcaacttcccttgcacctgaagaaacactttcaactcgtcactgttcctaataacagggtgtgcacttagcctgcgcaagtatttctccaatgcaactcttctctgctccacgaactcttgtttctgcattacttggctctctacgacgctcttatctggccgtggtggtatgcagaaccctctatacgtctcagccaatcgatcagccaatgtgacaacatctctgaatcttcttcgcacgctaaactccgatgggccgccaaagtcagggagattcgttctggtcgtaatttggtaggtgatgtaagtgtttcctccaacaatggaatttgaaatctcctgctctttctgagggttagatacagtgatcttgatgtaatcagagcttgaagaagaaggagatctcgatagtgaatctgagaattgactatgaaggctattatcctcggtaccgttaatctcgctatctgagttctcatcaaagggactgaagataacatctgcatacgacggaggctcgatgtaggagttatcgctgctgatcggcttagagctgaagctgctgcggaaatcttcgtaggaggatggcgcaaggagtggatcagaatcagctggaatcataacggtcggtggcggcgagagcgggtcacggacgttggagagtgttgacatggcgctacggtaaccagagttcgatgtatcaccgttgacatcgcttatcttcagaggatggtcaccaccatctactcctaggtcgagattctccatatcatccctttgcgcattgagattagtttcttcgaatccatcggcattctctgagcccatcatttcgacttctctggagtaacgacgaactaagctaattgaaattaacagaaaattagggtttgatgatttgggaacaaacggagatcccctgaaatgtgacgctgagcgacggtgtggctatcgaattaaaagaaaccggagtgactaaaatgcgcaggtggggactatgggagcaggagactaacgtgcacaccgtggcgggttaggggtggcacgtgataatggcttaaagtctcgtcaattgacaaatctgccaatgcgtacatgtgatgtgaagaatctgacaactttcaggtaaagtatagtcgccgatgggcttgtttaggcccattaggaaagcccaatattaattattgacggagatagccatatagctgcatccaaacattcttattaggtttcgttaagcagctgcagagcttccctgatcgtgtcgaaatcctgtgtttaactggaaccgagtcttttgatgtaaaaggtcaacaactcataaagacacttcaaaaaggttttccgacaaaattcttatcttctcag

SEQ ID NO: 2571 - DNA, 3000 bp, Unknown
  misc_feature (1)..( 3000): cDNA_ID_2163518_gDNA_ID_1620558_Annot_ID_160513 3000 nt of promoter + ATG
agttgtcacaagcaataactcaatattatcatatcatatattatatttttgaagatgaagatgaagagatttacttcaaattataatttaaggtagaactagaaactaaaatattatcattttaaaaaataattgttgatatgtgactttaatcaataactaggagcgaatcctcactatatttgttgacatatagtgttatcctgtatattttatgattttttataattgaaaaaggagaatatgtaatatttcttttgtttctttttaattaattttttagaaaaaatacaaagattaaaaaatatattaaaactgattataaatatattagtttttatgatttatattttttaataattctaaaccaataatacttaattatttgtcttgaagtttaaaattcatcaataataactaattaataatatatataaaacttaaataatcaacatttttaaaacatttttttcctaaaaaaaaagtaataaaaaaaaaagagtatagtggaaaataaaatgtcaaagttgaaaatttgaattagttaatatttatataactttttaccgttttaattttggatggaaatatggttctcagcttctaataattaattcgaagagagcacaaagcccatcctatggcacacgttccaatgtccaagtttcatagaatatccaaatatattatctgtttaaatattttaataccatcatcttctatcggaatctcaaacaacaagttcgaaaataaattatctgtttaaggtgacgtcattcccgccacgttcttgtagcttcctgatttcatccacgagctaagcaagtagcatcctcttttgtccgttttctcgtgacaactttactacctatacatatacatatacaatcaccgtattaatatgctttgaatcgtctaatcacacattatttgcagtaatatattggtataaacatcatttcttgtttgagcctaggtttgtggtttataatgtttcatatatggatcggattgcaattttagtttaattttctatttgtgttcaggtttgtcacacagattagtttaaaactaaattaggtgaacatatataccatcgtattatgaaccatctgttttaggttccaacttccaacagcaatatcgttctctttttgcatgtggacgtacgtagacaacatgacgtttgtgaatcacgtaaatttgtgtatgttttgtgtgtgtctatttgtttcttacaacggtaatagtagatagtttaaaaagataatttatacgttatgtgagaaattttttaatatatgatcatgtaattattttatttgtttttttcataattccttttcttttaattattttatttgtatttaattgattgatatactacaaaaaattcacactcaaaagaaaacattcaatttattaatatttaaatagactactagcatactagtagcagcacactgatttgggaaaaaaataaacattgttttggattatggacctataaaaactatttttaattgtattttattataaatgatgattttatgattctacaaaaactattcaataacaaacaattctacatacaccatacatgtttatgcttaatggttctattaattatgatggaaaactttaattatgatatacaaaacatgatgaaaagttataaagcatgcaccttgctgacaatctctaataaatttgtttacactaatcaaaaataattcccattgtgtgggaatcaaattccatccatagatgtaaagttttcgtaaaccaaaaaaaaaaacgcttccgagaaaaacaacaacaaaatgtttaggctcaaaagaaaacaagatcaaataaaagaagaaggaaaccgacagcaacaaaatggaaagataggattgccaagtcgtatccaatctcaatctgcgactcaattcaaagcaagatagggtttatctatattcctcgggaaacaaactgtttattttaaaatttattcagtgttcaaatacgattttaaaactttacccacattaatatataatcaccaaataaaatacatagttgacagaaaaaatgacgatacgtaaaattttaaatacatttccttgtaaaagttatttcactttgaagttgctgataaattgtgtatgaatgattgaatatgtatgataagttaaatgtatagcaattgtttcaagtaaaatgtataatgctcttactcttaagtataatgtccatcaatagttgcagattatgtcacaattgatctacattttgaggctttagtgttcaaacgtttgagattggtaggatgatacataaaaaattggtgttctttcttaattgcaccagcttcctttctattagagcgaggctacctagcctatattatacacccattggaaagaatctacgattatttcttaaacccgattcattatatggctaaaatccttgtgcaactctttaattgttcgaaccattctatatacatcacattttttcttaatgacatcaaatgaacgagacaatgaagatgtcaaatggtaattcgtttctgccataatgccctcatacgtgtcacaatcatttaccttccgaaaaaaatataattttagtccaacttggaaaaaagatatatacatcagcacaagtagtttctttttgatcagaaataaattttaaaatattttaatctaatacttcataagaaagcaatatttgccaatgcagaaattagtatataaggagatgatagggaagaagagcaaatatgcttgaagcttctctaatttcatagctcctaacaaagcaatatcatttccaatttataaaagttaaagccatggctgcatctttctctgtcccctctatggtaagaaaacgacccataattctcctttgtattatttgattaagttgaatacaatagaattatttcaccagtaaataagactaacatggaaattgatgatcgataaaccaaatcagataatg

SEQ ID NO: 2572 - DNA, 3000 bp, Unknown
  misc_feature (1)..( 3000): cDNA_ID_2163557_gDNA_ID_1620558_Annot_ID_160527 3000 nt of promoter + ATG
agtcacgaaaatctattattttctgattttctcatgatgaaagggtacgtacacacgtgaaacatgcaaagtagtatgtagcagaatcctagtcacagataacgttcaagaccgttgcattgattgcgctagtttcctagatatcgtcatgcgtgcgatcaatgcgagaccgagagaaagccgcttcaccacacaaagacgagtcaaaaaaaaattaaaattaaaactcattgtgggcttttaatagggacttataaaacaggccattttgtacttattgggctttcttcaaaacaaaaccctaaacccaaaaagaaaaaatagacggtgtagccgctgaaaaaaccctaattcccaaagctaatccgccggcgtttatttgagtatatatacgtttcgtcttctttcctctattcagaacaacatatgcttctttctgcttaataatttcaatgagtctagggttttgttatcaaagttttcgtttttttctggggcgtagaaagggtttatggtgatgaaacgaatatttcgtggactagagtttcagatctgggctcttcacccagaatttgaagaaacaacccttggctgtctgagtaaatcctttttcgcccactataatgaaagtttttgttttggtgttccctttgaattgcctatgatgataaaaacaattatcttagcggatttcagtgaggtttttttaaaatcaatgatctgaattgttacacacactgaggctttattagtttgatttgtttttgtttattggggaaatttggtttgcgatgatgataaaatagcacgaaggtgcgtgaagggcagtggacaaagcaatgaaaatttgttttgccgtgagctctctttaataaacgacttctccttccactgagcattttttagatcttccctaaatctttgtgtttgttattattgttgttaataatgaatggcgtcttttaccaattctgaaggattaaatatggttcctttaggtataatggcattgacgcaatattgattgtggtatatcctgatcatttggcttttttttctatgttatttgatcctggaaatgcctcacacatttgttctatcttctttttcattatttacgaattgggtttcctctgaatttacgatgaggtttgttggttgaatataaagttgttggagcgagatggattgtttggagtgcaatgatgttttcttttctcagatttggtttttctaactgaaattgatgattgttctgttttattattcgattaagaccgtctccaatattaatccctattttttcgttggagatgctcttgcttcttcctgttttagttgtcaaaagtcttatgattgttaatcatttgattaaagacattcgcatacaattctgttatcaataatgagaaggaaaatgtgatgatttaacatacggaacaattatggttgctgtcattacttatacgagttcgatgttgagaattgttggtggataatttgtgttgccttcttgatttcctgcgttgaaacaaaaaggttgccacattttgctggatgaagaattgttggttctgtgtgatgttgtttatgtgatcttcaggtgtgatcttacatgagagactaaaaagagagcaacgggtttggtttgagtttgtttaggtcaaaccatcagagagacattacgagatatcgtatcatacccttgggccaattctgcaatatgcgttggagttttgttaatcttgatcatacctttcatatgcctattatcggctttattgacttagttgtatcacttggtcctatactccttgttccctttctctgataagtctatgacttcgctgttatgatcattgcgtttggtttttgtcgtccctgtttgtaaatttgccaagattgaaaatgtaatttcgaagaaccaaaattgtatcacaaggcaaatattttatatacttctaactctcccaaaatatcgagcattatcttaatatctttactatgtcaacttttggcaaaactttattagaaatctgaaaataaaactcacaagattaattatttttcagaaaagagaaactaatatataggacttacctatattaattgtttagagatattcatactccatttacttgaacttttttattaagtgttcagattatgttccatctcttgtattttattgcttttttctctacacataagaacctttcagtttccatttatgaagatttataaaatggtacagatactttagtaaaatgttgtatcattatatggagagatgtacaaatttatatagagataatattcagtaatttaatttagacagatcatacaaatgttaataacaaaaaagaaaaagaaaaaagacaaaactggaatagaattagagaactaaatacctctaattaaaccggatttgatggtagtatacaaaaccaaaatcttgacattttgttaatccttcgaatacataagggcaaaatagtaaaataccagctctgtttttacttattttctttcttaaaagaaatatataaatacgaaggatcgatccttaaattgtttcagctttctttttgttttcattttccggtaatatcattttcgtccgacttgttttctcctccttgccgttaagttccattgaagaagaagaagaagaaggtgtgattcaacgataaacctagcgagaaaacgaaccgcataaaatcgccattgtaggttttcgattttctcagtcttacatagctcgaaattgatgtataactggtttttattcatgctcgattctagagatttttagaaaatcctattccagtgagaatctagagatttccattttgaagcgtttcttctgtttcgtatgtaggaacgagacggtggtgttaatctatggttatggaggtttgcttgactttttgaggttggcttgacttttgaagttttgatctgaagaaaagaggtttcgttgtaattggtttatacatc

SEQ ID NO: 2573 - DNA, 3000 bp, Unknown
  misc_feature (1)..( 3000): cDNA_ID_3068622_gDNA_ID_1620558_Annot_ID_160528 3000 nt of promoter + ATG
aaaagaagaattatatagaaacttaggagtaaacactgtaaaacacgaattttctaattaaaaaaaaagttgtagttataatctaaaagacacatagaaaaatactttagtggaaattaaaacaacataacatgagtagataacttaatgattttgtgacttacttgacacgatacatcatacatgtatctatgaaagttagggcttacatactaacttacaagtaaacacataaaaatgttgtggttttaatcaaaaagacacataaaaaaaagacttaatggaagaacaacatcaacatgagtagacatacaacttcatgctttcgtgacttacttgacacgatacatgcatctatgaaagttagggcttataaatagacaagactcataggttcataacttcattaccttattactcaatcattttctcaattcttcaatctttcatcaaaatttcttccagagaaaaaaaacaaatctcccccacaaagaaaacaacaatgtcgacgaaaaagatcatgttgaagagctccgagggtaaaacgtttgagattgaagaagagaccgcacgccaatgccagaccatagctcatatgattgaagccgaatgtacagataacgtaatcctggttttaaagatgacaagcgagattcttgagatggtgatcgagtactgcaacaagcaccacgtcgatgccgctaatccttgctccgacgatgatctcgagaagtgggacaaggagttcatggaaaaagataaatccacgatctttgctctcaccaatgctgcgaatttcctaaacaacaaaagccttcttcatctagcaggccaaaccgtcgcggatatgatcaaaggcaacactccgaagcagatgcgcgaattcttcaacattgagaatgatttaacacctgaggaagaagcagcgattcgtagggagaataaatgggcttttgaatgagcggattatcaaaacctaaacagctttctttcttttcttttctttcttatttagtatgtgtttcgttatcaatctaggtgatggtgacttcatctacgttcgatgatccaataatgaaagcagctgctttctttcttttatcttttttttctttggtgtgtttaagtgtttttcaatttcttgatcaatgtaattgatgatgacttcatcaaagtttattaattaaataatgaaagtagacatatatttcgttctttgtgaaagtaaaaaatactcctttttactcaataatatacttttgtattcctatagttgttttgactaaaattctgatagtttatgtcttgtttaaaccttataaaatgtatttaaagttatacatatcttgagtcaaaataattaaagttatagatttaattaaaaaactatactgacatattcttattcttattcttatccttattaacaaaattgagatatatacaaaattgtttaacaaacaaaagagttcttgagatttataaatttgttgcaaaacaattattgaaacatgtaaaattttaactaaaggttgtagattgttaacattgggtatgtctttcaaattcacatataagacgtgatatttatgcatttacagaaagtgtgtgcattaatctatactatatgaaaaaggtttaatactttattttgagtcgatcggtgcttaaagttcaatggattaaaaaaaggaactacataaaaatttaggagtaattaaatactgtaagcaagagtttccctagttaaaaaaaaaaagttgcagttttaatcaaaatgacacagaataggtaaatatatcaaagactttgtggaagaacaacatcaacatgagtagatatataaagtgatgcttttatgtgacttacatgacacacaatacatctataaattgaggaaagcattaacaagaacgaagaagaagaacaaaaacaaaatatatatacaaaactctttttctcttgttctactacgaaaagaagaattcaagaaatggttcttacagaggctgagattgaagccgaattggatcgtctcatggaagcaccggaagtagatgaagagcaagtgaaggtaaatgttttttctggtatttttgaaacttctaatgtttttattctatgtagaacacattagttaaacctttgtaaaatctaggatttggagaagagaatgatcgagttcactaaaacaaaccgaggtatagatcccaagtatatgaagacaattgaatatctaaagatggataaacgactcaaatctatgatcaaagttacaggaacttctattgtgaagcagaagtcttcctcttcatcttaattagttggttttttcagatgataagtaaaagaagaattattagtataataaatatgatcatcatcatattcttaaaaaaaaattagtgaatactttaagtttaaggtttgttgtattaattaagaaaactaagaaaggcatgtcttttatcttacttattcgtaaaaggattctcataattaattactcagttttctaataatattttcctgtcctcaatttctttttttgtgtcaacaacatacttcttgattcatataattgttttgaactttgattaaatttttggtaggttatgcttgtttaagttaaccctatataatgtattttaaattttacataattcagtcgaaatatttaaattaaagagatttaattaaaaattatttatacgtttccttactataacctaattttgataacttttaatagtttaatttcaattcaaataaaaagttggatattatggatcaattacaaatagttctaatgcctaaaatcacttcacaaagacaaagtttcactaatttggtttagaaattgaggacgggtatggatccggctcgggtcatccatctcaactccaaagagtctatctggtccttccggacccaaacagtcaaaatagcaccaaattaaaaacacagacgcgccgccgtacgagaaaatctccggctatg

SEQ ID NO: 2574 - DNA, 3000 bp, Unknown
  misc_feature (1)..( 3000): cDNA_ID_2113272_gDNA_ID_1620559_Annot_ID_160544 3000 nt of promoter + ATG
acgaatcctaaacatccataatgacggtggtgggggtaaatatttgggtttaccagaacagattggaggaaaaaaggagatctttacctatattgttgatcgggtacaacaaaaaacaaaagggtggtcaactcgatttctatcagaagccggaaaagaaatcttaataaagacagtggctttgtcattaccagtttacacaatgaactgtttcaaacttccaaaggggatatgtgatgatatcaacagattacttgcgtcttactggtggagtaaaagctcggataagagatcaatgcactggatggcttggaagcggctgaccataccaaagaatgaaggcgggttaggatttagggacattgaatgctttaataaagccatgttagcaaaacaagtgtggcgaatacttcaagcaccatcatccctgctcactcgcctcttacgtggaaggtactttgaaacaacaaatattctgaatgcaagaaccggaggaagccctctttcatttggagatccattctagaaggacgagacctcctgcagcaaggacttcgaatccttatagaagatggcaaacagacaaacatatggactgattcatggcttccaacacacccaccaagaccacctcaaaaacgtgatgcgacggtcaccaatcatacacaagtcaagcacctaatgcaagatggcagaaacatgtggaataaagaagtaatagaagaactctttgaagcagatgaagcacgattgatacaaggttaagattaagatcacaaccgtcccctgatgtactaggctggaactacacaaagcatggggaatacacattcaaatcaagttattggctctgtacacatctaccgaatcaacaacatgattatgttcccccaccaggtttacccgagtttaagagagtagtatggaagctagacacgacaccaaaactaaagcacttcatgtggcggatagtaactcaatcattggcgacaggcgaggccttgacacgacgacatatcatttcagattcacagtgtaaacgatgttgtgcagctcctgaaacattagaacgcctattctttggatgccattatgttcaagctatttggaggggctctccggtgtcacatacagcgtttttcaatccacacttaccttttgaagataaattcagattaatccttcaatgctgtactgatacgagacaagaccatatcacaagacaaatacctttatggatgttgtggcacatatggaagagcaggaatttgttagtttaccagcgaaaagggagtaattggcaagatgatgtacaaaaagcgataacagactcatatgagtggattcctctgcagcgagacacacaacgacgaagtctaaatgacagaagcgggcaagggtagcaaaaacctattcacggctttatcaaatgcaattatgactgcagtttctcaaggaatgatctagcaccaaaggctggttggattttacgaattgacacaggcagttatctacttgcggctcaaggtacaagacaactatgcaactcagtgctagaagcggaactacaggctctcttgatggcaatgcaacatacatggagtagaggatatcgaaagattatatttgaaggtgataataggactgtggaaagcttactcaatgggaacacaaggaattttgaacttcataacctcgtcatggagatacaacattggcggaagaagttttctactgccattatcaaatggtctttccggtcaactaacaaagcagctgatcgattagctaaagtggagttagaaaacattgttacttttgtctctcattcttatgtacctctgtttcttgtacaaatcctccataggattacacatcatccctctaataaagtatatctgttaatgttaaaaaaaaataaaaaaaaaagaatcggttattttcgggttttaaacttaaaaaccaaagaaaccaatatccgaatcgaaccgaaccgtaataaatttcggttagtttcggaagaattttcaaaaatccaaaataaccgaaacccgaaataaccgactcggttcggttcggtttacccgaagtcgcaggcctaatattttatatcaacaattgacatatattttgacccaaaaaaaaaaaatcaacaattgacatatatttgtttttattaaagtttaatttacatattatggaagtctcaaaatatttgttaaacaatggcaaatatttgttagacatatttcatctatttagcatgcacaacacgaatccatatctaatattagaaagaattatcctttgattctttttttctgaaggaaattttgattaatggtaagatttgtttataagcccaaaagcacaaatattctcctacttatagcatgatatattttgaagtgaatgtaaattaagaattattttcgtaacaacaaattttatatttatacaaaataaattaaattcagtttctttctctcttctctttctcggtttccccattttctatctagacaaagagtgttgtctgaattggctctgtctcaaaaaatgaaattctcaaattaaccacaacgatctttagagccttcttcgctcaccgatctctgaaaccctggtttgctctcgtcctcttcgtgtaacgattcttcttcttgataaatttttaatctttgtttcggcttttcgatgaaattgttttttttttggatctcgtctctatcagctcatgttcttctttgattatatgataattgttgtttcctttgctctgttttatgattattgttgatttttgagattgaaatgttcgagggtttctactgttcactgttctttacacgtatcaatgttttcttgatcatgttctcttatgatgttaatagagagactagtgttattgtgatgaatgattcttgttaactaaatttgtcatttttgttttcacttgacattcatttctctaaccatttattataggtagtttctatg

SEQ ID NO: 2575 - DNA, 3000 bp, Unknown
  misc_feature (1)..( 3000): cDNA_ID_4254803_gDNA_ID_1620559_Annot_ID_160563 3000 nt of promoter + ATG
ttgctactgactaaacgaatttgattagtaagttgatttttgaggaattggttagttgatttttgaggaatttaaagatttcaaaagtttagagattttaaaagttttaaaaaatcttatggattcttctcaatgagttgtctaaactctagcaatgattttcatggatttttgtttacttttcctaaacgaagttttacaagacaatattttttccctcttatcatttcatttacttgttttattttactcttttttgtttattaacctaaactaaattatatatttcatatgatataaatccttggcatattttttgtattattatcaattatcactatcgttaatgtaaaatttatgaacttagaatttctactgttatttatgttaacagatgaaagattgatttttttgggttttttgagttttatttttaagagattttgaaagttgtgtcgaagagaattcatgtcccaataacatgagaatttaatagaattgtaaaatcagtgataactaaactttttgaataacaagaaattgtggatggagtttaaaagtcatcaaagcaataacactagaatatactaagaatataataatccattaacgaataaatgtggaatctgaaaaaattttaaattaaaaattcatcaaccaataacaccttcttagcagcaaaactcaaaagttaggcgatcgaatttgattttgtctcaacttagcctgtgaattcaaattatttttctatgattttgtcccttaaattataactgatctacttcatatagactattataactaaaatcatttctagtcaataatagaagatgctacgaacaaaagcacttaattttgaaaccttaaataaaatacatagtataacgatttttatatacttatctattagatcacaaaaactaaattcaatgttaaaaataaagtacataaatttatttgagatatggaagaggtaagaaaatattatttgataaatatatcacaacaattattttgttaaatattacataaataaaatgacacacgaatattatcgaaaatagtcaaatatccaaaatagataatagagatagatcttttcaacttcatttccttgcatgatggtcaaaattgatattttgttacatgtatcaagacttccagtttacaaaggtgaatttgaactaaaataaatatgaaaatcaaagaagaaataagtataatctagtaacacaatataaataaagggttttgtgcaaaaaaaactgaaattgtatattgttgcagctttacccttcacgttaaaaaaatgcaaataatcctataaattttaaaaataatgcgaaatatagccatttttttgcaaatttacatatattgtaaatattttcatgatcacatacatttgtttttgaattagactcttccaatatagcaatctattgaagaaataagtattatttatcaaaaaattgaatttttgacaatagcaaaaaagttaatttgcgtattattttgaaattcataagtattttgcatttttttatgtgaaagataaaattgcaaaaatagacgaatttgaaagttgtttttgcacaaaacccaaaaataaaatacaacaatataggatatatagatcatagcctctaaaaataaatttaaaattagactcttccaatgatgtttcaacccatataacaacagaaaagcaaaacaaaaatatttaaaatttgagataggttcgaagatgattatctttggaacttggttttcttgatgtatatgattaaatttggtgcatatgtaattaagtgtgcactggaccaataaaaaacattgaaaccttatataatatatcttcttatgacacattattatttaaataaacaaacaaacaaaactttaaaagcgtttgcgttcagcgttcagcgttcagcgtttgcgttcgacgtttagagttggcacaaaatccaccaaattaaaaccattcaggcggaggattcaatatatctcacagtttcactctcaacatttcaatatctctctctctctctgtgaagaacaaatacagcgtttcttctgcgattagatctatttcgatactcacgaggattgcctcctgaggagactacatatactaaacaaaatacaagctgaggagactaaatatatttagttaataccaataatatatgatatacaactacatatttacaaacaaagaaaatatagtagatttgtaatatatacataattgagatttgatgattgattaaaccaagaataccgtgcgtagcacgggtactgacatagtatgtgtattattctgaacttcataagattatttttcatttttgatgtgaaagataaagttgcaaaaatggtcgaatttgaaggttttttgcacaaacccagaaataaaataaaacaatataagatatgatcatagcctctgaaaataaatttagaactagactcttccattgatgtttcaacccatataacaacataaaagcaaagcaataagttgaaagatgataatcaaaattaaaaaatgagtatctttgcaacttggttttcttgatgtatataattaaatttgttacatatgtaattaagtgtaaactggacccataagacctttttcatccttgtaagcttaatgggctttatcaatataatgttggccgacaaaaaaaaaaaaaaaaagacccataagaaacattgaaaccagtctggcccatgacccatataatttatctttaaaagagtctgcgttccacgtttgcgttccgagtttgcgttccgtgtttgcgtttagagttggcacaaaatccaccaaatcaaaccagtcgggcggaggattcaatatctcagagtttcactctcaacatttcattctctctctctctctcaacaattagatctgtttcgataatcacgaggtttccctcacttcctttccattgctaaaccaggatttgcctcctgcatttggaa

SEQ ID NO: 2576 - DNA, 3000 bp, Unknown
  misc_feature (1)..( 3000): cDNA_ID_3068657_gDNA_ID_1620559_Annot_ID_160564 3000 nt of promoter + ATG
agctaagatttcgtatagcatctgaaatcgcaaccggtcttcatttcctccaccagatgaaaccggagcctttggtgcaccgtgaccttaaaccgggaaacatattactcgaccagcatttcgtcagcaagatttcagatgtgggcttggccagactcgtccctccatctgttgctgacactgcaacccaatatagaatgacttcaaccgctggaacattcttttacatagatcctgaatatcagcagaccggtatgttgggaactaagtcagacatttactcattcggcattatgcttttgcaaatacttacagctaagccaccaatgggtttaactcatcacgtcgaaaaagccattgaaaagggaactttcgctgagatgttagaccctgctgttcctgactggccattcgaagaagccttggctgcagcaaaacttgctctacaatgtgcaaaattaagacgcaaagacagacctgacttagggaacattgttttgcctgagcttaaaaaactcagggatctagctgaagaaagcattaaatttggtgtaagacagccttcaccgatcaggagctcagggtccgcgacttcgatacaggtattaaatccattaagcaccttctctagattttaaacatgtttcggttagttaaactatatattttccttatgtaggagattataagtgatcctcagctacaatatggatctgatagctcaagtttgcacaacagttctacatcttgaaaaggaaaatccaagtcagaaactatcaaagagagaacaacatacgttaagaggagcaaggcaaactaattttggtcaagatcaagacttgttgttgtcaatagcggttgtataccaaatatttttaaacagagttttaaatctgtttatatgtaatattgggttttacagtgtgctaacactaaacccttgtagttaaccaaaaaaaaaaagaagaaatactaaacccttgtataccacagaatctatacggatttataagagtatataccattttgattttttttttcacaaaggtttagttttattaatatcacaacccatgactacaaaactgaaactggaaaacatataaggcccaacacgagcccaaccatttgcatcgcttaagaagaagattggatcgaactataagatctcaagacaagtgtcaacattgataacgcgtgtaacatgaggagacaaaagatttcagtcatcgtctttcgccgttgaagccatcgattctaccggagattgaaactaacatcgaatgaatcgagtatagattcttctgtaattcaccgataactgcaaaacagaagtaaagatctaatatggaaccattaatctcaatcacttgctttaatcatcaatattattttttttttagattcatcgcaaagcaacggaaatgagataagatctcaaactaatctacttctgttaactaaaccaatcaatgctttaataaaaagaaatagctaaaagcagtagtaataagttgaggaaattgctttggatcttcaactaaattgcaaattgcctaattattttccataaaccgtaaacctaaaggatatgtatgacccttttgagtggagaatcgccacaaacgccaccactaatatacagatccgatgaggtttaaccgcaacttctattaaaaaaaactaatttataagaaaaatgaaaagaagcaaaggagcgctgacggcaaagccgaccattatcgatatgaaagcgacaagagctggccaacaccggaaatagctggtagttgccagatgataatccctatcgagagacaaagccagaaagaatttcggacgaccataagagtcttcagttttctttctctgaaaaatttgagagagaaaagagagagaaaacctatatcctttttttaccattttgattttctgaaggtaaaatcgaaaacttcttaaggaagtaaaacagataaggtagaagaaatgaacactagaaaggttcatggtctagtggcaaagtctacataatgttctcactttaatagtgagataaaaatggaaattttattgtttcttctgtttcagtttataataataatatgtgatgttttcggataattattttgtttcagattaaatgatgttttcagttttctatacaaagttcattagattttatatgttttttttactatttatattttggagtttattttatagttggttgaattgtgttaggtaaataataaatgatgcttttatctatatacaagaaaaaataaatgatctcttaatatatatgcaaaaaacttataaataaaattttttgaagtagaaagagtacaatttatacaaataaattgtttaaaaataaatatcgttttatattttcaatataacctcatctctataaaaaaaaactaaaagtcatcatgattttaaggaatataatttaaatttgaatttgtgtttttatttttaaattcatgtgaaaaacgttaaaataatatttattgtgaatcgaacagagttgaaatctacatttaaaatataaaccaattattatgtaaccaaatttaagttctgaaacgaaatttaatgtgaagaaaaaatgaataatttgtttttccttgcaaaaaaaattaactaagaaactaaaaaaataaattattagtgcaacatcaaactcgtataagttccggtgagcaataaataaaacctaatagtcatcgtaagaaagaaaactggcctacttcataaatgctcgccgcaatttattactaaatcttcccttgtgtaattttcaaagcattcaaacgttgccttcctaaaataaacaattataaggtgatgataatggtcaccaccacaccaataatacgtttctggtcaaacttaacaacacaacacaaaaaaaaacaagaactcattcagattcttctctgatgatccacttcttgtaataataacaaaaacaaacagagtggtttctctatg

SEQ ID NO: 2577 - DNA, 3000 bp, Unknown
  misc_feature (1)..( 3000): cDNA_ID_3068677_gDNA_ID_1620559_Annot_ID_160545 3000 nt of promoter + ATG
aagctctctttgtccgaattggctccgtctcaaatatgagattcccaaaaattgttgtgaacatgtgaactagaattccacatgcatgtgtagtccaaacttgggaggagtaagagcatgagaaaatcaagtgatttcttgcctctactccatctccacaaagaacacaacttccgttcgctccaacattccacaagagaaatctatctcctagacaattttgaatatcaatccaagttatgaaaaaatatttaggagtagagttggggaaccaaactacctgattaccaatcacattttggatttgcttcccaaatcaagtgccaattatgttgggacgagaacttgcacttataggagccattttgccttttccacattgagatatcctgaccagtttaaagaactattgcggttagtgtcaagctcatctttgataatgttcaaatcaagccgatgtcgtctacggcggtgagtagcaagcacgtcagccacgtagcttcgagaggcaatttccagatcaatacttcctcgtgggcctagaatatcgaacaagttcccaagtgtgcaccaaacatcatgctgaaaaaggtaccctcacaagatattacttccacctataaagaggtttcgttattggtctatacttcagaattatttatagccacaaccgggaggagttcccacatacggaccatagcgaagcattatgaaacaaagtttatggacccaatcgacccacattgaatcccctgcagagactaatctccatataagcttcaagacactaaccctattagcctcggatagcaatcttatctcagaccaccctttttgttttggcttacaaatatttttccatacaatctcgcattttttgggtttaactcagatcttgaccatataaaaactggatatagacttttaatttctttaatgcacttacttggcaagcggaaagcggagagccaaaaatttataagacttgaaagtattcattttatcaattggaggcgacccacaaaagataaaaacccaccagttcaagagcttatatgcgttctgattctctctggcgaaggaagagaatctgtccatgtcatacaattagtgagtagtagaagaccaagggaaactatccaagtatattttttcgatgttgagaagtagtccctgccatgaacaaggtagatttcttcaaatctatttttaaccccgaatttgttgcaagctgatcaaagacctacaaaatacctgcaactgaccgagaacttccatccgagaaaattttaagaataagaaacgtaatctctatttcttaacttccgatacaccgtttaactcgagattgagccaccaacacatcaccgattcataactctctctcacaagtgacacatatgtcactgtacattcatcaaacaatgcatgatcctctctcgtaaactagtaaagattatatataaaaggtataaaccaacttaaccgggtcttcttctaaccaaaccaaactgagtctttgctcccacgtgcttataagaaaaccaatatgtcatccgcaaaagacaagtgtgtgagtctcaatgtttttacatctaagatgaattcgtatttgtttatcagcatctgtcttgtcaagcattaatgacaaaacattcatgcaaatgaaaaaatagatatggtgataaggaacagccttgcctcagtctcctcacactccaaataaaggaaacaagctaactcccgtttaacctgaacagaaaaatagtcggtaccaaccaatacacaagttacacaactcgatcaagtgaataaagctttcaagtagattcatggccttaagaatattaagctaaaaaggccattgaacctaataaaaagcttcagagatatcgatcttaagagcgcaacaactagagatggactcgtgacaatccttcactagtaagaatattttcttttgatgttatcgactaggcctggaataataacccgaaccgatttatccgaaccgaaccgaaccaagatttgagcaaatcggttcgggttcggttattagcatataaccgattggaagctttaataaataagaatcggttatcggttatacataaccgaatggttaaccaacatttaatcctaaaccagactaacctagtagactcacatccaaccctaattttctaattgtttcactcgcactctctcactttctcccaccaaacgagatcatgaacgctctcagcctctcaccattcaacatccatcttcttcgttgaatttctctcaccctcacacaaagtcaatccttctcttgatctcttttcgtctctgtttgttcgttctcttttttttgttttaagttagttttcttctcttctttcatcctttcttcatattctcatctctactcttcaattaattcttcttctacacaaaattttctcttttcttttcctttaattagctttaaacaacggattatgatgatgaatttgtttgttcttcttctattgccgacaagacaccgtctgccccccgccactacaacctcttcaaagaagacaaaaccctaatcatttggacttataggcttgtatttgtgtgagcttttatttaatgtttgggcaatcaaagcccaaatggttttaattgaatcccatgaataaaatacgaaaaaattaaaagaaaataaaatttaaactcaaaatggcgatttttttggcgatttatatatggttacttaaccgttctcccaccatcactctggtgacggttcttctctatttttccgacgatgtggtttcctttcgacccatttctccgacggttatctccatgactataccaccttctcgtcgtgatgatattggagcaattgtaaagatctcaagtctatttatacccagatttgcaattcgtctattcacagttcttgaaaaaattatccctcttagactccctttccccttttgatattatcacactctacgcaaaatg

SEQ ID NO: 2578 - DNA, 3000 bp, Unknown
  misc_feature (1)..( 3000): cDNA_ID_2163474_gDNA_ID_1620560_Annot_ID_160580 3000 nt of promoter + ATG
cgtaaatttttgtgcaacctaagcctatgcgttctgattgcgtaatcttaaagcgagaacaattaaattttgagaaaaaaacaaagtaatcacacaaagaaaaaaaaaatcatgtgaacgacaaacaaaccccacataaaatggtgtattcgccactcgttaattggctatgttccgcgtcgctcagcaaatggatcgtgagtgtatcagttacaagtgaagccgaaaagaggaaaagaaaaaaagaataataattgtagattttatcaataatttataccatttcgtttgaaattattgaaagaatttttttaacatcatatttatatatagattttactgtaatgcaagttatggttttcagtaatacaaatttctaacaccgagcccgccattaaggtttatgtagtttctagtagattttacattatgttaaaaacgtaaaatttgaacgatctacatattattatgtatttttctaatatattttttagttgaaacaaccaattttgtaaatagctgtggtatgatcgaatcaagttgaagtgcaacccaaacattaatcgggtctacgtacataaaatctctaatcacgttgaccaagcgctccagctcgatctgctagtaaaaacagaagcaatatattttttatttttttttatgtacttagttagtggtatatatatagttgtaaattgggtatttccaaagaaccaaagtaatgtaaactatacataagcgaaaatttaaacgtttttctattctatagtcttgaaaattaaaacaatatttactaggaaaaagaataatataagggcaccgacagtttctataagaacatgtggcacgagggcttggagaagacagtacacagcattcaatcaatcatgaaaacgacatttgatgtggtaacctactaaagttcgatctttttttatgaaagtttcttaatatttctttaatttccggactatatctatcaacaagtcaaaagattaaaaaaaatcaacaagcaaaatactgttaaaatattgttttatatataccacgaactatttgtcggcaaatgtatacatatagtatagacatcatacatgggcaaatcgcatatatttgtgtgatgtgataccatagtctcaataatttgaacatttttctcttatttaagcacggaggaaaaattagctatatggcgacttggcgagtggagccaagattaaaaaaaaaaaaagcatgttatttaaaaatatggtagacataacatacaaaaaaatatagtaaaataaacagaactgattgaacaaaagagagtgatcaaagttgaaaaataatttaactataaaaactaaaaagaaaattatcagaggatggagatattaaactaataaaaatgtaattaaataagtaaactataaattaaataagtaaaaaattaaacgtaattagaaggaacaaaaaaaactagaaaagtaaaaacataagagaggaaggagggaagcaaaagtgaaaaccaatgcagtcaacagtcaaaaaccatgatacagtccatgcgtagaacataattaacttaagcaataaatttaataagtaaaaaattaaacgtaattagaaggaacaaaaaaaaagtatataaaaaattagaaggaacaaaaaaaaaaactagaaaataggatcttggacacgatgcttacagattgttttttgtctgggaagtaaatgcccatatctgtttctcgacattttgaagtctctctaacaaaataattagaggaattaagaacttgattgtgtaactttttttttaatcttaaattaagataatactatttcattacaactattattttcttgcacatgttgcaagaacgtgagagtgtacgcagacaaataattaaaacgaaaataaaattataatgattatatacaatctcggctatcaattgattaatagagaaaattgactaaccactctgaattggctcaaaatgtagttattaattcaaaccgagtttcacttcatttatattattttcattttttaactttaaaatatatatatttaataaaccaaatatgatctaaactaaatctaaaaggctccatccaaagtagatttgattttactatatatttaaaacatgtatggtaggaaaatttaaccgaaaccaaattaaacacattttagggtgaagaaaatcacccaaaaaaaaaaggtgacttttttttgtaacaaaacaaaagacctaaagtttagagacaaaataaaatgttagggtgattcaatgcatcacataatacagtattgttaataattaatggctaataataatgtgtgtttggaagtttttactaatctcttctttacaacaacaagtggagtggaagagagagatacacacaaggtttaatgggtcccacattcttttacttctcaaaatttaattactaattttatctaattttggtgctctttttcctcatctacataattgcctttaattatctcacaccatttaactaatcactgattctcttcttccttacgcgtttgtacttaacccccttttatcatcatttcgcaggcttgcgtctgtctctctctctctctccaccattgactctctctctctctctcgctctggaatcatcctttatttctgtgactgtgtgcactttcagagaggagagagaggcccaaaaccaaaagaaaagaaaaggttgtggcttgcagctgaatcaataccatctccatatatacaatacaccttcactattcccccttttgtatttttattatatttttcccatcaaagtctgtttttttagactccggtttgccgctttgtgtgtgtgtgagagagagaaagagagctatctatcctctgatttatggtctctggatctctgacaatcgagttgagttaattacaacacattcctctctttctcaatcgatctgtgaaatccaagattgttagctgtgtctgttttcagacaaat

SEQ ID NO: 2579 - DNA, 3000 bp, Unknown
  misc_feature (1)..( 3000): cDNA_ID_2163488_gDNA_ID_1620560_Annot_ID_160585 3000 nt of promoter + ATG
tatgaatttagagcatagactttggacttggatgtatactgttttgtcaattttttaaaaatttcttaaatttgcctcatatatataataatttggatgtagcaaataaattttaacgagtgaaatataaaattgtgaaccatatttcattcacgtggaatagtaatatcaataaaaaaaatagttaattttggatgattgattttaaataaatggaaaaagaaagtagaccaactcttgtcggaaattataggtgaagaaattgagttatagtaatgaatggctaattgggaaacacatgacacaacaaactttacgtcctttttgccatatttaagcactctctataacaatgtccccgacccctactccaataatctacttcccctattctactattgtggtccagtttataccattatttataatccaaattttagtttatgatcaaactttcacgttatcaacgagaatcgcattcatgatttggctaagtaagattttctaagcctaatatttgtattcaaatcctgtaaagctgagatatcctctcttacaataagtcatgaacgcacaaccccaataatgaatgaagagtactcatgaatgaaaatggttccaaaaacatgacacaacaaacttgacgatatcatctcttacaagtctcgatacgaagttagtaatatatctcttcgtccacaattgactacataaatatttttatgtatgtagaacaatattgaatgtaaactaggttattaattacgaatccattatttgacttgcgtattaatcatttgttttcaatgttctgataaatcatattcctttgaaggaccacaactccatctccatgatcaaaggaccactcgattttcaataatctccttgagttttatcccactagtctatatgagatagacaacattatagtgaatatggttatagaatctggatggtttatatcaatttagacatcatgtagaagtacatctaaactgttggtttaaggtcggctggtagtgtgcacccatgatttggcaacatctaaactggtttggttaatagatcatggcaagttattactcccctaacctcatttcctcttcctgtaatatatattgatcttgtatttaaaaacatagaaagaagttagattttgacagtttgaaaactgaggaaagtgttgagaaagagaagaaaaacgtttttcaagagatagtttcaagaaatcaactacaaacaggcatttatcaaaggtgacaagtcattgatcttcgttcgtgatttcatccgaccttttgattaccaaagttcctgaatttttttattactaaactgggttaaggtatgtgtttcggtttaaatttcttacatatacaaatgtgaaattaagtttgtaaccgaaattctgtttctcattcaaaagacgtgattgcataaattatcatcatttatttgctttgcaaacaagaaatattaattttgtggggatagattcatgttaatgtgggaagacagagaaatatcgacgtcaaatccttagacccatatgtctcaataacttccaaaacgttattcaattccgatataaaattgggaccataaactgatcatagaatcattcatctctatatataaacacaaaaaggttcaacaaaagataattctatataaccaaagaaaaaaaactctcttccaaaaatggcaattagggtttcccacaagtctttcctcgtcgcacttcttctcatactcttcatttcctctcctactcaaggtaaatttatagctaatatatatatacacacaagcgcgctcacctcacgagtttctagctatatcaagtataatttgaatgaatcttcttcttgttttttggttgaatatcaaaatatattacccaataatgagttcttgatatataaacattttgattttttagcacgaagcttacgagaagtagtaaggaatagaacgctattggttgtggagaagagtcaagagagtcggaaaataaggcacgaaggtggaggaagtgatgttgatggattgatggatatggattataattctgcgaacaagaaaagaccgatacacaatcgctaataaacacacatgaacttatcgaattcttgtgagatatcctgagatccaaagatatcccgagattttatcttttactaaacataaattataagaagtgagaatgtattttatataagaaaagaagtgagaatgtaaactattattatttataggaacatataaatataaacgactttgtatgcatgtgtacagtattatctcgagggaaaacagttctatacaataatcatagcttgtgtgtgctagctttatgtatggattgcatcatggttttctgtttgtgaaataaaactctataatatattatgtgtatatagaaacccacaaatatcttctttaactctgttgtagtattagttccaataaaataaaattacacctcaaaagagtatttgctgattttatatatcgaattcaaacctacggaagctcccatcccatgaaggtgttgtggatatttgatatcaaaatatgcatataccaaaatacaatcaaatagattataatttaaagtaataggactttggaaaaactaggcaacataccaaataatatatgggatcaaagttttcgacaaatatcgattggttttcagtctccaaacttctttcatttagaaggatagaacttaaattcattagtgtcttaattttgtagttccacaaacaataatccttgtcttaacatataaattagtcttataagtcagtaaaatcatggtgaaatttctctactgcaagtggaaggattcaaaagaaagaaaaataaatccgagcaattgatggattttctgttactgttagagagttgccgaggctcgagcgataatgggccttaaaaaacttactcaaatgggccatatggaccttagattttcatttattacaaatg

SEQ ID NO: 2580 - DNA, 3000 bp, Unknown
  misc_feature (1)..( 3000): cDNA_ID_2163683_gDNA_ID_1620561_Annot_ID_160594 3000 nt of promoter + ATG
cacggatatggtcacaagctgagctagctgcagaaagtgcactagacagcttcctggccttgataatggcagcaccacgttgttgaacggtagagatgaactctccattcaacctacaacattagttgctaacatacatgagcatcacattcacgaaactagattgagatattaaaagggtgttttagagatttttaccactcgtcattcttgactagctcacgcactggcttctctccaacggaagtcttaacggtagcgtggttgacatctgggtattgggttgatgagtggtttccccagataatcacgttcttcacatcagacactggtacgcttaacctctcagacacttgtcccaatgccctgttgtggtcaagcctggtcaagcaagtaatgttcttctctgggatcgatggtgcaaattccttcaggatcaatgcattggtgtttgcagggtttgcaacaaccagaacctacaaaacgaagagatagcaaatatgaaatatctcatacaacaaaataagagattaacttgcttaatttctgcataatgatcataagaacgattcgaaaagacttatcaccttgcagtttggtgcagcatgcttctccaaggcagaagcttgagacttgtaaatggaaacgttcttggacataacatccttcctctccattccttccttcctcgggaaaccaccaaccatgacagcaacattaacaccggtacacgcttcaacagcatcagttgtagccaccacaccttccacagaaaaaacaccaacatcacatttcagcctcaagcaacataccatattccaatacgagcacagtaaaaatatatactagaataaaaacttaccctttagaagagggaaagcagcatcgaccaattccatcttcacaccgttcaaagcttctgctgcaaaagggatgtcaagcatgtggaggatcacaggctgatcagcaccaagcattatcccccttgcaatcataggaacaagagcatatccgatttgtcctgcacaataacagaaacacacttaaacatgatctacacacaaaattacaaatcaatcgccaaataaagcttacaaaatcagaacaaatcatgataaaatcaaataactgatccaaaatgacaattacatctcaaaatgtaacaggattcaccaaatgatccaatcaatttctctcttcagatctcactataggaatcgaaaatatgattcaatgatcgtttacatttttggattatgaaaaattggtgttacataaagatctgacgatacgaatcaataacgagagatggaagaaacaagatcggagaaataagaattttacctgcagctccggtaacaagaacacgaactggttccttcgccatcttataatcgagatcggaaaattatcgccggtgaaaaaaagagagagattgtgaatgatcagtgagagagcgtgaaggtatgaaagcagacctgtgtgtttatttattggtgatggtgaaagctgagatgatccatggattgatgcccacgttatcgaatcatctcgaaccaatatcattttgggaagttataatgggccaatttagtgttaaaataagcccaactaattaagcccatttaatgtttagacgagtttatcgtaccgactaatttggtaaagccctaattaaatggggatgttcaatgtttacttttttcatgtttaattaatattttcttcttttgtaagtggtgtctgaatatataaaactaaagttctagctgtctttgtagaaaatgcatgtcattatatgtttgacactgttattgaagaaatggtctaaacaaaaaaagaagataatataatatcaatcgaaattcgattctattatattactttattctacataataaaatattttatatcagggtttatcgagttagtaataatttttcttattaccaataaaaattaaaaagcaaatttaacaatcaagtgattatatagtattttataaatagtaccaattttttttttatggtgtatctgatagtttcgagacaaattttgttttgtttacttttaaaaatatattatcaaatactcattttttggtagaatattatgtttttttatgatattttttatgtaatagtttcaaatcaaatatcaatattgcttgaggcctaccaaaaaataatcaatattgcttgagcggaagaaaataaagatgctagaaaatattaaaatccaactaattttatgtcattaattatcatctttttcatatagtgacgttactgtttacagttaatgaagaataaatcaaatttggagaaaaagaaaacaaattagttaagcaaaaaaataaaaagttgtaaaaaattagggataaggaaagaaaatctcaaaatctcttcttcaaggccgtctcgtcagatttctttttcatttttcttttaacgtttggtttcgtctctaatccattatcttccttaagaaaaaaaaaattcagcaaaaaaaaaagagaaaaaaatagtgaatcaagctgtctcgtagcagtctttatagatcaaacgataatcgaatccaacgacccattttttttttttttgggtctgatttcgtctctctttgttcttttcaccttttttttttgttttggttttgtctcttccgtttcattttgtgtttcttcaatctgatctaaagcttttgtctgaaaaaaagtgtcagactttctatgaagatgttgttggtcaatgggtgatttttagtttgtgttaaagcagaagcataagattacttggtgaatcgattacaattttgatttgattcagatatttgaagggttcttactagaatttgaattggggatctttgaatttcgatcaggcttttagagaggtagggaacattgaattgagatctgggtcaacttttggttttgttggggattagttgttttaagagatcgaagaaaggaggaagctttttgatttggtaacgatg

SEQ ID NO: 2581 - DNA, 3000 bp, Unknown
  misc_feature (1)..( 3000): cDNA_ID_3068725_gDNA_ID_1620561_Annot_ID_160618 3000 nt of promoter + ATG
tcagtatttggcaatgagaccccatcctgcaaaccaaatcaaatgaacatatataaaacagttataataacaaaatgataatttctcgtattctgataatacctcgacacaaactactgtacttgtctgggctcctatattcacaatacaagctgttgtcaaaccattcccaaaaacggccgatagaccttcttggtggacaactgctgagttaaagtatagctctcccaacacaatagttagcatttcctttatttctgataatatcatgaagccaaaatcagaatacgagttcacatcgatcaagaatatatttagattgaactgtgaaaaagggctggaatacgcataacaagcttaccgcgggtgtcaaatgtttctgggacaacaataacagcatgaaaagagaatctctccttgtgagttatatgaagtttctctaataaaatccagtccaagatagcagttaagtcctcacaaacctgaacaaaaaaaaagaagtatcaactcagtagccagaaaatcccttctacaaagacaggttggaagaaatattggagctatacatacccgttgcgctgaataatgtggcgaaacattgaagtgacctctccgaataggatggtataaacaatatggctcttttggcgatattttcaaagcttcttcaccaaaaatcattttcctatacttgcgtttactctcactagtatctttagagtcagtaacatcaggaacagcttcagatgcactagcatcacctttatcaggagaagtttctgcacaattgatatataacaagtataaacattgaaacccagcataaacatgtataaaaattggggaggatccaaataaaaaccattccagtaaattttactcaactatacgtaacaaatacaaatcctactacgacagggagggaagttgaagcacaagaataatgaattagaatgacacctgctggtgaggcaagagaaattttctcatcctcatacacatcagtccaagtaaagactgaatctttctttatcgtactcgcttgattgtatccgtcgatcctccccatctgcataaactttcagaggtttgtaagcaaagaaaaaaacaagaacaatcagttttcacgcattactcaaattgataaatcaaaaccatactatctgtaacaacatttaagcaaaaacagttagcatcaacaaactattctacttaccttgcgagatgcagagccagaagaagaactttcatccaggaacagtatcttcaacagcgatgccgcctttcagtataaacaaacacaagtaaaagaaatcagtcaacaccaagaagtagattcaattgaaagaagcagcaaagtgaaacacttacagaattataagctctctcacggtcaacatgttgattagtagtgacctcagtgttaagcatctagaatatacaaagaacacacctttacaattcattcaaaagaaaacaaagtaaatcaaaacaaaaattggacaaaacctgatcaacaacagttggtttcccagattgtgtaatgtatcttgcaatacaattaggaacattgaaaggtttctcatccatagccaatcctactcttacattagcagaccctaaaattaaacccaacagcaatcagattccataaaccctaaagcttaaaacccttaattcgaattgaaatttcgaattgagagagaggaatcacctaagttgatgacaacgagattagctcctcgttcagacaaaatctgagtgggggcaacagttttcaagtaatcctgccacgagagatgagaattggattttggttttgccatgaaaatggtgagtgaacctggaaaaaaagagaaaaagattataccattggaagcacaattccttcgctaagttcttcgctggagcaatttgtagaattagggttttgttgtgatacataaaagcttggatcaaagagatagcaaacctaataatctaaaatagataaagtggatttcagattttgtggactgaagattgattggagcaagaagagagagcgggtaactcaaaggtttgaactgagaaagcccaaataacccgcgcgcggcccgtcgtagccttggaaatttcgtcggaggtccgctttccgcttccagaagttttcttaaaagttttcgtaagcccgctgcaatggcgcttatgaaaactttactttgttagaatcttaagtttatgattatgttcgtttgcctatcgctggcaactgaaaccagcgaaagcgatatgtttcgcaaagttgtgattccgttttaaagtatagtggaaaaagtaggatatataagataaaattgctttcaagatcttcttctataatgagactcaaaactaatgtagtgattttggtatttgtgttgatactaacgattcctgatttgaaaagtgcggtgagaacaaataaacagataagataaaatttcttccgagatttttttctataaaaaacttcaaaagtaatgtagtgatttggtatatatgtggatacttatcttcgtattttatatttaacgattcttgatttcaaatgtgcgatgagataaataaaccgataaggattcctgtatggtgagttattctctgatccaattctctgtctggtgaatgaggagtgtagttgccatattaaccatcgtatgatatatggtttggtacttagaagcatctaatagtttcatccaatcatgatatgttttcttaccttaaaagattttttaaatttatgggtatctgagtggtgtggtagtttgttggtttggagtaatgatgcaagatccgtatttcttggttttggtctgaaatgttaacaatgtagtttattaactgtttgttgtaacattagtctttaattctttcgcagaaaatggaaccacgccacacaagttacagaagctgagtgcttgtgtaccatctgtggaaaatggaataacattaggtgcaccccgaactcctccaatg

SEQ ID NO: 2582 - DNA, 3000 bp, Unknown
  misc_feature (1)..( 3000): cDNA_ID_2163768_gDNA_ID_1620561_Annot_ID_160619 3000 nt of promoter + ATG
cgttaacacttcagagactatattttcaagagaggaacacaaaaccttgcactgttgaaaactatttagaggattgataaagctgtaaccaaattctcatcaggattccacgagcatatatatatatatgtacagagtaacaaatatatcattttgagagaaacacacacgaagacaccttaactcactgtaagtcctctaataatagttaacacatgcctaagtattacaaaaccacagaaactgtctactatagtaagcagggcaggacagtaacagattgatcagttaataagcaatatattattgtaacatgaccatatactgatgaatacacacgaatctaaagagaataaaggtttaccgtttcagtcgcaggaggtagccattgagagaggagacagcaacaacaagcttatcaaaagacaagaccaccacttcactgtgtattatagaattcagtatcaagaccacaaggcttctttgcttgatatcttgttctatcattaaagggtaattctcatcagtaaaaaagcacttagtgaaagtaatttcccaaaagtctctcctacgcatttcatcgtacaccttcgctgcattgatcattagagtaaccaaaaccaaaattgctctctcccatttagtgtgaaaaccaatctctcttcaccaaatttgcttctgagtgaggaattcgatcatttgactaagatcattgaacctaactgaagttggtataatacacccgtaaacaagaagttacaagatgtccggaaacgattcaagtccatggtttgaaacttgaagtaagagaccgatcttttaagtcaaatttatgaaagatttaacctttaggatagaaatgattgtatttactaaaattatacacaacattattaggcatggagctaggattggctagtgatcattggtttattcaggatttggtacaatagtattcctgagaaactcgagactatatactctatggttataacggaaagattaaagatctgtgatgctaactttcttccgtctccacgcccagtaacacacaaagagccctactctttctttttccattctctgtaatatacaaactttatccactaatgttgatgatgcaagcagggaatcaaaattgcgtgcagaacaaaatgccacacatatccttgtccttataacacaacatggtgtcaaacaacaatcaacttctctataaacttactctacttacatcttcctcattcattcttttcccccacccatgcagagctttgtgggtgttcatattatgggcgtgtataacatatttgatccctgctcataaactttggggagccatggactgctgtgtcggtcttctgctgcaaagtggcgttgtgcgagggatagttcttctcctcagggattgtagcgtaggaatatagtcatagctaaaatggaactacataaggaagagctgtgatatccgcagactctattctgaaagcttggttccagacctgcaaggattcgccagaatctggaggatctgttctcgccttttttaatttgatacccgactgaccaagtagccattcttggtcatcatcaatctctggcaacagctcccttgtaggtacatggagtatctgattgagatactttaggtcaggatgaggcggctttgcggatggttcaccattttccttgactttcactttcattgttgcagccaaagggcttggtggacagactttatgcttttttccagagacagtaaaaccattaattctaacttctttaacttgtggcttgcaagttgttccttgcacctcagaagcaggcattggaggagttcggggtgcacctaatgttattccattttccacagatggtacacaagcactcagcttctgtaacttgtgtggcgtggttccattttctgcgaaagaattaaagactaatgttacaacaaacagttaataaactacattgttaacatttcagaccaaaaccaagaaatacggatcttgcatcattactccaaaccaacaaactaccacaccactcagatacccataaatttaaaaaatcttttaaggtaagaaaacatatcatgattggatgaaactattagatgcttctaagtaccaaaccatatatcatacgatggttaatatggcaactacactcctcattcaccagacagagaattggatcagagaataactcaccatacaggaatccttatcggtttatttatctcatcgcacatttgaaatcaagaatcgttaaatataaaatacgaagataagtatccacatatataccaaatcactacattacttttgaagttttttatagaaaaaaatctcggaagaaattttatcttatctgtttatttgttctcaccgcacttttcaaatcaggaatcgttagtatcaacacaaataccaaaatcactacattagttttgagtctcattatagaagaagatcttgaaagcaattttatcttatatatcctactttttccactatactttaaaacggaatcacaactttgcgaaacatatcgctttcgctggtttcagttgccagcgataggcaaacgaacataatcataaacttaagattctaacaaagtaaagttttcataagcgccattgcagcgggcttacgaaaacttttaagaaaacttctggaagcggaaagcggacctccgacgaaatttccaaggctacgacgggccgcgcgcgggttatttgggctttctcagttcaaacctttgagttacccgctctctcttcttgctccaatcaatcttcagtccacaaaatctgaaatccactttatctattttagattattaggtttgctatctctttgatccaagcttttatgtatcacaacaaaaccctaattctacaaattgctccagcgaagaacttagcgaaggaattgtgcttccaatggtataatctttttctctttttttccaggttcactcaccattttc

SEQ ID NO: 2583 - DNA, 3000 bp, Unknown
  misc_feature (1)..( 3000): cDNA_ID_2163750_gDNA_ID_1620561_Annot_ID_160615 3000 nt of promoter + ATG
caatatttccatgcgtgattttgtattttatgtgataacattcttgctagccgatttggctagcttttggactaatgtcattgtctacttctgactcttacggctcaaaaactaagcttttgtagtttgaaaaagataacttatagtttgacttgttagctacaagcctagaatgctgttttaagcatgaagtagaaaacattttttcttattggtacaatggttgaggaactctatagcgggtacaaagaaaatgtagcgtaacatatgcaaaacgcacaaatatatattttgcactcggacaagtattttcttcatatcatgtaattagtcaaatacgacttttcatcaaaaatgctcgcaagaaatcctgcagtgtactctggtatggtgatatctttgtacttagcagggttttcatcagacaaaagatctttaatcggtccataaaccgtggaatttggagaaagactcgagctaaagaagcacgcaactgaaatccgcggtctatctttgttcggtcgtaccctatgctccacgctcaagaacttatcgttcgttatcagctgcaaaacaaaatgtctcaaattaattggtaaagaatctgtttttttagttaaaagaatgcatcaactggacttgcctgcatgaaatcaccaatgttgacaacaagagctccaggtacaggagggacatcgacccaataatcttcatgaagaacttgaagaccaccgatttggtcttgaagaagaagcgtgaggaaagagttgtcggtgtgtttacttatacctaaagttaggtcaggttgtgggcaaggtggatagtaatggcagagcataaacaaacccttaagacaatcaatcctcttaagtgtctcagagtctaaacctaaagcttctgagagaagttggaagagcacagctcctaattccattacatgcttcgtgtattcgatcaccgcactcctaaaatcatcatattaagaattaaaacactagaaaaggaaattgtttacttgaattaaaattgagataataaaatcgtggaatcatttgaactaagtaaatttatgttaaacaatcacataatgctaaaaagttttttttttggttatatatgaaaccaaattgtttagaaatagcataaacacaacaaatagtataatactattaatcactatatataacatgtacctgcaagctagtgggatttcctctggattcggaggatctggagcaatataacaagtgaaagagtctctccaattcaaaggagaagaatgatagagatcgaaatcattgttataaacaaatctcttgttgttatcggtaggaagatattggttcttgacaactggatcttgttcatgaaaccttcgaacactctctttgatctcttcaagaacagttaaaggaacatcatgattgatcacttggaaaaatccccaattctcagctgcgtctttgatcttcgaaatgacaacgtttcttgaagatgtgttacgatctccgaggtcgatgattgggacggtgaggtttaagccggagatatcagaaggtctgttgtttgataaaatagaagaagggacatgaaacatgctaggaacttcggttatttcggcatcgacgagtcctttcactcctgtcttcgtcgagataaaagtcgtgagatcgtttaaacgatcgattttttcagaattctctgtcatgtttttttctttttttctttctttcaagattctgttttttgttgttgttctgaagactcaagaagaagaggaagattcaatttaagacggaactaaagataagtgtcgaagtttgtggtgtctgtgattgagagcgacgtgttgtgttgtgcaaggaattcaaagtattaaaattgacttttaagatattccgacagaaacaaaaacagaattgataagagggagattcagtttaagacagaactaaagataagtgtccaagtttgtggtgtctgtgattgatagcgacgtgttgtgttgtgcaaggaattcaaagtatcaaaattgagtgttgtgcaaggaatttaaagtatttaaattgacttttaagagattccgacagaaacaaaaacagaattgaagactagaagattgaaaataaattaaaagaaaaagaaccttaaaaagaaaacaataaaagtggagatgcggggtatcgatccccgtgcctctcgcatgctaagcgagcgctctaccatctgagctacatccccatgaattgaacgagtagcaattatataatatctaacgcgttttgtaaagtatagtagatcaatttttcatgtatcttatattcttattcagtaccgcctttgccttgttggttgtaccaagtaaccaacatttgtatggatctttaaatacttaatgattaaaagatgtttaattattattattttgttatatagcttagtgctctaaaatgttcatgaaaaccaacttgaaaaatattatgatagctagtttgtattcaatttaatttgtgtttgtaaattatttttcattttctttactattaattttgttttatttaccattttattttacgggaccaaatccgactacctacgaatgttagtaaatccggttccgacaaaattacacatatataaactttttttttctgaaatatggttctcatatttaaaccaagattctcaagttaaaaatattgtcctaatatttaatccaagattcccaagctaaaaatatggttcttttgtcgaaagtaaaaaagtacatattcttctcggagaaatgaatcgatcgtgtaaaatatagtttctcgttgggagttaaaatttaataaatttgataatgtttttttttcttttttttgaaatgttaataaataaacctaaaccaatagaaccgcagtttttcctcctcgccgaaacgaagaagattctccttctctccgtcagacaaatctacgaacaagcgagcctgagcttaagaccaaactcatagag

SEQ ID NO: 2584 - DNA, 3000 bp, Unknown
  misc_feature (1)..( 3000): cDNA_ID_2163695_gDNA_ID_1620561_Annot_ID_160597 3000 nt of promoter + ATG
gactatattctgatcatcttttgcgggtcttgaagattcctacaattaatgatgcctaagttatcaagactcaagacacatcacaactttcctagtatggccgattctctcattcaattttcaacggccatattttcatttattgttgcgatttctttctttattttagcatatagacgttgcacttgaacccctatataacatagtcagacgtttcgggttcctatatgcgagccgcaagagatgaccaagacggacgaaggatacccacatggctttggagtcaagaactcactggtcatgcttggtgtcattaactttgtcggtattctcttcaccttccttgttccttagcccaagggcagagccggccatgagcacaagcgggccaagcccatgcttgcagccgattattcaataattacattttcggcctccaaatactgaagttgttctatggtccaatgttcgcgtcagggaaaacttggtccttgttttgtttaacttcttaagttcgaatctcccaaatgccgatattattacagtttttcttcttccgtttttgtcaaaaaaaaattagttactaaattataaataattaacctcaattgcaattaatcttttggttccttttcttcctctagcattgtgtggtttattggtccttaaactgtcagctttttagttcaaatccatccattttgtctattttgtctctgtatctcatacttattctataattcattagtggtttaactgtaacaaattcatgttttattctgataagttttttttctttacttcttaatcattgtttcttcataaaaacaacatatgaaggatatgatagaaatttgactaaaaaaaacttgatggatgagtctacgtacatatataaatgcaaggaatatcatatataaaaattgcattgatctttgatgctttaatacttttagtgctttttttaaacataaccaattttatattttgtttgatcacacttttttatactatgaacatgtgtaaagaggctttttttatattatgaacatgtgtaaaatatcctctcttttttttttactataagcatgtgttaagtggccttttctttttctttgcttgtagccttgtaaataataggaatgcccaagggcaagtcccttgaagagctctccggtgaggctgaggttgagaaatgattacgccataatattttcaaattcttaattggttcgatgaattacatcttctattacgatttactttatttttgcgatgcgtaatgtgatatttcatgttcgtaatggtggatctctacatttatttttttgtgtgacaaaatgtaatcaatcgatatttagtggtcatttatgatatttatttgactgcttatctctactacacagctactatcaaattcctaatctttgttgttattatggttatatttaatttatgcatgtaatacctctcgtataacaacaaaacattcaaaccatttaaaacattaacgtgtacatatcgaagtccagaaaacccgtcatttaaaacaaatacaatcctcacatttatatatatatatggtctgagctggattggttgatattaaatccttatttatgtatatgtaatggcaactaagtccactaaggcatgaattatctgttaaaatgaatttatatgcttatgttctcgcgaatatcctatgtttttcgaatatgcttttttaaaataatgattttgactttgctaaatgataattaatcttcatgactatatgtatcctgattgtcactcctcaaatgtcaactattagagttgaataactcgactgcaaaaaacaaaacaaagaaaacgaggaagatggagaaatttaaaacctttcgacttatattggctctaaaataacttgtagttcagatttacacgaaacaataaataaatgattagagcttgcaactctccttatttaattttagaaatgcattttatattgcgaataatataattgcaaagttggaatcaaacataaatatatataactggtcaacgattacaagtaatgccaacaagattaactacaaactgaattcgtgtctacactacttctttttgattttattttattctttttttgtgtgtgtacaacgtctaaattagctacttctatttatagaaatttacatggaatgcatatctatagtaatgctcatatatcaatctgtctccatatagtaattgagatggttaaacagaaatttttgctaaaacttcgtttcctgcttcaaaataataatcagaatccgtaactatcatacaataaaaaaatcatcccatctcacgtatcctagagagatttattgtataaggtgttcatattctggaaggcgtatcgtccagcttagatgatgttttatacttttcaatataaaatagactgtaaataatattttacttcagaaacaaatggtgttcaaaaatcttaaacatcaactataaacatacggagggagtattgatgactaaaattctaaaatccaaaatgaaattacaaaataaataataactatgaagaaagaggcgatcacgttgcttacatatctttccttttcaaaaagcatttttttattacatttaacgtgcttctctttcttcttctctataaatggccagcataattgttcatttctaatgaccacatatagtctctcctcaactctccagagaagttcttaatttctcctgccaagctgattaaggtaatattactttcctttgtcgtctatatttaatttgtgtatataccatttcaagttgagttttcttgttcataattccaaagatatcaagttttgtttcaaaattttggccattgagaggtcaaatgctctgttccatgatattttttaagtctccaaatgaaaatatttcataagcgagaaataatgacatgaaatcttggattctttgcgttgtatgattatagagctctaggaaatg

SEQ ID NO: 2585 - DNA, 3000 bp, Unknown
  misc_feature (1)..( 3000): cDNA_ID_3068745_gDNA_ID_1620561_Annot_ID_160610 3000 nt of promoter + ATG
cccttggaccagaataattattttcttgtaaatgtgtttcgtaaattgaactttttaaactttagttgtggaaacaggtgaaacactaaaacacatcattaaaggtaaaaacaaacactataacaccataacgtgtaagaggcatattactcgtaccttagcaaaaagtttttttgccttttattggctgcttcggcgtccgagtcgtggatcgggatgtcttgtccgtacatatgcaacatgtttctttccttttgtttggtcgaaataagaaaacaaatctttgagttcctttccttttcattacaatacaatgattataagtgtttgtttgtaatcgaaaactttcatgccaaaaccaaaataatctcaaagatttaaatttaaaagataccaattcttacaaaaattttggtttcaagttaaacccaagtagtgttcgtctactagttgaaaatttattataacagaggataaattattatgatttcgaaattctgattatgatagtaaaatcagtaatgcccacctaaatacgtgagtatacgatattaatgtaaattttattgatgatatttaaattttaaatagtttagtcatccacacattattttggaattaatttagtaatttttgttttaaattaaataatttttgttaataaacatcaaaatggcaaaaactttttctctatttactgcttgataccatcttagtataaaaatgtaagatcgatagatctgacatgtatcacaataatgtgagttactaactgtgaaaaaatactttatataataagattaagaaatcatatgctataactaatttgggagactgcttcatatattcaaaaaccaatgcaatggaatggttacgtaatattttgattgatttgaccaattaaatgattaatgtaactgattatattaattaattttaatatgaaatattttatttttccagaaaaaatattggaataagtattaatttgcatattcatattttatttaatttaagtatttatttattagatcatataatacatacaaacaaaagaaacatataattctttatattttgttaaacgtaataaaaaatgtcatatgtaaggaattatttatatttacagtaatatgatccaaaatagttagtaataaaaaataaaataaaaagttagtttgattatcaacatgagtggtggcagagctgaataacaattgtggtgatatccctttattattaaaagggaagtacaaattgaaattttgtctaatttggcctcaattttgatttcaattttggattttgttctttgctattcaaaatcattaatggtaatttggtcttaacaatctcctaaactttatatgatccgattcaatctaaaccgttcaataaaattaattcccttcaatctaaaccgttcaacgaaaataaggaatctatgttgtttttgaaatcaaaatatgatcacattccatccctaaaaacactatattcaatcacgaaatcaataatcaataatatccaaatcatatattacgattcttcactaatcattagaaatttatatttataagtttaggatatcaaatttattcaaatatttagtataagaaccaaataaaccgattgctcgcggtttagttaaatcctagtgtaaacatatttacaatgtcagaggatctaataatatttattgaactaacataaaggtaatactagtagtcgtactttagaattattttgatcatataatgaaatgacagaatgccgtttctcatgcatcataaggggagatgaatctacaaaaccaaaagaaaataataaaactcatattaaaacattcatttgtatggaaatgaaaaataaaaccattatgtggatgagagtgaatatgaatcagaatctcttttgatgagtgtgtgtgtgagagtgagtatgagtgctatcttgagattggggtcaccaaaacatacactgcaactcttatagcagtcttcattcacgaaccgaaacaaatataataacaaacagaatttgcaaatgtatagccgtcttgggtcccgcataggtcgactggtgattttatgaaattaaaatcatatctaaccctttaaatacgtggttgccgcctaaacactttagaaatttctacgttcacttttttcattattgaaaaactattaaaacgtaagttaaatggtaaaagatttcacgtgttctaaaagagttcttttatgtaaagcatcaaatttgtacatttatatatttctaccaccaaaaacatttattttcaatggtccgataagccgtctagcttaatttacactaattatattgtaaaatcagtttcttttcaccatttaaaacatctacaatctgaaaagaaacgataatagttataattgtagaaaaaacacaaaatacacaattgttcaaactaattaaaaataatttgtaaacgtaataacaattagtgtcatatttggatttatgcgattctaagaactctttttgtgcacccaatttttttttgttattctctttcactgtaaaaaaaaaacttctcttaactctatagaaccaaacctaagagtttacaaaaagaagacatagcaactaaaaatttggtagctcccaggcacgacactcgatgcaggccgttagaagaaaagaattttcaaaaaaccggatcttacctaccattacatcctaaaaacagtaagaactaacgatttttacccaataatggtacgaaccaacggtccgacgcctctctccggtgactttccttccttttcaccggccaaatcctccctgaagagctgctctgtaaccacacttcttccttccggtagtctctctactccctctctgtaacttgctttgtaacccttttcaaatttggtaaacctgtgtaaccctttgaaactttaaccaaagactggaaaccctaacctgcaacccaaccccttaaccccttactactgttgcacc

SEQ ID NO: 2586 - DNA, 3000 bp, Unknown
  misc_feature (1)..( 3000): cDNA_ID_2163704_gDNA_ID_1620561_Annot_ID_160601 3000 nt of promoter + ATG
ctccttgtaaatcattttatgccaattacttatgctttaaaaacgattgtaaatcatgttttacccttttataagcttttaaaatcccttgtaaatcattcattgccacttacttatgcttaaaaaacgattgtaaaccatgctaaccctttttaaatcccttgtaaatcattgtatgtcacttacttatgctttaaaaacgattgtaaatcatgttttacctttttataagtttttaaaatcccttgtaaatcatttaatgccacttacttatgcttaaaaaacgattgtaaatcttgtaaaactattataaaaagctttaaaaagatttacaaaggttttaaaaggggttttaaagtatttacctatgtttttaaagactttataaaaattttaagagtttttaaaatgatttacaatggtttttagcaactaccaaaacttttaaaaaatttacaaagatttttaaaagcatttttttggctgggaaaaaaattttacgagaaaacatttttggcgggaaattttttttttggcgggaaaaaaagtttggcggaaattttttgtttggcgggaaaaataaattttggtacatgttattattaaatgagggtaatttggtcattctgttcaatagaagggatatttttaaaaataaacaatataaaatggtattgttacaaaagggtagtaaaaaaagggtagttttgcaaatctccctcgagaatttgcaatttctctctcatagcataacatgtcttttttttagtaaatttcaagatgacaaaaagaaaaaaaaaacataaagaaacaaattgaaagcaacatctatttttctgacttgtaaaaatgtggtgttactagcaaatatcaaatttttgtatctataaactagattttaacccgcggtatactaggagaacgatttattttttaaagttaatatatatacaagtttacaaattgaatatatttataaaaaaaataaattttttagtttacaattattattaggtaacatcccgccaaatctgttccatcaaaaagcttattaattttattaatgttaaccttagttatgatatgattctaaatcattgtctagatattttagccaatgttaggacgttgaacccacatagttttcgtcaattgaataatatatgttcgttttataaatttcgaatcacaatttatgcagaaaatgttttgaaatttttcttaactttacatattatacaataaaaaatcaaacaaagatgataggaaattcatagttttaaatcttaatcaaatcttctaaatatcaatattgttaaatatagaagtaatgagtataagagttgggttttatttgaaccaacccaactaagatttaatgaacatcataaactaatgggtctggtatcaaatgtaatcagatgcattttaacccacaatcaaaaggtgactgcaaaaatactatataagattcatagaagtagatcgtctatataggcctgaaaaatatcagttttaaattaaattatttagagatcttattttgttgggcttaaatactggagaataagactactttagtaatcaaaatatttgggccatgtaactaatgcaaaccaaaatcattattgacaaaagtcattgcatcaaatgattttcttaccaaaatgtctttaaaatatatatatatatatatatatatatatgtaccttcgtacggtacggttgcttttatataaaaaggtgttgtacggttgcattgacttttgatcgtaaatactatatagtccggagactcaaatgcaaaccactttctctatttttttggacggaagttatgttaacctaaattatctaaaatattacacaaataatttttaaacagtttaaaatggcatataattatgttaatagaaatttgacttttagtacggagatacattagctgagaagtttgacctcaccttatttagtgggaaccttgttacttttgaattagtttgaacaatatatctctaattcatataaagtattttgaaatataaagctttataaatataacatattttttggtgggtaatgcttctttttttctgtggcttataactacgtggagatcttatcttctgtccgcttatattagtatttcaccatagtgattttaataaaaatcagattaaacaatatataacagctattttagtttacaggtttaaacttttattttagttctttgattttttttttctttcagaaaatggtggacatcttctaaagtttgttttattaatctaggtagaaactttcaaacaaaagacgaaaacagaaaagttgactttagtacggaaatacatgatatgagataactgataagataacttgttagatggtttccactctcataaacaatataaaaaaattattaacgatagtgaactcgatttttagtaactctatgaaaatcttcttgtgagatcataacattttagaagactaggcttttcgtgtaatatgatctgtagaccattccaatgttatcatatgcagaacagcaacacaatgaaataaattaagagatggaaaataaattaagatcaaataaaatgtggatatacccttaagattccggagacaatacttctccagttctcctctcgtctataaatttctgccgtctcagccaacataatcacaaccaccacctctctcaataattctctctcttgtccttcacaacctgttactacttaggtgaatatcatctacatgtttattttgtcttaatccaaattcacatttaattttgttttcactctttttatcatgtatacttttttaattagctagccgagattatatatgttaaaactacctctatttctaacacacccaagcaatatatcatctttccaatatttacgaaagaagaaatttctatacaaatattaacctttactttgtgcaaaataggagagaagaaaaacaaaaagactgactgag

SEQ ID NO: 2587 - DNA, 3000 bp, Unknown
  misc_feature (1)..( 3000): cDNA_ID_2163821_gDNA_ID_1620562_Annot_ID_160628 3000 nt of promoter + ATG
caaaatcaaacctcatagagttcatcagagatgagtcccatgccatgagtgaagggaacaagagcattaccatcaaacacctcatcggtaacaccattacccaccaaatatccctataccacatataagtccaattttaacattcaagtataggaagaaggtttctctttctctcacatatacaaagagacaattaggtaactacattagtacccttagtcttaatggtatttatttaacaccaaaaccataagactttgaatccgaaacatagcctcaaacattagtcgtaccttgaagttgataaccggctttgtcacattcttgcttgttttgtttgttctcattgcatttttatttcctacaacataacaagaaaacgatgagaaaaattggagataacgttattttctaattctgccaatatatgaaaaggagctaaagatgatgttgagagagataatactgacctttgacaacctcggccgcaagagttggcacatagataccagcatatgattctcctgatataaagaacggatttgactgaaactccggaaacattttaaaccactgatgtggatgtaatagttagtgtcttgaatcacacacaacacaaggaaatcttttttaaaaacttttacattcttatttcacctcgagaaggaatgtgtgagtatcagacgcggtttttgtatcatcagttgtataatcggcgttgtcatttgagtaagagaatcccacaccaactggagagtcaaggtatatgatgttggacacctgaaaacaaaacacattcttaaaagttatagatcaatttcttttgaagaaaatgtttgaaaataagtcaatgttgtttttcttttcaaccttggaccaactataaggattgagatgcaaaagatgtgagttcttcttttttggttcgaaattgaatggacctgcaacagtattgaacagtatcatatgtttagattatctttgcttatatacaattgccaacataaaagagcattgtatgagaccctatttcgagttatatatgaatccttttctcgacacaagaaaaggtatataaagcttaccgtgctcgtagacaaatccatccatgctagagcaacctggaccaccattaagccaaagcacaactggatctaccgaagcatttctctcagattccacaaagtaataccatagattcttattacgatgtttatctattgccacataccttagatcacacaccaaattacataagaaaaagagagattaaaaaatattttgaagaaagtctataataaaactttatgatagatgagaatttcacaaaaaaatgtaaaacacatatgaaatttacccggcatagtgtttagatggaaaagtgccgttgaaaccaggaagattggtaatgagagcagattttggagctgactttgttattgtaaaacacaaagacaataatatcgaagcaatgatagcttctactaaccgacccattttgatgaagaacgttgagctacaattactagcaaactcttattattataagaattttggtaatgtttaacaaaaatagatacggaaacaaatcttgggaatctattgaaatttgtatggtaaaatccaatctagacttaaaatgaaaatcatacttaaaaagaaacatggaaagaataaatttttattcttactactataatagagaaaatgttattacctgtaaagaatatgatccagttgtatatacattattttgaatgacataatacatttaaagatcttaaatttgcattgttaaattaaaataaaatgattataaatacaaaaaaattactatgttatcttttcaaatataaaaatatttctataatattattgtaagacatttcatatttttctacattatatttttaagtaaaattatattgtacattttaacatatagatatttaatttatacaatatattatattcagaattacatatatcgaatgtagttaagatttatttgcaaaacttgggtagaataatatctttgttagataggtttcataaagattgaaactgtaattaaaaaatagattaaggatttttggctaaaacgctaacaaaaatgtatatataaatgccaacatgtaaaaaatgagatattcttcataaatgaccatgaagaggcgcaaagagtaattttaaaggcagtagaagatgttaagaagtggcaagatactttccgggccaatttttttttttgtaagtatgttgttaattagctcatatactctctttttctaactatgttgttaaaaggacccaaagttttatattatatatatatgtaggtatatgattttgtaaaaaaagacaattagtataaaagagtccatttttaaatatatgtattgggactccggatccattgaactagcactgtgtgcagatgctattgcaaaaatttgtctcctcttgtggtttgtactttgcttgattagaatgttggtcatcacctttgttaagaccattggtggatgcttagaaaccatgtattggttttttaagtattaatataaggatgctaaagtaagtatgtttgacggggaaaaaaaagatgccaacatgtaccaaacaaaacaacaatctttcacccaaattcatccaaattcactcacacaaaactaaggcctacacaaaaccaacaatgctagaaagagtcatcgacgatcacgtcgccaaccaatctcagccgttcaattttcttgcacatcacttgtcaatcatgcctaaacaaaccttaacaaatctttcccctttatatatttccaaattccaattttctatattatcgcttcttcctcctcctgcttcttcaactccaaacctcaccctctcaatttccctccttcgccggtccacggcgtcatttcacggtggcgcttcacctctctccgtcacctactctcctaaaaatccaatctttacaaaatccagaccaatatagaaatg

SEQ ID NO: 2588 - DNA, 3000 bp, Unknown
  misc_feature (1)..( 3000): cDNA_ID_3068804_gDNA_ID_1620562_Annot_ID_160635 3000 nt of promoter + ATG
ataccccggcttatttcgttagacccatttagatttgaaattggaatttttccccctaatttgaaaactttagtctgtttaaacaaaaattcaaattacaagttacatattgcgttcgaatcacatgggtaaaaatgatctatttgtttaattaatatgactcttattattagtcaattaccctgtttagtgtgatttccggtttgttttgtaaaccggtgtgttgttaatcctccaattattggctaccgtaattttaattcactcccttaaatttcttgtattctgtcagcaccaatttttttttttattgtattctgtttttaacactctgtttctatccagaatcaataggaactttcctaatatgaataattgtagtgttttattgatttgcatatgaactagtactacgtacaagtgctaaattagagagaacttgacttaatctctaaaaaagaacatatgattgtagatatgtctattgaataaacaaattgctatatgaggggaatagtgtggtcttatttaaaagattgatacaatatacataggaaacaaactttgtaaataattagttctacgaagaagaaagaccagacgttatttaaaccaattatattcctcgtggttcatagtttctcactaactaaatgccatctattttggcaatccatatgggtgtctgattacatcaaattctcatagctcctctgtatactctccgtaaatgatgaaaatactctttctgaccatgcctcaagtgaccaagtccaatcaacaatcacagaagaaagcaacagtcagaggttttcggaatcgatggaaacgtttctgaaaagagctgaggaagagatcatcagagtacaagctcaagagagcgtagcgttatcacttgtaaaagaaatcacagagtatttccatggaaactcggctaaagaagaagcgcatccgtttagaatattcttggtggttagagacttccttggagtagtagacagagtctgcaaagaagtagggatgataaacgaaagaacaatggttagttctgctcataagtttcctgttccagtgaatccaatgatgccacaacctcttcctggactcgttggacgaaaacaatcttcttcttcgtctttatcagcggccagcttcaatgtcaaaccttgctacattcttgttgttgtcataaccacggctactggtatggccttgtgctgacacgatgttactaccaagcaagtgtacattctcttcaggatactgatccaaccaattatgtttggtcgttttggctctcaacgtttctagctctgcagctacttctatcatccttggcctttcctctccctttagtcttgtacattcaacagcaactcttgcagcttcatggatttccctctggttttcctcgttcaacacttggtcgtcaataatctcatgcaacctattctctttcgtggccaaaacaaagtaactcaccaaatgttttgaagtctctggcctttcaaagcacaatgccttttgacctgatatcagttccatgaggactaccccaaagctataaacatcgctcttttcgttcagaagccatgtggtatagtattctgggtctaaatatccgagagtgccttgcaccatagtggtgagctgttctttatccattggcttcaactttgaagcgccaaagtcagctacttttgcagttaagttttcatccaagagaatattttcagttttgatatcgcgatggatgattggaatagaagcaccggagtgaagatacgctatagctccagcaacttctattgctatctccaggcggtgttcccatgtaagagaagaaacaaacatggaaccgtgcaagtgatcgaaaagggagccaccggtaatgaattcatagaccaacaagggaacttcagtctctagacagcaacccaagagcttgacaacgttcctgtggttaatttgtgaaagcacgagcacttcgttgatgaactgctctacttggttgttgtctcctagccgagttttctttatagcaacgatggagttgtcaggcaatatccctttgtagactgtccattggcctccttgacccaagattctgctcacatcataaccattagttgcttccttcatgtcttcctccgtaaagattttgaaatcaatgtttgatgaccctgcccccgagagtcgctctatcaacatgccaccgccatttttctcaaagaataattgtcgttggatcttggtgtccttctggtgcttccttatattttttatatagctaatgctacgcacgaggctcaaaatgttggtggtgtttgctgatcacatgatagacaaaaaaagatcataagacccgtagtagttctgcaaaacaaattaatcaaaaacgagtgtagagagcttaccaagaataatcataatccagactaagtacttattctcttctatacatgcaatcacgaaaatagccaccacgaagaaaatagccaccaggtacacaacgtgctgcaacttcatcttcttctacctttctcctctctaaatgtgtttcatctcatcgcttattcgcttcttatagtttgaatacaaacttctgttttgacatgttctcttgactcgtttttgctgacctgttgaattatctgccatactaaaattcaatcaagaccatgtcaatgtaatgcaaggagatcatgtttaagtataccactccatattcccatgttatatatcctaacatcgtttaagcctgcttccattttgccgccgcggtgacttttatttttgcaggactttaaagaccgaccacacgacgatttgtgcttacaaggaatcttcaaatgtgatgaaacgtaaagattcagactactacacgttagataaatttaattatgtcaactacacgttagaaattttcatgcaaatccaccactttcaccaaaaaaaaaaaaaaaaaaaaaaccgtgagaaaaaaaaaaactgaaaatg

SEQ ID NO: 2589 - DNA, 3000 bp, Unknown
  misc_feature (1)..( 3000): cDNA_ID_2163857_gDNA_ID_1620562_Annot_ID_160637 3000 nt of promoter + ATG
tccaacgacaattattctttgagaaaaatggcggtggcatgttgatagagcgactctcgggggcagggtcatcaaacattgatttcaaaatctttacggaggaagacatgaaggaagcaactaatggttatgatgtgagcagaatcttgggtcaaggaggccaatggacagtctacaaagggatattgcctgacaactccatcgttgctataaagaaaactcggctaggagacaacaaccaagtagagcagttcatcaacgaagtgctcgtgctttcacaaattaaccacaggaacgttgtcaagctcttgggttgctgtctagagactgaagttcccttgttggtctatgaattcattaccggtggctcccttttcgatcacttgcacggttccatgtttgtttcttctcttacatgggaacaccgcctggagatagcaatagaagttgctggagctatagcgtatcttcactccggtgcttctattccaatcatccatcgcgatatcaaaactgaaaatattctcttggatgaaaacttaactgcaaaagtagctgactttggcgcttcaaagttgaagccaatggataaagaacagctcaccactatggtgcaaggcactctcggatatttagacccagaatactataccacatggcttctgaacgaaaagagcgatgtttatagctttggggtagtcctcatggaactgatatcaggtcaaaaggcattgtgctttgaaaggccagagacttcaaaacatttggtgagttactttgttttggccacgaaagagaataggttgcatgagattattgacgaccaagtgttgaacgaggaaaaccagagggaaatccatgaagctgcaagagttgctgttgaatgtacaagactaaagggagaggaaaggccaaggatgatagaagtagctgcagagctagaaacgttgagagccaaaacgaccaaacataattggttggatcagtatcctgaagagaatgtacacttgcttggtagtaacatcgtgtcagcacaaggccataccagtagccgtggttatgacaacaacaagaatgtagcaaggtttgacattgaagctggccgctgataaagacgaagaagaagattgttttcgtccaacgagtccaggaagaggttgtggcatcattggattcactggaacaggaaacttatgagcagaactaaccattgttctttcgtttatcatccctacttctttgcagactctgtctactactccaaggaagtctctaaccaccaagaatattctaaacggatgcgcttcttctttagccgagtttccatggaaatactctgtgatttcttttacaagtgataacgctacgctctcttgagcttgtactctgatgatctcttcctcagctcttttcagaaacgtttccatcgattccgaaaacctctgactgttgctttcttctgtgattgttgattggacttggtcacttgaggcatggtcagaaagagtattttcatcatttacggagagtatacagaggagctatgagaatttgatgtaatcagacacccatatggattgccaaaatagatggcatttagttagtgagaaactatgaaccacgaggaatataattggtttaaataacgtctggtctttcttcttcgtagaactaattatttacaaagtttgtttcctatgtatattgtatcaatcttttaaataagaccacactattcccctcatatagcaatttgtttattcaatagacatatctacaatcatatgttcttttttagagattaagtcaagttctctctaatttagcacttgtacgtagtactagttcatatgcaaatcaataaaacactacaattattcatattaggaaagttcctattgattctggatagaaacagagtgttaaaaacagaatacaataaaaaaaaaaattggtgctgacagaatacaagaaatttaagggagtgaattaaaattacggtagccaataattggaggattaacaacacaccggtttacaaaacaaaccggaaatcacactaaacagggtaattgactaataataagagtcatattaattaaacaaatagatcatttttacccatgtgattcgaacgcaatatgtaacttgtaatttgaatttttgtttaaacagactaaagttttcaaattagggggaaaaattccaatttcaaatctaaatgggtctaacgaaataagccggggtatttgagtattttcgtatcaactagccttaaccactaaactacaaatagaatttttctggtttcattcatttcataaccgactcaaaaaaacacttcgtctctacgattcaaatgatcaaattcaacagaatcaacctgtttcggctctaaacggtgatgaatttggcgatgagaacacaattggggaggaaatccttgtcaccgccgtcaaaagaagcatgtgattgaatcgggaaaaaacctccgattacgcaaacaatcaggaatgtaataaacccaggtctgatcgatttcaagtttgtttttgattcatcgattgttgcctttacttcataattctcttccgatttttcagaacagaatcgtgtaattgaatcttgattacaaatccttgtaattacgcaaaataaggttaggaatcacaaacccctttctgtgtatttctttgttgctccgtttatagtaatcaatctcttattgatttagaagaatcagtgaacttcgtagtagtgtgatgatgctgatgatgatcatcttcattttgtgtccgttgattgctagtttttctctggtttcaattcaatcatgtaggttattgaaaaacgttggttacacgtgttttgattaagaaaatctatccatttagaacttcttgtgatgatttttctctgtttagtgattcatttctttggctctagtgttttagttacatgactcttaaagttctttcatcatttgataggttgatagtc

SEQ ID NO: 2590 - DNA, 3000 bp, Unknown
  misc_feature (1)..( 3000): cDNA_ID_3068796_gDNA_ID_1620562_Annot_ID_160641 3000 nt of promoter + ATG
attttctttctctttcgtgaagagatcaatttgaattttttatttctttgtaaaaatatgttgattccagcaggcactgcccatcaataaagcaggtgaagcatttgctttaggccacgcagtataaaaataatctgaaggccacatttcagacttatatgttggtttgttggtttagttgtccattactaagacagttagacagatgtgttgagtaatgcctttcttcagcgatgatggtaatacaataatgcaaactaataatataatattcatgtctctaataagtactatattacaaattaagatcaatttgtcttctcattattcttctctgtatatctagaaatcaccgttgttttattaaaaaaaaaatctacgttaacactaaaattgaacaagaagtatatataatttgagaccgtcctcatcattgtacttgtaagtttacgattatgatataattagtcattagagaacatgaatatgctgaagaactatattagattatttaactttatgtatatagtagaaatatgatatctcatcgtaccaaaaatattcgagaaacaatcaaaacccaaaatccctcttatttcaaacacgtggcgaaatcctgttcgttcataactggcagttagagatgcaaacagaatcaaactgtagggagtaaactgtaaatacttccttttcaaagtaagtgtatttgatgataatggttctctgattagaaaaggctccggctttatcattctcagaccatcatcactaagcagtaagtaagcactataatcgcagaagatagataaaatggaagtagggtttctgggtttgggaatcatgggaaaagccatgtcaatgaatctattgaagaatggattcaaagtcactgtatggaacagaacactctccaaggtaattttttttttttttttgtctttgattgtgttttggtattatggttttctgatttagttttagttgttcagatctgataaagtcggaaactttttgagtaatttaatgcaattttgggaatttttgatgattgtgacagtgtgatgagcttgtggagcatggtgcatcagtatgtgagagtccagctgaagtaatcaagaaatgcaaatacactattgctatgctctctgatccttgtgctgctctttcggtatttgaaatccttttttgcttcttttgtgtgtgttttagcattggtgatgaatgatatgaagtagttgtttgattaggttgttttcgataaaggcggtgttttggagcagatatgtgaaggaaaaggttatatcgatatgtcgactgttgatgcagagacttctttgaagatcaatgaggttgaatcttttgtactttagatgctgatgataagattagaagaaggttgattagtttgattgagctgtgttgcgcattggtaggcaatcaccgggaagggtggtcggttcgtagaaggtccggtttcaggtagcaaaaagccagctgaagatggccaactcattatccttgctgctggtgacaaggtacaactcaaaactgtacttatggattgattgatagatctcaagaactgttttagttggacttagtaggaaggagctctcgatgtgcggctataatccgtttgtgttttaatccttttttgtaaggcactctttgaggaatcaatcccagcttttgatgtcttggggaagagatcgttttacttgggacaagttggaaacggagctaaaatgaagctaatagtgaacatgataatgggaaggtgaatgtcccgtctcttttacaattactaccattagtagtaggaatggaacatggcttcatgatcttattgtttttcgtctgatacagcatgatgaatgcattctctgaggggcttgtattggctgacaagagtggacttagctctgacactcttttggatattctggtgaggtgatcaaacttttgcaagctctgaaataatggtgttggtttgaatcggtttctgctatgggcaggatctgggagcaatgactaacccgatgttcaaggggaaaggaccttcaatgaacaagagtagttacccaccagcatttccattgaaacatcagcagaaagacatgaggctagctcttgctcttggcgatgaaaacgcggtttccatgcctgtagccgcggctgcaaacgaggtcagttagttagttagttactcagagacaataacatattggctctccctcctctagattggtttcttagcttgaatcttaaaatatatgtttcggttctcgacaggcttttaagaaggcgagaagcttgggactaggagatctcgacttctctgctgtgattgaagctgtgaaattctcccgcgaatagcaaactgtttcaaaacatccactcatttggattggctgagatactgaaatcattgttatcttcccaaatagagatttactcatttggccaaacacacattttactccttcaccaaataaaaagtcttaaccacatatccagaaacgttcatagagttgcaaccttacgtttcaactactttatggctagttcactcgatattggtccagaggtagatcaaattgattgaaacagaaccaataaaatagagcaaagtttatttgaagttggtcactgttaaggttatatgaaacaaaggaagcaaaaaagaacccgtagatgagaagatcaaagaaataacattgcatcaagatggtcaagagaaatgttcctatggattatagacaaacgaggagaggaggagaccatttcagtagaaaattggatttcgttggagtgtgaatgtaaaagcccataggcccattaataatataactagtaaagcccattaacatttttcagcccacgaggagttttctagggttttgtcttataagatgtcgcatttaggtcattccgcctcttgcttctcttcactcacaatctcacagcaaagcctctcgttgctagaggaatcaaacaatg

SEQ ID NO: 2591 - DNA, 3000 bp, Unknown
  misc_feature (1)..( 3000): cDNA_ID_2105795_gDNA_ID_1620562_Annot_ID_160643 3000 nt of promoter + ATG
cgagtgaactagccataaagtagttgaaacgtaaggttgcaactctatgaacgtttctggatatgtggttaagactttttatttggtgaaggagtaaaatgtgtgtttggccaaatgagtaaatctctatttgggaagataacaatgatttcagtatctcagccaatccaaatgagtggatgttttgaaacagtttgctattcgcgggagaatttcacagcttcaatcacagcagagaagtcgagatctcctagtcccaagcttctcgccttcttaaaagcctgtcgagaaccgaaacatatattttaagattcaagctaagaaaccaatctagaggagggagagccaatatgttattgtctctgagtaactaactaactaactgacctcgtttgcagccgcggctacaggcatggaaaccgcgttttcatcgccaagagcaagagctagcctcatgtctttctgctgatgtttcaatggaaatgctggtgggtaactactcttgttcattgaaggtcctttccccttgaacatcgggttagtcattgctcccagatcctgcccatagcagaaaccgattcaaaccaacaccattatttcagagcttgcaaaagtttgatcacctcaccagaatatccaaaagagtgtcagagctaagtccactcttgtcagccaatacaagcccctcagagaatgcattcatcatgctgtatcagacgaaaaacaataagatcatgaagccatgttccattcctactactaatggtagtaattgtaaaagagacgggacattcaccttcccattatcatgttcactattagcttcattttagctccgtttccaacttgtcccaagtaaaacgatctcttccccaagacatcaaaagctgggattgattcctcaaagagtgccttacaaaaaaggattaaaacacaaacggattatagccgcacatcgagagctccttcctactaagtccaactaaaacagttcttgagatctatcaatcaatccataagtacagttttgagttgtaccttgtcaccagcagcaaggataatgagttggccatcttcagctggctttttgctacctgaaaccggaccttctacgaaccgaccacccttcccggtgattgcctaccaatgcgcaacacagctcaatcaaactaatcaaccttcttctaatcttatcatcagcatctaaagtacaaaagattcaacctcattgatcttcaaagaagtctctgcatcaacagtcgacatatcgatataaccttttccttcacatatctgctccaaaacaccgcctttatcgaaaacaacctaatcaaacaactacttcatatcattcatcaccaatgctaaaacacacacaaaagaagcaaaaaaggatttcaaataccgaaagagcagcacaaggatcagagagcatagcaatagtgtatttgcatttcttgattacttcagctggactctcacatactgatgcaccatgctccacaagctcatcacactgtcacaatcatcaaaaattcccaaaattgcattaaattactcaaaaagtttccgactttatcagatctgaacaactaaaactaaatcagaaaaccataataccaaaacacaatcaaagacaaaaaaaaaaaaaaaattaccttggagagtgttctgttccatacagtgactttgaatccattcttcaatagattcattgacatggcttttcccatgattcccaaacccagaaaccctacttccattttatctatcttctgcgattatagtgcttacttactgcttagtgatgatggtctgagaatgataaagccggagccttttctaatcagagaaccattatcatcaaatacacttactttgaaaaggaagtatttacagtttactccctacagtttgattctgtttgcatctctaactgccagttatgaacgaacaggatttcgccacgtgtttgaaataagagggattttgggttttgattgtttctcgaatatttttggtacgatgagatatcatatttctactatatacataaagttaaataatctaatatagttcttcagcatattcatgttctctaatgactaattatatcataatcgtaaacttacaagtacaatgatgaggacggtctcaaattatatatacttcttgttcaattttagtgttaacgtagattttttttttaataaaacaacggtgatttctagatatacagagaagaataatgagaagacaaattgatcttaatttgtaatatagtacttattagagacatgaatattatattattagtttgcattattgtattaccatcatcgctgaagaaaggcattactcaacacatctgtctaactgtcttagtaatggacaactaaaccaacaaaccaacatataagtctgaaatgtggccttcagattatttttatactgcgtggcctaaagcaaatgcttcacctgctttattgatgggcagtgcctgctggaatcaacatatttttacaaagaaataaaaaattcaaattgatctcttcacgaaagagaaagaaaataaataatttgaaaatttgaaaaagaaaataaagcttttagaaaaagaaaaaaaatagtaatagtttttaaaatgctatgaattaaataatataaaagatatggatagtataatttcattactttcaagaaaataattgaaacgcagagaaaaaaaaaaaaaaacaagagcccatcgagaatggatcagtaaaaaacctaaggcctatctccagcaagtgcaacttacatacattctcgaataaattctgatccgatcaagaactcataattattgtaacagataaaatcaaatttgagagatctactactaaatctaacttaaagcattgtactttcttttatctcattctcctttgctctgctttcttctggtcaacccccacgagattccttcttatgtgattgtaaagagaagatttttcagag

SEQ ID NO: 2592 - DNA, 3000 bp, Unknown
  misc_feature (1)..( 3000): cDNA_ID_2163880_gDNA_ID_1620562_Annot_ID_160645 3000 nt of promoter + ATG
ttatcagtgggagatctgctaattaatcccacttttgtttttctttttctctttttctttttatacgtgaattctgttttttcttttgattgtgctaaatgaaaccataaagaattcatctaaattggatagaaaattaggacacacataagatgtacatgacacagtcaataacatgatttttatactattaaccatttacattgtaagattttgatgtggctatatatgttcataactagagatgtgcaatctgattttgatgtagagttttttttttccggttgctatcattcttatgcatatatttgatgcttataagtccatttcatatttcctttaatttgtttttatagaggaaaatttcattaatgatttatttcatggactaatacagttttattcgaaagacgagcagataattataacaaaataatcaacgaatcataattaatatcagtcagtcactattattttttaactgtcagagatttcaaacaaaactaatatcaagtacaatcaatcttgatatctcattattatgcatacaaagttacaatgcggttgcaaattcatgagacgtggtcaaagaaaacgatgatgatgaagaagaaataagcaatttgttatgttaatacttagtatcacacgtgtatccatgcacacgacatacaaatcatgacattatcccgaaaaaaaccaaaataaaattgtagtatatgaaataaatgataatgcactaagaaattagagtaatgatgaaagatagaggagaacagcttttgctttataaagcagtttgcttttgtggtttaaaaagtggcttgtctgttgactaatcactgcgtagacaaagatttgatttttgtgtttgtatataagcttagcagttgctcgatccaataatttcttcatcaatcattttttcattgtgcagtagtaaagtaatgaagtactagactcatgtaaaataataatatacgcacatccgattgggaacaacatggtagaaaaaaatatcaaatttccatatatgttaatcgaaagacaaaatgggggaaaatcactattttataacattaagtcgcatcattattaatttcttgatcaacttaactataactattatgtactacatttggtaagttcttttcaaacttttgttttctctaacaattttcttttattttagaccaaatgttaagctctcaatcattatttcttcttttggaatttcgagttttgtagttttctcattttaacttcatttcgatcatatgttttccgtcttatcaagttctaattctaccctctaaagtaccatctaatattccaccgcttaaaatatccaattgacattgtcacattcggaagaaaagaaaaccatccatttggcgaaagcacatgttatattatcaacaaacaacattgataaacgatatttaatttcaaatggttgacaaaacatattttagcacgaatttagagcatagatagaaaaaggatcaaatatcttaatataattaatgaatagttatgaagatattaacatatattaactgtgatgagtgggaataaaaacagagttaaagggagtcattaaaaaagaaaaagaaaagttctaagtcacagactcacagtatatctcatcgacacaacgagtgtcccactattataattttataattcacagtttatttaactttgcgttacatcacaataattttcacactttatcacttcgaggccacttggttattcttcccggaatataaatgctttattaataacagattaatggtgcttagtgcttaccatataaattcacttttcacctgctctaattgattaatagtatgatgtatttttttttatgaaggcttatcttaggtctaattgattatcgtttgttgctttcctacatccgagaacaggttgagtctattaatcctctagacttagaacacaaccaggtcttcgaatccaaatacattacttcaaaaaaaagtctaaagagtaagtaacatatctattgattttataacccaaaaaacatattaattgattttttgtttttagtacatattcgatttggtagcatcatccctttttaaagagcaaggctggtaaatccactagctcacaccattgtccatgtaccagtataactatgcaacattcaatacaacatttcacataattatttattttcaatattaaatcttaagtttttctaaaacagttgattgtctagaaaaatacattttcttcaaagcaaatatacataattgaaattgaaaacagtcgattgccaatgagttgatttaaaagaaaacaaaattatttattaaaccaaaaaaatcgtacatatgtaatatttcatcattgttaaactcatttgtatattttttatgatatagatatattttgttttgtgtctttttttttttcaccaattttgttttgtgtctacgattgtatagtaaaccatctttgcatttttgtaattttaagcactacaatatagttttttttcaataatttattctcatatatgtaaaaaacgaagtcgaattctggtaagagagacgaaattaaataaatggacccatatttgtagataacttaatataaatcaagtttttttttttgtgtgcgcgaagtatataaaccataaaaatcttatagaattctgtttttttatcacatgattgaaaactaaacatttcccgattttgtctctggccttttccagtttacagtctagaggaccattagataaataattggcagacaaatctttctctttctctttccctctttaactctcactcacaaatacttccaaatcaaaatcctctgttccatctttttcttaaaaacctccaaacaaagaatcgaaaaaaagaatatttcttatacaaaagaaataaacctcaaactctgcaccttagagattaatactctcaagaaaaacaagttttgattcggacaaagatg

SEQ ID NO: 2593 - DNA, 3000 bp, Unknown
  misc_feature (1)..( 3000): cDNA_ID_3068788_gDNA_ID_1620562_Annot_ID_160644 3000 nt of promoter + ATG
atctaacttaaagcattgtactttcttttatctcattctcctttgctctgctttcttctggtcaacccccacgagattccttcttatgtgattgtaaagagaagatttttcagagatgggtctcttcgaatcggtgaaatcaatcgattgggaacaagaatcgttcccaacttatcaagatttagggtttttgcctctctttgcagtgttcttccctacaattcgatttctacttgacagattcgtcttcgaggtaatttacttattcatgggattttagatttgttgtttcttcaatcgcatttattgttgtttcaccaaccaacccaaaaaaaaaatattactttcggatttctactttttagttatgagttatgacccttgagagaccaatcattagtcttgtctctctgtatgattctgctgatgtttagattttgtctgaaaataaatgcaatgtatatgaagatattgtttggtaggtgaaagcttacatatttgtttttattggtgtttgtagaaattggcaagtcttgtgatctatggaaggatgagtacgaataagagtgacaacataaaagacaggaagaaaaatagtccaaaagttcgaaaatttaaagaatcagcttggaagtgtatttactatctatcagctgagctacttgctttatctgtcacatataatgaaccttggttttcaaatactctctacttttggattggtcctggagatcagatttggcctgatcaaccaatgaagtaagttgtttcgttatggtcatcgatatcttttgtgatggtcatttgctaaaatatgatactgctatgtgtgcaggatgaagttgaagtttttatatatgtttgctgctggattctacacgtactctatattcgcgttggtgttttgggaaacaagacggtctgatttcggagtttccatgggtcatcatatcacaacgcttgttctcattgtcctctcctatatctgcaggtacgtatattatacacttgtgttgtggaggaaaggatacactgactcttgttttgtttttggatgttgatgatatagattaactcgtgctggttctgttattcttgcacttcatgatgcgagcgatgtgttccttgaaattgggaaaatgtctaaatattgcggagcggaaagtctcgcgagcatttcgtttgttcttttcgcgctgtcttgggtcgttctacgtctcatttactatcctttttggatcctgtggagcacgaggtttgtttaatatccactttagcgtttgttcttgaatgttttttccttgatgtatatatattgtggggttttgatttgcagctatcaaatcattatgactgtggacaaagaaaagcatcctaatggaccaatcttgtactatatgttcaacacacttttgtatttcttgcttgttcttcacatattctggtgggttttgatttaccggatgcttgtgaaacaagtgcaagatcgaggcaagcttagcgaagatgttagatccggtacgcaataaaaactcttattacaatattttgagacaaaaacactctattaataatgttcatgtctttttgcagattctgaaagcgatgatgaacacgaggattaatcgcatgttgggaatattagtagtgcacacgctctatatctcatgaatctgaaccacacggagactaggaatttcaacatcaagtaggatgcattgcagtatttgaacagttggttcatcatcttccagaggatcgtaaccggatcaaaccgttttgaatgaatcggtttctcaatctgaatttttgagtttattgttttctctaaagtttgagcaaattcaagattttgatcaaactgctccacgttctattgttttttcttctataatttttaatttacgcttttgcaataacacaattccttgtatcattatactaatgtcatctcaaaattagctcccttcaacatctatgcaacagactaacaactaaatgaattttcttggggttttttttggttcattgcataatttgataaaatccaataaaatacttggaaaggataaaagaagaataatttttcataaatgaatgaaaaaaaaatcagcatctttaggcgcacaatagtatcgcacgatagcgacgcacaatagtagcgcacgatagcggcacataatagcgacacgcctatgggatttgtttgaggttttagctttctcgctgtcttggccgagaagactgaaaccaattgcaacaaaaagaaagataaaaaaaaacaaaaaatctcttctttgttcatcatcatcgatcgattctactgcaacaaggtacgtctttttcacttccttctctgaacaaaactctaaattttgttgcttttttttttcctgtgtcgtctcgcgctgcgattcttatacatcttggcttcaagtgatactttgcttcccaactcttgaaatgtataaattttgagactttactggagattttgagttgggattgttttcatgttcttaaagattcgagtttcgatctctatatgattcagtagattgtaattttgaatcggatgtctggaaaagaattgattttatagtctcttaggttactttaagtagtactttgcataagatctgtgatttgatgattgttatcttttgttacattgctggtggagtataataagatgagcaagaaccaacagaagtttgcgtttgatttaggttatttagcaactagtcctgttttggtgtgtttctaatctcactcactgggtctctcttatgtggaatataagatatttgatcctacgactgttagtgctttcatgctgggtttataatatggatacaactgaattcctggcattacattttttgttcagaaccaatgaactgtttgtttaggtgtcattgttatctaagtgcttgcatccttcttctgatgtgtgtgtgtcttgatacaggtctgtgagattttgataaaagctaagat

SEQ ID NO: 2594 - DNA, 3000 bp, Unknown
  misc_feature (1)..( 3000): cDNA_ID_3068774_gDNA_ID_1620562_Annot_ID_160651 3000 nt of promoter + ATG
tgagaaagatttcttctccgttgttaaatctagtgaacgcgtcgtttgtcacttctaccgtgagaattggccctgtaaagtaagtttgtggattcttcgtccatgtgatctttgagtttctttagagcttgtgagggattagtaagtaacaatgcttgagttttttgctgctgggcttcgaaaagtttgtcacttgttggtttgatccacaaggtcttcttctccatagctactagacatgttttagcttaagattcaagtttatatatgccttgtggattaatcattgcctgattcttccgtgtcatctctgagtttatttagagcttggaagtggtgtagtaataactaacaatactcttgataagttgtagcaatgctcttgattagtggatgtaatatgatgttgataagatatatgaggcacagaaccaaaagtggtgcttccactagacccgtttttagcctaaggttcaagtttataccttgtagatgtttctgtattgtctgattcttccctgtgatatttgaatttcttagagctttggaagtgatataggaacaatgctcttgtgtgtttgtctctatgaagattatcgctgtcgtgtttcatccgagtgtgcgggattttttgctgctgggtttagcctttcttcaaaaagttattacttgttagttttattgttttggtcttgataagagatgttaggacagacatggtgcttcttgtctatagccactagacctattttagcataaggttaacgaaattctctctacataccttgtggatttgtttacattgcctgatctttcctgtgatcgctgtcatgtttctttggaatgattgatgtttataaatggaaaaatctttgtgcaggtgatggataaacacatgagcatattggcaaagcaacacattgagacacgtttcgtgaagatccaagctgagaaaagtccattcttggctgagaggcttaagattgttgttcttcccactcttgccctcattaagaacactaaagtcgatgattatgtggtatataataataatgcttaatctaatctcttagaatatgatttatatggatgatacaatgttgttgttgttgataggttgggttcaatgaactgggagggaaagatgattttagcacagaagatcttgaagagagaatagccagagcgcaagtgatccattacgagggagaatcatctcttaaacaaaagtctacaacacaagtcagaaggaacgtgaggcagagtgctcgttcagattctgactccgaataaatcccttttcttatcaaaggtttgttcgtttgtatcctcttgttagttgtaatacttgcaattcatcgttttgatgatcaaaatcaatgttgatcgttagattgatgaacatgcaatatctagaatactacattgatgttttatatgttacctagtgagagtgttggaatgaccaaagtctttttgagtttgttctttaacttttgaaaaccttctgtctcataccatgtcttctcgattcctccttaagtctgaaacctagacaagtcaacaatcgaacaacactttccctaatttttttaatttattagtaattgatagtggagtacatgaaatgttttatttaaaggacgaatcacgttacctaaactctcatagaataaagtcattaatggttgcattagatctcttaaacttgggaaaacaattatataggacacgtgatcattttactcaacttggttaaacaacaatactattaaactaataccccaacaacaaattttaattaatatttcttatcgatgcaagctacttctactactactactaaattattcgacaagaatccaaattaatgatggcgaaacttcttggtttcatcgatatttaacatatatcccgatttcgatcaaattgcaataatgtcacaaatccatacgaattccacatactaataataaaactaaaatacaagtcatggatgggtcatggtcatgtatacaatactagaaaaagtataacttgtggacatcataaaagatagcaactttgattttgtctacaaatataaaatgtagatgccatattccttgaataaaaaatgaggccaaaaacataaaataaacagaagaaaaagaagaatatgattcttttagaaaagttaaactatagtagaacagtctgtctctctttgtttgttgtatttatatatagtaataaaaagatttgaataggcaatattagttttatattataataatcactttcaaagtaaattactaattatttcgttttttttaactatttgttttgtaaattactaattaatttgtttttttttaactatttgttttgtaaaacacaaaatttgattttttttgtattttacactgaaaaatgggaaacaataaaatagaagatcgttacagatacgcaaagcactccattccactctcgtcccgcttcgcctcttttagggcgcaaccaagagacagagaagaagagagagactcgtaagcaacaataaccaatagctctctctctctctctctctctctcctctgctgattcttcgctgactcttgcctcctcgacgtcgtcttcggctttgtagcatctcgccgaagcgtcgtaagttctcttcttctctaacctctttgcccttgagaatcttagatcgaatctgctcctcctttactggaatctaacatctttaaaaagtcgagtttcgttatactcctccaatcgcttctccaagttcgtgtatgttgttgaatttgaaggaattttttttttttgtaaaaaataaaagtcttgtctttttcagatgggtcatgtcgatttcgtgtttattgctttagggtatttgaaaagtcgtcgtctttgaacaaaagattgaacctttaatgacattcttggtctgtttgttgtttttgatctttgaacaggttgatttgagagagacccaatttggattgttagaaa

SEQ ID NO: 2595 - DNA, 3000 bp, Unknown
  misc_feature (1)..( 3000): cDNA_ID_3068792_gDNA_ID_1620562_Annot_ID_160642 3000 nt of promoter + ATG
agaacgtggagcagtttgatcaaaatcttgaatttgctcaaactttagagaaaacaataaactcaaaaattcagattgagaaaccgattcattcaaaacggtttgatccggttacgatcctctggaagatgatgaaccaactgttcaaatactgcaatgcatcctacttgatgttgaaattcctagtctccgtgtggttcagattcatgagatatagagcgtgtgcactactaatattcccaacatgcgattaatcctcgtgttcatcatcgctttcagaatctgcaaaaagacatgaacattattaatagagtgtttttgtctcaaaatattgtaataagagtttttattgcgtaccggatctaacatcttcgctaagcttgcctcgatcttgcacttgtttcacaagcatccggtaaatcaaaacccaccagaatatgtgaagaacaagcaagaaatacaaaagtgtgttgaacatatagtacaagattggtccattaggatgcttttctttgtccacagtcataatgatttgatagctgcaaatcaaaaccccacaatatatatacatcaaggaaaaaacattcaagaacaaacgctaaagtggatattaaacaaacctcgtgctccacaggatccaaaaaggatagtaaatgagacgtagaacgacccaagacagcgcgaaaagaacaaacgaaatgctcgcgagactttccgctccgcaatatttagacattttcccaatttcaaggaacacatcgctcgcatcatgaagtgcaagaataacagaaccagcacgagttaatctatatcatcaacatccaaaaacaaaacaagagtcagtgtatcctttcctccacaacacaagtgtataatatacgtacctgcagatataggagaggacaatgagaacaagcgttgtgatatgatgacccatggaaactccgaaatcagaccgtcttgtttcccaaaacaccaacgcgaatatagagtacgtgtagaatccagcagcaaacatatataaaaacttcaacttcatcctgcacacatagcagtatcatattttagcaaatgaccatcacaaaagatatcgatgaccataacgaaacaacttacttcattggttgatcaggccaaatctgatctccaggaccaatccaaaagtagagagtatttgaaaaccaaggttcattatatgtgacagataaagcaagtagctcagctgatagatagtaaatacacttccaagctgattctttaaattttcgaacttttggactatttttcttcctgtcttttatgttgtcactcttattcgtactcatccttccatagatcacaagacttgccaatttctacaaacaccaataaaaacaaatatgtaagctttcacctaccaaacaatatcttcatatacattgcatttattttcagacaaaatctaaacatcagcagaatcatacagagagacaagactaatgattggtctctcaagggtcataactcataactaaaaagtagaaatccgaaagtaatattttttttttgggttggttggtgaaacaacaataaatgcgattgaagaaacaacaaatctaaaatcccatgaataagtaaattacctcgaagacgaatctgtcaagtagaaatcgaattgtagggaagaacactgcaaagagaggcaaaaaccctaaatcttgataagttgggaacgattcttgttcccaatcgattgatttcaccgattcgaagagacccatctctgaaaaatcttctctttacaatcacataagaaggaatctcgtgggggttgaccagaagaaagcagagcaaaggagaatgagataaaagaaagtacaatgctttaagttagatttagtagtagatctctcaaatttgattttatctgttacaataattatgagttcttgatcggatcagaatttattcgagaatgtatgtaagttgcacttgctggagataggccttaggttttttactgatccattctcgatgggctcttgtttttttttttttttctctgcgtttcaattattttcttgaaagtaatgaaattatactatccatatcttttatattatttaattcatagcattttaaaaactattactattttttttctttttctaaaagctttattttctttttcaaattttcaaattatttattttctttctctttcgtgaagagatcaatttgaattttttatttctttgtaaaaatatgttgattccagcaggcactgcccatcaataaagcaggtgaagcatttgctttaggccacgcagtataaaaataatctgaaggccacatttcagacttatatgttggtttgttggtttagttgtccattactaagacagttagacagatgtgttgagtaatgcctttcttcagcgatgatggtaatacaataatgcaaactaataatataatattcatgtctctaataagtactatattacaaattaagatcaatttgtcttctcattattcttctctgtatatctagaaatcaccgttgttttattaaaaaaaaaatctacgttaacactaaaattgaacaagaagtatatataatttgagaccgtcctcatcattgtacttgtaagtttacgattatgatataattagtcattagagaacatgaatatgctgaagaactatattagattatttaactttatgtatatagtagaaatatgatatctcatcgtaccaaaaatattcgagaaacaatcaaaacccaaaatccctcttatttcaaacacgtggcgaaatcctgttcgttcataactggcagttagagatgcaaacagaatcaaactgtagggagtaaactgtaaatacttccttttcaaagtaagtgtatttgatgataatggttctctgattagaaaaggctccggctttatcattctcagaccatcatcactaagcagtaagtaagcactataatcgcagaagatagataaaatg

SEQ ID NO: 2596 - DNA, 3000 bp, Unknown
  misc_feature (1)..( 3000): cDNA_ID_3068800_gDNA_ID_1620562_Annot_ID_160638 3000 nt of promoter + ATG
aataaagaaaacaaatcagcctacacattattgttcaataatactcatatatgtataccacactacattgcatataaatattgcattaacataagcttatctctcatgcattgtagaattcatccaatgttgaagttaaaggtggccacatgctaaaatatgcatagtttttattttcaatccaaacataatgatggcaccacttacgagatctccgcaaagggtcaaacttgcagttcattaatgtttgctaaaccattatattaatgagaaaaaggtccatcattatgttttatggcatctgatttgagaacgttcacgttgttgattttgttgtttccttctaataaataccctaatacttgtattaagtcagagtatttgtaacgacagtgtagatgcttcttttctttctattattaatcttattaagttattatataacgatgagtactcgcattacgtgcggactttcactttatatcttgtaatttaaaagtatttaaatgtaaaatttagattagttttttaatagacaagaagacaaaattcctatttgatactaagctccataaatcaacattgtttttttgcattttgcatttaaattcctaacaaaatctattctcagtaaacattattttcagaatttctttcatttgtgtcaaccttaaaccaaaaaaataagacaaaaggcaaaaaagattggagtacccgctctgaaatccatggtggtagtatttaagtacaaaaattaagcattgataatcgggttgtctgttcgtttaaataaaaagatgttattaagttatactaaatagacaaatagaaccaaaccttgataagccttattgatttgttgaaacataaatgtaaaataattttctttttttaattttcatagttgccacttttacaaaaaaaataaaaaaaaatacgaactccataaccgaaaaactctatcactgaggatttgagtccaagaatttgatgctagagttctcatgtatcaccatttttaatatattatatagaaaaagaacaacttacgaaaactattagctaatccactataaaattatttaatcatattttgacttaaaattataaaatttagggaaaaatatccaagagtataagaaaatcaattaaataatttaatttaagaaaaagacatacaaaataaaagaaaattattattgatacaattaattatgtaaaagtttataatatatacaattaaataataaattaccataaaccattaacttacattaattattaagtggacatgtggcaaaagctaagtgatgatgtgtcattcatatgaaaagagttgaccaactttcatatatatgattataccacatatagataaattataaatttatgatctttatatatacaatgtttataaaattacctacgtatttgttattgttagttaatttgttattctagatgaacactcatgctacgcatgggtttttatttctaaaattgtcggaatatatgattatggtcttttgttgattttgatgttcagttttgcgtgtgtttaatgtgtaattaataaatttatatctattttatatagttataattttttttgattaaatttatctataattcgaaatatcaattttactataatatgaatatttatatacctattattcaactatttcactatcatgaaaacatacaacatcattttatgatatattaatatgtaattatattacttatgtattttgaaacttgtttaacttaattttaacaaacaattctttattccatatattctttcgtcatctagtacaccaaccacatcatgatatgctagcaatttaagtcaacactttaattctgttcctttgcatatagccgttcctttgcatatagccatatagattctcatatttctgtgtggatatgtctaatgcctcggatgaccattacgtgaaaacattgtatatcaatgttatcaagttatcagaccgcacaaaaataaacataaagaaggtcatatgataaataagattcacataaaacgtaataataagaaaatatccaactaaaattactaaattaatatgaggttagatagcaaacatctaaactacaacacacgtaaatgttagccattatggattaataactattgataaattttttttaaaaaataagtaaaatagaatgaaagtagtacttgatacattattatgattttttatttattgaatgtttttagaaaattcactttaagagtgagattaatagaaaatgtaacacaacaaaaaacttttaatttttcctcaattaattttactaatttgtttatttaattaatgtagaatgacacatgtcattttcttgtatgatcactcatatgaagagagttgaccaactttcatatatatgattcatcactcttacaatttcaactaaatatttagggcattttcatccacgagaaatccataaagtttctcaaacaaaaaaatattaatattatattataatttgattatttgattaaaaaaatatttttgttaaaaaattaaaccaatagtaaaaagaaaattgtcatgatggatcgtaaaaagtatctcaaagtttctgaagcgagaaactttctacaatctctcttttacttttattatttttatttttttaactatgaaaaattcttatgagatactaccaatggagatagttttagaggttcttctataaccatccgctatggtgtaaaataaaaactcatccacaaacgtaaaacaactactcatccatccgcaatgattttcttttttttgaaacactatataaattttaaaaataaaacgatgagactacttataaggtatttttgcatataaaagtataaagttcaattttgtgtgtcggtggtttcctgatactcttgtactcttacattttcagtagctttcccacgtgaccaattattttactccctttcttagtccaattatg

SEQ ID NO: 2597 - DNA, 3000 bp, Unknown
  misc_feature (1)..( 3000): cDNA_ID_2163853_gDNA_ID_1620562_Annot_ID_160636 3000 nt of promoter + ATG
accattgaacggaatcaaacgccttggagatatcgatctttatggcgcaacgatctgatactgactctttatggtagtctttaacaatttcagtcgctagtaataagttctggattagaagacgatccttgacgaaagctgattggttccccgcaataaactgtggaagaatttctttcaacctctttgcaatcaactttgatatgactttgtagatgacattgcagcaagatataggtctataatctttcatttccttggtctcgaacttcttagggatgagagcaagtatggtagagtttaccccttttggtaagaatcctttttcaaaaaaagacttcaccgccactataaattcagcacctataatctcccaagtagctttatagaactcagttgtaaaaccatccgggcctggggacttatcactcgacataaaaaacagaacagtcttaatctcttcccctgtgactggttccatcagtctacttcgatcctctgctgtacacctaaatggtaacaaaacttgaagttcctccaatgtagctccctcaaagtcatttggaaccaactgcaaaaactcacggaaaaaagttctgcttcttcttttatttcttctcctttttttgttacactgccatcttgcctttgaatctcacgaattgagttatgcgctactctcgccattaccgctcgatggaatgttttgttattcttgtcaccgacttgcatccaatggagctttgacttctgtttcaaatatttttcttctatttccgccaacagttcccatttctcatgcgcttcagtttcctcgatcatggcctgtggagaaggactcttcaaattttcctcttgcttttgacatagggtatcatgcgcttcctttgttctctttaccaaattacccatcttttctttagccagttgacggatttttggtttaagtgccttcagctttttggtgaatctaaacatggtagaagttgacatataaacaggctctgttgttttccagtaagcttctaccataggacgaaattcctgcatttccgctatagcattgataaacttgaatggtttcttccccttcactctttcaccaacatcaatattgagatttatcctacaacgtaaatgatctgagcaccctcctgcctcaaatacattgtacgattgcgggaaactcatcttccatttattattcaccagaacccgatccaactttttcagtattaaatcattctcctgtctattactccaagtgtagagcgaaccatgtgaagataggtcagtgaaagcacaataattcaccatctcttgaaactcacgcatcccataagttactcttgtgtcatcccctttagaatgctctgccatattcagaatttcgttgaaatctccaaaaattatccaaggcttatttcgaatgattggagaatcacaatgatctcttagatcattccataagtctttcctttccgaagcaaaatttgagacgtaaagaaatgaacaaaagaattcatcttcttggccctccaatttcactgagcacgttatgagttggccacttttatatatcggactgagcctagtgttattgcgccacacaacccaaatcctgccacgcctgttgtgctcataatttgtcaaaatagaccagtctttaaaaatttgatttcccactgtctgcatcttgctctcctgaactcttgtctctagaatacatccaaactgaaaattttgttcctccacccatttctttataacggaatgtttagtagatttgtttagaccgcgaacattccaaaagaaacacgacattaatgagattttttgttgtttctcttactctgatcattaggaatattcctggccgattgagtagtagaaaccgttttatgagctgttttggatccccttggtaagtactgtctcgagggcggatcttttgttcccctagactcatcaaccactgttgtagtgcatgctgtcaccggagggtcttgtgggagtataatctctttctccaccccctcttttccaatagttggttcatccactacttcatctacttcacttaaagctgagtagggattagacagaattgttaccgccccatatttaggcccctctgttgctttccgcggacttctacttgtttttggtggtgtaatccatctctgaccatcctcacccagatttccaataacgatttgtgtaggtgttacctctttctctttaacctccactaaataaattgataaaaataaattggattttttagttagaaaggtttggcaggacgttatttactaaaaaataaatgagttttttaggatgaaaggtttgactagaactgaagatttatgtttattatactataaagtaaaagatcaatcttgtaactcatttttattttacttcatatagttaattagataacttttagtaaattgacctctacaatacttttaaaatctctatatctggtatgtcaaagattattttaatcatcatcaaacagtgcattttcagtttttttttttctcacggttttttttttttttttttttttggtgaaagtggtggatttgcatgaaaatttctaacgtgtagttgacataattaaatttatctaacgtgtagtagtctgaatctttacgtttcatcacatttgaagattccttgtaagcacaaatcgtcgtgtggtcggtctttaaagtcctgcaaaaataaaagtcaccgcggcggcaaaatggaagcaggcttaaacgatgttaggatatataacatgggaatatggagtggtatacttaaacatgatctccttgcattacattgacatggtcttgattgaattttagtatggcagataattcaacaggtcagcaaaaacgagtcaagagaacatgtcaaaacagaagtttgtattcaaactataagaagcgaataagcgatgagatgaaacacatttagagaggagaaaggtagaagaag

SEQ ID NO: 2598 - DNA, 3000 bp, Unknown
  misc_feature (1)..( 3000): cDNA_ID_2163833_gDNA_ID_1620562_Annot_ID_160631 3000 nt of promoter + ATG
ggcagagtcagttaaacaccgtcggcgagaagaaatggggtttctgacggcggcgattagggtttcgacatcagcagcctcaatgcttctacgccgtaaatctcggcagctagggttcctagcctcctcctcgccgcttttttccagctttaattccatgaatcgcactatcaggtactactactcatccatcaaatcattcaaagctcgagcttttgattttgttgatttgattagattgagattagatgcacagagattaacttataatgaagtagctcgtgtaatattgtgtgcaaggttttgcataaggaatctcttactagaccaatgtggaacgttagcttcttaagatcctcttcgtttcattcaactccagctcgtgagaccggtgatgatgacattagcaaatctgagaacagttcgagtcaagatggagacagttgtactaaattaaagaggaagaagctgaaaggtaagcgtgcggttgtgcggtggctaaagtttttccggtggaagaaaaagaaagaatttgaaagaatgacttctgaagaaaagatacttaacaaactaagaaaggttagattgttagtgatgtagaccagcaaaattctattatgttcgtgtttatatcggttattttcgcaggctcgaaagaaagaggaacggcttatggagacgatgaagaagctggaaccttcagagtcagcagaaacgacacatgaccctgagatattgactccagaagaacatttttattatctgaaaatgggtttgaagtgcaagaattatgttcctgtagggagacgtgggatttaccaaggagtgattctgaacatgcatcttcactggaagaagcatcagacgctacaggttgtgatcaaaacgtttacacctgatgaagtgaaggagattgctgttgagttagcgaggttgactggagggattgtgcttgatgtacatgaaggtaacacgataattatgtacagagggaagaactatgtgcaacctcctactgaaatcatgtcgccgaggattactcttccgaggaaaaaggctttggataagtctaaatgtagggatgcgcttcgtgcggttaggaagtatattccgaggcttgaacaggagctccagttgcttcaagcacaagctgaaacgaagcgggattacacgaatgtgaaggttgatgataatcaagagaggtcagaagagttgaagaagattatagaaagaagcgaagagtgtttggaggatgagcaagaagaagatgaagcaggattagaactagcgacggattcagatctttcggatatttttgagactgattcggaattagaagatgcgaaaacagagcgaccactttttcttgaggagtttgagaaattcccagctataaacaacagagaagacgaagactttggggatctcgggaaggctaaatcagaaggtgaggagaatgatgatgataagtcaccaaactttgatgaagtagataagatgtttcttcgggctgcttttcttttaaagaagaaaagacgatgaataatcaatcatcagagattccatcacaatgggtacaagtaatggttttgtttagcaaagtcacaagtattatcttctttcttaacatgctcaaagctttaattctgtgatatttataaaatgtgtttaggagaagtagcttcaacttcaaaattttggtgtgaacgtaaagctcctaagtaagcttatgcttgtcaattcgttgaaaatcatgtttttgatatagcaatccagtggttaaaccaattttagacaaaactctaattctaggacaatttaaaaaatagtatcaaacaacctattaagtattaagcaagtaagtgtttaagattgaactgtaagattaatggagcaaacttcagaagaagttactcctccaaaaataggtgtatgccgtttgaagtggagagcacacggtattctttagtaaaaggcgaaagaatagttcgctttgtgctcaccacacggctccaagggttaagaaaggtaatcaccagatgctttatatatatgatgctttcgacttctagtttcggttttgctcgatgtgggacaaaacaaaatttgtttgttctttgctttgccaaactatctcaagtactgggccgttcccgtgggctgtttgtgtatttaatacatgtaattctataaatattcatttttctgattatctttttttttttttatcttcttttagcatttcatttcagaaaccactttttgatcagcttcatttaaagaagtatggcaaatgaagaacatagagaaggaatatattcttcctcttgataacaaacttgtgtacaaagtatatatagacgagaatgtgcagctaaacctaaccgactacacacgttaaacatacaaagcccatctaatttcaggaagttcgtgatcagatcatggtatcgagttctatggactacatgaaaggagattactttacgtgttttgatccttaatccagaaaaacaaaactacttgttaatgggccttcagccttctaactccttggttgaaaatataatcaagtaagaagaatgttcttgagatagaggcttcattccacaactgttagaagaatattaatcaaagttcttaacttttttcaaatgtcaggaaacctatgttggagtaagcttgaaataacttaataaataagttattaaatattacaaaggattatgttaaatctctaggagttatctagatatttaaattaggagttatctaatgttaatcctagtatgattaggtctaattattctctatatatatgagtcccaaggtgtggttgaccatatgagttttaaagagattaagatttagagattgtttaggttttgagttattttcctaaactataaagagagttattcttaaatctttgagttcttaatcttctttgaaaactagatttggtatcagagcatctaggtttgatattgaaacacaaac

SEQ ID NO: 2599 - DNA, 3000 bp, Unknown
  misc_feature (1)..( 3000): cDNA_ID_2163825_gDNA_ID_1620562_Annot_ID_160629 3000 nt of promoter + ATG
ccaataaattttctaagttctatggattaagaaaaatgttgaagagatacaaaaagaacatggatgttggagttaccgtaagcctgggatcttagagaaccaatatcctaaggcaaatgctacggcatggaatgtaacaattggaacaatcaatccaagaccttcagctgacagaatctgactgcgattaatcgaaagtgggcttccaatgcacaacgaagtgcataccatagcaacaaacggcatcacaggttgaagaagagtgaccacaggcttcgcataagtatttaacacaaggccaagagtgattggaacaagtaccacctacagatagtaaatcattggacgtcaagaacgatgaatcaacaggaactaccgatcctatgctaaatcttgttacctgaagtatagacttcgacatggcaactgcatcaacaggaactactgatccaattagaagaccactaagcaaaggtgtaaagattacagaagcaatagttgtagaactagtgagaagaatgctcatggccacatcagctttactcagagaactcgcgtaactagacaactgagccccagccacacaacacgtgagtataaaaccagcgtagaaggtcctcggcatcccaaatgcattagcaactaaaaccccgagaagcggtttcaaaacgtactgagcaacaaacccaacagataacggcactggtctgcaaccaaacaatgttctcacaaacgttagaaaaccagcttaactaaactgatcataaaacttataagagaatgctccaagtaccttttgaatgcaagagcaaaatcgtcaactgaaagctgaattccaatagataacataatccctccaagagcaggagcatagaggtctttagataccctgaaaacatttcatctgataatcatcttaaaaccccattcaaaatcttagtttctctaaacagaagatgacaaaacagagtcaactaagtaaaagccatagactttatcgttgattctcctgataagattcatatatatacaccaattttgtaaagatataaactttggcattacagagatagatagagagagtttgtgtgcaaaccaagtgaaactaggtgggtaagagagagcagcaacggcagtgagagcaacaacaaatggaagcaaagcagaccaaaactgagacgaatcagctttctctgtaacatcagttccaccacaaaacgataacagagacatattcccatctctccaatgtaatccaactctgcccataaacggcgtcgttgaacacgccaccactggaaccaatccgctgtttctccgccttagtctaaaatctagaaagttactaagcgatgaagaatggagagaagataaaggtgaactagaagaccggaattgacaattgaaggattgagatttagcgggaagattatgaaattcagaaagtgattgtctttgtatagctggtggtgggagagacagagaagcgattaaagtcatttctatattggtctggattttgtaaagattggatttttaggagagtaggtgacggagagaggtgaagcgccaccgtgaaatgacgccgtggaccggcgaaggagggaaattgagagggtgaggtttggagttgaagaagcaggaggaggaagaagcgataatatagaaaattggaatttggaaatatataaaggggaaagatttgttaaggtttgtttaggcatgattgacaagtgatgtgcaagaaaattgaacggctgagattggttggcgacgtgatcgtcgatgactctttctagcattgttggttttgtgtaggccttagttttgtgtgagtgaatttggatgaatttgggtgaaagattgttgttttgtttggtacatgttggcatcttttttttccccgtcaaacatacttactttagcatccttatattaatacttaaaaaaccaatacatggtttctaagcatccaccaatggtcttaacaaaggtgatgaccaacattctaatcaagcaaagtacaaaccacaagaggagacaaatttttgcaatagcatctgcacacagtgctagttcaatggatccggagtcccaatacatatatttaaaaatggactcttttatactaattgtctttttttacaaaatcatatacctacatatatatataatataaaactttgggtccttttaacaacatagttagaaaaagagagtatatgagctaattaacaacatacttacaaaaaaaaaaattggcccggaaagtatcttgccacttcttaacatcttctactgcctttaaaattactctttgcgcctcttcatggtcatttatgaagaatatctcattttttacatgttggcatttatatatacatttttgttagcgttttagccaaaaatccttaatctattttttaattacagtttcaatctttatgaaacctatctaacaaagatattattctacccaagttttgcaaataaatcttaactacattcgatatatgtaattctgaatataatatattgtataaattaaatatctatatgttaaaatgtacaatataattttacttaaaaatataatgtagaaaaatatgaaatgtcttacaataatattatagaaatatttttatatttgaaaagataacatagtaatttttttgtatttataatcattttattttaatttaacaatgcaaatttaagatctttaaatgtattatgtcattcaaaataatgtatatacaactggatcatattctttacaggtaataacattttctctattatagtagtaagaataaaaatttattctttccatgtttctttttaagtatgattttcattttaagtctagattggattttaccatacaaatttcaatagattcccaagatttgtttccgtatctatttttgttaaacattaccaaaattcttataataataagagtttgctagtaattgtagctcaacgttcttcatcaaa

SEQ ID NO: 2600 - DNA, 3000 bp, Unknown
  misc_feature (1)..( 3000): cDNA_ID_2163829_gDNA_ID_1620562_Annot_ID_160630 3000 nt of promoter + ATG
ccaggttgctctagcatggatggatttgtctacgagcacggtaagctttatataccttttcttgtgtcgagaaaaggattcatatataactcgaaatagggtctcatacaatgctcttttatgttggcaattgtatataagcaaagataatctaaacatatgatactgttcaatactgttgcaggtccattcaatttcgaaccaaaaaagaagaactcacatcttttgcatctcaatccttatagttggtccaaggttgaaaagaaaaacaacattgacttattttcaaacattttcttcaaaagaaattgatctataacttttaagaatgtgttttgttttcaggtgtccaacatcatataccttgactctccagttggtgtgggattctcttactcaaatgacaacgccgattatacaactgatgatacaaaaaccgcgtctgatactcacacattccttctcgaggtgaaataagaatgtaaaagtttttaaaaaagatttccttgtgttgtgtgtgattcaagacactaactattacatccacatcagtggtttaaaatgtttccggagtttcagtcaaatccgttctttatatcaggagaatcatatgctggtatctatgtgccaactcttgcggccgaggttgtcaaaggtcagtattatctctctcaacatcatctttagctccttttcatatattggcagaattagaaaataacgttatctccaatttttctcatcgttttcttgttatgttgtaggaaataaaaatgcaatgagaacaaacaaaacaagcaagaatgtgacaaagccggttatcaacttcaaggtacgactaatgtttgaggctatgtttcggattcaaagtcttatggttttggtgttaaataaataccattaagactaagggtactaatgtagttacctaattgtctctttgtatatgtgagagaaagagaaaccttcttcctatacttgaatgttaaaattggacttatatgtggtatagggatatttggtgggtaatggtgttaccgatgaggtgtttgatggtaatgctcttgttcccttcactcatggcatgggactcatctctgatgaactctatgaggtttgattttgttggtgaatttttcataattcttgctttattcctcaatttttattttttctaatgtgtaacaaaatatggcaggaaactaaattagtgtgcaacggaacatactataccggcggccagtcaggagtgagtaaagaatgtgctggcaaacttaaaacagtgtcagatactgtgaacttattgaacttatataacattctagaaccgtgctaccacggaacatctctatccgccttagatatcgagtttctgcctaagagtctccttactctaggcaaaacagaaaagccaatggcggtgagaaagagaatgtttggtcgtgcatggcctctaggtgccgttgtgcgtccaggcattgtacctagttggtctcaactcctcgctggctttggtgttccttgcattgtaagtagtaaaccacatcatgcatctttcctcttatagtatttgctaagtattaccgtgcatgattgccactttgaaaactaattatcactaggttacactcgaatttacatatctacatttggatacattgtatattaggatcatatatatacataaatagtttaaaaagttgtaagaacaagggtatttaattttcatcattagacacaaatagttcatttgatcaaattaaatgtatagtaccaattgtaatacatttgatgattctccacaattttagaaactgaaaacttgtaatggatgcaggacgatacagttgcgaccaaatggctaaacgatccagctgtaaggaaagcggttcatgctaaagaggtctctattcaattcatcatatttctctcaatcagtatttgtaataagttgatgatggacattggacaccattttaacatcttggaccttttttcgaaacgtcgatataggaaaaagcgattggaaattgggagttatgttcaagcaacctcgaatataggcacgacaccggtagcatgatcgaataccatagaaacctcactcttagtggctttcgagctctcattttcaggtgcacatatatagaaataaatcaaaggtaactaaaagtaaaacgaatgaaaatataaaatataacaaaagttaaattttttgcagtggagatcatgatatgtgtgtaccatatactggctctgaagcatggactaaggcaatgggatacaaagtggttgatgaatggaggccatggatgtcaaataaccaagtcgccgggtaatttttttgttataactatctttcggtcagtttttttcccaactcattgtttctacaattttgtgttgtaggtttacacaagggtatgccaataatctcacatttctaaccatcaaggtacaaacatcacacattttcttcatattctatttctacaaatgaaaacgatttgtgttttagtttaagtttgaatgtttttttttgcatgcagggtgcaggacataccgttccagaatacaaaccgcgtgaatctttggacttctatagtcgtttcctagcaggagaaaagatatagaattctcaagttccatgcatgttcattaataaaaatatttataacaataaaattccattttttcttcaataaaaacttcaaattttgtaatgtaatttacaaaaatgtgaaggattctatttcgtgtactaaaacaagtttttctccacacaaaaaaaaacatatactgttctgtattttttcaagggaaatttaaattgaaaagttaatactgtatatatttgactataattcaaaccaaaccaattaaaccaaaaatttagaaaaccaaaaaagttgaaccggaattgaaccgatatctagattgaaaccacgggatttattgaaatcgtcttccttctcactattccggtgtagctgctcaaaa

SEQ ID NO: 2601 - DNA, 3 bp, Unknown
  misc_feature (1)..( 3): cDNA_ID_2163635_gDNA_ID_1620563_Annot_ID_160660 3000 nt of promoter + ATG
ctg

SEQ ID NO: 2602 - DNA, 3000 bp, Unknown
  misc_feature (1)..( 3000): cDNA_ID_2163658_gDNA_ID_1620563_Annot_ID_160666 3000 nt of promoter + ATG
ttcttttatcatcgactaatcacaattaggctctagtacaaaatttgattatttacaacaaccgttcaaactccaaagattgagccttttgagatgtggacgtaacccttagttttaaaggtggaaacctttcgagatattttagagcatctttctatatgcagatccccaattgcaaaaacattaacttcatggaaacagtagttacaagcaagagacacaatacaagttaaatgtttgtgttttgagaagatgtcttggtaaaggaacaaaatttcatccagatatgaatcatttacagttaaaaccaaaagatggaacctttccgacatttgagcttccatatgctcaagcaagtctctgttctcgactcctgatagcgtcttcactctgtttttaagttagtgagaatgagttccgctaatatatcgacccatgtgtcaggaacaccgggtaggcaccaatgcatacagtcttgtccccatattgccaccgcgtcctgcttccctaaccagatcgctgggtgggcatctgctctgaattcgcttagatgggtcagatcaagtaacttgatctttgtcgtttgcaactcattcttgatgatttggttaatctttcttgcttctttgttcactccattgttcctgggatcaaaccacaagtcaagctgtctaggtcttagcatcaacatcatttatcagaatgcaataggattaaatcgaaagcgaatatctttgccacccatctctgaggaaagcctagagaaagaccagacttgcttagtaaagctcgttaccatacctggttttcttcgagtggcttatcgagcaaacaacttccattctggttccaatcaccaccatagaaatgccttggtgattgcaaacgccagaacttaagggtcttcgcagggacttctctttggatataagaaaccatattttgaagaactagttcaaatcctggtaatatatcaagaggaggatttatcggctttccctttcggtagaagacaagaggtgtctctttaggaaacttatcgtaaccccacctaaacccaaaaaccagacccaaatactcatgaataatttcttcacaaagttgtaagcataaagaaaaaaaaaagaaaatccaaggatataattattaccaatggccagagttaaatatgagaacatcatagaagctagtgacgttgatccactcatttgcaggaacatcaacatcaactcgataagttcctttcactccgtcttgattagcttcagcagaagatctcgcctgccaccttttaacatgtcagtttagaaaaaacaaggctggaaaaaactcaacatatacacaaaaacattattctttcagtttcaactcttaacataaactggagaaaggagttgatgttccttatacgattctaaaaccacctaacaagcctataacccaaaatcctaagattcatcaaaagtttgatccttgaagagctaattacaagattttaaactatggaagtaagcaatcttactgatatttagcgagaagaacagctctgtgataagcaacagtgacattgaacttagggaagtaagctccacgccaagcttttttcttcttccacttaatagcacttggatcagccactctaagtatacacaagaacgaaaccaagaaattctcattcagagaatccccaacaaacccaacattcttgttcctcatcatccctagaaaccgggtcgggtcaattcgactcaatccacatccattgggctcccatctccatgaattgataacatccatattatctcgcttgttccgtaagcaattccaagcgtttctgtggaaaggacaagtctcgtcgtacaacggtttcggagtttctggattgaaaacccatctgccggagaagagatcgcacggcggaggagaggcaatgtttgaagtaatcggacggcggagaattaaggaatagaaaaggagtaataagagagaaaggagcagaatacgtggaagaagtgaagaagaagatcggagcttcgacggcatcgtcgtgtagattcgtctggatcccaactccatcgattcgtctgaaactggagagaatgacactataatctcgcggttgagccggtaatttattccggttcggtttaattttatacggtttaaattctatagtattcggtttaaatcgattttgatttagaagataattcatttggttatctactgcaaacctcagagtctgatatacttaaactgaaaaagaaaataaaatggataaagataaggataataatattggatggttcaaaatgtaaaacacaattttggtttctttagagttatggttttggcttggttcgtacgagcggacccaaatggttcgtatacgtggttagtattattgacggctctcaccattttattatttttgtagaaagctttttaaaaaaatcgttttcattggtccactgcatggataattaatttataaaagtaattaaaaagaaaaacaaagcctaatcatccaactaatctaatcactttctgcttcttcgcctacttcattcacatcttctttcctcttcctcctttgggttacttcttcgaatctcctgtgtaaggttaaaccaatgtgtatatatattatatttacgtttttattgtattcatctacgtgaatgattagctctgtgaaacagtgaaagtatcattttaatctctacattttgttttttgtgtaatagtgaaaccattggcttttgattttgagcgattcttctgaattcgattggtgtatgtatttcccttctttttaattcgatcttggtgtcctgatttatatgtctccgattcggattttgtcttaaaaaacgaaactttagtttttgttacagtgtgcaatttgcttgtgagtttttttagctgctatcaattttttttgcatctatttatcatatcctagttgatggtttttttaaatcagtgtttgcagaaatg

SEQ ID NO: 2603 - DNA, 3000 bp, Unknown
  misc_feature (1)..( 3000): cDNA_ID_2163655_gDNA_ID_1620563_Annot_ID_160665 3000 nt of promoter + ATG
caaacaatcacggttgcaaagtaatctgaacatttcagtacttctctctcaatctacggatacaatgtttcagctacaatctctctctattgttttcatttcaggtggtggagatagtggttcctgaactggaagagatgcgtgcagcccatgttatttcgattgggtctccaacactgtcttctcttactccctactgtgaagctgggtatgtctctagctctatcatctatgaaccaaattagaactttggtttaagaactcccacatttgtcttgtatttcaggaaaaattcaaaactaagttatgacactcgtaccagctttgcaattttccgttcattctctgcttcagactatatcgctgctcaatgtcttaggtaagcggcaatagaataatgcactgtatgcgcagctttcacttttgcttctaaagtcacaagagtaaaccaatattgatagaatttttgttgcaggcgaagattgatggagtatcacttgaatatcttcaaagacgttgatgtcattgtgacccctacaactgggtacgtaatataatttcataccttatcaaaccatctagcaaattgaagatccctatattacttgcaatgtcttcggatatagttacttgtatattacttactgcttaaactcctctcactttacaaacagaatgacagctccagtgatacctcctgatgctctcaaaaatggagaaaccaatattcaagtgacaagtttgtcaagcaaaactctaacttcttacttttggtgcaatctaatacatagcacatttacatcagagttctgatattcaaattgcttcttttctagctgatttaatgcgcttcgttctagctgcaaatctcctcggcttccctgccatatcagtcccggtaagacattttttttatcagtctctaaccaaggcttagacaatcatgttacttatttcattcttgcaatataatcgtatcttctttctgattaatcactctctttttctaacttattggcaaacaaaaatcaacgcaggttggttatgataaagaggggcttcctataggattacaaataatgggaagaccttgggccgaagctaccgtccttggtttagctgccgcagtcgaggtactctctctttttctctctctgatacgttttcaaaagatcaagtagaaactagtgcggtaagaggcggtaaatagtaagagcggactctgtaacttgaatcgattttggtatttcaggaactggctccagttaccaagaaacctgcaatcttttatgatattctcaatacaaactgaattcataaggatcttccacagaactgaaaaggcaaggattgtctctggctgcggaatattatttatgtttacattatataaggttaatatgtcaattgatctacaaatcgacgattattgtgctataaaccgtgttggaatttcttacgtcgactatgattaattttaaaagatgtgaattagtcttgagcatacttgtaaacttttaaaatgcattttgaaaaaaagtttagaaacctgaatgctaagtaaatctacataacaatgcaaaaacgagttgaatttgtggaatcactaatgacaaatgctagatccaaaatccggttagtttcacatcgtcttgcaaatttatttatccaaatttctattatttaaaaagctttaaaacattgttttaaattccatagaaaaaaataaaaatcttatataaaatcattagaagcttgaatgttaaatctacataacgatgcgaaaacaagttgaatttgtggaatcgctaacgacaaatgctggatccaaaatccggttagtttcacatcgtcttgtaaatttattatccaaatttctattatttaaaaaacttttaaaaaattgttttattgaaaaaccttcaaagttttaatagtaatataaaaatataagtttaaaaatattatttaataaatgaaaaataagtgttaaaaatctaaattaagtgtaaaccatattgaatctagagtacctcttaggggtttggatgatgtatccaattagtttacacaaaacagaaaaatttaacaattaataaaaaaccttaaaattttaactataatataaaatatacatttaaaaacattttttaataagaaacaagtcgaaaactaaaattttattatagaaaagtttaaaaatctgtaagaagttttactaaaatccgtaaactttaaaactttagcgaataagaagttttagttttatcattaaaagaaaattaaagagaagggatgaaattgaccttggttttatgggccgaaattgtttcttgtttgggctttgcacaaagatctctagttttgacaaccgtcaacggctaactaatcccgatctatccaccttctcaagcttgcttctctttgatcatctccgtcgacgatgtagcccccaccgcgtcagaattctccgtagaagagagatcgcacacacatacatatgatctcgcttctagttattgtaaacaaagggctcatcttccatcacgctctcgtttcttgttggcgaaaagcaacggcaacaaatcaaaagatataaaatagaagaagtaaaggaagcaggaatcgaagaagatcatgctataaaatcagactttgtatttgcaattctcgctctataactctgtctttctctgatttgtgaattgtgatgatgagactatattttgtagacccatcttctgtgtaatttcctttctttcaactcaagtttccttttctcttgttactcttctgttgtttccttttttaccctttcgtttggaaaattccggagtaaaaggttcggtgaataaggacgaatgggcctaattaatatctgcaaggcccagcccaataagatatactatctaagaacagatttaaacccctaataaataaagttttcacgcgtgatctgtacgtctttaatttacttgtcctaacgcgtgatcggaaacc

SEQ ID NO: 2604 - DNA, 3000 bp, Unknown
  misc_feature (1)..( 3000): cDNA_ID_2163645_gDNA_ID_1620563_Annot_ID_160662 3000 nt of promoter + ATG
atccacctccggtttctattaaaccgtcttcgttactcttccttctgtatacagcttcctgttgttgttgttgttcttgatccctaatatgcatcctctgaaattcctgcatttgtctttgaatttccatcggatttacgacgtgatccggttgaatcacacgcggatcgttaaacaaaggcggttctaacgccacaggaaccggtaatttcacctcagccggtggtggcggcggcggagctgcaactttctccgatccaaacaaaaaatccgcattattcggaggagcagttacggatttctccgattcagatagcctaggaacagtgttcaacgcctcgacgaagcgatctcgatccgattgagtcgaactttgagaaccaaatccagaagaagccgggaagagaaacaaacgcatcctcgctggcttagacgacaaacgaagcaagcgatcgtactcgtgcatcatatgctccagatcatcatcgttcgtaaccgagatcaaagcgtctaagtcttctcccggaagctgatacttaaacgtaacttctcctccgccgccatcaccgccgccgcatacggtggagagtttggaagctaaaacagggaatctaatcccgcgatcaacggaaagaatcttcgtttctccgtttacgtaagtgagctgattatcgtgaggccgtggctgaatcttgccgccatagctgcacataaacttcaccttgtagctatgttgctgctggttctggttctgatcatcccatggaggcggcgggttatcgaattcgatctcacgagatctcggtgacgagtcggttgaatctggataagagttgtacgagaatttctccatctctccgcgaaaattaaatgattttttttgttggtttggcttaattcatgaagagaagaaattagaaagaaatgaagaagactgttgtgatgaaatggtttttattatgtatcggtgatggtggtgttggaaaatgagtacgtgaacttattgctcatttacacgtggcctgtcagattttatgagttttaaggcggtgatgagattatgtgacggttctgtgacgttagctgaatctctccatggattaatatgacttttggggacactgtgaatgggcccaacactagtgttttgatacttcgacgttgaaagaggccagcttttagccttttacatgttttttcttaatattttgttaaatcaacattagtgaagcaatatttttaaggttaagtgataaataaatagttaagaaaaagggaaaaacaaaagtcgttgtcgtcgatctttcgcctgatcaggcttagatatgttttatgattgtgttattggatttcttttgtgtataacaaatatttgaatgtttgaatcatcatcattcatcaactgtattacacatccgaatagtctttgggttagttctagaagatagatgttttttagtctgtcaacatgcagaagaaaactgtaaaagggtcaacaaaaaaaaattgttatgttaaattaacatcaagaatataagataatttaaatttgacaccggtgagtgtatactcactttctcgattgtttgctattattatataccttagattattgccaacttgcaccttattataaacggtgaaattgttgtaattattcaaacttataatagacgtatttcactagcatgccgaaggtgcaatcatggtcgtacaagaacaatatttatattgtcaaattcacgtaacaatttttgttgttttccttgtttgtcgaagacatgtgcattgattagtatttcttccaatattattttgtgttagaacttagaaatgttcattattttctcatcctcttaaataatccatatatatatggactaatcggcccgccgtcccggtacgatgttgctcgatcagtcataaatcaagtcgtgtctcgtggttgtttgtacttggcagagcaagtcaatcaaccgaattttggtaaagatgcatcttagccaaaacttttgatttcactagatatactagaatttagcattatacgaatgtcgaccatactttttgattacttaagagcctcttatatagttagtcctattattgatagttttcttgtagtaatatttgaatattataacgaatcaaatttttcgaatctaataagcacaaaagaaaaatggaatcgaatattattttaaatgaaactatgtactaacataaatccaattatgttcaaatgaaaccaaatcaaataaatgaagtattcctagctttgaattagtaagtatcatatgaaatggctccatatggaaaccaaaaaatccaactgaatgcaaatgaaagtgttttcactacttcatcgtaaatataaagaaattgttaggtgtgataatgaaaaacattagttaacgggccaaaattatatatttacataataaaggggtagtttcataaatttgagaacatggttggaacatttcaacaaatgagacgagttcaatgtacacttgaattatgtacaaatcagtacaagaagcttaagatttgaagctaacatataacattcaagttcccaacaacttcaccgctcatctccgcacggctttcttcatttagtaatccttcgccggatcggatcatcgtttctcagattcctctttttaagtttcttctttcaggttcgcaatccgaatcttccacaaccattgttcgtttcgcctgtgattctggtttctgaaatttctgccttggcgtggtttccttgaatctgattacttggattctccgattctcatagttcttaccagtttttgttttttatttcacttaatttgttctgattctggataacagattcttatgataaggtgaaagatactagagattcatcggttttgttttgttttggcaattttctcaagtgtttgacttatagaacagtgacgtgtgtgatctatgatatcaattccaaacttaatgatgttttgtttgtag

SEQ ID NO: 2605 - DNA, 3000 bp, Unknown
  misc_feature (1)..( 3000): cDNA_ID_3068834_gDNA_ID_1620564_Annot_ID_160674 3000 nt of promoter + ATG
taatttgcctcatcaggccaaacaaatattcaatatatagtggatcatgctcattatttcagtgtgtatttatgacgatcatacatatatgttccgagaatgagtacgacttcaaatattcatcacataagtaaaatgaaagatgattttttttttaatccaaaactgattatgtaaacttagtattaagatgatttgatgtcaaaatctttatcacatgatgtaacttatcaaagattgaatagctaagctagtccttgcttatcaagaatcaatactataatgaaaattcatgtatgcaaacagggcaatagaaaaatcaccagcttaaattcgacaaaagcaatgcgggtttggtggtaaaagtctccaagcaacctcagatggtgaacctaaaacgaaatgaaaagatggtgtaaaatgagaaaacacaacatctttataagtgtataaacaatcagcgacagtcaaaaaccaaatctatacctccccacaaactgttttaaagaaattttccaactccatcttagtgacctgcaattaaaaaccaaaaaataaaattggtaaaatttaaatttcaccaatgtctaacaaatgacataataaagctacctccttgtcaatgttggtacaataaacagtctttccacacttctctagctcgtccttggactgaaggaagaaaacaacgttatgcatataccacattattgataagaacaagattgattcaaaattatctagtcaagcctagctaagattggtttagacatgattatctcaacttacttgtggaaggaaagacgggttaacaggcgcaatagctgttttggacataaaaaccctaataggatgagaaccaaacatagtaccggattttcgtaaagcagacctagctccctctgagacatcacttcactgattaataaaaaaacagcaagaacatctcaactcataagaaaattggcgcataattgagtacctgcatcggtgaactcaatgaaggcgaaacgaagaatggacttatagtcaccgcacatacggcaatcaacaacctttaacccaaaaaaaaatggcaagaaaacttatgagaaatgagtttgcataaaatcaaaacgaagatcattaagtaagtacctggccacaagaaagaaagagacttgcaagctgctcctcagtaacctacaaaaagaacaagagggtttttgttatgtatatatgattagattctttatgaaaacgtgttttcttgagacaatatttctctgttttgtacttggttatcgatgtctgagacatatacagttctcttgatcatatcttcattctgaaccaagtttgtttttttggttatccatggcctccctttgccaaagttccttctctgtgttaattgacaagacttagagagcaagcacaaagaagaattacaatcatatttttcaataagcaaattgaaaagctgatcctaacatgacaatctatcaccatctaaacctcgaaatggcgaaaaatgtgtgttatgttaacaaattgattaaattcctcaacaccaagacatctaaaatgaaaaatatatgcaaaaagagtcataaccatttagagcagatatttcatgaacacataacatagttcacagaaaatagtatagatgaaatatataccattgtagcaaactggccaataagaaaaatagtttgctttggaaaatggttagtaaaccagaatctatttccccaaaactcagagtggtgggtttgagccagaaaagaagggacaaattccttagccatcggattcaaatgacttatctcactcttgagattcacttcactggttctttggatcaattcgtttgttagaacagaggatttggatttaggtgtctgatcatcagaacatgatggttttgtctctactaatgaagtagtgttgttgtctatattctgattattagaagagtccaccttcacaccaacattttccgcgacagccatgatcaaaccaaaagatcaatgaatctttagatgttggtaataaaatataaaaaaacaactcatgcactggagaaaggttagaggatttaaggagatgattaaaatagaggaaaaattattatgctctttatagctaaaacaattagattttctagtcaagatttttatttcatttttttttgacattagtcaagaaaataagcaaatacaataaattataattatttaaattttctttgtgtcagcacaatttctgcatttttttcttactacatataaagttattattacattaataggattctgtttatttttttaattatctctatcttatttatctagttttggtaagagagaaaaaaaaaatcgaaccggttaatcaattcaataccggtcggccaagtgtctctcagaatttgaccccaattcgatccgatattctgaaaacgacaacgttagcatttcgccatttagaacaggaaatagtttccgtgcaaaagcttcggtggctcttctcccaccgccgtatgttcttccagcgctccggaccgccgtctggtctgactttaatttgagatctattccgatccctaacagctacttctggtatactatcgttctctctctctaacacctctgcgtatttggatcgtattgactagagtcttcccattatacttgcatcgttctctcttccatggtttcgaacttgtttaagcttatagtcttcaataccttctaactatctaaaaggtttcgtgtttcaatttgcttctggtgcgatttgctcagtgttttctttctctaccggaatcagctctagacaaattgtttgctatgttattgtattcactgggattttggatagtcccagtgaaaatctttcaatcttgttcgtgttacattttctgatttatgagaggaataaaagtctaccactttaggtaataacttatctcttttgattcttgtatcacagcaagtttcaacttggaaagaaaca

SEQ ID NO: 2606 - DNA, 3000 bp, Unknown
  misc_feature (1)..( 3000): cDNA_ID_3068830_gDNA_ID_1620564_Annot_ID_160676 3000 nt of promoter + ATG
ttaatttgaagtttttttatccaccatgatatcaatatcggcctatctcaagatttacatataatctttaattagattaacggattggttagattatctaacgtagataatgtttgattgtatggatgttttgaagaccattaatgccaactagcttaagttttttgggaaaatggataagccattagcctttttgtttgtttgttcatagagcagaccattagccatttatgatattataagatggaaatatctcaagtggcctaaaaatgaagaaaaacatcatacacatactgtaaagaacaaaaaaaaaaggaaatatcaaagttggccacacaaaaagagaggccatggaaatatcacacagacaaaaaatatctgtttgaaaaaagatggagcatgttcagtgtaagttaggccaaaatatctttagattttattcctcaagccaaaagtcattgatccactacacttcaacaccggtgcgtagagcatcatccaaccaattaatcaaacattttctttttcttatatatcgttgagttattagtcaattgtggttattacgctcgtctgtatatcataggttcgagttcaagtaatttaaagtttgggcgacaaaacaaaaatagtaaaaaatttgtttcaaagtatcatgttgtgtagttgaattttaattttgccccacatattatctttttgattaataaaataaatatactttcaaatagttgtaatttatcaaataagtattgatcatagaacagtgattacttttaaaaacagttgctaatgttttaaaaatgtaattctttctcgaatttcgtactttctattacatattataaaaaaataacttattatttagataccacagtaaagttgttatccgtaaaaattatttgacattatatatcgttatcatcattatacaaattttttttgataattcagatgattttaatggttttttatgtccaaagagtaatcttcaagcccgaaaaaactatgttaaaattcgaacttcggtgaccaatattactgaaatccaaatgacgaataattattttctggtttattattggacgaatgcgacttaattattttgtctattttatatcatttctattagcaacatcataataaaatttctaatatatgctgtcaattatgtgaccagcaacaatatagtaaaacaatgttaattaaacccatctaacaacaataaaaatttgtcactgacatagttttcctatatagcacttatttttcttttgtcaataaaacacgccggcctaaacctatttctcagtttaacgcatgaagtgctagtacaaggaactaaaccacctggcttattattaaccattttcttcatttgtttgattgatcattacactaattgtccttttttattacctagtagtttactaagtttgattaagagaagaaaaccatagggtccagtcaataaaaaagaaagtcatagcgtaggacaagactcttgttacaagagagcgagtaggagagatatattacactcgcgggcgcgtaaagagacaaggaaaaaagaagatatttagtctctgacagtgacagctaccatttaaaggtgaaagactgtgtcagataataaccatacacgtgtcatattcctatccaccaaagaaccacgaggtttttaaacaagtgtctctaatctaatcccacccaacaacaaaatatctagccgcggaaaattactttaaaattcatcaccctttgtccctactcttgactcgtgcatgttccatttgatttattccaccacgcaaccaaaatagtagcaatagaaaaaaccaaaatgttgataaaaatttggtaaactatgaatctctatgatcgatattcatttgtttgattgttccatttcttttctaatgcaaatcaatattaaagtgttcttatttcgtgactaaaatatatggctggccgaaaaaatataaaataatatatgacatttgctattagttagcaccagtgatcatttggtgtaagcaaatgttttttgtgccaaaaaataatattgaaatatatgtataattaattcattaacaaaaagttcttatttgttatttcagaaaataaattataccatgtgtccttgattttcttatgtgaaaaaaaattgaaatatccttattgtttttaaaataaacaaattgcaaacctatgtaccaaacagaaaataatacaattgtttttggataaatttgtatagatactttttcccactagcattagatattttttgggtttggtattatcccaaaagtcacgagtgggatttttataggtactcaaaagctaaaatgtctgaacaataatataaaatacattttaaaataaaagtaaaatttagaagcatcaaataagtaatagtttcaatgtttagtgttgatctcttattaaaagaaaaataaacaagaaattcactaaatatttctccatcacaaatacataaacatcaattgcaataaatattttggtaaagtataataaaaaattaaatccaactttaaatatgaaccacatagaaaaaccaaaggctagccaccacaccaattttttcttaaaagaaggttatttggcgtattggatctcttttgtctcgtatacagtattttgctgatgtggcaaacgtggccacgtcagccaattctactagatattttttcaaatccaaatactctttccacaaccgttagatcatggtcggttcgccacccactttcaatcataaccgttaaaacattcgctagattttttctagatattttcttttctccacactattatagaaagaataaagttcttttttttgctctcttctcatttatctctccactcacaaatattttgatttgttttgtaactgtttctctttctctggagctttcttcttcttcttcaataatcgatttaggtttttcaaagctaagtgtttgtgttgtgataatg

SEQ ID NO: 2607 - DNA, 3000 bp, Unknown
  misc_feature (1)..( 3000): cDNA_ID_3068855_gDNA_ID_1620565_Annot_ID_160682 3000 nt of promoter + ATG
tggacaacgcaacactttggattctacttcctgtgtgctattcaagtccactttcaacttttcctgtgaaggtttgagacatatagattgagcagagaatcttgcagctgaatctgaactgccaaaaattccagttgctgccttgcagttgacaccgggaaacttttcagcaacttggggtttcttgaaggtagggatcaaagaaaaatgagcggctgaacaaacatcagatctgggaagctgactgtgtttgtctcccgcactctgcgacggttgagagtcagactgcaaaaatatgaagtatgttagagttacaagaacaaaaccatagttatctcacgatagaattcagtatatttcaataatatacctgactgaaatagccaattgaaggttttggcgctcttaagcctgatggctttcccagtcgtgaaactgcggactgcgtgcttccagctttattgcaagaactttgagctaacgaggtgcccagagtaattacattagagtctggaataactgatgcatgaccaagcatagccacatctgatgcagtcatagggccaacgttggattttgcaacaacagaatgctgtgagtatgatactgtcggaatttctgaagatttgctgatctagagttcaagaaaatgcaataggttactcttaataggaagaatattggaaacaaagcatttgctgcaaatttttagtgcataaactatttgctatattggtttgcagagggcagcatagctttaccacatttcttctagcttgcttaagagagggcttaggaattgaagatttactcgccagactggattttgttttactcttggtgcttgaagtgtttttagagaagctttcagatcctaagctcctctgagaattctctgtcatatcagacaaaaaaccatgtagcaatatataaacaggatgaaaagtaacagaactaaaaaggatatgagatgaatagtttttatttgctaactgaagtgaacatacttaattgagtaggttgactgtttttcgctttgattggactttgagtagtccttttcatgttgtttccaactgtaactgggtcagatttggtagtaggaactttagatatgctcagctccctgcaacgtgatgttgttgtatgcacatttgcaggtcttttcagggtgcaagatggttaaggtaaacaagcaaaaagaacacaaacaagacctgcaaaggatatcaagattgcctatacactcagtactcaaagtaagaaaaggatatgaagatgaaggaggaggccggggacagccactgcgcttggaaccactccttaaatcctgagctgagataacttttttctgggcctataatgcagatattcgacatttagatagactgcgcctcaaaatatatatatttacgcaaggaaagaaacgacttatgaccctcattagctccacaatatttaggtccagtaaactcaccgaggaagattgggatttagatggtgatccgtacttgggcattatgccactgacaagcttcttctctctgtttttactattcacaggcaagtcgttaaataagttttcttcaagtgcttgtagtcctggtgaaacattacatttggaagctgacattgactctctgtactcttcctgaatggcagctaaccgatctccaccaagatggcaagcagttccagttattttagataactcagatgaatccaaaacacctggttcatgaccatatcacacatcttaagattcttagtaacatagaccaaatctttgacctttactactaacaggaaattggtaaaaaaaagtcaccttcttccgttgaaaaagctctatcccatgctaaactcttgcgcaaattaaaccctgcattctttttcttcttcttcatctgttgtcgctccacactcaatttgggcaattcaactttagcattctcctttcctacactatctgtatcaactgaagcgcatggctgctccctgttgttgctggtgcctgttactcttcctgcaaaaagtattaaccttcatatatccgcagaatacacaacatttatactaatttgctattttatcaaattaagatttaaacaatgctaattcagatgcttaaacactctaacaaagggagagagaaattatcagaacgaagctcggatcgagaacgagaaattgaagcgcttaccaattggggaaaaaggaggccgagtaggaacgatacgactagatctagggatttggagaggtgagcatttcaaataactctttcctcggctcgaattagttttcttcggcgtattcttcagaagccaattatcttcgtcgtcttctccagagatatctaagagatccttatccatttctagcttctctttcgagcccaagatctgacgattaggaaatccggaatcctatagctaggttttttcaaacttacactgagaaaatctcttcggaagttgtaggcgaaaatcctagtcggtaaatcggaaattgttcggccgatggaagagacgactgttgatagaatatcccggcctcgtaagcgggaagaggttgaaaaacttgaaattgaaagaagatcggaccaacgttctctataatctcaggttattattgtcatttaaagcaaatcgattgggccggactttaaagcccatttatttgaattttaaattctcgttcaccctttattggtttggtttggttaggataatattttttcggtttgattaaaatcatatcggttcggttcatggagcattgaagtaaaagtagttagcacatgttttatttttccatttgtagcaataagcctagaagacaatacagtctctgtgttatgctacaaaaggcaaaatctctaaagcaaaccaaaagatcggagatctattaacaaagctcttttacttttctattttcaagaaccattttcaccttcactttcactaaaagagttagggtttcaaagaggtgaagatg

SEQ ID NO: 2608 - DNA, 3000 bp, Unknown
  misc_feature (1)..( 3000): cDNA_ID_3068848_gDNA_ID_1620565_Annot_ID_160696 3000 nt of promoter + ATG
tccaaaaggctagggattctaaagggtatagcttcagctcttaaatacttacacacagaagctacacaagttgttctacacagagatatcaaagcttctaatgtaatgttagacacagacttcacaggaaagttaggagattttggtatggctaggtttcatgaccatggagcaaatccaacaacaacaggagctgttggaacagtaggatacatgggacctgagctaacatcaatgggagcttcaactaaaaccgatgtatacgcatttggtgcattgatccttgaagtaacttgtgggagaagacctgtagaacctaatctgccgattgagaaacagcttctggtgaaatgggtttgtgattgctggaaaaggaaagatttaatcagtgctcgagatcccaaactgagtggagaattgatacctcaaatcgagatggtattgaaattagggttgctttgcacgaatcttgtgccggaatcgagacctgacatggtaaaagttgtgcagtaccttgacagacaggtttcgttgccggatttctcaccagattcaccgggaattgggattgttactccggttttggtcggaggaagctccaccgtgatctctaacatttcttctccggtgactgagtttattactcactcgattcaatacggaattggacgatgagatgtaaaatttgaagcttgaagatgaacgttgttaacaaaaagttgatatggccgagttggtccaaggcgccagattaaggttctggtccgaaagggcgtgggttcaaatcccactgtcaacattctctctttttttttttttaaacgtttgcaatattttactaatgtatatattaatttatgaacatacccctttgtgtaattaatttataactatacccttgttaattctctgatttacaatattgaaagtcttctgggaattttgggagacaacatactccaatttcagtttcttctggaagaaaatcttaattttgctacaatggtgaaccatggaaagaaggaagcctggattatggctctggacaaggtgaatttcctttctctgcttctgggtattgatcatcaaacatgagttctggaatttaaaggttttgagcgattctttagctacgaaatgtgtgaagaaggaataacttcagttcagaacaaccaaccaggctctatgtttcaattagatacagctcaaaggttttcatctaatctggatgttctcatgtggtcttctaaagtcaacaagaagctctgggtttatggctttggccaagcttcctttctaatggattgttttagctgatctatagttcggggatgcaaatgggttacggtttctttctaaggacatgtcttcttattctgcttatcttactggtaattatagcgctcatggttcttggagtaggatatctattcagaaaaaagacaagacatatgtagatgtaatagaggctttcatgcaaaaaagaagtagtagaggcatgagaggaggttcttcctggtggtaaagacacgtgtttctaaatggaattgctttagctcttaggtagttatacactgaaatatcaaggcttctcatgttttgtaaaatgctgagttaaaggcaaagtgagtaggttttgtgtgaccatgggtccaacctagataccgttgtctctgtgcgaactttaggtcaaatcgcatggagcttgcaacaatggctgtttgcacagtaactgacatgtatgcctgtatgcttgagcaaacttttggaaaggaaactgtgtaagctgggatgctagctgatagactgtttgaaaatgttggaaacagataagatctgagttcagcttagaaaatagggtcgctttgctcaaatcaaatggtgtgccagaactgaaagcctccatggaagaagtggtgcaatatcttgaagttggaacctggtcctattctctgctgattgttggaatcttccttcattagcagttatccagaaaatgttcaaagctaccacaaggagcaggtatctgaccattaatctcttatctgatttatcactatacagtaatggattttcaccaagttaaaatttcctgctgccacaaaaaactgcctagctacctctgcggaatttaggttgtctaagcaaactaaactttcttctatctaattttgtcccgctggtggtgaggctactatgacataaccaaacaatgaaagaatatgctctatgcgattccctctgtctattatcttctctccaatcttagtttcagtgatttgaattgttgttcatgtgacgatgtattctcctgcacctgtagagctgaattagcaagtcctaaagggttaggttagtaactatatatttttgtcaattttcatattcaccatttaaagaaaattcgtagttttcatgaatatgacaggctttcctaggccttttccctttggtcgggctcataattgtgttgatattattacaaaacttggattttttattcattctacgtctgaagggtcaagggcatgtttaaaatatgtttaaaataatatttatttgtctgcgtccttctaaagatggcttcaaaattcaaatagaagaaaaatccaatgcaagtaggtgtgctatctagtcctacacacattttaaggaatttataaatgttagtcatacgcattattattgttccagggtacctccatgcaacagttgcgttgtctatctaataaattgagatcatataagttaaaatattgtgtcagaatattttgaaaatcacgttgaagctttatggttatctttttaatataatcgtgttagtggagtacagtttgtaaagcaaaggtgattctcttgattaaataaacatctattagaaagtttgataggcttgaatcactgatacagaagcttacatcctctttttgtccattttttctccagcttgcgaggttatgattcatcatcagatccagactctctgattcatcatctgca

SEQ ID NO: 2609 - DNA, 3000 bp, Unknown
  misc_feature (1)..( 3000): cDNA_ID_2167124_gDNA_ID_1620565_Annot_ID_160695 3000 nt of promoter + ATG
tttagacaggtgttggaagtcttattaagggaaaagtaatataccataaagataccaaagcagtcgtaatatttgactttgaagtcgtattcaatgggtctacagccagagagaaagagataattgtgaagcattgagagcaaatagagtatacaaaaacaaaagcgaaacgataactctctatttgtttcattaccaatgattcgaggattgcttttgggaatcatctggatgatattttgtgtttgttcatcatttcagcaagagacgccgtttgtttacaacaactttggtcacgtagatcatcttcaccttgacggtagtgcaagaatcattcccagtggtggtatcctgcaactgacaaatgcaaccaatagccaaataggtcatgttttctacgagaagccgattgagttcaaatcatctgaatcagtctcgttctcgacatattttgtgtgtgcactgctccctgctggtgatccgagtggccatggcatgaccttttttgtgtctcattccactgatttcaaaggcgcagaagcaactcgatacttcgggattttcaacagaaatggttctacttccacacgtgtgttggctgtagagcttgacacttctctagcttcagatgtgaaagacatcagcgataatcatgttgggattgatgtgaacagcgcagagtctattacatctgccaatgcttcttatttttcagacaaagaagggaagaagattgacataaaactcttgagtggtgatcctatccaggtttgggtggactatgaaggaacaacgctcaacgtttcattggctcctcttagaaacaagaaaccaagccgacctcttttgtcatcaacatccatcaatctaactgatattttgcaaggtagaagaatgtttgttgggttttctggctcaaccggatcaagcatgagttaccagtacatactcgggtggagtttcagcaaaagcatggcgtctctgccgaacattgacatctcaaaacttcccaaagttcctcactctagcactaaaaagaagtctacatctcctgtgctcagtgttctgcttggtttaatagctttcatagttttggggattcttgttgtagcttatttgtataggagaaacttgtactctgaagtaagagaggaatgggaaaaagagtatggtccaattaggtattcctacaaatctctatacaaagcaaccaaaggattcaataggagtgaatttcttgggagaggaggttttggtgaagtctacaaaggaactctccctcggagcagagaactgagagaagtagcagtgaagcgagtatcacatgatggtgagcacggtatgaagcaatttgttgctgagatcgtgagcatgaggagtttaaaacaccggagcttggttccacttcttgggtattgcaggagaaaacatgagttattactggtgtctgagtacatgccaaatggtagtcttgaccattacttgtttaatcatgatagattgtctcttccctggtggagaagacttgcgatccttagggacatcgcatcagctcttagttacttacatacagaagctgaccaagttgttatacacagagacatcaaagctgcaaatgttatgttggatgcagagttcaatggaaggttgggagattttggtatgtccaggttatatgacagaggggctgatccaagcacaacagctgcagtgggaactgttggttacatggcacctgagcttacaacaatgggagcttctactggaactgatgtgtacgcgtttggtgttttcttgcttgaagtaacttgtgggaggagacctgtggaacccggcttacctgaagcaaaacgttttctgatcaaatgggttagtgaatgctggaaaaggtcttctttgattgatgctagagatccaaggttgacagaattctcatcccaggaagtcgagaaggttctgaaactcggtttgctatgtgcaaaccttgctccagattcaagaccggccatggaacaagtggtgcaatacttaaatggaaacctagctttacccgagttttggcccaattctccagggattggagttctgtctccaatggcgctttccccagcaccactcgtgatcccttcactatcattttcgtcttcctcctccaacaactctatgtttattactcactcagtcctctacgggagtgggcgatgaaagtttctaacaacttccctcttctttggcctcttaatattgactgattttcagccatttctattcagattttgtttcattaatgtatatggtagcaccatgtccattctccatgaagcttagcttgtagaacgatttttaaaaaactgatttttcaggtaaattcttgcaattacttagttcattatttgtaaagcaagttgttgtcaccatttgagtacagtgataaattgttatgtattgagaaagctgatatagttatggatttgtttcttttaatggttatgctattttggaaaactgatagatatcaaaagacacaacagtttagtctgtaactaaccttattcatgccagatctcaggtacctgcaatatattattgcaaatcacgtatcctaggagatgcatgtttctgcacatttgagtaggctcttggcttttaaagagttaaaatactcggagatagtgacaattcaacattttatttcgtttaagacaagtaggacttggtatgacaatcaatgagaagcttgcctttcaaaactgtgaaactacaaggaaattttattatgtggaacttctgaattcttttatcaaagaagactaaaatgtgacagctatcatattgttgaagtcaactcttaccaattctcttggaaaatgcagaatgttcttcttcttgtgaagtaataatccgaccttgtttcgcagatggagaggatagttatttgccataccattgactcagagacaggatttttctcagaacagcaaacactttgttgcattaaca

SEQ ID NO: 2610 - DNA, 3000 bp, Unknown
  misc_feature (1)..( 3000): cDNA_ID_2167087_gDNA_ID_1620565_Annot_ID_160685 3000 nt of promoter + ATG
atctagtcttcccgagaaaataaattctttagctgcaccagctagtatacttggctgagtgtcacatgcttgcagctcaaagtcgcatatctcctcaggtttacaacccagtgcgtttgcaatgatctaagaaattaaaaagaggactacttggttactaaaccagaacaagatctaaaattcaagctaaaaccataaagcttatatatttcaactggacctccattagaagcggatgatgctttgatttagaactagtttcagcacacttctttccttcgtcatgttcaccactttcagctggcgttttattgagctccgccttcaaatatatcacacaatataaataaattgcaaaggaagtaagaattcaagtctgctacaaacttgacaacaatggtttcgacttcatagataaatctgccaaaagttaaggggttcacagagatgggttctgatctcaaatagtgggtgacatgcaaacaaatactttagccatactagatgaaacaaaatttagcagagacgctggacaacatagcaagcatagaaaaagcaccttaatagctgttgccagtactggaacgaggtgtgtctgagtgtttggcttaaaaccttcagtgttcacattcctgtccgcaaggcaaaacgaaacgtacataaagttcaatattaatttctctacataaagtaactgagaaataaataatgtttttttttatcgcaaacacgacaaaaaaagagtctaagaagtattccaatacaaagcaatgatttaaaggtaacctgtccaagtgaatggccaaggtaggaatcctcatgataggatcctcaatcctgacaaggcgatgagaatacgagacagaacctgctttctcttctttaagaatcacacgtcctgcaacagtcaagtcacgatcaaaccaggtgtaccacagtccacctccatatgtttgaacaccaacctccaagcatccacctttagttatctgtcaacacaatcctcactttctagtcaaaaaagatttaagtaaaaccgctggagaaaatgtcaaaaagatcccaaaatccaaaatcaccttggatacaggtttcaatttgaggcacggactatcagtatgagctccaataatatggaacccgtttccagctacgtatctgttcaaagttttccaaaagattagctctaacattgtagcaatagatggaaccattggtttcagaagaagaaggaaaagatggttacttgtgaccaatggcaaaagcaacaatagtggagtaatttctggtgaagaagtattttttgccggcttcgagtttccaatcatctctctctgaaatctgttcatacccagccttcaaaagccgtctctttgactcgtctacacataataaatagtagatcaatcaatcaatactagaactgaatcaacaacggaaaatcaatagttctcaaaaggaaaagagatgggtgatgattgacgataccgacggcatgaaaagcggtgggagaagcattgagaaaggagaggaaatcagagacgagggagctcttatccatggctggatctcttaacttgagttcttcgggtttttgtgaggcagcactccaatggatgttcggtttccgatcgtccctgtgtaagtcttgccggaggttccgtttccattttagtaacccgagaagttttattggcccattacaaagcccaattggttttttaaataaatagttatttattcatgagtacataaaaaaaatgttatttattcatataaacgttttatacttttatgtaaaaactttcaataaattattatacaaaaatttgtttcatttgaaattttgaattaacgcactatttaaaaatttgttcattttaaaaactttcaaataaattttgtagtcatatactataaatacccttccttatatgtggttggataattttggtaataacataagaattcccaaaactagaagattttatgtggttgggtaatttcggtagtaacacattcaaacaccattaaaccaatcaaaaccgaaccggactaagtggtaataaaattagaaatcgaagggtaataaattctagaaacccttttttttttttttttaacaagacagcaacgtggatctggcagacaaaatcatatatataaataatattaagagggttaaaaaaggccatcgcctcaaaaatcacagccatccattttctctttctctctctctctgtagctctctctcgttcgagcttccatttttcctcatcgcaatcttcatcttcaatctccagctatctcaaatcgatccttctcgaatcgtatgttttcttatcacctcttattgaatctccttcgttctcgttgagtttgaatctgctgaatctcaaaaccctaattctgtttcctccgaggttttttttattggcatcatcggtttattagtttggatcgagaaattgagattgaagattgagatttttggattaatctacatgtgtttatatttcctgtgattgatttataatgatttgttttcacttttgtccgttgacgcgtctttaattgaaccgtcgcggcgcatgcatagatcgatactgtgaagttcttcattgtagattcattttgttgtttgtaattatattgttagtattcgatctgaaatgttgaatatttagagtaaatttaagattttttaagttggcctatgataacgttgatgagatgagtgaacatagatgatttctaggattggatttcgaatgttatcatttagtttcttctgataattaatgaagttgccagcaaaaaaaaaaaaagttttttcattgcgtttggtttttacatgtgttttatctgatagctcatgaaataaaatttactttcttagcctgtggccttagctttgatgattaatgtgtcttatattctttctcttagaccatcatgagtgaccatggtgagaagacttgtccactttgtgctgaagag

SEQ ID NO: 2611 - DNA, 3000 bp, Unknown
  misc_feature (1)..( 3000): cDNA_ID_2167104_gDNA_ID_1620565_Annot_ID_160691 3000 nt of promoter + ATG
atgaaaatagcggtgataaaggtgaatgacatcaatggacatgcacatgctgccccattatgacacgtgttaagtgacggttaactagatttttttttgttttttttagttactttgactgaataatctatatatatttatagttgcccaaagaaaaaataatctatataaatttaatgtcatataatctatatatacttaatagtctttcaataatttttctttgaaaatctagaattaagaaatattacaacggtgattaaatatttttaacacaattgtgtttttgaacaacatttgttaataacttttttaggcagatatgattttttacattacattaacaaatgtaaccgtaaaacgaaaacagatattttaagtttagcaggaccccatattatttttaacgttttttttttttctttcaccttgacaaaaaaaaaaaaaaaaaaaaaagtttttcccaaccgacgataccatcaagtctcctcaatccaacgggctccttctaaatttccgggaattgcattgcacttagtaacataaatggtgccttattaaaaaatggtaagtcataagtgaatgggcttggacgcttggtaaataaaatgaataagctaacttagggcccatttatgctagactattgatgatttacgttttactttggataataaaaagtaaatgttgattgtttgttgatgatacttgacagaaacaaaaggaacatgaagaatatcttatacttcgtgtctgaataaggttaagatcagatttttctttgtttggattttatttgaattcacactccataaaagttacagagtaaacgatgtagtcatacattttagctacgacgactagagaggcaaaataaaatagtcaataagcaattattgttgacaaatatgtgcatgagaaacgatttaattaaattatcaactaaacaactaaaattaaagaaatagtctataaagattccccgggtttggtttggacatgggaaatggtctaaaaccggaaatgaaaattcaaaaatcaaaaactatcatcaaaacgacaaaggagtacgctttgtcgtgctgcgttttggaataaccttttgttcccttgtctctctctctttcttgctcagactcactgcccaaagccacaacacacattacccacttttctcttctctctctcacacactgtttcctcttggaatctgcaaaatacctaaaaagaaaaagaaaacttaggttttgcttctctacccacattttctttaaacaaaaattgaatcttttcttcaacctcaaacccttctcgcagcgtaagtagctccttttattcctctgaatttggttctgatgattatattctcatgaaaacttttagttactctgtctcctgaaagttgcattagcttttcctggaaaatgtagtttcttttttgagataaagttgtgattttttccacccttttcgttgcctcttttgcatattctgcttcttcttcacatgttaagtttcagaaagctctggtcttttaggttcccttctcatttagcttaaatcataagtaaaattactaactttttactccatgtaaatgttgaaataactaggaacttgaccttttgctctgaagaaattggaccttgaaatataaaaatgtctcctttttgttcttcttttttagtttgtaattattatttcagctattagtttacttttaaagtagaatattgggatagttcttcatatgtggtttgattaaaaaaaggaactctttttttttctttgtttttagtaacttttaaggttaaatgttgaggcttttctttgctgcactgtgattgtttgctcatgcttgctttaattaacatgatcattgcactcaagtgattttactaattagatactcctttttcctggaaaactttatccatgaaaccaaatagatttctgattccctttgggtgggtatttatctgttgatttttcttatattgaaaaaatgtgtgaaactcattatgattcatgatagtagttctttaacgtctaagtcccctccttccacgccaataatggaggagaagatgaaacttggtctagaaaattgacagtttaaccctcttgtgtcccattttggagggtgaatctggtggggacattaaagtaaatctaccacattatgctgcttgtgtagttgtgtaggacccttggtaccagccttcatgatgataggttgtgaacattacattgtcaagaggcaaccaatgaagattcgttttatgttactttatagtcaaacaacttttatagttagctacaatggttacaatgacaagatatgaattgtttttttctttctttttttgggtttatattggataaatccagaacaaaacttaactatacagtctttgaaatcatattttggcaatatgcttctagttcacctgagatgtgactctgattgtgttgattgtatcagtccattttagaatattgaatcaagtgttgtattctctattgagtgaaatagtaaagaccaagtttttgtttggtgttctagagctatgtagatgtttgatcaagaatcataaacacgagggcatgcactcagatcttaatgcggttttatggtattaatgcacaatccaacgaatctcaatgtctgactctgacataagacactagttagaagagcaataaaagattttgtttcttctttgggatgttcatatttctggtagtggatttgattatagacgtaaagatatatttttttacgcttatcctttctctgtaataactcctatcatgttttctctctgccattggattcttaattatgtctccatctttctgcattaaatattcatgacctctctacaattcttggtgggtcaggctacattgaagaaacaaagaggaggctaaaaatatcttttgtataaacaaggttttgattcatcctgtgttttggagaagtaatattacagtatg

SEQ ID NO: 2612 - DNA, 3000 bp, Unknown
  misc_feature (1)..( 3000): cDNA_ID_2167120_gDNA_ID_1620565_Annot_ID_160694 3000 nt of promoter + ATG
gccaagagcttactgtctctttaccctaaatctggagttaggagatgtgttgaatgtcgtggcctcttctgtgtggactgtaaagttccgtggcatggaaatctgtcctgcactgagtataagaaattgcatcctgagcctccggcagatgatgtgaagctcaaatctcttgcaaataataagatgtggcgccagtgtggcaagtgccaacacatgattgaactttcacaaggatgcaatcacataacttgcaggtatctatctatttctctacacattgatcctcctataaaccttatcaaacaaggccatgtaagctaaagcacatgtgatggattgcaatctttttatctatgtttaactattctgacattccctttggtattctcattagatgcgggcatgagttttgctacaattgcggaggtggatggaacaagataatggggacttgtttaaatcgctgcccaacctggaacgaagaatacatcacacgacaagatccagcgcgtgccaatgtggcagctaacaactactttgatgatgaggatgatgatgatgttgatggtgattacgactatgatgacttcttccacccgcattttggacatgctatgaatgatcgtaatcctgaagagcccttcgaccccttcttcgacttgccagatggtaatgtgtccttccaaatctctctaaaactcttgaatcctatatatttcacaactgaaagcactctctgtttatctgtaggtgtgctctttaccccccagatgttgtcttccaagagtcgtcagcaattgtacttgccggattcagatgattcagatgataatgcgacaacacaaaatgctcctgctgcagatgagaattgcccatactttgggaagtatggaaagtacactataatgtacgactccgacggctatgaactcgaggatttcacgaaccctttccatcctgactatcctcacttctgaggtttggtttggaaccaaagttcgtatttttctttcttttttcaaggtccaaacccttttgctatatgctctttactctttaatcgttttttgaggttcatgtttctatgacgtattgttctatataagactgtttgggtaatctttgaatttgaagacacctcgggattaaagttttttttttttccaaaaggtgtctttgtatatataacatctaaacaacagcatcatccatcaatggagaatccatgttggagaggcaagtacaagatacaacaacaacatttacaaacaacgaaatacaagtaaagtacaacacattctgccacaaaagagaaagttgtcaaatggtagcttgttaagagcaacatcataactaatctcaataagaccaaacatcaaaactcaaaaggtttggagttgatcttatagcttccatcatatgcttgtagtatgattgctttgtgctcaccatcttaacatccgaacagggtgatatcttctactctgattataagaaaactaaacagataaaagcataaaactaaaacaatctagactagaagcttaaccatgattaaaaagccaaactaaaataaaaatcaaaagcgataagaaagagataaggatggcacaatcaaccaaggaaaaggtgagtcatcaaagtggccggagagataccggaccaacttctccggtaaactgaaaaagattacagaaccttcaaaaccaccatgcccaaactaattccaaggcagcaaaaacatccttaactgctaaaagaaacatcttcttctttattcaatatgtcacaaacgaagattgagatatggcttcaaaaaccttcgagaagaagcatcttacacaaaaaccggccatgacgtcgccgaatgagccaacacatgccggactcaaaccgtccatcgccataaaaaggaaacggtcgatgacgaaaatgatagccgacccaacacatcgaataataagccggtcgttgtcggactgaagccggttgcaacaactggacggccttgccggaattaaccggacggctttatcggaataatctgaacggcggaagaaatcaagtttttctctctagaagatttaagagagagaagagagaaaaactcatctccgttttccccgacgctcatgacttgggattaaagttagagcattgttttcgctatatttttcgtcgtttggttattggtttcggcttgctcatctttttatttcccttcaatgggattgatagcgaacaagtaaatatatttttgcattcctatataaacattcgtattaaacccattttatatagctcacccacccacttaccctttggcgaaatcaattctttgtttttttttgtctaactcaccgtctctgtctctgaattcccagctggagatatcagtcgccgtctttttgctcttggtgaagatagattcgagaatcccgaaggttctacgattaccacagagaaattcactatagtgagtaccccatctattggatttgcagcaatgcatacgtctcgcagtcaataagctgaggcggagtcacgtacatggactttttgcttgagctttctaccaaataacccacaggttcgtcatttcttagtatagtgtcatgttgaagaattttcggtcacatgaatgttcaagttaaatcgtatattgttctgtgatgagaaagattataatctgcttataaacactgttccttcatatacggttaataatctctaaacttttgttttaaaatgattatgttaaatcacatactcaacaacggaagatgaagaaatgtttggattcaactaagcattatattagttatgcgtaatctgtagctgtagagaacatgatcttattgaattttgtttcttttgttgatgttttaacttctaattaggaagattgtaatctggttatgatatttttccttaaattaagtgttttactcgtttcgagtttttgttttctgctgattatggccattacaagacgcaaca

SEQ ID NO: 2613 - DNA, 3000 bp, Unknown
  misc_feature (1)..( 3000): cDNA_ID_2167116_gDNA_ID_1620565_Annot_ID_160693 3000 nt of promoter + ATG
aatcttcgcttacgtagttactgataaaggctcaggccggtttgtgatgaaccgtcggtatcttgattattatctcaatgattattccggttggttaaaggaccgtgtcacagataatggatattggagagatatcggatcgtgtgttagagattctggagtttgtaagaagattggaagagatttaaatggtgttccagaaactgctcatatgttttacttcagaaatctttctcctgttgaggtattattattttttttgtttaaaagaacatactagtgtactcttaagaaactattatgtcacttgttcttggaatctaacacggtgtgaacgttatatgatatgtatttgttttcaatctgtagtccggatgttgcaagccgccaacagattgtggctatacgtacgtgaacgagacagtgtggattccgggaggagaaatggtgggaccgaacccggactgtatgttgtggaacaatgaccagagactactctgttaccaatgcagctcttgtaaagccggtgttcttggtagcttgaaaaagagttggagaaaagtctcggtgatcaacatcgtggttgtgatcatacttgttatcttctatgtcatcgcgtgtgcggcttaccagaatgttaagaggatgtataatgacgaaccggtcggtgaggctaggatgaccaatctcatcctagtcattttcaaatttaaggagattttggtacagtttttcttcggaattgtgtttttattactctttaatggtttaatggtctgttgttgtaatgataaatttgcttttagtgttttcttctttggatatgttacatatgcatgatgatgattgttcttgcagattagttgaaagaaatgctactcatctttatatagagtagaaattaatttaaagttgatatgaaaaattcaaaccagacatgagttaccgagaatggttcctcaaagagtgttcaaattactcacgttgggaacatgttgttttgaatttgtggattgatcttcacgactgagttctgggctccatctacttatcgtttgttcttccactgtgaagttctccaaacatacaagtagattcacatcctctcctttgaagttaccattaacgtagagagtcaacaacgttttcgcaacacttccgcttaacctaacagcacaatggatatctgaccacactcttaaccgatcactgtcaccagactgaactaaaaccgagtattcagagtggacaagagatggatggtgacggtatgccacaaaatccacaccgtattgcaaccctgatctcaaaacccagttcttcgatcgtaaatgtgaataagctttgaaaaacattggaaagtttggtctttttgatttcatgtagagccatgtgtctacttcattctccaagcaacgaccttgaagtgagattttgatgcatttgagattgtaatgcaaaaagaaagcttcttcaaaagataactgaatccatttcttgattttctctgccgatagaacgagtctgccaaaacaacaacggtcaagaagctcagcttgctctggctcaaccgctagaagcacattgcaacttgagagggttcccgaggactctgtttcggctagagagagctggagctctgagactgattttgaaataggttctgcaagagcttttgcttcagctcctttccatttccatctaggcgccatggaattgagctgcatatatagcactaaaaatcaaaccttttgaccaaaagatgtaaaagcttttcttagtctattaccaactacaactcttataatctaggaaatcagataaacattgtcactacgacatagttgttaacgtttaaggtatcttgaagaaccaagtaggaattggaatgagcaaaaccaagagcttttgattcttttcccacttttgtattcaaaaatcaatcgtctatgaagcggaaactgtgacattcaaattcacaacaaaggtattttgaaatagtaaacacattttaattgaagaagcaatcacattcagacttgtcctcacatgacagtaaccatgaagagaagagatttggttaaaaacgaaacctggcgtattgatttatgaagaaaaaacagaggatatgaaggactcgggaagcagggtctacaatggagagagctatgcttcgaggatccaatggagagctatgcggtagtgaaaaacgtaatctcgtaaaaattattgttgatttcgattgcacagtgaaaatagaaaagaaatagccacgaagattcttcgaaatcgagaggaagagatcgagaattgaaacgagattcggatctctctctccctggggaagacagtcgcgcgactcgagcagcagagattgtggtgcctactgagtacctcgtgtgaagtctaaaaacagcgtcgttttcagctaaataaaattctacaaaaatgacgtcgtttggaataattttgtttgggctgcctatttatacatgtctaggcccgcgaattttaagtctacagtatttatttaaacatcatacacaaaatccgaaacagataattttgattcaaattggtaactatcggaagtatcggatgagaaggaggaaaaaaatgctttgcttatttcattaattactaccttgatactatctttaataacagatttaatttgatattatagattccactttttacttaactgattgataagatggagataatagtttacctttttatttactggttaaaatcgagaatttatggtccattgacttcttttgaccaagtttaacgaagaagcgtctcatgtaagctattcacaaatgacgttggtaccccttcccacacacgtatgatgtgattgacggttctctgtatatatattaatttaaaggacgacgtaaagcaaaaaacctattcgtcgtcactcgtctgtcgtcaccattcatcaacagagcataacagttgctgatttaagctctgcggagagcaagt

SEQ ID NO: 2614 - DNA, 3000 bp, Unknown
  misc_feature (1)..( 3000): cDNA_ID_3054206_gDNA_ID_1620565_Annot_ID_160684 3000 nt of promoter + ATG
gcatccagtggtggaggtagcatgttccctgaatggtgctgcagaatatttgttgctccagtgatttgttgaactctactccttcaaaattactataagacttaactaatcatccaaaaatactagaccaactatcatattacattacctaaagatactggtaccatgaaacagaacaatcatgaaagcaagagggtattttaaaatttcagatgatacaaataccttgtataggctgatatgatctcatcttttgtgaagctatcatcttgagaaccaacctcgtgcaaatagagacaatcaggattgacgcatgcctggaataaaaacatgcagttcatcactccaaagacatcaacttcaacatgcatctgaagcgaggtaatcaaaaataacaacgcagaagaacaagaatctataggagacataccacatttctcagccatgcatgacaatacttggttgtcccaaaacatgccctgcaaatatagatagagagcgagaactttcatatgatcattaggtgaatataataacttataaatacaattctagtttttttagaaaaagcaagtcaaaacttacttcaatggtttaccatccaagataaacccatgaacagcttgaatgcagcgaacagcctcttcctcttttccataagtaatatatctgcgatgcaaaaaatcattatcagacaacttcactgaccaaatatatatatataaagagggaaattgtttgataagaagtatatacagaaacgcacacactgcatgtattgtttgggaattgttggatgacaccagatgctgttcgggacatggaaacctttagaacttttccatactgaccaaaatattctttatgttggagtagctgaaagaaaaatggcgcgctaatcagatagtaatctacaaaaagaatgattataaaggtttggatgtaagttgtcatacatcttcatcggctagattaagaggcaacccaacaatgtaaacaagattcctctggatcactcgcacactggtgagttgttgctttctcccttcagaagattttgattttgacttctggatcttcttgcgctccatattgccttcagaagccagactgggaacaggtaattatagagaaaagccatcagcaaaagaaacgaaaaaagactgtcccagactaaaattaaatgttattacaaacctgtcacaattaacagtcatccctacaatcttttctttgtcatatggagtgcgacaagctggacaacgcccttctatttgatctttctctgccatgtccactatgtgatgccagcaccaaacacaaatctgaatcacatacacaaaattattaacagataaaagagtgattatagcgatcatgaaaacagagaaagacgagagctattgaacattgcaataagcaaaactgttctcccaataactttcagtttcaagattaagccgtaacatatcaattgaaattaagagaaaatggaaggtagatgcaagacctgataaccacatttgcaaggcttcaattgttgatcagtcagatccatctcttcagcacaaagtggacaagtcttctcaccatggtcactcatgatggtctaagagaaagaatataagacacattaatcatcaaagctaaggccacaggctaagaaagtaaattttatttcatgagctatcagataaaacacatgtaaaaaccaaacgcaatgaaaaaactttttttttttttgctggcaacttcattaattatcagaagaaactaaatgataacattcgaaatccaatcctagaaatcatctatgttcactcatctcatcaacgttatcataggccaacttaaaaaatcttaaatttactctaaatattcaacatttcagatcgaatactaacaatataattacaaacaacaaaatgaatctacaatgaagaacttcacagtatcgatctatgcatgcgccgcgacggttcaattaaagacgcgtcaacggacaaaagtgaaaacaaatcattataaatcaatcacaggaaatataaacacatgtagattaatccaaaaatctcaatcttcaatctcaatttctcgatccaaactaataaaccgatgatgccaataaaaaaaacctcggaggaaacagaattagggttttgagattcagcagattcaaactcaacgagaacgaaggagattcaataagaggtgataagaaaacatacgattcgagaaggatcgatttgagatagctggagattgaagatgaagattgcgatgaggaaaaatggaagctcgaacgagagagagctacagagagagagagaaagagaaaatggatggctgtgatttttgaggcgatggccttttttaaccctcttaatattatttatatatatgattttgtctgccagatccacgttgctgtcttgttaaaaaaaaaaaaaaaagggtttctagaatttattacccttcgatttctaattttattaccacttagtccggttcggttttgattggtttaatggtgtttgaatgtgttactaccgaaattacccaaccacataaaatcttctagttttgggaattcttatgttattaccaaaattatccaaccacatataaggaagggtatttatagtatatgactacaaaatttatttgaaagtttttaaaatgaacaaatttttaaatagtgcgttaattcaaaatttcaaatgaaacaaatttttgtataataatttattgaaagtttttacataaaagtataaaacgtttatatgaataaataacattttttttatgtactcatgaataaataactatttatttaaaaaaccaattgggctttgtaatgggccaataaaacttctcgggttactaaaatggaaacggaacctccggcaagacttacacagggacgatcggaaaccgaacatccattggagtgctgcctcacaaaaacccgaagaactcaagttaagagatccagccatg

SEQ ID NO: 2615 - DNA, 2584 bp, Unknown
  misc_feature (1)..( 2584): cDNA_ID_2025601_gDNA_ID_1620566_Annot_ID_160701 3000 nt of promoter + ATG
gaattcatatacagcacagtgataaacataaacacacacacataaatatgcagaatcatgatttaattgattgtgcaaggaactattcacataggagtcggagttattgtgtcaatttaaaaataattggtgttttatcaggtgatagataaaacattttgagaagttaattatatgtaagttttttgcgtaaaggggctgttattggaggatttttcttaaagctattttaaatataagtttctcttacaaatttgtgactcttaaatgtggatgagattcgagaaaaagagagattattccacttacagaaatgaaatgaaaaacgttggtcacgacgagaccgtcaatcacgtcgacgccgtgaatccagccgagagacgcgtttcgttctttagcctttttctgtctttcttgttttggtaaataataagacgaaaaatatgaaaccaaaaaaatgaagaaatttatatgtctaacgactcttttctttgactataatcatcttttctttttaggtcccaaccatttcttcttgtattatctatcacatatcatcagatccaaaatcaacttgattaacttccttactgaattagatgtaatcaacgaacaacttggaattatcttaatcaattcgtgttgttagtttgcatttctctactaataattgtctacatagatactaacttaccaagtatcaaaggatcctaagaagtccaaaatgatatctcattagaagtcaattaatccatataattaagatttttagtaagaaatacatagatgaacaatgatgttaacatgtaaagttgcctcaaaaaacattctcctccaataccttatatgaaatcaaattaagaatcatttgagagcttggttacacaatttaagttttttctttactttgctttagaataaaaacagtctcatccagctcctgataagaggttttaatatgcctctatgttattaaccagcgtaagtccacaactgatttcagtggcttatcatgattcatggatagagtttgagggagattttgggacttaggagactgctatacgcataagttgtagcacatatggctcagtctctcatcatccgtgttgaaaacatacaatggtcagcacctattatggatcgggcctatatgaaaaaaaaaaaaaaaaaaaaaagcaacagttctggagagtttccatcattcaatgtgtaaactaattttcttaaacatcttgttaattttcctaagatctgaagcattaatgggatttcatataggcttcaaaggctatataaattttcctatagcccaactaaatatattatcatattgggctcacttacttggagtcttggacggtttaacaagtttgtactattgtttattattcacagcctattaacataatttaatcctaatgctatattaattaaatagattatattcaattaattagttatacagcaaacacaggagctttctgtccacatgcacgaccaccatgcatagtcccttctttacggtctatattcatttgacctcttcatctatataatttcatttattcccctaagattattataccaaagtgaatagaaaaaaaaagaaaccgtctatgcgtttagtttttccccaaattgctataacttaaatcatatagatttgtagagaaaatatcagaagaatacgaaaattaaaagtatgagtaatttttttattagctgaaaaacgagaatgcgagaatttttataaagacaactttttgtttcgaccttttttttcttcttccgcacgtgttccctaattcacctaactacaagtctacaaagtacaaaacccactcaccatccacacgttacgattttgtcgtaaagtatatacgattattcattttctttttctatttgtcaaacgtgaatattgtttttattgtattaaaaagaattatttagttttcaatttttggttgcttcaagaaaatactcactaacaataacataccaaaaatattatcttccaatatcgttttattagaaaagcgtcgaaattgataccttaattttgtatgatatcaagtagtgaatcacatttcttaatacacaaattagcataacgttgcaaaagaaaaaaaaaattaggaaggagaaaaagaaaatgtattcttacaaaaacattaacgttgttatactacaacaaagaaaataattatttttctagtttgaaatacttttgaaaatcaacgttgttattaacttttatatatttatttattattaattttcacaaaaagttgttattaaggagaaaagtgtgttgttgttttattttattttattttttaatccagggaataaataatttaactataaccactttaagaaaatgtgacagagccaccaaaaagagcataaaaagtaaaattaaaataataattatgattttgtattaaaagaaagaaagaaaaaaaaaggagaggagaagaagcagtggagagagagcatgtgaataaaaagcgtgaagctttttgatatctctttctcttcctcttcctttctcctccgatagatttcgccggcgatg

SEQ ID NO: 2616 - DNA, 3000 bp, Unknown
  misc_feature (1)..( 3000): cDNA_ID_3068877_gDNA_ID_1620566_Annot_ID_160706 3000 nt of promoter + ATG
atttttgtttctttggttgtttcatttttctttttcttttggagaaatccatctttcataacttcaatccttagatttacctaaattccaacaagtcaaaccaaaaccataaatcaaccaaatctttatttgatgttaccatgtaactaaattctaaaataccagtctttattaaagaaacgtataatccttcttcttcctaaaaggggttcattaatcatacaactccttcatgtttaatgcagaaaccactcaacactcattcatattacataacccaaagaaattcatcaacattgtcatagctaaagaaagaacacacattcaacactcctctgaacattccgctaacacccctacttgctttgtgtaccttattaattccaaaaacatgaagaagataatcaagagacaggtagaccatataagcttacagatatcgttgatgtgagttttatattacctagaagagaagagggtgatatattacttagatcccacgaatcatcactcatctgtgacagaaatacaggaacaaaaaaggaataagacattgtcatttggtcagatcatagatatatctactggaataacactttattcacaacacacatttcactgttcgaagatacacagagagggatcacttaaaatatcatgcagattatacattgctagtcgtgatgcagtatggtggagataacaaatgtaacctatagataatagcctttttaccttatcagtgtacattcagatctttttacaaattcactaggtagctccgatcttgtaacgtataccaaatgctccagaactaacaccagtgactatcttacagaagaagcaatctacgaaactcagtaactttatttgacaagttttcatctgaacttgtcataaaagtaagaaggtagtgcctacatctcagttagatttgatatctaaacattacccaagagtatagataaaaaaaattttggcatgttaaccagattcttcctacatattcccattctttcctaaattttcctctgttaacattgtaacctttcctagtctggaccaaagcaaacaacaacaaaaagtataattgaagcttcctttttagaactactgcactatttgattttcaatgtttcatacaacaacaagtatacagtcaccaacttacgaaatgaggggttatagaagacataatttcttatctgccttttcccaagtcaagaatcataatacttggatgctaatgatacttaatgttgcctcaaactaaaccgaacagaggaaaaataaatcaaacaaactcacttagaaaagtttatcttcaagggtcaaaagaaactttcctctggactagagtacttttaatctaaagtctaaacgcaatcaatgggtagtgtaaacaatgcaagaaatagaacgatgtcggcgcttctttgtcccatgtgtaggggaacaataatcttctaacatatattacagcaaattagccataaccaccaaaaattatgatatatactatacaactaacttcagtaaatagaaacagtttcggcagatgaagaagatatatacaaattcatagaacgaatacactaaagctaggaaatcatctatgtacatgaccatcatcctcaattttcgggtaagcaaggcaatgaacatggacagcatttctcactaaatcgacaaaatcatcttagttcagctataaaaggatctcattttcctgtgctaccatctatggcaatctttttcacaacatattcacgtgatcacaaaattcacaacactcactacactactgaatctaaatctgacacatcaacagaaacatccatgaaaaaaataacaacgaaagcagcttatctaatcaatcactgaatcacatagagatagagataattgatccctgacctttgatgtgttcatgatgagcagaagcagaagcagcaacaacatctccatcatcatctccaccagacttgacagtaacaataggcacaggtccatcacgatcatcaggatatctaaccacaacaacaggacaaacacagtgatgaacacagtaatcactaacagagccaagcttgccatcacttcctctttttttctcagcaccaaaacctctacttcccataatcacagcactaagaccaagcctctcaatctcaagacataatctctctctcatatcatgatctttcactatatggatcttataaggaaaccctaactccttcaacggtttagctagatccgcaacttttgttgaagtaaaagcatcaaaatcctcttgactaggttgaggttgagcgtttggatcttcaatttgagttttcagagggagaggtccccaatcggcaccgaagaggacggaggttggagaaacgtggagaagaacaacggcgtctccgggacggatgtagtgatctacagcccaacgaacggcgaaagagctttcttcggagagatcaactgcgactccgattttacgacgagctccggcggttggtgttggagttgcggcggaggagggagtagatgaggagtggtgatggtgagagtgacgtggagatggagggtgatggatcttgatgtttggaagctgtggatgatcggaatctgctggattcatgatttttttcagatgttgtttttgttcgtcggaaagtgggagtgagggaggtttctcttaacggagaagaaagaagcgttgtttttgtttttttaatagaacattagactgcatgccgttatttatatacaaagacgacaagcattctaatatagatgtagttaatagaaggagtgatccaacggtcaggatcaaatctgagcgccatagttttgaagaagacgattcactagatctccggcgtcggtgatttcctccacttccttttctggcagctagaagacgaaacctcactcaaattctgatctctttgtataattcgatcgagttattcgtatgattcgtatagatcggtgactcag

SEQ ID NO: 2617 - DNA, 511 bp, Unknown
  misc_feature (1)..( 511): cDNA_ID_2048793_gDNA_ID_1620566_Annot_ID_160719 3000 nt of promoter + ATG
tcctttaaagagaataatttaagttaaatcagggggtagaaaaaattaattcaaccatcaaatatattttattaactaaaataaagtgggagaattcaagaatactatatagtttgaatgtccttaaactattaaacctttttattcaagccagtacgggtattgaccaatatagaaaacaaaattatataaataccactttttgtaatgaaacgaactaaaataaaataaacgacattataaagtaaatcaaattaaacacgaatagtaagccgttcacttaaatcctggatttcaacatactgtgaaatgaccgttataccctttgatatcttcttcaccctcttcctctttccctctatatatatgaactcttcctcttccatttttcctcacacccttaaagcttcaacaaaaccagatcaagcttctttcaccattttcactcttctttaagctttctttcttaatttctctcatttcgaattttaaacacaaaacctaaacgatg

SEQ ID NO: 2618 - DNA, 3000 bp, Unknown
  misc_feature (1)..( 3000): cDNA_ID_2048860_gDNA_ID_1620566_Annot_ID_160702 3000 nt of promoter + ATG
catatttgtagattactgcataagctagtggtttttaatcggtttatttgttccggtttaggaggaacaagggccattacggtttaggatgagcaagggccagtttcaatgaatgtgaatggcggagaagtaaatatagtcgaggaagcagcggtaaaagtaagaatctagtttatttacctatctaagagtaataaagctgctgcatttcacgaacccttatgttctatgatctttaatggatgatatcatttttaatcttcgtcctgtaataattcaccttcaaaacgcggattatacatgtcgttttcctgacaaaagacaaaaattagtaaattactgaataggctctaacttactccatgctatttcaatggttaacgacccaaattgtctctcaaatttaaagattcaactagaaattgccgataatattggtccagttttgggctaataaattttgtttattgggccgactcgatgaccattttaaagaggactcaatagatttttattgatacgaaaatattattaaatcagaccgaattaaaatgccttgaactccggtttagccgacatgtttggcaccctaatgagaatagcttagttagttttgtgttagtctaaagattaaaagtaaaaagtttgattctgccgacaatttcttagatttggtgctatttaaaagatttccctcttcaattttatcgaattccaaccttcaaataggcttttccatacatttattgaagaatttatcattatcagtcacaattatgtgtcttcatctttatacgtacataattactagtaataattaaattctactactaatagaggacggccaaagtgtcagtaatgatgcatgaatggttagttgataaacatctctttcttatgaattcaatttttcaattttttttttttttttttatatttatttcgtatacttgtattttgttgaatattattaatacatagctacataaaatgtgataaaagattaggtaaagtaacaattggtaagaaaatatcacaaagaagcaaatgacaaggatagtctcataagtcataatcaatacagtttacctatgtcaaaaaaagagtctcatatacagtacctataatgttaaaaaattaaaatacttaaaccttttctctctttttttttggtcaacaaaaatagtaaaactttcatatgaacatttgtctgccaaattctattatctagttgaagtaaacatatccaaaatattaaactgagtaggcgcatcatattaacgtttgtaaaaaaaacaactatacatggtgtatctctaaattctaaaactacatatatgattggttatgttgacagtaaacatgtaatttgcttaccgacgagaaatcatgataatatataattgcacatgtacatctatatctctatatttaataattttgaaaaattggacgtacctcaccagatacatgtttaattgataataaataaaaatttgacatgtgtcttcccagatttttgaacatccaactaatagcacatgtgcatgtaaccttcatcacaaacgaaatcgtgataattaaattcagaattcgaattaaactatactaaaccatagttaattagtaaatacttcaattattacacgatattttcatatataactcttgacatttctccagtttatttatcagcgactagtcgattacatcattagaatgcaaacataaaagatagcttgacaaaacgaatttcgacatccaatttacagttacaaatgatgtactgtatgttaatttcttaagaaagcaaaaaaaaaaaaatgataataaattccatgtgcctaatcaagtgtaggagtcagattccgacctatatgaaagaccttagcatgtgctacttcattcactagcaccacaaattcaactctctctttttttatccctttctaataaaggagaatagttctagtattatagacatgaaagttcataaaagttaaatcacataattgaacttgtgtgatatatcaaggttttagtagtgacatataagtgaaaactctccattattgttagattatatatgtactgcacctagctataatttccactattggagaaaaatataaagatataaaaagtgtctacctgaattcagatatataaaccaatgaaacatttaagagttgaatgtctactcgaattatattagtataagttgttttcattgaaatcaggacatatatatatatatatataataggggtaaaagaacaataataattttgtaatatgaataaatatcaatattaacgaataagaatataaaataggtacatttaatgattaaaggagagatattaattgttgaaaatatgaatcctatgttttgttttctaaacgatattgttaaaaagtctaatcatcatgagtcatgattaagtgaaccaaaacaagtttaaaatcttctgaaaacgacaaaacaacacaaaggaaaaaaagaagagaaagttaatttcaagggacttttaatttcaacttctttatatagcaaatatgaaagagtgataactcaccaaacaaacaaatttaaattttatttcatctttacacgaaaaaaaaaaagagaaataaaaacatgaaagagtggtcactcaccaaacaaacaacctaaatttagataaaataccattaatgcttaaaaataataattaaattaggaacggttacacattcaaatatgtgttttgactgtagaatacaaaaacaaatacatacaaatatcattatctaatgttatgcatgagacactatatatgtatgctccacataagaatcatacaaagcttcactgtgattgctcaacggtctagattctgtcagagcctctctcttcttattctcatgttacattaatctttgaaccaaagtctttttgtaaccgtctctgtttcttcttcactctgctcgtaaaaaaacattgaaatcttcgcatca

SEQ ID NO: 2619 - DNA, 3000 bp, Unknown
  misc_feature (1)..( 3000): cDNA_ID_2048974_gDNA_ID_1620567_Annot_ID_160728 3000 nt of promoter + ATG
tacacttgatagaagcccgtcaacacccatttgtttcagataccggtcaccttcagagaacctctgagcattcaacagagcttgaactaacacaagataaccattgaatcctggcttaactccacggctgacaaaaccgtcaaatatcctacaagtctcaacaagatcatgcccttttaggagacaactcatcgcagcattgaatgttgagctatccggaatataacctctctcacctatcttcctcaagaattgaccagtctctttagccattgagttgtttgaaagacaatacaacacagcatcgtaaccaactctttgcaagtttgagtctttctccataaacccaaccaaaacctcaaacgctttacacggcggcaagcaacggaaaatcccgtgtacgaaagttctgattgtagcttcattaggattcaactttctcacccgcatcatctccaattgcttcaacgcctcatcaaccctccctgctatcaaaaacccgtcgatcaaaatcgtgtatgtgaacacattgggtctattcccttcctgttccatctgtttaaccaatcgaatagcttcatcaaccacacccttcttgcaaacaccatgtataagtatattataggtaaaccgatccggtttacagccatcactacgcatctgctgaaacttgaggtaagccaaatcaagtgaattagacttcaccaacgcatcaatcacagcattataaagccttgtacttggtttcattccaagaaaagatatctgagcaaaaacatcattacagtacttagctaaacctaatcttccccagcttccgatcaaaacacacatcaattcatcactaatccgataccctgaatctctaatctctttaagcaattccatagacaacaataaggggcctttacgaaaaagtgcgttccctagaacactcttcagagactgatccttagcgtaaaccgggtcgaagttggagacccagaggtaaaatcgcagggagtgtaatgggttgtcttgattctgcaaaacgctgatgacgaatcgagtgttgagaccaattcgatgagtggtgaattcttgattcagtatcaaaaaccaatcttttctctctatgacttgcgaaatgtaacgctggttcagaggattggtgggtttacctgaagagtttagggtttttgagagcttagggtttacggatgtggaagcgtttagtgatttggaagctgctgccgccgtcgctattctagatgctgaagaagcaaagcctctcatgtcgtgaccagaacggagctgagtgcaagtgaaacattgatttggtctctaacctcaagacgatgtttcctaaacgacgctgtttaatacaccaatatcaatatgtgttcgaatttaataattttttttttagtttcagaataaattaagaaaaagtcatgaccaaaaagatcatctcctttgaaacaaacaaaaacaaaagaattttggttgatcctaatgactcttccattgccaccatgaaaatgagggttttcattatagtttatccatctcttgattactatgaattttaattttcttgtaataattatatttctaagtgataattttctaatttctatcttaaattgtagcattgactaaatatttccatcttcatcttcaaaaatatattatgataatattaagttattgctaatgagagatgtaataaaaagagttgtgatgaagtcattattatgctatttatgtatgattaataatatgttataaaaattactattgcaatatatatagttttcttatatcattgcatttatttataagaataagatacaaatcaagtccaataacttagagaaaataaaggcaacgctagaatcatcaattttgagagaaaatggatttataagtttgtattacttttgacaacaacatttcactggacatggaatacaaggagaaccacactgtccacctttttgaaagccagctctaagacagtccttattacattcatcattccagtaatcttcggaacacctaatattgcagttgtcaaaagagaagccttcgatccttgcatctacacaagtccacatatatatcaaacatcatcaataccaacatgtgtaaattttatatcattccaataaaaaatagttatataacatgtccaaataaaagtttttaacgaaacttttgaattcatgtataatatatatataaacaaaaacgtgatcataacgaattccaaatatttagatatatagcctttgaaatgatcactactaaattgcaaaatagctaaaccaaactttgaaaatacctgaagccaaaacgttgttgttaggcaacgaaactgcaagtattattacaaggaaacatgtcaccaaagttttcgtactacccataataaatttttctatgaactcttttgaggtattcaaatgtttttattgtttaggatcttaaggattgactatttatatataacttttggtcttcagtttgttttattacaattaattgatgatccatttttgtttctcaaagttttttatttttggcaaaaaaaatcatttacatttatgaatatataattatttacaattaataatcctaaatgagaacttaaaaattgaaaaaagtgtgtgacacttgtgaatatggtcaaaggtaatttgttggatatgttgtcattatgttcaatcaatatctcaagttaaatgcgagattttaatttcataattcaatattggaaattttttttttataattaggtatattataaattttaactgatttcaaaattgatattgacaaaacaaattgaaaggaaaattaaatattatctgtaaagtcattattgtttttgttaataaatattttttagtttcataataaattaggaaaaagtcatgatgaccaaaaagatcaataagttgaaagttgataaatgtcttgttttttttttaatcatcttctttgaaacaaacaaca

SEQ ID NO: 2620 - DNA, 3000 bp, Unknown
  misc_feature (1)..( 3000): cDNA_ID_3068946_gDNA_ID_1620567_Annot_ID_160732 3000 nt of promoter + ATG
gacacgtggcgtcttctggtttttccggttagcggaccggaaattatctcaaattaatttgaaccgaacatttttgtgaggtcgtcgatgcaatttgaggatcatgctctgactgttactacaaatctacaatattgttcgactaaatgggaaagattacattttgtcattttctattcgattatttcaacatacccaaagaagaataaagagtagttcattttgttttgaaataaattttgttggccattataggaaaacaatggcaacagaatcacgttattcttgataatattgttagccattgaagaataacaatggcaacagtatcatgttttacacgtcattgataattaaagaatttcttgccaattttggcactacacaccaagaaaacattttttctataaccttatcccaatcacattattaaaatcacttaagatctctactagatttgacctgactagatctgaccgttcgtgagaaagctacttaaaataaaataaagaaagaatgacgtacgtagaccaaactactgttatttcttgaatccatttacatggcgtttctatacttctatcttatcgacctaacttaattgcttcgaatggtagtcacattcctttggccggccagttgctggagcctggaagtagctattcacagtattagcttgtttgtgttttttttttatcaaaccgataatctcattaactcaaattctatcaaaagaggaaggattacatccaaactagaagaaattacaaccaacataaaaacaattatacgaagtaattaagacaaccaaacgatgactaaactagagataaatagacgataacaatcataaacatagaccataaaaaattgcaagacaacaatctcaaaatcttttagatctttgtcttcttggtgtgcatgcaatatatatttatattttttgaaaagaaaatggtgtggaaaatattgcaatcgttcgtacgtatatttttacaaaatattaaaaccaagcccatgcaaaacacatatacaccaaagtcaactttctttttcaaaagtcaccgaaccagaggttataaaactttcactcaagaagaggaaccagaactcggaggagcagaggaggaagaagaaaaaggttcttgatctgcgcatgacagcttctcgtgaggaccagcttcttctcgtccaacacctatcagatcaagataatacaaataatgagaaacaatgttgttcatctcatcgttatcgaatccgctgttgcagatttgatcgccgtaaagaacgtttatggtggctccaaaccccggagttcgttttgcagcagtgtcattctttgttggcttccattttccgacgaaaacatcgtgcgccgacggtaaatgcttcttcggtggcgtcatccaccgccaaatcgccgcttgaaacgctaacgtagcattgttctcgagatactctggatgactcagtagatccactttcaaagcctccccggtttgaccataattgtaattcctaaaccagaccaatgataatgaaatttaaaccgagaaactttaaattagaattaaccggaactgtttaatctaaacaacgtaccagtaaaccggtaaagctcctcgaccgtggtacgagacaccaggagtacaaggatatgtcaatttgtagtaatcatcgcaataaagctgatcaggactcatctccttgttgtaacacaatccccaagctaatggtccgcctgttgcaaccccgtacccgcctttaaaccgaataatcgtaacggttattagtgatttcaattcccggttaataataaataaaccggtttggatcgctctaaaattaaacttacatgaggttttgctcccaacgtggccaagaaacgcagcgacttccttcatcccttgaagtttctcaccagcagtaccgaaaccaagaggctggtactcggcagccgcagtaatgaatgatcggtaatcccaaaagccgacggcgtgagccactggactgttacgcttagagaatagattctcgaattgatatgtctcaaaaaaatcggagattgtatggttgcaacaatactcggaccatcctttgcattcccatcctttgtcgcataattttttacctttcacaatcttcaccagaggctttctcgttgaactcgaaggctcggaatcttcagcgttgacaagggttccggtttgaaacacaaccaatgcaaccgtgagaagcaatagggagaatagcggtttcgaaaccatggttgatttttttttgtctttttcttcgtctatcaatgtgaccattgtatgtataactttatatacaaacatatatgtatagagtagtgtcgtgttcgttttaggaggaattaagttttcggaatttggtggtaggagaagagttgcttttcgtgagtttttttttgcttggttttgaagtttcttagagtggaagttacatgttaagaaaattggtcgaagcatgtacacgtagaactgtaaatgttttaaacttcatttttctaacaaaatggttaatctattttaccaaaataaaataaaaatggttaatctattgcaacacctttacaattagatttttttttggtttaggggacggattataactaatgattgggaaacaagtttgagatagaaattggaaatcgtttattggagcggttttgttgctgctagaatactttggaactaatttaaccatatattttttcttttccaggctatgaatgtcaatatatttagatattgaaaatgtttggccaatcttgaccttgacaaaaaggaataaaaacaaagaatcaaatatttgggacgtcacttcgaatgagttcatgttatccgcagttgcatcagattgctcaagtcatttcaataacttaaccattatttttatattttttgtcaaccaataatttaaacattaattaacccaaaaaataaatacttggaactaataagtggtaagtaa

SEQ ID NO: 2621 - DNA, 3000 bp, Unknown
  misc_feature (1)..( 3000): cDNA_ID_3068890_gDNA_ID_1620567_Annot_ID_160736 3000 nt of promoter + ATG
atttctgctctaaaaatggtgtagatcctcttgctcaagtagccaaagaagcatgataaagtcatttggtaaatggtaacatgtttatgatcattatgcttaaattctctgtgtttcaagaaaatgcaattgtgttaacttgattttttctatattaacttcggtatataccgaataaaaggctccaaaaaatcgattttaaagatcaaatgttttattttattttattaatttatttgttagataaataaaggtagctacacagagcagtaatgttaaaaaaaattcaaatattttgagaatcccaaggaggacaaagatcaaacattccagtctttttgttcagtttgcaaggtccttcttcacgtatcttccattcgcatcttttgcatccaaacattgcagattcttggtctctttcttgtatgtatatacggaaataacgaaacactagtctccaagcaaaagtgcaaatgaatttagtatctccagaaacactgggtgtaaattcaaatgatcacgatccaccagctagcatacgtcggagtccaaaatcaacgtcttttgatgcacaatggtatgccattggccaataacctgaaagagcgttatgtatcaccactgttgtatttgggttctcaacacttggtggtgaagccatggggttttgagcgagggacattgttacacttgcacacataacgataatgagagctacaagttctgctagagcacccatgttgtttttgttttttgttttccttgcaatatgaaagtatattgaatatggactctttccacttagtactttattgtatttataataccaaactttattgattatgtttccctaacaagcttctttgttttgttgactcagttacataggttatatgttttgaataatatgagtcaaagtaaaacttaattaggtataaaaggaaatctcatcttggtaaaaagacagctatatcttattatataaagtatggatttcaaagttgctaactcatataattgttacacatgtcaagtcaaacgatcagatgtttacatgtgtcattcaaaatttaacttttttattctctaaaaaaaattgaaaattttaaaaagtaaacaaatttacatatactaatttatacgtctatatatttataaacaattaacatttattcaacaaaaggaaaattaacaaatttgtctttaactcatctaatcataagtgaaaaatataacattttgagaaaaatagcttagcttataggatttaacttttcaattattttcatttattaattttaactcatttaatattaatttgcatgatgtaaaattaacttacgagattacggcatatacaaaaaatatattttcaacaatgtttggtttctaaatatttttgtggattgttttttttaattaattattagccctatgcgtttgggtattcgggtcgggtatttcgggttcgggttttcgggtttagaagtttaggacccgttcgggtaatttaagattttgggtcgggttcggtttgggttcgggtttgggttcgagtttatttatatattgaaatatgaaattttgtgtgcaaatttattaaattacttgaaaatttcaaaaattcccaaaacaacacgagtagttttgcttgaatatatctaaaaatacacaaaaatcactaaaatatccaaaaaaatcctaatattttttatatataagtataaatataactaatatatacttatatttgagatatgtttggatacctattcgggttcgggttcaaatttttcgggttttgaagtttagacccgttcgagtatttgaaaatttcgggtacacccgcctaaataggcgggcctagtaatatatgtagtcaataatctatttataacttaggtatataaggaaagctatatatttctcaccattaaagtcacatattaattttggtaaatataaagctatatatagtcaataaaaattatatattgaaggaaatctcatcacgattatataattggtcttgagtcagttaaataaccgtacctcttaactaacagtattttcatctaaacatgaaatactaatttttatttttattagaaaaatagaagtagacatacatgctaattatttttaaagcgattgagaattccaaggaagacaaacatcaaacatattactgttcttgttcaatttgcaaggtccatctttgcgtatcttccattcgcatcttctacatccaaactcggcgaattctctgtctctactctgtttgtagatatcgaaccaatgcaactccttatcccatataaaaccgcaaaaaaacaaagttcctccaaaaacactcggtctaaattcaaatgaccaagttccatttaccgccatattccggtctccaagatcatcattttttgatttacaatggtatctcaatggcagatgacccccaagatcattgtatatcaccactgttgttcttgggttgtcgaaaccggatgttggagttggagggatgctatccttttggcctcgagatattgttacactaacacacatagtcactaagaaagccacaagttctactagagatcccatttttttttttttgttgcaatatgaaattattgtatatggatgaatgactctttcactcgatatatactgtgttaccagtttattacatttccgtaacatgttttttgttcttcatatgtggtcaaataaaaacttaaatgtcatggttgatgtatatgtagtcaactatggtgttaagcccaataagctttataaaagcccaataacattttcaaaagcccgagaaaacccgtgaaactacgtccgatccgaagatcgatcacgcgactctgttatttagaacgacgatcgcattatttttctcctaataaacaaaacgagcccgccagatttctctgagacagtgattcagttttggttttggaacctaattctctctcaagagattcagctaag

SEQ ID NO: 2622 - DNA, 3000 bp, Unknown
  misc_feature (1)..( 3000): cDNA_ID_2048928_gDNA_ID_1620567_Annot_ID_160740 3000 nt of promoter + ATG
taaacaatcttactaccaatcttggtaaaagtaacttactattcacattcctagttgcaaacacattcaagaaacttcaaatactaatacagtgattatttttatcagatcaaaaccttttggaagtaatgcctagtataactccaagtgttgtgattttatagtaaaattgtagaaatatgcgtaaagtaccccataacaaaagtatatgttttgagaaattgagtggttaccatgacttaacttctaaagtaatatttcatgttcccctctttgtttgagagcagaattgaatctataggtcctctggaatctgaactcacgtttagtactgcacgtagaaggcaaatttcacttgtagatggtgatggcgataggttaaaatttatcttgtggggagagcaagtcattgtggcaaaccttctgaggtaagctcctggctgggtgcttctacctttaaatttttcgaccaaccccttcttatagattcattttcagtgtgggaagtgtgcttgggattgagaggccttatatttctagtctcgaagagagtgcaatggaaggaaattatgagttctgccttgaatacggtagcgcaacacatctctatctagtgccatcaaccttacaagaggaacgggtaaatgaagttttttttatgttgcttcctttttctgttcagatttttgcattgatttgttttttttttcttcaggtttgtgtagcgttgtcacaacatcagtgtcaaggatctaaactgcttggttcagtcggagtttcacaggtgacattgcctcgtgatgccgatgggtctgtagacttcagtaattatccttttcgggtgagtagaagttaagataccatttattcaagcatgatgttaattgatggttatggtaattgatatttgtaaagttcacactgaatctaggttcataggttcttaatcaattccgtgtttagaaatcaggcaatagggaggttcttcatcacttccgtgttaataggttcacactgaatctaggttcatatcgctacagatcctattcatatgcataccatttattggtttttcttatcatagcaccaaaatgcattcataagtcttacagttttgcttttatatggcgcacaatatcatctctgttggaaatttacagccttgtaagcctaggagattatacgtaaagcctgctctggctattatttgaaaatctatgtcttagctgcatctgctaatattcctctccttggttgaagttctgcagacgatgataacggacattcgtgacaaaacgactggcatcagtctttatggggttgtaacagacatttcatgtgatccaaacgccacaggagtggtcttttctttgaagatcgaggacacaactggagcaatatgggctaagctccattttaccaattactggtataagcgtgtttcatgaatctcgaaacgacatctgaacagaaatttgaaggctttaacattctgtttaacagaaatttgaaccatatataatatatggtttccaggtcgttgggaaggttagggcttggtcatgtcgtgtacgtgtctgggttatcctgcaaaatcacaaaagagaactggtaagccgtttctcttgctttgaaactgatagatatactacggatccatcgctattgggaaactgatttagctcaaacatgaactgaatacttatcaataagtaacagtaggtattggtttattgctttagcttaaacattaatggagttcttgtttttgggttgagcagcattgagatgttatggcatgagaaagacgagaaagctacattcgtaaaccttagctgcttgcctgcatttctgacctcttcttgtattcacctgatctccactctctcccaaatatcaaaacagagaaaacctgcaataaatgttcgtcttgctctctaaatgattcacagagctttatgtggcgtttcctttgcacgtctggataattcgtttatttttctttattggacagatttgtcgggttaagctggatgagatcgaccaatgccataacatcaacactagactagctcatagcctttgcggccatttcatagatgaagaatcatcatcatcttatggagcgaacctgcattgtagtttctgccgagtaagctgcaacagtaacacagaagtagtgagaacattccacataacgataacacttgcagacgaggaaaccaaactatacgcgtggtgtactggtcagtctgcatcagctatacttcaaatatctcctgatgaattctgtgacctcccagaggtaacaaagcaatctgttattatatatatttggttataatagtagctaatatatggcggtaaaatgaatgaataaaagaagcaatgtaaaattattggtggttcaggatgatcagctaatgtatccgtcttcattggagaacgaatggtttctagtgattttagcaaacagcggtagccggaatttgggttccggtcatgaaacggacgacacttgctgggaaatcacacgagctctcaagatttgaagctaccatgaattttcctttacttgtcatgattagttgaaaaaacagactctgaccgtctttaaaatactaaactagtggagagactatttgaattaagaacgtgaatgtctgtttgtctttttggacagtgttgaaaaacttggtgggcccagaccccgcccttatcttgtccgttacatttgcctccgtgaagatattttccacccactgtttttttgagctattttaatcgtaaggctgcgatcggtcgtggactccattcaacggccatgatgtttctgtatcgttagacagcattacagcgaataactaataattattaatcgttgatccatttcaatctccttagtaatacatagtcccttcttccacatcagaacccatttgtctttgagtgagagaatcagctttcagagaaaaaagtatacctacagagagagttatg

SEQ ID NO: 2623 - DNA, 3000 bp, Unknown
  misc_feature (1)..( 3000): cDNA_ID_2025385_gDNA_ID_1620567_Annot_ID_160742 3000 nt of promoter + ATG
ggaaaaagattagtggactgaatttagatctagtaactgcacatttacgattatatttttaagattttaactatacggttaactacttaactgtacggttttgatacacttacggtagtatatattttttaaacgtaactaatttttttttgtggttaaaggttatagttataaaccattttatatggttacagttagattttggtcatgcatacctccaccggcacctcctcctgcgccaccaccaatacctcctccaagtcctccaccagaacctcctccggcaccaccaccaatacccccaccgtggcctcctcccagtcctccaccagcacctcctccagcaccaccaccaatacctccaccatgacctcctccaagtcctccacctcctccggcaccaccaccggcaccaccaccaatacctcctccaagtcctccaccagaacctcctccggcaccaccaccaatacccccaccgtggcctcctcctagtcctccaccagcacctcctccagcaccaccaccaatacctccaccatgacctcctccgagtcctccaccagcacctcctcctaaaccaccaccggcacctcctcctgcaccaccaccaatacctcctcctccaccggcgcctcctcctaaaccaccaccggcacctcctcctgcaccaccaccaaaacctcccccggcaccaattcctcccccaaaacctttcccaccaccaaagccaccgccaagtccaccaccaccaccacctcctaacgtctccttctcaaatctcctacactccacaaccccaatcaccaccactacaagcatcaaacccaaaaacccaaacgatactttccccatatcttttagtaagtgttggagtatcgtgttattcactatacaattgttatagctcaattgactaagccaataacactatatatagcaagtacaacgaacatttatgagatatggttgagagagcttcaagctctttttcacaccgcgtttctccgcatgttctcatgtcaatctctcatgctcaaattttctacgaagcaattaatgagtgataccaattgtctcttttaatattaatctcctattcctatcataacctgtcatccttgatttaattccatgttcacctagtttacgtactgacaatacagcgtataagttatagcgacactctctcatatataatatatactctaatgtgttttctaaccaattgaattgatgaactaaggacttttgtataataagaacgtgcagagaaaatacaaacaattactagttcgataaaactatgaggaaacacagtgggatcggtgaggatgtgtaattacatttaagaatatatatcgtactttgttctacatttagagcttctcaactactttggatttggtagccacattcaatgcaaaatccccactatcattttcattatttgctctagcctctactataagtgtctacgagaatatcatccttatttgacttatgcataggaatacaataaaaatgtaaaaacatattggtatactgtgacttttaatgaaatttggaatccataataaaagtttgtaaaataaattgaccatagtcgtcctgtaataaatgtgataagagcacatgtgagagggaattaggcacgagtgaagagctaaagagaagaataaagatcgagtttaaatagagatagaaatgaaggatagagatttatcatgcgtgatcattgttgttgtgaggagaattaggccttgtgtgctctgttcttgtgtgataaaaatggagaattgtaattccagtcttatcaggttaaggttttaattcattgtaactggattgacagatattaaatacaaagaataggttaacgttcttatcaaaatttatcatttatatatatttacatttcttcttattcgtccttgtttttgttttttcttatgttatcatctagatcattttttgtgtacagaatcatgtagaccgtatttaaatcacaagtcaacgtttatgttttccgacagattttcataagaaatacatacggtcggcttcgagtaacgtaacaattcttttccgataatacttacatatttttccggggctgccaagctaaggccacaagttttgctagaaataactgtgtatattttatatacggtcttgtttgggctgctttgcatatcaaacatattagatacgtaagttatgttcggtcgtaaaaaaaaaaagaagttttatttcggtccagattgatacgtacgtatcaatcattaatttgcataatccacgcattgtactatacatgatccatttgcattccgttttgttgaatatcacatagctggtttttgacaacttttatagctctggaagccttagcttcctttgatacgcaaaggctttgcaccaagccaccaaagcatggtgttttttttctggtcctaaacgcaaaaagttatctaatatagttcaatagtaccatatttgtcatgttttttcatcgttatatgcagtcttctggtggaaattttcttactattttccaactataacaatagaaaaattatagctaaactaaaattgaagaaaaagaaaaatttatttccaacctcttgtgattggatgactacgaacttaatcatgcacctatccataccagagttctactgattttttggctaagaatctccctcagagcatcaaaccaataagatattaccacgtgtcactgaaatccaattcagctaagccatccaaaaactttagcaacgtggccggttattgcacagtcgtattctccgatgtattaccaaatcacccttaacgtaacattacaatatacataaaagctgagattaatataagggtaacatcgtacttttcatgaccatcattcttcttccccgagcccgcctagcttctccgtctctcctccatgaaaaagctcacaaacggttttatcagttaaagcttttttaaacaatg

SEQ ID NO: 2624 - DNA, 3000 bp, Unknown
  misc_feature (1)..( 3000): cDNA_ID_3409119_gDNA_ID_1620567_Annot_ID_160749 3000 nt of promoter + ATG
tacagctacaactaattcatttataccaaaaactctacaacaacaaaagctacgacaacagtcagcactaaaaaactacagctacaacccaaccaatcacctaaatagttgtttatcttcttggatcaattctgatcataacaatttatagtttacatatatttctgaattatttataaaacaagaaattttctaaaaaaaaaaaaaaaaaaaggaaccaaatattcgaatttaaaataatcgagaatatcgcatagtgatcaatatgaatatatgaaattgacttgtataatatgtaggattacaactgattatatacagaaacgaagagtaattatgctgagtaatgagtggaagaattacaaggatacgactcaattagaggaagctgaataagcaattcgtatatgtcaaacacaaatatggatcatctataccgttgcttgacttcatttgatatgctagttttggaattatattatgtaacacacagttcataagttttgcaggtaaataaaaatggtggagatctagagcttaacatcaagcaacatttgccattcttcataaagcagcagcatatgtatattgtatcagacgacccatgtaagagtcacatcatctagaaaagcaaagtaattgaaatttatgaagagtagaatagagagatacacattagcatatgtaatgtaatagtttaagtgacatttacatttgatgtaaaacagatttatttaatatatggaactttgattcagagtttcttttgaaatttgagttatatatatagagagagactattaatcagcatacaaacaatatataatttttaacagaaacaattaaagataaaaactatatacacgtcggtttacaaatgactcaaaagaataagatttacacgacagaacttaaccgatgttaagattactaaaaccgacgcaaacgtttcgacgtataagtaagcgtcatttcctaaagttaagttaattatattaacgtcatgcaatgttacgacggtttttaaaccgacgctattatgttaaagtcagtttgaaaatgacgttaaagtcaataatgaccgacgtcaaataccgtttctcttgtagcgatcataatttggaaagtgttgatcatataacaacatatacttggatattttttttaaaaaaagttagtgtcaaaacaaacatggatcataatttggaaagtgttgacttaagatgttacctttttttttgtgcaaaaagatgttacctatacagtataaatactgaacaagtttgattgaaatagttatcaacatatacttggatattttccaggattaaaaaaaaaaaaagtttagacgaattatgggttctcttgagacatgcttacttttctttgtaatggttatgtttatgagtgcaattatgtctcgagcctcgacgagtgtagtgatttataatgatcttggaggtggtttgccactacggcaccactgcaaatcaagagaggatgatcttggataccagagtttagcaccaggtagatcgtggtcgtttggatttacaccggatatttttggccggactttgttttactgtcgttttagttggggagctgagagtcatatatttgatatctacaaacagagtagagacaaagaatttcaagagtttggttgcaaaaaatgcgaatggaaaatacggaaaaatggaccttgcaagttttataagaagaccggcatgtttgatcattgctattcttgggattaatatccttattttataaaacatgtcgtaactatcaatctatgtctgtctacttcttcttctacctttttttttcttttttgtatgaggtaattgtgtcttaatatgatattttatggtttgacctacaattcgttttcttttttttttacttgttaatgacacaattatagtcaaataattttagagcgaagtaacaaaacattataagaatataatgtgaactacaatgagcttttcttttatgcttaacgttcattttttaacaaaaaaaaagaattataaataaatagagaacaagtgttgatcgaaagaacaactatgtaaattatacatttgtgcttaactaaacgcatatcgattagagtcccatttcatgaccccgaaactcaatgagtcaaacgtagtgcacaatctagtgtaatttaaaaccagaaaaaaaaaaaaactagtataattcgacataaccaaatggcatagttaaacgcatgttggtgaatggaggaaactaaacccgcgtgggaaggcttttctcgagtagtggaagtgaaatattatcttaaaacatatactttcaatgacataaattggtgaagatttactcccataagtgaaatgcattacatctagaaacttatctcttttatatttatttccgatttagcaaaagaagtaagtagaaagtctattgagtcaaacccaaattttaaaaaaaataatgcaaagaacttgcatataaatattttacattataatttgtattaaattttgatttagtaaacatatataacaaaattttcatctttcttttaataatatagtttttagtttgttagattttttttttttaatttgggcaacacaacagttgtgtaatagtataggcaaagaaaatggtcggacagctaagggaagatcgctctctcctcatcagacaaaaaattacaagcgagaatttctttgttcctttacgaccggacaagacacgtccgtcatcgtcttctactactttctatcttacgcctctccccttatcctacgccaaaacatcttatcctgcgcatcatcccttccattaagacctagggttttctctctctcccatcattctcttctcccgatctcatttccattacccaatcccgctccttttctctgattttgaatcgaacccttaatacccagaaatctcacggttccgaggagtgggtttttgggggttagggttttcgagagatgttga

SEQ ID NO: 2625 - DNA, 3000 bp, Unknown
  misc_feature (1)..( 3000): cDNA_ID_3068895_gDNA_ID_1620567_Annot_ID_160760 3000 nt of promoter + ATG
tcatatatttgcaagtggactaataactacgtgaacgatgaaagtataacattgatccagttaatgtgaccgatgtctttttttttttttttttcttttttgacggcgaccgatttattcttcttgaaaacaaaatcaacacaatctaatattggatccgattgttgatccgttgtataaagagaaaatgaaaataatcaaaaaaaaaaaaaatgaagaagagaaaataacacatgatttcagtgtttctttttaatctctttgaaaagcttttttaaaattcaattatttaggattttctttcactgtacttaagtctaaaacttgtcagtataggtgggaaatccattgacggacgatgagtacgataacaaagggattctagaatacgcatggagccatgcagtgatctctgatcatctttacgactccgcaaaacataactgcgacttcaagtcttcgaactggtcagagccatgcaacgttgctatgaacacagtgttcacaaaatacaaagagattgatatttataacatatatgctcccaagtgcatatctaatagctcatcaggagcttcctacttaggtttcggagtcaatgataagtctccggcggttaaagactggttcaagagagtgagatggtttgaaggatacgatccttgttactctaattacgctgaagaatatttcaatagagtcgatgttcgattgtctcttcatgctactacacgaaatgtagcaaggtggaaagtttgcaagtaagttttatgtagaatatatctaagtttcttaattctgtatattaaaaaggttaaaatgttaatctttttttggtttttttctttttttcttttttttgtgattaacagtgattcgatattgcaaacgtaccattttacagtctcctcaatgttgcctacttatagtaagctcatcaaagctggcctcaagatatgggtttataggtatactcgacacttctatctagataattggtgttccttttctttcagatatatctttcagatatatagaatgttccaataaccatacatacaaaaaaaactcagtttcgtgattgattgtcgaagaacttttttttgacgttaatatcattagaatttagaaaaaggaaaatgtttggctgttacaaagtagagcctttggctttgaatctttggcaaataataataagatgtttggctgttacaaagatttttttttccaaaaaagaggctgttagaaagatgaatgatagacatataaccacgagattcacaaagtaaacccaccgaagatattatgataactattattcacccaccaaactcttgtacgtatgtctcttttggatttacatgatctcgttacatataagtaaatatttgaatgattaattagctgtcaaatgaataacctaccgatgtaacccagtgtttgttcattgattttgtatttgacagatactgtcttcatagtctcgaattagttggacggtttagatatccggaaaactcttttaaaggaaaaataactagttgagtaacaatatctgattttattttccttagaaagttgaaaattgattagttataaatacttattattgtctaacagtggagatgccgacgggagagtcccggtgatcggaagtcggtattgtgttgaagctttagggatttccgtcaaatcggagtggcgttcttggttccacaatcatcaggttagggtttattgtgaaattagctagaaatgtgtgatattttagccaaataagtttatattagtacggttaaagctaattaaagtcttttttgtgtgtgtgtgtattgtgaaggtgggagggagaataacggagtacgagggagggttaacgttcgtaacggtgagaggagctggacacttggttcctctcaataaacctgaagaagctctcgcgcttttccggtccttccttaacggccaagaacttccgtcaagcccctagatactaccactatatcatatagctagtctcttctctctatctttttaccgagtataaaagatacatgcataaataataagtccaatacataatcacatattagttgttactgtctacccaactatgtgagaaatttacaatatataatggttgttttgtttagtgtataaggttggtgaaaaagagagtgagtttgtaatttgtttaagaacaagaatatttctctagtcgtagggatcacaaattttttggtcttggacttgttaattcgtgtgtcttttactttctctctacaacttctcttcctttcttactgcgtgctagacgaagaagcaggaaacactaaaataaaacttctcaaaccatacaaattataagttcaagactttgttagtccaagaactcacaagtcaacgaatcatttgtaaataaaattttagtgggcatttcagtgttacaacttgctgtgttatttcagagtgaagatgaagcaacgatggagatatggttaactagtaagattgatgaagccaatgacgacgacgtcccgtggagaaagttctttacagtgaaatgtaattatacgttttcattttcgatgagtttcatggtggatgaggagaacaaagtggcaatgtgttgtgacacatacatgagaaaagatggtaaaaccaatgtttacttcttgagaaatctgcataccaaccaattagttttgatggggtgttccaagttcggttcaaatcttgtaaaagaatgtgattagtctttatggaaacagaggttgcttacaatattttagtttgactctatatgaatacaaaacaaagggtcttttttgatctattgaaactgtaccgggcgatttgggaacatataaataacaataggggtcaaaatgatattttaataaaagttttcttatccaaaacccaaaaatgtctttgctcttctgctaaaaccctctctccccttcttcttacttcacttcactcgtgctttctccaatg

SEQ ID NO: 2626 - DNA, 3000 bp, Unknown
  misc_feature (1)..( 3000): cDNA_ID_2048879_gDNA_ID_1620567_Annot_ID_160757 3000 nt of promoter + ATG
cataatcatcaatatatgcgctgttttttcaacgttataagttatccactacaagtctttaagtatatcattttgtagttgataacttattagtttttgcttcaatatgtgtaactcttccgaatttacaataaaaatttgttcttgtcaataattacaaatatatgtatatatataattgttattttcaacaaacaaagattcttaaagaccattcatcagagacttaagcacagaaatcgccacgtcacaaagatttttaactagcttgtttctagccgtaacagccaccgagctttcatcgtcggcgccggcgttcgtgattcctttctgacaagaatcagtctgcttctcggcgtctccgagcacatatatcgcaaagccgaatttgccgccctgcattgcctccatcgcctgaggaatattaaacttgaccaccggccggtacagctcagcgcactgagccagcgcgcgctctgccgcaggatcgtgagcatgtttgatcagcgattggatgtatcctaaagtatcggtcatgtttccgagcacgacgctggccatagcggcacctaaggatttgggatcagaaggtgacggagagaatggacgaagagaggcttcacataggtcgcagaatggcgttgcttggcatattttgtcgataaggtcgtcggaggattggactaccgacggcagaagcagaaggagaaagagggagagacacggtaatgatgtgacggtggatgatcttttcatggtcggagatagtgaaatttgagaaaaaattgatatgtgataaaaataaagacgtgtgtggttgtgttgtgaatgctactggtagctctgtttctagacttatatagtagttgctatttaagtttgttatatgaaaagctttcaaattactaacaattatgtttttcttctttaaaccaccaagacaaatgtgctttttacgtgtcatcacatatgaattttgctatatatcgatgtgatcaactaggttaatgattattaggtctacgtggttattctaattcccacccgtgaacgacttcgtgatcaacaaactttatttggtttggagtttgatagaaataacatactatataagcagctagctctatgtattttagactatatgtaaacttggatttgagtattaatgtatatatgtaggtatgaggtatatattgattgaatcatactacctaatttttttgaatacatggatctgtgtttggtctttagtttttgtttgttacactttatccttttggttatatgtggttgttgggcacgataccaagagaaagaagagggtatgtgtggtttagatttggcgtatgagtactttagtagtcggtcacatatacgacaaaaaaaataccattatatatgagtccacactatacccgacgtcgaccaaataatttcaaaataccttaacttaattaaatattgtgggggctgtttctctcggcagtcgatatctggctcgtgaatgttttgtatatcccgtgattcggttctagaaacttcgtgccgaatttttgcccgtgttcaataaccggttcttaaagccagtcccggttaatgtaacgttatacaaatttgatccacatcattcattcggattaaagaggcatggtcgatattggttacgagctttattattattttagatcatattaaataagatgtaaattaattagagcaacattcggatgatggctctggtcacatcgcaaatcttttccattctctgagtcaaactggtcaacggagattggcctttggtaaaccctccttcgcatatggaagcttccacgccggcgtcaacaacagccccttcagcgaacttagggtttcctttgatagatataatggcagtgtggacgtcaacgtctacgatcgttttgtatctcatactacactcgtctaatggctttttcagcattggttttgttttgtaggcctcgttgatctgcccgaccgtttcggccccaagcgcctacattcccaacaaaaaaaaaaaaacatttacattttaacattaaatctaatatttttaactttaaatttagtaaataaaccccgtgatctcgaaaatattgtcttattcatattgagtctacggaaaaagagtgaaaaccttgattttgtcgacgaggacggtgtcggcctaggagctacgtggatcggagcggaggagagaaagacagagagtgtagtcaggtgtctgtttgcatgtcttatctacaatatttcccatcgcaactcccaccaccatagccatcatcatcatcatcatctttaccataatcatcttctcagctctctctcaaaaattataaatttattagtactaattggtaaattaagatgtactataatgcgatgaattactagacatgtctatttatatgtgtttgtacgtgtgacttaattaaaattatgccaaaacgttttcttttcattttgttgcttcgatacatgtaacctatttaatgtgcattctttgacgtgtccagcctgtaattatctacatagtttgaagttattaccctctaaatccggggatgatccctctgaataaaagatctgttactccgatttgaataaccattaatttgttgccaatttgaaattagggggaggggaatagttttgagggaaagaccacaagataaaatatataggctttggttgtgctaaatgtgtaacaataaacatgtatcaaatttgataagtatttatatatagagataaatagtcatatactttttacatctagtcaaacacattcaactacaataagaaagacaataaaagctagtagtatgcacaagtgttaatggcctcttcgtcaacgtaaataatatcttgccttataatgatctttgaccaaaacaggtcaatggcttcgtaatgatatatatatccagtatccactaaggttttcttattaacctttcaatgcactatcaaataaaaaca

SEQ ID NO: 2627 - DNA, 1663 bp, Unknown
  misc_feature (1)..( 1663): cDNA_ID_3068921_gDNA_ID_1620567_Annot_ID_160761 3000 nt of promoter + ATG
cttatagtcttcctagtattaattagttttataacattttaagaagtttctttgctctcttctcattctaacaaaaaaaaagaggaattatgttcttattcaatggcttatcagttttctttaaaatgaagtaagataaagaaggtcgaatctctttcgagcaagttattattcttatttctaaaatccagtaatcaaaagtctgagatttgtggggaatagaaactttgtgggcgtgcgggggaatcacacagtcttctaagacataaaatggtcaaaataatgtaaaaaaatagtaatatcacaacttatagtaactattaacattgttatatcatttgataatgccaaaaaagaatcccttgaccttcgttcctaaattaattaatgtttcgcgtaatgtacaaatatgtttattagtttaacacacacattggtggtattcagtaaaacctttatttttcaattgcaatatttttttataacaaaatactactacaaaactaggacaaggctcttaatttcataaaagaggtcccctactattaaagaataatagtaatgatttttgtttcgtgtattctttagcccatttcaatccgtccgttcctcttctgtcccttctcttcgtactacgtttcagagatctttcgttttatgcccaacatttttattcattctgttttggtccaataacataacaataatttagtttcactgctagtgagaaactgtaaatgtacatgttaaaagctttagttgcaatttctaagaaatgctctgaataatgtcaattaggatagtggtatattttgcatctgtcacttgaaaagtctgtgtaatttacaaagttttcggattatacggaagtagagtcaagaatatatgagtactatagttgacccattagcccatttgatatctgaactttctgtttattttcgcataggcctattctcggcccatttaatacttactgcttcttattacttgaccgaattaacatgaacagtatatcatgaacaaatcttgacacttgatgagtatatgaaaatgtccccatcaagtgcaatatgaagcctcgtaggaagttagttgtaaatgcggaatctcattattgactttgcttcttcttagttagtgagtaaggcaaatcacatgatcatgttagtggagtcaaacacttggcacgtaccatggccatcacaaacctggcttctagagaaaccttaaattgtaaacaacaactttttttttttcgttattactttctgaaatagtgtgatgttaaaattatggttgaacttggcaattattagttttaatcaaattaaacaaaagaaaaaagaagaagcaaatttcttcctatattttaacgatcgttatcttgtaattcaactaaaattataaaaagttatcaaacgaattgttcacaactcagaagtgtacattcagcttccaatcttccatccattacaatcttgcatatcaaacaaaataagaattgtaaaatcttatccttaatatttgtggccacatacttccacaatcaaccaacatccccaatacattcactacttgtctactttatatatacactaatacactctacgtacgatagacaaaggcaaataccaaagacaaacaaaaaaaacctgagatg

SEQ ID NO: 2628 - DNA, 3000 bp, Unknown
  misc_feature (1)..( 3000): cDNA_ID_2048914_gDNA_ID_1620567_Annot_ID_160746 3000 nt of promoter + ATG
atatataatcgaaacttgtcttcaatgacaagagctagtaattagtttactaaaacatagtaatgtatatagattacggctttgttatatatatagcatggtttaggcatatcgatacttttaaaatttaaatggttaaacctcttaaaagtatacgtacttgtagattcctttacggacatggacaataatccaattagagttaccaacagggacagcatcgatggctttctgaaccgaagtgtagtctcctttgccttcgatatctacaattatcgatctatttgtcgcgattttttcagtcaaaagtggggcgtcgaatttcgtcttttgcattgctgatgcgtccgaaccccatatggacattacaactagggttaggacaaggatcattcttgttcgatgacccattattttttttattttttcttggggtttctacttttcttttggaatggggttatgagaaagagattatattggtgaagggagaggtttaatttaagaaaacaggtttttaaatttagggtgctttgttgtgtttgtttagttttgggaggtaagggattttggaggaagaaatggtttttacttggaatgttttgttttttatttttagacatttattaaggattaatggacgataaatactttgaagtatatttctatctttggtaactaattacaaaaacaaattgtgaatgttgtgtaaatgatacactgtataagccgcttattcattaatcaacggtaatcaaagaagtaccttagtcgggggccattagaatctcgtgaagcccaatccaccaatagaacgtcaattattgtcataattaatttcttataccctacaaaaacattactgaaaatcaaaatcttgattaaaaaaattcaatggatttatgcattctccataatatacgataaaagttgtctcaaaacttcaatttgggagtgatatatcatcttatatgattcaatctgtatatggttcacaacttcttctctcatgttttttctttttattggttcacaacttcacattcgatgtacgtattactagttttcaacgtattaatgtaattaagttagcaaaatatttattgtgtttagctgtaataagggtaggaccaatatattcgtttatagaaaggctatattttgtccttaacgaatccacaaacctcaaacttgacgaggaacataggaaaagaaacctataactttgatcagtttgatgctactttattagtatccaacaaaaaaaaaaaaactatgcttgtggaagtttaccagttaccactacactctacactctagttgacattaaattaaattaaagtaatttttcgtattatagttaaattactgctgcatatattttcacaagaaagctttacgttttcttaccaacaaaaaaaagctttacgtttactaatatcaccacatttattactcttaacggagactctagctcctcaacttgtggacctttgtatgttattgcggatctaaaagaacacagagaattaagagaaagcaatagagagagttttaggatgacgaagggaaatagtgaagtcacagtgttgattccacatttggaaaacagctagggacattaatttcaccgcaaattcgtattaatgacttccaccaatattactcactggagtctctagaatctctactcgtctttttctactaaccctacacctttgggtcattgggtgtatatatttcttctgttggactctgttttctcaatatattgataactatattccaattatttatatcttatagcctatagactatagataatgcttatctgattttttattttattttctgaaatatgaaccctccattgacgattgtaacaatgaatgtttttttttgggtctagctaggccaatttctttttgctattttctcacgttttaggccaatgattgatgataaaaaaaaatatatatatatatatatatattcacgtttcacttaaattttagaatattttttcttttctacttcttttaattcaatttaaccaagcattcacatcatcatatatatatatatatatatatatatatgtatgttgttgaaatatttaatcaagcattattagtttatgataaattaaaatgcagaaaattgaaatgttattttatagtataagaacagtaattaaaagagaaggctaaaaaatccaaaatttgataatacattaatagacatcatgtggatagataatatatgtgtgtagtatatggatgcaaacgtgaaaatcaacctaactgtttcacattatccatgcatgttgcttttacccattctctgtcttgtcttctccatcaactgttacctataaccatttattgaaccaaaccggtccaccggttcgctacttttatgtaagcaaatgcgtgatttcaattcccatgtaccgcaactatactgaaacaaaacaaaacacgaattttttttggctatttctctacaatataattgaaaacatatactttatccaacatcatattaatacagatatattcggttcagaaactgttaaccaactttaaccggaaatatagtagtctttaaattagtattggttgactttttaataactaatgtcacatctctttagcaaaattttataaataacgcatataacattagccacattagtaaacctagcaatctggtttcgtttcgtataatgagtcgagaggatgactaaactcaacccaaaaaaatcaataacctatcggttaaaactaggtgggatctcaaaccaatttcatgttttaaaaattcttttcggttgggattattaatgtcacgaattcacggggactttcttcagcttcctatttatacatacacttccaattgcaaatacacaagtcatcttctctctctttttttagtgtgtgcaaagtcatcttctcttttaatatttacctaaaattccaaacaaaagagaaagtt

SEQ ID NO: 2629 - DNA, 3000 bp, Unknown
  misc_feature (1)..( 3000): cDNA_ID_3068938_gDNA_ID_1620567_Annot_ID_160741 3000 nt of promoter + ATG
acaagaagcatgtagcagcctggcatggatgggcaaacctggagataaaacaaggaaatataagtaaagcaaggaatcttctagccaaaggcctcaagttttgtggcagaaacgagtatatctaccaaacacttgccttgttggaggccaaagctggccggtatgaacaggcaaggtacctgttcaagcaggcgactatatgcaattcaaggagttgtgccagttggttggtaagtgttttgtatcatcagcatgtttacgatgagaactagccaactaggacaatgccattccataaagctgcatcctgtgattaatcctcttagataattgtgtaaaaagagaatgctactggagctactgccattttcatggaaccacattctggccccccctgtattttcctcatcagtcacataatttagtttctaaaaggctgcttgtagttatgaatgagcttcccttttcttactaaatgttcaatttatgaacaggcatgggcacagttggaaatacagcaggaaagatacccagctgctagaaagctttttgaggtaactactaactgctacatccttttttatatttgtcattcacaatgaggtcaaagcagtggaggctgtatattcatcccaggaatgacttactgcctgttaagcgatcgagctacatatgaaagcgtattttattttttcacagaaagctgtccaggcaagccccaagaatagatttgcgtggcacgtatggggggtgtttgaagctggagtaggtaatgttgagcgtggaagaaagctcctgaagataggtcatgcgctaaatcctagagaccctgttctccttcagtcccttggcttactggagtacaaacattcatctgctaatcttgcccgggctttactaaggagagcatcagagctcgatcctagacatcaacctgtttggattgtaagtatacaagattcagtttggttgctctttacatgattgatctgctcaaataggttttgtttatacgttttccttaaagtttgagctttagattttgctaatagttctttacgcccgttttattggtttatcttgtaaattaacacttagcagactttagttttacccagttctatctggctagcgaattcaagagtctttacaatcgtgtatgaaaggggaaatgattggtgaaagtgtattccggtttaggcttggggttggatggaatggaaagaaggaaacacaacaacagctagagaactttaccaaagagctctctccattgatgcaaataccgaaagtgcttctcgctgtctacaggtataactaataaattcttctcgctgtcctctcagcgaatgaacataaacattgtaaaaacgagggaataagacttgctagccaaaaacatttgaatcataaattagctggcaagtttgctaaatcattagcatattattggaggatgctgaaacaaattctttgtctctacaggcgtggggagttctcgagcagagagcaggaaacttatcagcagcaagaagattattcagatcttcattgaacattaactcacaaagctacgttacatggatgacatgggcacaacttgaggaagatcaaggagacaccgaacgtgctgaagaaatccgtaacctctattttcaacaagtaagctcttgtacacattcttgatattatagcaggttcttcttgtagagtttatatattaatctttacttcattgcaaaacagcgcacagaggttgttgatgatgcttcgtgggtcacaggattcttggatattattgacccggctttagacaccgttaaaaggctcttgaactttggtcagaacaatgacaacaacagattaactactactcttagaaacatgaatagaaccaaagatagccaatccaatcagcaacccgagagctctgcgggacgcgaggacattgaaactgggagcgggtttaacctcgatgtatttttacgctcgaagctgtcgttggatcctttgaagctggacgttaatcttgattctaagaggttagagagattcactagaggaagaataaatggtgcttgaaaaaataagagggatatttattgaggcggtgtaaagatgaagggtcgatgtataatttaaagaattagcaattgttataattttagaaaggttttgggagattctcattctcactataaaagatttggaaagcgagtcccataacctcaccggcggtgataaaattttctcaccagagtcgttgtctcgccgagcagaacgttcaactatgtcttctgcttctccatgggatatcgctgcatcttctcctgttccaattcgggcttctagattttaaaggtgaggctaaatttgtacacaatatgaagaaaggagaagctgtgagggagcaacgacagtatctccctatattttctgttaaagatgaactattgcaggtaataagagaaaaccaggtgatagtggtggttgtcgaaactggttcggaaaacagagccaacactattttaactctgttatcctttgaagtatggaccagttacatcttcaaaacgaatcgcataagaagtttggcgtaagatatctcaggcctaagaagtttggactgtgactttgaaaccccaaatgggtgatgtagaaacagagccaacactattttactctgttatcctttgatttttgtttcaaaatttacatttatacgggagaatgaaaacaattgatcacaagataaatatagtggggaatgtgtaaagacctgaaagttagggccttttgatgaaaaaggaaaatcaattagattaacgcatatcttaattgaggaatttgccggcgcgttattaattgagcaccgaattgattttaattcttttaaaaattccccgcgaaagcacaaatgccctgaattcctcctgataaaccccggcaatttcagtaacgtcaaatctagggttttgaattggtatccgagctctgatg

SEQ ID NO: 2630 - DNA, 3000 bp, Unknown
  misc_feature (1)..( 3000): cDNA_ID_2048936_gDNA_ID_1620567_Annot_ID_160738 3000 nt of promoter + ATG
tatggtgttaagcccaataagctttataaaagcccaataacattttcaaaagcccgagaaaacccgtgaaactacgtccgatccgaagatcgatcacgcgactctgttatttagaacgacgatcgcattatttttctcctaataaacaaaacgagcccgccagatttctctgagacagtgattcagttttggttttggaacctaattctctctcaagagattcagctaagatgagtactatgaaattttgccgcgaatggtaagagctctcttatgctaattctgttcctagtttctggaattgcacctctctgctcgtctaggttttttcaaagtttcgaaatttgcatgaattttttagtttttgttgtttacttttgatgtatttcttccgtggttgaaccatctatggttgataaggtgacaattcgctaaaagtgagtaccttttttcgaattttgtttttgggtcctttcttaattgcattgttgtttctgtttgattttggttcagtaataacattctgtatcctaaggaggacaaagaacagaagatcctcctctatgcttgccgtaattgtgatcaccaggtatagcttttggtcattttgtaccttttttttgtgtggaaaaagggtttttagtgttcaatgtagtgcacaaaattgcgagtgggacttagtttcattgcaattaagagactttaatgaaactgtttcctgcttttatctctcttttaatgctcctagtttccttagttttaccaacctctctatttactaactccttcaattaaggcttagcaagttcttatggtttatctttctagtgttgtgtttatgagatctatatgaatacttgaagggcctcttttagcttattgatttacacaaactgagtagttatttgcaattttttaagctgcattatcaatcttgttgttacaaattgacagattagattagatcatgtaaatgggtttgttgtcctcatctcagaatttatactttttgtggcactgacttgcaggaggtagctgataacagctgtgtgtacagaaacgaggttcatcactctgtaagtgagcgaactcagatcttaacagacgtggcttctgaccctactcttccccgaaccaaggctgtgcgttgctctaagtgtcagcatagggaggccgttttcttccaggtataactctcttaagctccattatttatttaactacttggttatgctgtatcttcactgtttgcttccccaaaacattatgctcaaattctgtacaccgcttgaggatttaatgtagctatcattgaatgtgcaggctacggctagaggtgaagaaggaatgacactgttctttgtctgttgcaacccgaattgtggtcatcgctggagagaataaagagcttttcggtttcaattggtgagttcttaagagttttaggagttgatgtagttaccagtaagtgtaatatgtggaatgacgggaacaaccttctgccccagtcagagacaaatccgtattcatgtaatctgttatgaaaccataatctcaacttgtgtttcaccaaacataaagattggaacttgtttctctttggcatttagaggaaatgagaaattcaaacccaaacattagctactgtcctccacggctcatctcccagaaggcaacctctagttcaagaactcgtacaagtacatcttcagcttcaccgagcacctcaccggaggcattctccagacaacgttcggcaatgttcttgacagacgaacaatactgtttaaacccgtcattcccccaacgatgacaagcaccggtaagctccaccggagttttgttcccgtcttctaaacaatgagcaaagctctcttgatacactgcttcaattgcccagaaagctgtcataatcaccggatacttcacctcactgctcatcagatcttccaaaaacctgaattaaccagaaactccggtttatttgctggttcctaatttcattttcgagtgtgagaaatctattcaatcagcatatatgaaatcaataacctgccatattcttgattagctctttgaggcacaacggtcgagaaatcaacatcccatttcgatccttctcttttaaaccattctatttcatcattcaacgatgctataccaccaagcaccacttccatatcggaactctcgccggaatctttgcaagctctgatcaacacactcgctacaaacggcacaaacctcctcacgaacagataatcttgcccctacaaggaaacaacgtcgtttaaaagtcatcgagtgagatttcatattttgccttgttttcatcagtaattactaattacagtaccagccaagttctgaaggacgagagatcaacggatccgtcacggatcgagacgacaaaagcatgacgtgtagccgccgtatagatcgaacggtgcttatcaatccatgtgtcgatcacccctctcttctccattgaaattgcttcttcttcctttctctcaagactcaagactcaagactcttcttcttcaccgattcactgtcaacgctttgattttctgttgtctgtgacgtgcacgtttcattgggctttaaattaatgggccaaggcctattaaagtctcgccacgatagcttaatgattctcccaaatcgacggctgtaaagaggcgcttaaatttctcagattacgtgacagtttctgaaccgttgagatgtttggatgactaaagtttattaattacgtggcacttactcagaagctctctcacgtcacgtatccgtcgttaaagagtgtgacgtggaaaatgttttggaattaattttgtgtgtttgtattatatcaccgtactaattagctcatctcccgaagccatgtggtaattctaattttgtgtatttattattttctgttaagacgaatcggacagagagaactccggcggcggattgcacttccggcaagatctcgtggggataaataag

SEQ ID NO: 2631 - DNA, 3000 bp, Unknown
  misc_feature (1)..( 3000): cDNA_ID_3068942_gDNA_ID_1620567_Annot_ID_160733 3000 nt of promoter + ATG
gtacccgaaattttcaaatactcgaacgggtctaaacttcaaaacccgaaaaatttgaacccgaacccgaataggtatccaaacatatctcaaatataagtatatattagttatatttatacttatatataaaaaatattaggatttttttggatattttagtgatttttgtgtatttttagatatattcaagcaaaactactcgtgttgttttgggaatttttgaaattttcaagtaatttaataaatttgcacacaaaatttcatatttcaatatataaataaactcgaacccaaacccgaacccaaaccgaacccgacccaaaatcttaaattacccgaacgggtcctaaacttctaaacccgaaaacccgaacccgaaatacccgacccgaatacccaaacgcatagggctaataattaattaaaaaaaacaatccacaaaaatatttagaaaccaaacattgttgaaaatatattttttgtatatgccgtaatctcgtaagttaattttacatcatgcaaattaatattaaatgagttaaaattaataaatgaaaataattgaaaagttaaatcctataagctaagctatttttctcaaaatgttatatttttcacttatgattagatgagttaaagacaaatttgttaattttccttttgttgaataaatgttaattgtttataaatatatagacgtataaattagtatatgtaaatttgtttactttttaaaattttcaattttttttagagaataaaaaagttaaattttgaatgacacatgtaaacatctgatcgtttgacttgacatgtgtaacaattatatgagttagcaactttgaaatccatactttatataataagatatagctgtctttttaccaagatgagatttccttttatacctaattaagttttactttgactcatattattcaaaacatataacctatgtaactgagtcaacaaaacaaagaagcttgttagggaaacataatcaataaagtttggtattataaatacaataaagtactaagtggaaagagtccatattcaatatactttcatattgcaaggaaaacaaaaaacaaaaacaacatgggtgctctagcagaacttgtagctctcattatcgttatgtgtgcaagtgtaacaatgtccctcgctcaaaaccccatggcttcaccaccaagtgttgagaacccaaatacaacagtggtgatacataacgctctttcaggttattggccaatggcataccattgtgcatcaaaagacgttgattttggactccgacgtatgctagctggtggatcgtgatcatttgaatttacacccagtgtttctggagatactaaattcatttgcacttttgcttggagactagtgtttcgttatttccgtatatacatacaagaaagagaccaagaatctgcaatgtttggatgcaaaagatgcgaatggaagatacgtgaagaaggaccttgcaaactgaacaaaaagactggaatgtttgatctttgtcctccttgggattctcaaaatatttgaattttttttaacattactgctctgtgtagctacctttatttatctaacaaataaattaataaaataaaataaaacatttgatctttaaaatcgattttttggagccttttattcggtatataccgaagttaatatagaaaaaatcaagttaacacaattgcattttcttgaaacacagagaatttaagcataatgatcataaacatgttaccatttaccaaatgactttatcatgcttctttggctacttgagcaagaggatctacaccatttttagagcagaaatacactccaaaaaaaagtaactcaagtctcaagatgagttgctagcaccaaaagatattgcgcggcgctggcttcaacaaaatctgatctacgtttcactagaccaacaactaaaatagggtggtcgtcctcgcttttgtgctccagaattcgtccattactggttggtgaatacaaagcaaaaaattacgaaaacgtacttgaagttgtgaactgttttatataatttacctttcttcaaaacgccatagaagcatagaacgatcgtgtaacaaccatgcacgtcaaatctcagggaaaagtccatgtaagattgtcccttccttatcatacatacatgtccttaactaaagaaggtaatttccaatatgcgtcaacctcggcccacggctgcaccaggacaacatgaaaaataaaattaaaaaccattaaggaaaaaagcaagcaatttgtttcatgaatatttatgcatagatataattaattaccttgcttgtttttcaggtgatggattatataaattaccacggctatattttgtaaagtcaaagaattcgttgattggacgacgctgcagcgagccttcttggcagtagtggttaatgagttcccatgcgagttccacattcttcatcgaaatcaacatcttgctggctacttttaattcactactagaactgtcgagcaagtaataacataaccctaatgaaacaaattacacgatcttatgagcgtgaagtggctacgaggtatttcataaagcattttaattttgaaaatcaacttcactatccaaaaagttcctaaaatctagagaaactagttttttaagcgatttgtttttaagtttgttacaaaatccaaaaattaatttaaatatatattcacagccaaaaatgggctacgaggtctattgacccaatgggctttttaagacttaaaccaggttagaaaaaatgaaagaaaagtcgtaaatgcctcgtgtacaaaaaaaagtggttaaacaaaacaaaacaaacaaacaaagcgggctttgaaaactccgcctccgtttgttggctatttacactcactctgtctccgccggtagatttgtcagctgcgtcttcctcgttttctctctctctgtctgtgtctcttagaatgcaatcagctatg

SEQ ID NO: 2632 - DNA, 3000 bp, Unknown
  misc_feature (1)..( 3000): cDNA_ID_2992744_gDNA_ID_1620567_Annot_ID_160730 3000 nt of promoter + ATG
tatttgattctttgtttttattcctttttgtcaaggtcaagattggccaaacattttcaatatctaaatatattgacattcatagcctggaaaagaaaaaatatatggttaaattagttccaaagtattctagcagcaacaaaaccgctccaataaacgatttccaatttctatctcaaacttgtttcccaatcattagttataatccgtcccctaaaccaaaaaaaaatctaattgtaaaggtgttgcaatagattaaccatttttattttattttggtaaaatagattaaccattttgttagaaaaatgaagtttaaaacatttacagttctacgtgtacatgcttcgaccaattttcttaacatgtaacttccactctaagaaacttcaaaaccaagcaaaaaaaaactcacgaaaagcaactcttctcctaccaccaaattccgaaaacttaattcctcctaaaacgaacacgacactactctatacatatatgtttgtatataaagttatacatacaatggtcacattgatagacgaagaaaaagacaaaaaaaaatcaaccatggtttcgaaaccgctattctccctattgcttctcacggttgcattggttgtgtttcaaaccggaacccttgtcaacgctgaagattccgagccttcgagttcaacgagaaagcctctggtgaagattgtgaaaggtaaaaaattatgcgacaaaggatgggaatgcaaaggatggtccgagtattgttgcaaccatacaatctccgatttttttgagacatatcaattcgagaatctattctctaagcgtaacagtccagtggctcacgccgtcggcttttgggattaccgatcattcattactgcggctgccgagtaccagcctcttggtttcggtactgctggtgagaaacttcaagggatgaaggaagtcgctgcgtttcttggccacgttgggagcaaaacctcatgtaagtttaattttagagcgatccaaaccggtttatttattattaaccgggaattgaaatcactaataaccgttacgattattcggtttaaaggcgggtacggggttgcaacaggcggaccattagcttggggattgtgttacaacaaggagatgagtcctgatcagctttattgcgatgattactacaaattgacatatccttgtactcctggtgtctcgtaccacggtcgaggagctttaccggtttactggtacgttgtttagattaaacagttccggttaattctaatttaaagtttctcggtttaaatttcattatcattggtctggtttaggaattacaattatggtcaaaccggggaggctttgaaagtggatctactgagtcatccagagtatctcgagaacaatgctacgttagcgtttcaagcggcgatttggcggtggatgacgccaccgaagaagcatttaccgtcggcgcacgatgttttcgtcggaaaatggaagccaacaaagaatgacactgctgcaaaacgaactccggggtttggagccaccataaacgttctttacggcgatcaaatctgcaacagcggattcgataacgatgagatgaacaacattgtttctcattatttgtattatcttgatctgataggtgttggacgagaagaagctggtcctcacgagaagctgtcatgcgcagatcaagaacctttttcttcttcctcctctgctcctccgagttctggttcctcttcttgagtgaaagttttataacctctggttcggtgacttttgaaaaagaaagttgactttggtgtatatgtgttttgcatgggcttggttttaatattttgtaaaaatatacgtacgaacgattgcaatattttccacaccattttcttttcaaaaaatataaatatatattgcatgcacaccaagaagacaaagatctaaaagattttgagattgttgtcttgcaattttttatggtctatgtttatgattgttatcgtctatttatctctagtttagtcatcgtttggttgtcttaattacttcgtataattgtttttatgttggttgtaatttcttctagtttggatgtaatccttcctcttttgatagaatttgagttaatgagattatcggtttgataaaaaaaaaacacaaacaagctaatactgtgaatagctacttccaggctccagcaactggccggccaaaggaatgtgactaccattcgaagcaattaagttaggtcgataagatagaagtatagaaacgccatgtaaatggattcaagaaataacagtagtttggtctacgtacgtcattctttctttattttattttaagtagctttctcacgaacggtcagatctagtcaggtcaaatctagtagagatcttaagtgattttaataatgtgattgggataaggttatagaaaaaatgttttcttggtgtgtagtgccaaaattggcaagaaattctttaattatcaatgacgtgtaaaacatgatactgttgccattgttattcttcaatggctaacaatattatcaagaataacgtgattctgttgccattgttttcctataatggccaacaaaatttatttcaaaacaaaatgaactactctttattcttctttgggtatgttgaaataatcgaatagaaaatgacaaaatgtaatctttcccatttagtcgaacaatattgtagatttgtagtaacagtcagagcatgatcctcaaattgcatcgacgacctcacaaaaatgttcggttcaaattaatttgagataatttccggtccgctaaccggaaaaaccagaagacgccacgtgtcgattacacctcacccaaaacggcgatacacacacactccatataagctttcctccaacctttacgacttcaacaacgtgtttgtgactttgtgattggattctccactcactgctccagatttgaataaacacaacctaaacaaatcgagagagtcagatatg

SEQ ID NO: 2633 - DNA, 3000 bp, Unknown
  misc_feature (1)..( 3000): cDNA_ID_2048968_gDNA_ID_1620567_Annot_ID_160731 3000 nt of promoter + ATG
tttacatattttaaatgtagtttttatttcagttttgaaatcaaataaaacttctaccatacacctaactctaaataaatatttccaacattcaaatatgtaagaaaattttgcatgtaacgtaagatatagattgatcataatgacattaatataatagtgaagaacttcctcttcttttttaaaaaaataaacaagtaagaacaccaagccgaaacttagatataggagagtcgagtcccatgtaagatgagcaacggtcacatgtcgcgggttaagctgctagctcatgcttccgataaaaaaaaaagaatccccaataaaaatgtgtcccaagttcaggaatattgttcgacttcttggggctgtaataatcggggtgacttcctcttactactatttcgtaagtggttggaaatcatttttggacagtgaaatttctatgttacacatgtaagcggatttccaaaacactgtcatgaaaatagtcggatcctatttgcattttcgtgtgcaggccaaaagtattcatgctcatgatctcgccgtcccactccactttcattgcataatcagtttgaatagtgaaaaaaacggttggataatatatggtctgctagaggacgcaatgttcaaggacgacaatacgatacccatccaccaactctcgagcttttgatccttcatttctgtatatttatttattaggaaacatttatacaataaaacaaaaataatacaaataatctaaccttctacatcttaatggtgagatcgacttgggtgcctccggaagtagatgtatttgattagtgagatatggtaatatgatgttctatatgtagttgcaaaagataaatatatgacattaaaagataataacagttttttaaaaacaattgaccaaaaataaatactaagcaaaacataagcaaaacataagccaaatatacgcaaaaaatctacttgatcttatttcttgatgtggtcgatcatatctctatccgggctctaataaattttagagaaaacaataggtcaacatacttaaactgtatttataaatttgcaaatacaaacaaaaagggaaagaatgtatgaatgactgtggacagtgtgcttctcgttctcgtaaagacactctcaaatgttgttgccaaaagtaatatagactcatgcatttattttctctaagctcgtggacttgatttgtctcttatgtttataaaaataaaataaaaaaaaaaaaaaaaaaaaaaaaaaaaaaaactatttattatcataagtggttttctccttgaaatcgagtatattataaaacatattcttaaattcttaatcaaacataaatagcataataatgatggacttcctcctatgtttataaccttactagccaaaattcattattattattatgagatattttgaatacgaagatgaagatgaagatggagagatcgaactactaaagcccgcctcgatgctattgatattactgtcgttgtatgaacctgagactagccagagttgacccaagctgaactcgttaaatacttctacatttggctgccacacattcattgtcgcatgatatccaaaaacaatcgaatgatttgttgcttaagcccaacaaaatgagaagtccaaccaaagatggaacaaataatcctatgggaaaatatttgggcgtgttcaaaaatcattcttaaacctatatttccatatgcatcgacattcatggtcagatttatgtttggttcacattagatgaatagatttattgttaaactgccttaatggcaaatatttagttaaaacacaaacaaatacgtacctcgtgtccaccggtgactctatccccggcgttagaagtgatgatagtctcgttcccaagggaaatcagccttcgaattggaattgatccctccggacattttgtgccgttcgtgtgccagacttgccatccatataatgcatcttcttctttttttcccgcagatggcatgtccgttggtctttcctgtatcatttatttacaaaagaaaaataaattaaacatttattaagttccccccgtaaaaaaaaaatatatatatatatatatatataacacatgcatcataattggtatgtccgtaggtgtttccttatcataactgaaccattggtaaactatcggttccgttaaagcataagactagaaaaggctcggtgcgactcgctaccacgtttctaaagattttatttagcaaattaaccccaatatatattttgctatgagggtctaaacaaactggtatatgagccatttacttaccacttattagttccaagtatttattttttgggttaattaatgtttaaattattggttgacaaaaaatataaaaataatggttaagttattgaaatgacttgagcaatctgatgcaactgcggataacatgaactcattcgaagtgacgtcccaaatatttgattctttgtttttattcctttttgtcaaggtcaagattggccaaacattttcaatatctaaatatattgacattcatagcctggaaaagaaaaaatatatggttaaattagttccaaagtattctagcagcaacaaaaccgctccaataaacgatttccaatttctatctcaaacttgtttcccaatcattagttataatccgtcccctaaaccaaaaaaaaatctaattgtaaaggtgttgcaatagattaaccatttttattttattttggtaaaatagattaaccattttgttagaaaaatgaagtttaaaacatttacagttctacgtgtacatgcttcgaccaattttcttaacatgtaacttccactctaagaaacttcaaaaccaagcaaaaaaaaactcacgaaaagcaactcttctcctaccaccaaattccgaaaacttaattcctcctaaaacgaacacgacactactctatacatatatgtttgtatataaagttatacatacaatg

SEQ ID NO: 2634 - DNA, 3000 bp, Unknown
  misc_feature (1)..( 3000): cDNA_ID_2167272_gDNA_ID_1620568_Annot_ID_160782 3000 nt of promoter + ATG
ataatggtggaaagaagagtaaatagaatcgccgagccatgtccgccacacgccggaaacttcaagttttctggctagatcgaagccacgaccgtcgtcgccgagcagtgccattgtcactcttaatttctgtctaatttttgttggcctgagtctgttttgtttttattgataatgggcttaggctaataaggcccatttaatttgcccactaatgggctttaagttactaatgctcatggaattttcccagtcaaaacaaaattaaaatatattgaattttaaaatgaagcgcgccaggtaggggtcgaacctacgaccttctgcttaggaaacagacgctctatccactgagctacaggcgcctatttgatctcttgctatgcaacaaaactaattataatatttttgttagtcattagttttaggcaacccgagtcgttgatggagagatcacttaattagttaatttatttgataagataattgatttgatcacatgaaaacgatatcttggttattaaataacctgtttgtcttttcaattcatgaatgatgacgataacaattttccatgtagacgtaaacactttcatgtcacatccactatcgttgtggttcggttagattttctatagacatgtctgtattttacgaaataatattctctaatccgttgttggattaagtgatcgcctcttagattgtcatttgattcataagtttacacgtaactcatttcaaattttctattaatcttttggcaatgcaatagaacaatcacagaaaattacggttaacgcaattgtgtttcacggtgacatatttgaatctttgattactaattgctctaaatcagtaaatgaaaaaactaaaccagaagtcaactaaaaacctaactgaatttcggattgaacaggagagtgtgtttatgactgtttaagtgagaatgaaatcggttagactgacttctccgacagaacttgacattggtgagtttggtggctattttgatttggactttggggcccaatttagagagcgaaagagattacatttggaggagtcaaaattagttaaggggtttagttcacccactatacaagaaacctctttttctctccttatcacctttctcactgaaattaccaattaactaatcatttcattacgttaagcatttctcatttcaccaaaaggctaaaagataattttttccagcaacaacttcacttacttgttgtttttatatcttcttgtctagataatattacaacaaataaatacacgtaaagaaaatcgcttttgtcataacaaagctcaaaaacaaatccaaaacaaataatcatcaaatctactaacattttttagaggaaaatttattgtgttggagaagtcttgtaacttggaggtttcttctcctttggtttaagctaagaaaattatcagtttgacccaagaaaaacaactcatgttagttaacgactcaactttactaaacccacatatatgtagtggaaattagacacatctatgtttatacttatagttttcgttggatttttcttcaatgcatatcgtacttctttctaatttatactcacgatcgcctcacgtaagctaaatcataaactaagttttatttcacgtaattcctaagttattaatgacaaatgagagcttaagtggtgggaccaaatgaactactaaggccatccataacggtggactctctaaaatgggtatgcaatgaataaaacaatattatttttattagagttttattatgtaattaaatttaaattacttaattggtattcaccaataaagttaaaacatgtgtaaagtagaggttctctcatgtgtgtcaaaatctctctacagagagtttatttgataaaactctctcctattgcttctctccctgatttctttctattatttttaaatattttaattatgagtttaagtgagagagctccaccgttgtggatgctctaataaactatgttgcgcctgatgtggtttggaatatatgttttttttacaaagcttcatgatgactcgtgaatgtcgtgtcgtgaaccaaaacaatctcataaatgttttctatcttacttagttataaaacgtgataaatttgatgtttattatattaagatgtcaagtaacaacaatggcttattggcttgttctagggtggtcaagcttctttgccatatgtttacacactcgttacgatagcgacacgataaccggaaataagatagcatattgccatattcttacctcgaaagattcacattcgacggcatttcgtaaataagttctgtgtaggtttacattaatgaagacaaatgctggaccaaaaccaaagaaaaaaaaaacaagatgtcagtatttcacatggttaatattaaattgctgaaagtacaaattaagtgaaattgtaatttcgaataaataaaaaacaaagaggggtgttttgtcttatcattctctataattacggaaatgccattgactagctttggtctttggatatttcaaccgtcggcgtgtctgttcgttggaaggcgttagttacggcatcatatcttttcatcttcttcttataaaaaaatgtttcataattttataaagctaacttgactttgcatggtggagttgtataaatatagcagagataccaatccattaccagtcatcaaaacctcatctttcttctttctctaaaatcttctaagaataaccattttctaaagatatcttttaacgagacaacaaacaacagaaaaacacacaaaaacacaaaacttctgtttccctgtttctccggattctctccggctctgagctttcggcttctcctctccggagatgttactctgcttccctcttttgtgttctttttgttttctgggtgaatattgtatgaacctttgactgggatttttccgaagaagaatcccagacgacgtaatttttctccaagctatg

SEQ ID NO: 2635 - DNA, 3000 bp, Unknown
  misc_feature (1)..( 3000): cDNA_ID_3068969_gDNA_ID_1620568_Annot_ID_160791 3000 nt of promoter + ATG
atacctgatcgcgggatgaatgatgattcgtgattggttgaattacttctcccacatcctctatgtcagccccaatcgatgatgatttcagaacacaagcggagaaggaagagattgggggcagtgaaagcgaagagcacctaggaaggttttgatctcgacctaggaggaactctaacatgaggaagaaaccccaatcaaagaatccatgtaccagacaaagagatgagagacgatcaacttttgatcaaagacgaaaagagacttctcagatttttcagagtacgacacggtgggcttcgacttctcgtttccattgacgacggcggagatggcgacagagagagagacgattgagaggagagatcaaaggattctcgtttccattgacgacgatggtggaggaagaaagcaatcatcaaagacaaagaagcttctcagattacgaatgaagaagacggagaatttcagacgacgacgacgcaaggtgggctcacggtggtgggcttttttttatgggccccttctttgctaccaaatccaaccaggtatttctttattcattctttttcttctttttcttttctctaaaaaaatgtttttggtaaaactataattaaatagtttaaatctttcactaaaacatttcaataaataaaacttagtataaaatcatattaatttcattattactttttaaaaatgagtttaagtgttaaaattttaaaaacgtcggaaactaactgcgcctacgcatcccgtccttaattggtccgtaagtcttgcggtgttcgaagttcggcaatgttttcacgtaatatagatttgacacttaaactcattttaaaaataataattatgattttcactaaagaaaaagttttatgcttgaagctctcgtcggtcgctagagctgaatttgatttgagggagatggaaagagacaaggttaatgattttgtggttaatggcaagattaacaagttaattaagttattatcaaatagaggttcgtagcgatggaggaagagagacagataagcttttaagtagacaagattctgatgcataaagatgtacaacttgttcttggaagatatgctatgagactcttttagtgatgtcctcatatttctttgccttaatccctttttctaaaccgtcaaaagattcatggtttggaaacttgcaatagcctctggttggttggttggttgtttcaaacgttacactcacaaatataacacaatttaaaaactaaacaacggtcaagaaaagagggtttattttaagagtccattcaacagatcactagcactgaactttgtttaaatattcttttaaatctatgtggacctccctgttttaggatcccatatagtaactttacgagagcataacgtagacgaaccaacactaaccacaagtataagagcattgttcgattcaattacgcctatttggtaccagagatgttaaagtgcaacatggaaacatgattgaatttttctcaagctaagaaggtctaaacaaatgctaaaagaaaacgaaaccaacaaaactgtagagtgtagaaaaaaacatagggtacacatgttataaaccaaaactattggggtatatacttaaataaataaaagtacacgatagggaacatttgtaatacacagaacttaggggtgcatacaaaaataaaattgaaaaaacagagcatagatcagtgatccggactctgttttggaagatctctaaaaagcttaggatcatcatcggcatcgcgcagatagaaaccatcatcgaaattctgcgaatagctcacagcatcgtagtgaaacgtaactaacgttttcgatttattattctccaatccgcaacttctaaccaataataatcttctcatcaaatcccttaacttcggactaggtcttgtcttgttgttgtggttactgattcgagcgtactctgtttcttctgtatggatgagacaagataacggcgaactcaagcatcgaccggtggagtacgattgtctacggttgtcggcgagaactctatccatttcttgcaaaaataaaagagagattgttttattgattgagtgagaaatatggggtttataatcgacgaaagagttagagctaacaataaatgaattaccaagcaaagttggaaaataatgtagattttggctggttatggttaagcggtccaatcataattctcgttttttctttggcagctcataatttctcatttatgggaagcattcatttattgaaacttggaagttttcactagtcattagtcaacattttttggttgtaatgtacctacctatcttcatttggtagtaaaattgtggtacaatgtcaatgtgaagttattagttttaactcctgtttggtttcatcaaatgatataaatttcattgtttcttttgtttttaaaagaagcgtaaagttaaaacatatttggtttagtgaacaagggatcagacttgccagattacgtggtcgtagtatttggggaacaacacacagagctacttcactatcacactatatcttgaacgtgtcgtgtttgttcttgggatgctctcttcgaacaagttatttattatgtatccgtgactcgtgaacttgtgaggcccattacttcataacagttttcggtaaaagaaaaaggacgaaaaagaagagttaaaaaacgctagaaggaggggtcgaacctccgaccttgtggttaacagccacacgctctaaccaactgagctattccagcttttgttaactatttcaaaaacaataaatatattcgtaaacagatgttttaatttcaatttgacttgacaagattaccctttggcacatcgattaacatatcatcgactttggaacctcacaacataatcgcatgtagtcacacttagtcaaatccaaacccaaaaaatctcaaagaaaataagaaaaaataaaaataaaaatgaagagaataagaata

SEQ ID NO: 2636 - DNA, 3000 bp, Unknown
  misc_feature (1)..( 3000): cDNA_ID_2105764_gDNA_ID_1620568_Annot_ID_160792 3000 nt of promoter + ATG
ttgataaaactatatgttacgttcaaaatatattataaaaaaagaagagatattttaactattcaatcagacataacaatatcttgaacatcatttgaaacttttcaattcgatcaaagaaaccttgatatctcgaggtggagcacagggccatcctcaggtctattcaatccactaaaccactattagaaatatcacattagtcaaaaagttatgaattttttctgttattttatgagacatccaaatatcaaattcgacacgattcatattatacatttccttcgaaacaattagaacgacttttgaaataaaaacaaatgggacgaatagaaagaaaaaaaaagagtggggacattcaattattacaacataagaagggagctttatgagagaacaggagccagattcagttaattatgtctacttctggtattatatttgttttgtttttacacagatttgtacgaatcataatcaaagtcacatcttatctcacattcacatgttcaaaactattcattttaccctggattttcatagtaacatttatattcgtgtcttctaatttgttttcatctctaatgccagcttgcaaattttttcttttttttcctaagtcaaatttctagatagcatcctatataatgattagtgttatcatttcgctcgtgtaggctaattatcgattttcttttattttcaaagacacatactcagtgctagagaggagctatttgtttccgtaatcctgggcctctgagagttttgaacaaacatattgggctataacaaaacccattattagcgggccgtttatatctggattctgaagtccagtccaactagcatagcgaaccaaccggtccgtgattcaatttaaccggttattgaaaaagtatcttatccaatatttagtcttaacatatttcattcttcttcctccctattgattaatgaaagaaattcagtttctaagagatcaaaatccgatttacactatttctcttctctgattctttcacttacatttccatgaaaattaccgtttaatttcgtgatgaaacaatttggaaggtttagcaaaaatgataatgtttgttctttatgaaggaaactataattgtgcagcatagtagtagtttgttgtcttgtaatgtgaagaaaattccgatttgcgacaaaatttatgtaagtagatgaagaagtgtgagcgcacggctcttaataaaaagcgcgtggtgcatagagaaaatatctgatagtgggtttgcttagctgtctggtccctactttggttgttgggcttagacgctacccttcttaacattctcatttctcagcttctccagtacttattacggattgccctttttcacaaagagtctttttttttttgggggtgaattatacgtaagtttaatttatttattataattgtaatcaatattatattttaagtgataatttttttataggaaatggaaataaatatcaattacaagaaaaaatgttttaaatcctttttaattaatataggttggttagaagaatttggcccacgactaataatcatatgggcttttgagaaaatatttttaaaattcaacggtccagattagacccaatttttgctggaaaaatatatatatgaaaaatggccctcattgattcaataattgtgtgtttggatcactcttttgccttgagttgtctttctctttcttttcttctcctctctatcttctcttttgttgttacttttgttagtcttcttctttgtttctgagaaattattcagtttacttagattttgtttaattcattcactttttttccagtttaactagatttatttattaaaagtttctgattagtttatgatgtaagttctgctccacacaataccatgctttttctggtaataaccgctctcaatttttttttcctttcgaaaataacaaaattcgtttttttttgagaaaaaaatgagaaatcaatattttagcagttctctagcccagagatctgaaagtgaaaaagcccatttgggggtttggttgggttcataaacaagaagggtattttcgtcattccgactaactggtgttgccctaaattcgtccgccgtctagtcggtgaccgcccggcgatgagaaatgagtttttttttcttttgggttttgtttgtggtcggaatatttaattgtcaactcattgcaatttatacttatttcatagcaaattaattagttatgatttagtctttaattagctaggagtaatccagtttaagggcaagattcaaaagttacgaggagcattcatgaaaccgagatcctagctgtctccacgtggcaaccgctgacctggcaaaataaaaagcgaccaatgagagagtcgaatccgaaaataaagaaacgaaagaaaacaaaaaataatgaaaagtcagtgtgggacccattcagacatagaaatgactagtttgcctctctcacaaaaaaaggaaaatcattttaaaaatccacatcaatttttgtaaagttcgtaggaattattaaaaaaatacaaaaataacacatacacacgacgcctcacgaacaaacggctaaaataactccacgtggataactacgaagatctgagccatccgtggcagatttccggggcagctagatcggtcagcgtcacccaacagatctgaaccgtaagatctaaatttaacggttagatttaaactaagcgttatgtcggtcagattccaatggcctttaagaagagatgatgcctcccatcttcttcctcatcatcatcgaccatctcccaaaaaaccctcttttcatccctttttctgaagctctaaaatttttcagttccccgatcgccggaattttcgccggtgatgtaattttcccgcgccttttttgggaggtgaatttttttttcttctaaaagctcgagaagagtgaaaaccccagaaatgaccttgcgattcgtatg

SEQ ID NO: 2637 - DNA, 3000 bp, Unknown
  misc_feature (1)..( 3000): cDNA_ID_3068965_gDNA_ID_1620568_Annot_ID_160795 3000 nt of promoter + ATG
ttttctttttttcagtgtaagttattttatttttactttcattagttaaatgcaatcaaagtgttatataactataacgaaaattaaaaacacattagatattttaatctattttatatgaaaaaatgtagaactacacttgtaatgattcaaacaactacttagattaaatgacattaaatatttaaagataaattaaatccatatataatttagatttttagctttattaataacaacaaaaacaaaacaaaatcgtgtattgtaaccctcagtcgaattctctatatctagtgagggctttgacttatgattagaatccaaagagaaattaatacagaagaagacgaagttataatgaaaattgaggagcagcttttttggttagtcacgtcatgtgaagaggaagaagatgaaggagaaggagaagaagaagaagaagatcattaattagggagagggtcacaatgcagtacgagacagttcactgaatctgtctatctatgtaaaccccacaaactctcacgcatatcatagcttctgatgaatacaaacaagcctcgatcccattaaccacagacttgtccgtctcttcttcttcttcttcttcacactcatctttataattaacacacacatatgttatatactcatctgtggatgtgcctatactataaagacatgtcacacgtggtgggttatctatgtaactacgtttttgagtgcaatatgtatctatttacacgatactttactgttttcttttaatggatagcattagaatgacttgatggtctaaccattaacattagaatgacttgatggtctaaccattaacattagaataacttgagtccatcataacttggtttaatagttttttttggttgtgatgttacgccacaagcacaaattctgggacctttatattgtgtgtataaatgatatttgaatacagaaattaatatttgtagagattcatcaatgatatatttgcttttgttttttgttcatcattaaatcaaagatcttcgtttaataaaacttgtgtttcatatttttaaataatttataatccagatatattgtactatatacacccacacatgtataatatgaatgtgaatgttgaattatagattgaaagtgagtgaactgaaaggacgagagaggcctaagacagtttgtttgttttcgtgaacatggagcttctctttaccatgtgctctcgatctttttattattaatcttacttttatttacttttttcacattttgtttttatacggttttttatatgagaatggcactgaagatggagcaagaagttcacatgcaaacataaaatattacacataaaaaaattgaaaagctacattctaggcatatgcgtgattttccaaggatttttgtttcgtataaataatattagcagtcaaagtagctagatttgcttctataaatatactttcaaatttcacccctttactttcagatttgtcaatttacgccccgaaatggtgcccttgatagcaaacaattatacagtactactatgagaacgagaatatatctttaaaaattcgaaaagctccaatattttcggtcattagttcataacttcatcatattcataacaattaccgcgaatagcccatccaattattataaaaattttgactatgtaaaagcgttaatcaaaagaataaacgtcatatcaaacgtaagacaaatgtgaacacatatgacaattattaataggcctacacttgaaaaaatgagattactattcacaaacattaccttgatttaagggtcaaattgaaattaaaaaaaaaacaagtgatgctgaatataaaattaaggcaagatctagacgcaatttagtagaatatgcgtacacaatagataattacgtacgcctgtgtatatacgattaattccctctcaataatagttcatcattattatgtaaaatataattataaaaatatatatggcagacagaaaaataaagaaagcaagaggggtagacaaatgttcatccgttttcgtcgagacatgaaatttgtgggatcaaagcaatcctgtaaggaaagggaattaatcaatgtatattactctctttttgtttgtttctcaattagatgaatacatttttcatttatataataactaagacctaaactcttgagtccattactccatttcccctttgtttttttccaacacttcgaaacacagatgtgctagattatatatgatcacctaatgcatgatttatatataatatatgaaaaagtaatataaaatagccagaaatttaatcttgttatgaaaaattgaaaatgattcgagtaaacacctagatggtcattttagactgatatagtaatatctcaatgtatcatggtatttttttcgatggacgaatctgtctacatacaatgcacgtatacatggatgttagaaaccgcaacctctagaactatatgacacacgaattgcagaacttctaaaagttttactgcagtaaaatatcaatcattaaaccaaaaagtctcctataaaagaaatttgattattgattatatgattttgagtgaaactttcttagcagttagcagtaccttttcttttttcgtaggctaaacttaccaaaataaaaactacatcggttcatgtcaagtcttgtaatatatagctaatctagtactagctataggctacagcaaacaaaaatgtttttattatttgtcacgagaaaacaataaaatgtgttatcaaactaaataaaaaccatatattatactaatcacaaattaaacgggaatcttttatttaattaatagtatactctctcacacagacagacatctctggatttatatataaatacagttcatcttctttaatccacaaactcacacacacacacacacactctgttttcttcgtccattctattaccagaaaacagagtttgatagagagaaaaga

SEQ ID NO: 2638 - DNA, 1373 bp, Unknown
  misc_feature (1)..( 1373): cDNA_ID_2106809_gDNA_ID_1620568_Annot_ID_160797 3000 nt of promoter + ATG
atcagaattgatgtaatagttgaaaaacaaatcgatcgaatagagacaaatcatgtgataattgttttggtttggtagctagcatatagtactcgtaccagcatatacttttctctcgcatttaaaaatgcgtgaaactatattataaaatctgaaagctcatcaaaatctaataaaataacgtcggtggagatcgacgagccaacgttattcctcgagtaaacaaataactatgcaaattttctttatcattaaataattaacgatgaagaggtttcaactttcaataatgttgtcacaaaattctttctaacccgactcacttgtattttaaaccaggaaaaactacacgagagcgttgcataaacatgaagaactgttctgttttgggtttatgatagagataagcataagttagtagatttggtaggagtagatattggagataagggtaggattagggtaattaatgaagattaggtgcaaaacggctaaaaagattaacatggtggagcttggagcccacgtcttctccgtacaggcagccctctctatctcatctttccacgtacattttccactctctctttccccttttttcaagcttcataattaatttcatttagattaacaatttcattaatctgttattttcaaaggaaaatggaaacataacactttgtttgttttgttttttatatatatttgtaaagataaaactagctttggaattgtctgtcttcatttttgtaaaagaatctcacatattattccaataccaacatctgatctccaaggaatccataaaagttaagctgtttttatcaccatgaaagtacaagattttttaacgcatttattttgtcagaaagatttttttcactcattaacatttaactttctagcaaaaaacaaaaattacttttaaaatcactgcataatcaaacagtaaaatgataagtaaattggttcaacaaaagtcaagaaacataatctttatatttttgaaaaatctatcgtttgatgatttaattattaatgggaataaaaatttcaacggcgaaaagaaaagggacaactttattgtacagcatatttgctttatgtgtactgcgaaaataactttttcacagttgtaaaataaaaacattttaatatctcatttttttgatttcacaacaaaaacaataaaataaaaatcttttataaataaacactccctatctcttcttgtttccccgtcccctgttctcaccaaactctcaaagctctcttctcttctctagccttctctctctaacacatgagagaacaaaatcatcagctcacaatctcagccgtcgattatatcgccaccgtcgtagaagaagatg

SEQ ID NO: 2639 - DNA, 3000 bp, Unknown
  misc_feature (1)..( 3000): cDNA_ID_1441391_gDNA_ID_1620568_Annot_ID_160796 3000 nt of promoter + ATG
acgtatacatggatgttagaaaccgcaacctctagaactatatgacacacgaattgcagaacttctaaaagttttactgcagtaaaatatcaatcattaaaccaaaaagtctcctataaaagaaatttgattattgattatatgattttgagtgaaactttcttagcagttagcagtaccttttcttttttcgtaggctaaacttaccaaaataaaaactacatcggttcatgtcaagtcttgtaatatatagctaatctagtactagctataggctacagcaaacaaaaatgtttttattatttgtcacgagaaaacaataaaatgtgttatcaaactaaataaaaaccatatattatactaatcacaaattaaacgggaatcttttatttaattaatagtatactctctcacacagacagacatctctggatttatatataaatacagttcatcttctttaatccacaaactcacacacacacacacacactctgttttcttcgtccattctattaccagaaaacagagtttgatagagagaaaagaatggaactgtcgactcaaatgaatgtgttcgaagagcttcttgttccgacaaagcaagaaacaaccgacaacaacatcaacaatctgagctttaatggcggatttgatcatcatcatcatcaattcttcccaaatggatataatattgattacctctgtttcaacaatgaagaagaagacgaaaatacccttttgtatccttcttctttcatggatctaatctctcaacctcctccattgcttcttcaccaaccgccaccgttacaaccactgtcgccgccgttatcctcctccgcgaccgccggagcaacatttgactacccttttcttgaggctttgcaagagataattgactcttcttcctcatcgcctccattgatccttcaaaatggtcaagaagagaactttaataatccgatgtcgtatccctctccattgatggagtctgatcagagcaagagcttcagtgttggttactgtggaggagagacgaacaagaagaagagcaaaaagcttgaaggccaaccttctaagaatctcatggcggagagacgacggagaaaacgacttaacgatcgtctttctatgctccgatccatcgtcccaaaaatcagtaaggtaaattacaaaatgctaatcttttttttctttcaaaccattaataataattgtagtcaaaatcagcaaaagatttgatcatttttttaatgagtaggttaatgactgtattattatatgtgttcataaagaaaatgacctttttaatcttcttgatttacctcaaaatctaaccctagctaaggtttttgtgttctttgaagatttatttaacatttaattcaaaaaattggtctcaggaaaatcaacaaaagattcgtccttttaaatgagtgaattagttataaaattggtttcaaattcagccttttgtattttaacattatgtgtttgtttcttcttttttgaaaccttagttttcttcttcaagattgtttaattattgtgttcttacttttaagggaatctacagaaccggctgaaaagtgataaatcatttaaaagtgttttaaaataatgattattggtatgttcaaaaaaatcagatggacaggacatcgatattaggagatgccatagattacatgaaagagcttttagacaaaatcaacaaattacaagatgaggaacaagaacttggaaatagcaacaattcacatcactctaagctcttcggtgatctcaaggatcttaatgcgaacgaacctctggtcagaaactcaccaaaggtacaaagatattttacattgctcttgtttttttccttctacatattagcccttgtatttatgaattgttataaacaaaccccctgtctttttaacaaatctttttgtaattctgtttatgttttgcatagtttgaaatagatcgtagagacgaggatactcgagttgatatatgctgctcgccaaaaccgggattgctactatctactgtgaatacattagagactctaggcttggagattgaacaatgtgttataagctgctttagtgatttctctttgcaggcttcttgttctgaggtatcgatttaatataaagtatttatgcatggaatgttaattatatagtattcgtaatgataatattgatgagttttgttgtatatatgtttatagggagctgagcagagagatttcataacatcagaagatataaaacaagcattattcagaaacgcaggttatggtggaagctgcttgtaatgagtcatgattgaaactaataaaccaaaactattgtttatttctaataatactagcgcttataaactttagatgttgttttaattcccttgtgagtttggtttttttttcctaggggaaaacattatgagttcagttgtataaacaaaagaaggaaatttaaaaagagatgtttctcctaaattatatcaaagaacaaattgagatataaaataaaaggttatattatgttgctttgagggaaataaaccacttcgataattgaaattagggttcgtatatgacagtgaccgatgttcgaaggatgcatcatcaaataaaaaagctgtattaatcaaaaagttataaaggctaatcataagcgtgattataatgttaatgactgtgcctccaccaatcaacgcattcatcattactgcggcacttacgtcaacgaattaatcttttatcgataaaattccaagaggccctaacttaggcttaatcaattattgggcctataaagaacggcaactgatgtagatccaaatgggctttatttagtaagcccaaactttatgttttctcttatatcttcctgctctgttattagaaagaatctccgatttagatagaaacaacaatcctccggtggtcactcgctaatctccgtttgatctcgccgacactcgagccttttaccg

SEQ ID NO: 2640 - DNA, 3000 bp, Unknown
  misc_feature (1)..( 3000): cDNA_ID_2167302_gDNA_ID_1620568_Annot_ID_160789 3000 nt of promoter + ATG
gaggaaagagtctcgtcggagacgacggattccacggcggcagcggcggcggaagacatggacggaggagaggagaaggggcggaaagaggaggaggagagagaggtggaagtggtggatctaggaggagggagacaaaaagagaaagaagaagaccagatggggcaaggatatgatttacgaaaagttgagggacgaaaatgacaagaagaagatgagaaatatttgggttttggcgatcgacgaagaagattgagagaggctcgagacgttggagtcgccattaacatgtttgctattacaagcgttgccattattcttattctcttcatttttatttttattttttcttattttctttgagattttttgggtttggatttgactaagtgtgactacatgcgattatgttgtgaggttccaaagtcgatgatatgttaatcgatgtgccaaagggtaatcttgtcaagtcaaattgaaattaaaacatctgtttacgaatatatttattgtttttgaaatagttaacaaaagctggaatagctcagttggttagagcgtgtggctgttaaccacaaggtcggaggttcgacccctccttctagcgttttttaactcttctttttcgtcctttttcttttaccgaaaactgttatgaagtaatgggcctcacaagttcacgagtcacggatacataataaataacttgttcgaagagagcatcccaagaacaaacacgacacgttcaagatatagtgtgatagtgaagtagctctgtgtgttgttccccaaatactacgaccacgtaatctggcaagtctgatcccttgttcactaaaccaaatatgttttaactttacgcttcttttaaaaacaaaagaaacaatgaaatttatatcatttgatgaaaccaaacaggagttaaaactaataacttcacattgacattgtaccacaattttactaccaaatgaagataggtaggtacattacaaccaaaaaatgttgactaatgactagtgaaaacttccaagtttcaataaatgaatgcttcccataaatgagaaattatgagctgccaaagaaaaaacgagaattatgattggaccgcttaaccataaccagccaaaatctacattattttccaactttgcttggtaattcatttattgttagctctaactctttcgtcgattataaaccccatatttctcactcaatcaataaaacaatctctcttttatttttgcaagaaatggatagagttctcgccgacaaccgtagacaatcgtactccaccggtcgatgcttgagttcgccgttatcttgtctcatccatacagaagaaacagagtacgctcgaatcagtaaccacaacaacaagacaagacctagtccgaagttaagggatttgatgagaagattattattggttagaagttgcggattggagaataataaatcgaaaacgttagttacgtttcactacgatgctgtgagctattcgcagaatttcgatgatggtttctatctgcgcgatgccgatgatgatcctaagctttttagagatcttccaaaacagagtccggatcactgatctatgctctgttttttcaattttatttttgtatgcacccctaagttctgtgtattacaaatgttccctatcgtgtacttttatttatttaagtatataccccaatagttttggtttataacatgtgtaccctatgtttttttctacactctacagttttgttggtttcgttttcttttagcatttgtttagaccttcttagcttgagaaaaattcaatcatgtttccatgttgcactttaacatctctggtaccaaataggcgtaattgaatcgaacaatgctcttatacttgtggttagtgttggttcgtctacgttatgctctcgtaaagttactatatgggatcctaaaacagggaggtccacatagatttaaaagaatatttaaacaaagttcagtgctagtgatctgttgaatggactcttaaaataaaccctcttttcttgaccgttgtttagtttttaaattgtgttatatttgtgagtgtaacgtttgaaacaaccaaccaaccaaccagaggctattgcaagtttccaaaccatgaatcttttgacggtttagaaaaagggattaaggcaaagaaatatgaggacatcactaaaagagtctcatagcatatcttccaagaacaagttgtacatctttatgcatcagaatcttgtctacttaaaagcttatctgtctctcttcctccatcgctacgaacctctatttgataataacttaattaacttgttaatcttgccattaaccacaaaatcattaaccttgtctctttccatctccctcaaatcaaattcagctctagcgaccgacgagagcttcaagcataaaactttttctttagtgaaaatcataattattatttttaaaatgagtttaagtgtcaaatctatattacgtgaaaacattgccgaacttcgaacaccgcaagacttacggaccaattaaggacgggatgcgtaggcgcagttagtttccgacgtttttaaaattttaacacttaaactcatttttaaaaagtaataatgaaattaatatgattttatactaagttttatttattgaaatgttttagtgaaagatttaaactatttaattatagttttaccaaaaacatttttttagagaaaagaaaaagaagaaaaagaatgaataaagaaatacctggttggatttggtagcaaagaaggggcccataaaaaaaagcccaccaccgtgagcccaccttgcgtcgtcgtcgtctgaaattctccgtcttcttcattcgtaatctgagaagcttctttgtctttgatgattgctttcttcctccaccatcgtcgtcaatggaaacgagaatcctttgatctctcctctcaatcgtctctctctctgtcgccatctccgccgtcgtcaatg

SEQ ID NO: 2641 - DNA, 3000 bp, Unknown
  misc_feature (1)..( 3000): cDNA_ID_2167276_gDNA_ID_1620568_Annot_ID_160783 3000 nt of promoter + ATG
atcttcttctccatctctgcaacgaatcagaaggaagaattttgtttctaatttctcgatgcacataacgtaaaaataatataaatttagagttggtgttataccttcaacagccatagcttggagaaaaattacgtcgtctgggattcttcttcggaaaaatcccagtcaaaggttcatacaatattcacccagaaaacaaaaagaacacaaaagagggaagcagagtaacatctccggagaggagaagccgaaagctcagagccggagagaatccggagaaacagggaaacagaagttttgtgtttttgtgtgtttttctgttgtttgttgtctcgttaaaagatatctttagaaaatggttattcttagaagattttagagaaagaagaaagatgaggttttgatgactggtaatggattggtatctctgctatatttatacaactccaccatgcaaagtcaagttagctttataaaattatgaaacatttttttataagaagaagatgaaaagatatgatgccgtaactaacgccttccaacgaacagacacgccgacggttgaaatatccaaagaccaaagctagtcaatggcatttccgtaattatagagaatgataagacaaaacacccctctttgttttttatttattcgaaattacaatttcacttaatttgtactttcagcaatttaatattaaccatgtgaaatactgacatcttgttttttttttctttggttttggtccagcatttgtcttcattaatgtaaacctacacagaacttatttacgaaatgccgtcgaatgtgaatctttcgaggtaagaatatggcaatatgctatcttatttccggttatcgtgtcgctatcgtaacgagtgtgtaaacatatggcaaagaagcttgaccaccctagaacaagccaataagccattgttgttacttgacatcttaatataataaacatcaaatttatcacgttttataactaagtaagatagaaaacatttatgagattgttttggttcacgacacgacattcacgagtcatcatgaagctttgtaaaaaaaacatatattccaaaccacatcaggcgcaacatagtttattagagcatccacaacggtggagctctctcacttaaactcataattaaaatatttaaaaataatagaaagaaatcagggagagaagcaataggagagagttttatcaaataaactctctgtagagagattttgacacacatgagagaacctctactttacacatgttttaactttattggtgaataccaattaagtaatttaaatttaattacataataaaactctaataaaaataatattgttttattcattgcatacccattttagagagtccaccgttatggatggccttagtagttcatttggtcccaccacttaagctctcatttgtcattaataacttaggaattacgtgaaataaaacttagtttatgatttagcttacgtgaggcgatcgtgagtataaattagaaagaagtacgatatgcattgaagaaaaatccaacgaaaactataagtataaacatagatgtgtctaatttccactacatatatgtgggtttagtaaagttgagtcgttaactaacatgagttgtttttcttgggtcaaactgataattttcttagcttaaaccaaaggagaagaaacctccaagttacaagacttctccaacacaataaattttcctctaaaaaatgttagtagatttgatgattatttgttttggatttgtttttgagctttgttatgacaaaagcgattttctttacgtgtatttatttgttgtaatattatctagacaagaagatataaaaacaacaagtaagtgaagttgttgctggaaaaaattatcttttagccttttggtgaaatgagaaatgcttaacgtaatgaaatgattagttaattggtaatttcagtgagaaaggtgataaggagagaaaaagaggtttcttgtatagtgggtgaactaaaccccttaactaattttgactcctccaaatgtaatctctttcgctctctaaattgggccccaaagtccaaatcaaaatagccaccaaactcaccaatgtcaagttctgtcggagaagtcagtctaaccgatttcattctcacttaaacagtcataaacacactctcctgttcaatccgaaattcagttaggtttttagttgacttctggtttagttttttcatttactgatttagagcaattagtaatcaaagattcaaatatgtcaccgtgaaacacaattgcgttaaccgtaattttctgtgattgttctattgcattgccaaaagattaatagaaaatttgaaatgagttacgtgtaaacttatgaatcaaatgacaatctaagaggcgatcacttaatccaacaacggattagagaatattatttcgtaaaatacagacatgtctatagaaaatctaaccgaaccacaacgatagtggatgtgacatgaaagtgtttacgtctacatggaaaattgttatcgtcatcattcatgaattgaaaagacaaacaggttatttaataaccaagatatcgttttcatgtgatcaaatcaattatcttatcaaataaattaactaattaagtgatctctccatcaacgactcgggttgcctaaaactaatgactaacaaaaatattataattagttttgttgcatagcaagagatcaaataggcgcctgtagctcagtggatagagcgtctgtttcctaagcagaaggtcgtaggttcgacccctacctggcgcgcttcattttaaaattcaatatattttaattttgttttgactgggaaaattccatgagcattagtaacttaaagcccattagtgggcaaattaaatgggccttattagcctaagcccattatcaataaaaacaaaacagactcaggccaacaaaaattagacagaaattaagagtgaca

SEQ ID NO: 2642 - DNA, 3000 bp, Unknown
  misc_feature (1)..( 3000): cDNA_ID_2167155_gDNA_ID_1620569_Annot_ID_160809 3000 nt of promoter + ATG
aattctcatgaaacttggatccattccagtttttattttggtttttgttttttgccttgttggttttattgttgaatgaatccttttttagttttggtttggactttgaagctgattgattacgctctccaagcagtgttatacagtatactgtatttgattcgatttagctgcaatgtattattgcgctaaaaaccattctacttgttgggcttttattaatatttgagaaagcccaatcaaaacaataatcagtcatggcccaatttatccattaccgcatcccaacaatgaaaccagtaaagatctgcggtgaactcatcaatgattcaattcatcatgaacatcgaaaactacaatcactactcactaggattacatatagcacaacttgaacttgaatactagagaaaagagagaatcacaaacacacgtgacatacacgtgtcaaaatctctgtcacggacaagaaaagacatcgccgctatcaatccaccgataataatcagcgtcgacggtggctccgttgttagccgcggtggtgtgaagaagactcttgattttgtgaatacatttgtggttgcggatgcggtttagaacggcttttttgttcagcgtttgcgtttgcgtttcagacgatatcaggtgtagctgcttggacacttgctcatctttcaaaatctcctctcctttcgaagtcgcaaattccattgtagtagagaaagaaaattagaaagctttccgattttttgttgttgttgttaatggaacgaagaagaaattgtgtagtaaacaacacacactcgtgtgtatttatatatattaatggattggtgagacttcgcattcatataattgcaacttgttacattaaaaaaacatcttttaagggaagaataatagatattacgtgggctcttgtcccgttggttctgtgaaaactggtggctgatttggcatttcattagtttataagaaagggacacaaactatgtgctctcctacgtgcaattctcatgcgattagtgcattcttaatccctttaatggactgctttatctttgtcattgcttgcgtaacgagacataacgacaattaacataatcatgttgttgttgtttttttcaatccatcatgttgatttttaatattacaactactgacttctattctctaattaaattttctgataaattaaacggtatgacacataaacaatgtagaaacggaatagtcaaatgatatatacaaaattcacaatagaagcgaaacataacatatatttgtttacttattttaaggttgcatatcaataacttggtaattatttttggtcatagtggtaggcaatctcccactgacaatacgaactagaatctcactgcatctcccattacttgggacaataaactcaaatagacacttattggtcagtatcatctcatggcttttacagaaacacaaccatgattcatgcgagaacttgaatcctctgtcgtgattcagaatcttcaaaggccacttctttccactttcatcacaaagctcaatatcttcctccaattcaatcccgttcgatctcagaaaagttaacggtaattcctagcaaacacatagaaattgatattatgtaaacaaccattattatgagttaatacagatttatataaaaaaaaaggttctttaagctcaccaatttctgaagtgaacctcttgtgatattcctaacaaaatgcggatgcttgggtttgtaaaccgattcttcaaatccattgtgtttcttctctggaaaccatgatatgtcacaagtatctaggtaacaccgaatgaaaaaaagagttaaaaaacgcaataatgtaaattaaaccaaaaaaaaacatgttaataattacctccagcccggttaactgttctctgagtcttttcactatgctccggtttggttttgtaagttgaaacatactccggtttatcatcaaccagtacgtgagggtcttcattaaccgaatcgcgtttccgtttccggttaatgctctggccacaatcacaatctctcatacgatccggtttagtaaaaatatcatccggttcttcctcatcaagagaaaccctagatctatccgtggttgagacgacaccaacatcttttttacatccgtcattagcgaaaatcgtaacggagaatctggaatcgccgtcgtagctgaagacaaggaagtctccaaattcaagagattgatcgtttgcgaaactttgccaaccttttgtgaagaaaacacagaatctttcttctgtatcttctgttttagtctctacacaccataaccgtccaatctcatcgactaagaacgcttctttaggtaatggtttctctaacatatcgatgaatgcaggaggaatcacctgcagatttatttttgtaaattaatctccgcatggaatatattttgatattataagaataaactgatgagatataaaacaagtataccagttcgtgagaaccgaattcagggagaaagaccttgaaaaattgtaagtctttactgagatcaaccatgatttcttctgtgattagggcttttggtagtgattgattttaaactaaaccagaaggcaaagaagcaacgaagatctcagaagcagaggaccttataagagagatgagaggaacagctgttatgtgatgttcttttttttttttttttttgtcgtctgttatgtgatgttctaaagtctgacaaggttggaaaaaataaaggaataaaaccttttttttttgtttgggcagaaaggaaaaacaaatttcaggaattttgctttcgctcccctaatttattgttattattactattatgggtgtaaactgtaaaacttgtgatttttacaacttattaaacagccaaacctggggcagtcccggcaagacgtatttatgtatccgagcaaaaccaaagccctaacctgtaaatcgcgaccgaatctctaattttctggatg

SEQ ID NO: 2643 - DNA, 1414 bp, Unknown
  misc_feature (1)..( 1414): cDNA_ID_2167182_gDNA_ID_1620569_Annot_ID_160818 3000 nt of promoter + ATG
acttcacaagtgttaagggtctttacatgggttcactgcatctcaacagcaacaacaacaagctcaagtatcaaaaactgcgcctctccaacctccccaagattcctgacgcaggtcgggagatgttggatcaatgtttcatgagcaagcacttggtggaatctccctctggtgaacttttcttggtcaactggtaagtttgtctattaagaggctagctacttttggataaattcaaagtagagattgagctgctttcttctctttatgcgcaggtacgcacaatgcattcacacagaggaaaaagacggagaagtggaaggtctccacagcaaaaccaagcggttcatggtctttagggaagatgagaagagcaaagactttagttacacggaagatattggagatctctgcatcttccttggcgcaagtgaagcgttctgcctcacggcaagcatgtacccggggcttaaacctaactctatctattacattggccatggtcttggttcatacgatctaacctctggtacggtccattccttttaccctcctcatgcaccaatgctcaaccatgttccttactggatcccttctcatctctgagctctagcctctaggctatgggtttgttttacggtctttatgcatctactctctacttactactgttgagtgttcttttgttaactactactttctggatccctactctttatgttataaccaggtgacacaatattattagtccacatcgtatttgactcttccgtcaccattcacgcccatcttaatgggcttgtgttattttctatgagccgttattttggcccaataaaatgtgcagcttagtacctataaaagaccatttgattttatgatgatgaaaaatactattataacagatttatttcgtcgacatatcacaattaaatttaagatttatatattaaagaaaaaagttgtgacacgtcaaccaaaagttaaaataaaaatcaatttagtggcttaaaatggggataagaaaacaatattgaaaattgatgatttatccactcacaatccaaaaaaaatccaccacaagcgctgatcacgtcacgttcaaatatttttaccaaacatttctaaatatattgattagtttattaaatgaatttctaatggaggagagaaaagacatgtcaacatcagaaggcgatatttgtaggcactcagagatgaagtgtgttgcgttgctgatgccacctgtctcctcctcctccatcatttgcctccttcttcttcaaaccaatttcttcttcttcttctctcaggtttgagtctgaggcatcacaacagataaagtcttgaactttgatcaagaattctaaacggagtttttgctcttctcgtcggtgaaagaaaaatcgagatg

SEQ ID NO: 2644 - DNA, 3000 bp, Unknown
  misc_feature (1)..( 3000): cDNA_ID_2167171_gDNA_ID_1620569_Annot_ID_160816 3000 nt of promoter + ATG
aacacaaaagtaggactagtattattaaggatatcattattgcttataataatgtttaattaatgtaaccaacgacattgcctttttctctgatgttcacgtaacacatccaaatacatattatttcgtagtgatatccaacgataggctgtccgattcaattcatctaactgaattatttttggattattaagggtttggttgaggtcatctctttgtaaatttggcttaatttgtatagtttcttcaataatgcaagtcatctgatacaactttaaatccaatattatacttttaagtttgtttttatcgttcactaaataatttccaccatctgaacggtcgagtgttttttctctgagttaggttatctatattttttttcttttctttctagcttttacgcatttttttttatcatttgaaagtccaaaaataattattatcccttgtattcgtgttgatttttttaataaaaaagttggattgtcaaataaataaagttgaaaaacaagaagaagaaaaaaaaagcaaactgaatcagttctcgtcggtccaaaaaggagagagttctcttattcacacattttccatttcacaagcaaaattccaaattactcgttctttgactttcccggaccataaattaaaacaatctcatatttcagtacgtaagacactaagatcaaagagtacaaataattttttatttatctgttctatgattatacgaaataatagtcaacaaacttttggtgacgccaactattacaattttttaagtcaaaaaagtgagcaaaagtcgactggatcgtgaaggcctcctgctgctcgctacttggttcctgatatgtcaaacatccaacaagaagacactcacgactcaccaaccgcttctactaagtaatatatattttttcttgaatcaatctcctgcgattgagcttaacatgtgtttcttcttccttctaaaagctttgtttttgtaaaaggtttaatgtcaagcatttagttttcagtaatacaatcaaccattaaccaaaatattgttgttttacggatttactccgaagagcttaagtcactattggtaatttacacatatgtcctggaattgtttacatttcaacatgtgtcttttgttaatcttgtgtttagatttatattcgttacataatgcatggtttcacgtaactcgatattgtaacatggttggggttagaaataacaactttgcgttcgaacgaagccgtctttgccacagtttgcgtgacccatcaacgttcgtttgtgtttgtttgggaaagccgtcacacgtgcgtttgtgatcctaaattaaattatataaaatctgctccacatacactaaatctactaaataacccattaaactgaagcaaaacatcagtaatcaatatacaattatatcaccattactatgattccaatgtaaatttgtaatgtgtttcatgactgagaaacccattcagcaagtttttcgaattgttcgacgagcataggcgagagtttcttaaccggtttcctctccttttccggtcgaaaatcaaacccaagcgcgtccgagacttcttcggagctccacccggatttacggagcgactctgagatccgacccgcttttaatagaagcacatcaagaacagtttgattatcgataattaccatttcgccctcaaagaaacccgatgctgacacgtggataatctcatcaatatcggattcgctccacccgcctcttcttaaaaccgaaccgatccggtttacgtactggttcacccatttcggagtctctgttttgggaaggtccggcgatgaagaagacgacgatgatgtggaggcagagtttcgccggcaacgatcaaccgccgcgtcactccaaaactcaacccatctcgacttacccgcaccattagcccgacccaaatctaagcttctccgggaaaaattcgaggatgatccagctgatttctcgctcactgaacgttgcttagtgagaattctcgggaagaattcagagcttcgaaaagcagattcacgctcgaagaactcggatagatccgacccgcaacagaagatccgagtctcgtcgatgaagaaaaccggattaccagctaaagacgggttacaaggaatgtagcagtgatcaaagatgggaatcagtaaaggagctctttttaaggcgtttctcgcgacccttaaagctttttccgggtcgggtggtttcaagccccaagatttgcaccagagactgtttttagcgatttggaacgatacagcggcgactggtaaatcgatcatggcacggaggtggagacgagctccgggagaacgccagtctgggaatcctgcgccgacggagagaccggcggagaggataacacggaggtccggtgggaaggtgaaaccaaactcggcttcgactcgggcaaactcggtgtcggagagacctggttggattttgatacctgaatttttaagatgattgattactttatcggcgaaaggggagaaagattgaaggctgtttctgatcgtaggagtggatggagcggcggcgcgagctgagagacggcggagaccggctgcgtgagccggagtcaaaccggtcattctccggtcaacgtcgaccatgtttcactcaggtaagagaaagagcaaatttttagaaagatgttagaatttttgaaatttttgggtgagagatttgtgtaactgagaagggaaaaagatgatcggaggaaaatgaaaactttgtagtgggaaagagaagtgtagcgaggagcttctatatatatatatatatatatatatatatatatatatattgatgggaccaacatgtacatatattagatattggctgccaggtaggcttcaccttcctactatatagattgttttcaaatcttcatgacaacacttttgatccttcgcattcactaaataagtacatattatcagtttgacaccaaaaaaatg

SEQ ID NO: 2645 - DNA, 3000 bp, Unknown
  misc_feature (1)..( 3000): cDNA_ID_2167357_gDNA_ID_1620570_Annot_ID_160825 3000 nt of promoter + ATG
tttatggagctgaaacttttaaaagatgtgttgccaaaagagattacaaagccggtcgaagtgttggattttttgaaaagaatggatggttgttatccaaacacatggatcacttatcgtatactactcaccattccggtttcaattgcttctgcggagagaacttttccaaaattaaagctcataaaaaattatctacgttcgactgtgcctcaagaacgattgaatggtttggcgctgatatctatagaacaagaactggttaagaagctcgattaccaaaaattaattaatgaatttgcaggagcgaaagcaaggaggattatgtttcgccatgaagaaaaattatatttctgtctttttttcttgttaacaatttttctgttcaattttcttaaacaaaataaatttcatattattttattttgcgagaaaattttggggcattaattttgaatttgctttaagcatcaaatattctcggaccggcactggtaatctttctctctctttggacgttttcttatttccatttgcaacctaaaatatactagttgcgagtgtgacatgatggaaatgtttttggcaaataagacatgttcgtaatgacagaacaaccttgagtaccaagtgacagtatcaattgatctttgatacgatcgggttattgagccaacctaagggatcacaatttaaagctaagcaatatcgccaagtagttcacctatactagagtacttgtggcgctctaagatttgcataaattaactgcacatggagatggcgttatgtgattttttttttgttatatttcaaagcctgaaggagaatatttaatgtagaaaacaaatattttgcgtttgcgcaatcgaaattttgttttggtcaaaaatttgtattgttcgacacaacggcaaaattatagttgtgacttttgtattaaaataacaacggttctacaaatttaatgggctatagatttaggaccaacatttcggatctgaggtttaacacaaaagttgtgaaaatgagatatggttgcatatgcaccaccaaaattgcaaatcaagggatactcttcatgccgaatttgtgtatagtttagtttaccattttttatttttggattttacaatatttgtagatacgacatgatattttctgattggcatagaaagcttatgcaatagcatgtcttgagcacacatagtgtttggagtgttagatattatggtagaattttcttgtgacccaaatccatcacttgcaaggaggttaatttagaacaaaccaaattcatatgagatgaaattttaattatcaatctactaagactaataagaggagaaaatacaaagaatataaacatagaggaagtccaatacaattaacttgagacgtcttccataatatgagaaggtttcttctaaactctctcaaatcttgacatttggaatttttttttttgtgtgacatgtgttggcaatttttccttttttttttcttttctacaaaaaaaccacttcaattacagattgatagtaggattttactcacttaatccctaaaacactatcctatcgttgtactattttaggatgtcaatccaatccggtgtgatgcaaacagatgagatatgatcaaaaagctctaagtcaagccaaacagaaagttggttggttctaacagtcctagtatgcaataacagaaatgaaatgaaactaaaagcagaaatggcaatagcaggcaagtaaatgacaaagcagaaatgataacaggcaatcaaatggataaacgattcctaaggatggggaatcgaatagtgtggtctacttaatctattcaggcggttgacaaaacttcacagaagctatccctagacaacaagttcaacaacagattaattcactcccgtgatagaaatcctcaagtaaagctagacactgacctaaatccctttagcgatctctaactaagcaggcattatcgaatcaacatgttaaaatcaataccctctctacagccaatcccatgggatagaggtagatatctctggaattaataggatccaacgcccattaaacgcctcctgagcgctggacgtctggactcatactccacattagccagtgaaacaagcaataagcgcaactaatccagaagggattctagtattctaaactcaaccacctaaaacgaccaagtaaaccacaactattctatcccatcctcagaaatacagttcactactcagacataatcaaagacaatagcaaagcaacgattaaaaacatgataacagaaatgacgaaagacttaaacgaaaactgaatatcaaatatttgaaagtgaaaatacaaagttgcaggagaaacactgcggctataaaagttgcgaaaatgtaaaagcgagataataacggataatagcggatgccctcgggaaaaccctaagaggcagtttatacactacaagaaaacagacaaacaacgactacagaaagcgacaacagatgtagtcgtcgtttttggcgactacgtcacgaccgttttacgacgcatatacgacaacatgaacattagtagtcaattagtcgttattttacgactaaatatgttagtcggcaaatactcgtatagcaacgactatttaacgattatattatataagaaaaacgtttgtcgttacatagtcgcaaatggacgactacagtttccgactgcggaagttagtcgcccaatcggcgactaaaatacgacacatgtctgaaatcgtacaattgtcgcaactgagtcgcagaatagtcgcattaagttgttggaaaacgttttccgcattgccaagtaggtacacctaatttgtttgttgtagtcataaattagtcataaaaattcatctatataatcaaaattcacgacactcttctttcacaaacaaatcaaaacaacaatcaaaagaaaaaaaaaagaaaacaataaaaatttagtttattctataatg

SEQ ID NO: 2646 - DNA, 3000 bp, Unknown
  misc_feature (1)..( 3000): cDNA_ID_2167433_gDNA_ID_1620571_Annot_ID_160843 3000 nt of promoter + ATG
agatcaaatgaagtttggattcttgcaagtgcatcacattggaacagagaatcagctggccgatatactgaccaagccattgcatcctggccctttcaaatcacttcttaatcgtcttggagtttcaaacctcttccttcctaaagagtgatttgtggggggctattaacatatgtatatgatgtttataattagagtaaaaattcctttagtttactctaagtgtatataaggaacatgtatgattcatttaatcattaaggagaatatatggagaattcactttatctctctataattaatatttttgtccaaaataaaagtcaaggatccaaaattggtgaaaatatcgtatttctgcgttgataagatatacattatgcaaaaattatacatttgtaaattgtactttaagttaactaaaaatgtcgtcttcggttattttgaatctccacatcagttattatcatttaaaataggtttcagtattgtagtaattcattactatttacattatgcaaatctatgagtgatatttcaatcttatctttcaatattagctaaattattttagatttttaactaatcgacagcttagtggctgtaaattattgaaagtttaaagtcgtctttaacaaaaaaaaaaaaggtttaaagtcgtactgaaaacaaacaagaaagcaaagaaaaaataagtggtggttgtaataattatgccttgatttgctcgtaaagtatgcttcggtattatttgtaccaggtaacaacaactaatcacaatcttcctaccaaaaaaaaatcacaatcaaatgattgtttagtcttatattacgtaatgtatcttcttctggaagaaaaattccttaattactctaaaataattctagtttggtagatacgttataagtaatttggagattggtggatctactatgtatcagttgtagccccatcattatctatatatatacacaggatcggtccttgaattgtttatggcctaaaacattatttgaataatatgattttctataaaaattaatattaaaaaagtcattaaaatacgtaaatatattaaaacatttcgaaaactcatataatttctataattcacttttgttcagataaattaaaaatatcataatacctaatcgccaaattaaatcaaatatttggagattttgttttatgaaaatattaaacaaaaaatattaaatgaactaaaaacaattctctcccactccacaaaacaaaaagaaaggacatgaaaatcagaaggaaaaaagaagaaagtaaaatataagacttgaacattgcaattgtagtaagcacaactcttaaatactcctccctacagttttatacttttatttatagttaatggcttaaagcagatgttttagctaccggcgggctggaccagtctatacgtttatataagacaatgcattgtctaaaaacatagtgtcatgttcaatatatagtgttgagatatctcgacgactcttttggagatccaattgattaaatacaccattttaaaatttgtgaaaacattacaagcatttagttgcatcatcacccttccaagatttatataccaattgatgaatattgatttggaaaatagcatttccactctttaacagctcaaatagtttgagaactttttactccaacaatttctaaacttggttccttgtataaaagtattgtatccttttgacgtattaaatttatttttctatatttaagacatttacttttattaaagttattatgaatcatatatttataaattaaattttagtatatattttaatattatatatccaataaccaatatataagctggtcagaaattagttgaatatatggtcaaaaaaattggtagaaatataatttcaaccattctttttgttttggtcagaaaattgcaaccactttttggtctgctatttttgatcactgttattggtcaaataaatttaagatataatgaaaaaaattgttcaaatccttgtaacaaaaagaaaattctctttaaaattcaattatcaagtctcctctaagaaatatatcttattcacatatcttttatacaacaaaaacatatttttctttttcaatttctatttcttttatctccatcaccttgaatcttgatcattattagaggacatacattggactgtcctatatattttggtaagaaagcgatggattatcataccggaagtgatagtctccacaatttactctctctcacttcaccaagctgaatatattgagtttcagatgtactgggctctcttctctcatggtatattttctattttaagaaatgttcttccgcatcttctttttatgtttcactattttgttgaattaattttctattttcttagttatttattggattaatctttattattggctaatttttttggctatatttgatataatttaatatcgaattaaacttgttttgatatatgtaaaaaacgtttagaataaattgatgtttggcattttctcttgctccaaaatatgagtgttctgagatatttattgtccaacatttgtttgtttaaataacaagatgctgtctaatttctcatgcataatatgcacttgtgtcgctcaattaccaaaatggtttctataaaataggtttttatggatttgtcggtgcactagctaaggttgttgccaaaaaagaaaaagtaacaatttctgttttgttttgatttgtaaacaaataaacattcttctctctcctttgatgttttttttataactttgcttgcaaaatttccatgtcttttacacacaaaatgaattaaaacaataaaaagaattaataagtttacctttttcgcggaatattaaaaaattgcgccgcttcaagttcaaaattagatgctaaaatgtgtttctgtccaaattcaaaccagttttgtcttgtcttgtcttcttcttcttcagagcattgcaatg

SEQ ID NO: 2647 - DNA, 3000 bp, Unknown
  misc_feature (1)..( 3000): cDNA_ID_2167452_gDNA_ID_1620571_Annot_ID_160850 3000 nt of promoter + ATG
gtgcaagcgcatgcgtttccacatctataagtaactttgtgcagaagaccctgaaagcatagcaaatgattttgacatgtataaacgtgcaaaaaacattgtgtgcactaatttgccaaaagcttcaatatacctttatagctaaagtttgtagatttggagatttcaaaagcagacgaggcaatgcctgccaaccgttttccttgtcactctcaatagatagatgaatgagtttgtcgaagaccggcatggtataacagcggtagtaaaacgcctgatttatagtcaaagtcagaaaccagatatagatagaaatgagacaatggtaactagcaagaataagagacctcaagagaactggacgagaggtgaagggtcttgacatttcttatcgcagaaaccagatttgtaacctcaccaaaatcaaaagtgttagttaactcccacaatctaagatccagtctagcttcggcaagcgaatcaagataatcaacatcagaaccatcggagcgaagagcagaatagtcaagaaactcaagattcggtgtcttgatctcaacatcgtcttcataaggatatgtgttatgaggaaagtggaaaacaatcgtgagtcgcttgatggatgcactaaccacagacctcgtccaagttggctggtcatcaccactaccaacatcaagtatgaataattcctcgagcacagggcatccagagatgagccagttatacagagctggcttagcaacaacagcaccgagggaaagtgtcttgagcgcagggaaaaacactctgccctcaggtggaacattgcctcgaagaaaagttcgataactagataatgtgagtttaaccaatgtattattgcggaagaaaatccctatatccagataatgatcatattgggactgcaagttaagttccaagcagccgcgtttgagggcactgcgaatccaacggttaacactagatttttcatagtgggaattgagagtgagtctcttgatgggacaattgcttaacagagccactgtatctttcatgaaatcagagaagctatcagcatttctgataggtgttgagtcttccaaatcaaagctgtctacaaaatggaacagattcctccacctcttggacagaacagatgtggatacaacgagttttgtcggaagtaaagataagatttttttgccaagaacctcatcaggcaaactgctgatgaaatctctagagcccataaagactttattcgcctgcaaatcaaacaacgttatgaactttcttaagcacacactatatatgaaaagaaatgaacaaaaatgtaatttttccgatacagttgattctaaatagcctaaatttgattacccatgtagaaaaatctatgagcagatgtgcttaatgaatctatagctaaaacggaaagggggcaattaggttcaattgataactctacattgattctgtgagtcaagaacgaaaaaacctttgaaaatgaaagcagacgatggatgtgaaagcaggattcgtcgtctaacaggaagttccaagcatcaccacttcaccacgaacaagaagaagagaaagagatgctccttttttttttttttctttacaaagacaaacgtttgggtttaccaatgcttaatcctttccttagttattaaaaaaaaagagaaaaaaatactagggcctgattgacaagagtctttacaaagcaaaaaaaaatctaaagctttgaaatatatccaatcaatcaatttgttacccacaaggccacaaccaacatactttcttaattattattattttggctgtaaaaagcagttttttctgtctaaaacacacaatttaattatttaaagctttccaaaattttaaattctacaactacaatcacagctaaaacatttacggtctaaaatctaaagccaaagtccgaaccaatcagatccgagatctagactttggggacttggggtattccgtatttgattcggtgttggttcgactccgaatattttggatagaaacatttaggattaattcggttattttacagtttaattcagacttggtttggttttagttatttttaataaatttggttaaattttgactaaaataactaaaaacttaggaatattttaaatattttgagtatttcttattttgatataaataattgatatttttagattattcaaaattttgggtaattaggttatttaagatctaaatgtaattaataatttgggtatataattatattttaaatatttatttggttctttggatatttaggatccattcaaatatttaattaattttggattcaattcagtttttttcttctatttggttctctattccggtttgtttgtttacccctactaaatacttaacaaaatataataaaacctctataaattaataaatattattaaataataaaatttacatgtcccaaattggacaaatataaaaaattgacaaaattcgtttagagaataagataatctctatttaaatatacattcccattaaaacaattaaaaatgttacatttgtttatcataatgttttgtttaatatatctacgtaattctatttataactgttaagaaattaaaaattgcgtctactcattacaactcttcctttaatatttttttttacttatatcgcatattttcaccatcatattttcaccaatcttgatttttcattaacaaggtaaaccagactcactgggtatatattacttgggaccctctcggctaaaccgggttcaaaatttaaaatatacagtcagaaagtttgttacaggggtatatacgtcattttcaacatttgaaattttcaaattcgctgtgtctccctcgcaggtatatatcacagctacacgattgagagcaaaaaccaaattctcaaacaatttttcacttaacaaattagcaactagtgagatactgagtgagaagagatagagagagagagaga

SEQ ID NO: 2648 - DNA, 3000 bp, Unknown
  misc_feature (1)..( 3000): cDNA_ID_2167473_gDNA_ID_1620571_Annot_ID_160857 3000 nt of promoter + ATG
tgaaagacaaatctaaaattccttctacgggaaatattgagatactgttgtataacgtgaatattcccacaatcaggtttaaaaatgggattattatggttcgagacaaatccggggacattatggttagagaacaattatagttagagcattatcccttttttttttagttttaattatcacgtttattatgataagataattatggttagctctcaagtgttgagcataattatatacagttactaaacactcacgatttgtaatgcgtaggtataaaacatataaatatttattgagtattggatgctaattaggttttccatttatactgcttatgttcaaccagggtcacgcaagaatgtctgagaaaaggtacaagtagatgaaaatcaaatatttctgttttctatccaagtatagttgaccatcagatcatatccaaacgtttgattcaaatagatctatttgtaagattagttcgatttacatgattcaatattgtaagattccccaatcagtaatatgttgaaaaattagtaattgtgagcaaattatttttcagatcatgtcagatttacaaagtgcatgtaaggttagaagtttgttgattctgaataaaaaatgtggacatttattgaatcggataatatagaatagagaatatcgactaatacatgtgatttcatattatatagcttagtttttaatattaaaaaactttttacaacttggtaatgaaatggatgtctctgaatatttacatgtagataggaaatgaatatttatatgtctatccacaagccccagaccaatcagatataaccaatcttaagtatttttggaattagtatagtcggaaaattttgctatgcatgctccaaaatcgaaagagtccctataagttatgataaacgagaaagatgttcactagtttaaacgttaaatacaagagagaaatacaacttcataataagattacattaataaactagataaaagagggaaacagaagagatagttatattctgaaagtgggtaactcatgtttttaaataaattaggaaagcaaaaggatgtctctgaagaggaagaagtagacgcaatgtgaacatctctcaccattatattcgttgtaaaattcatggatgacccaacagtctggataatcctcataatgaaagagctcagcgtaagatccgaatcgttttggttccaaatcagaaatgtggtcaattagtgtcttggccatgatatctacatctgtaaaacacttgttctctcgtttgaaagtattaaacgcgtctaatacttcattatctgcgcagcggtttagcgcaatgtaaagaagcttggctataggaatgacatctttacaatcattcaataatgaaatggcgcctttcatgtcgagagaacagaaccctagcctcaagctcaggagatacatagcgtaagggtttctttttgcaagacatttggagtagaatgagaagtgaacagagtcgggtgaagacatgttgatgaagtcagggcttttatctaaacgaactcgggatagtgtctcgacagagaaagctgcagatttcccttcatgaccagatttaatccagtttttcagagcctcaattccttcttctgaaacgtggctaacaattagtgcgagaattggttccggaatgtataatcttgcaatcttcctctgttgacaacgaagacgaaagtttatagaagttacatatactttgtggaatgaatgtaaactatattgtttaaaaaaatgaaaaatttaacctgtgtgtcgctagattgtgtgatagagtgtagacatttggatgatgtactcattttgtcaatttgttgcgaataacgaaagagtaagatgtgatggagagagaagttttagtactgatcaaaacggtttagaaatgagtaataaaaacagagtaattaattggatgtttctcttaataggtcacaatcgtgagggatgaagcttagtggggagtacgggttcagttaatattcactatatattaactctaaatataaaagctaccacttgaattccattaaaccaatttcatatacaaaaacgcaagtcatagttctgaaacaactcaaatcatttgtataataattgtgacaccttttagttgttgattattaagcttttgaaaaacggtttatagggatggcaaatgatttgagttagttcataattagctcgaatgatttacaaatcaacaacacagtttacaaacagaggtcaaaattaatatttttgtgtattttgaactattgttgatttgtaaatcttaatataaatgtcatccagtcatagtgaattattcaatcagacaaacgaattaatacagttatgttgtgaatggattcatatggatacattaacaattatctttctctttcaacatgaaagataaatctaaaattccttctaccggaaatattgagatactgttgtatagcgggaatattcccaccatcaggttttaaactaggatttttatggttcgagcataattcggggacattatggttagagcacaattatagttagatcattatccttttttattttatttttattttttattatcacgtttattatgagaagataattatggttagctctccagtgtttaagtttcttccattccccattcctacaaaataatcttatctctatattgctgttgaatgttttagtggtttgtatcatattatttgtttgttccatccataaccccatttattttcaagttcatctaacatttatatcagttaacaatgcgaagagaaataaataattttgagtattttgaactattgttgatttgtaaatcattcgagctaattatgtttacaaatacgttaaaaccagtcatagtgaattattcaatcagacaaacgaattaatacagttatgttgtggatgaattaatatggatatattaacaattatctttctctttcacc

SEQ ID NO: 2649 - DNA, 3000 bp, Unknown
  misc_feature (1)..( 3000): cDNA_ID_3069010_gDNA_ID_1620571_Annot_ID_160852 3000 nt of promoter + ATG
caacgacatcaaaagcggtatttggattgcaggtacgaaaattttcttatacatcatcatcttcagaaactttgtcagctgcaggaagaaactgtaacgtggcttatctcatttttcagatttacagcttttgcgttgccctctttgtgacctcagtacctgtgatggtaaaagacactatctgttgctgagactttaggattcatgctagtctattagtctctgcaataactaaattgcaactaagagtgtttctgttttactaatgtaggaacaatgcaaactcttgatgttaggcacattgaactcttccttagtgaaggctacaaagatggaagctgggattataatctgattggatctcataagttggagaaagacgcaagtgcagcctgtggagccatatttgacctcaaacaccttaaaaaatcttcatcctcaggtaacttcattacttacttttatgttcctttactcctctttgaatcatactcctttgtctctcatacatttccacatgaaatctgtctaggtattctcaacctcaagtcttggaccggagaggcagatgattcccaacctaaagcagttattgcaccccatgcagttgctgttcacacaagattgcaacaaaacgaaggtatataactttacatcatcaaccatatctttatctagaaaaaaggaagagaaaacactttttttttgttcttacatatttgaattgcaggaatccttgtgaagtaccacacaatgaaagcaggaacagacggtgacattgtttccatcagaatctcccagcagcttctctgattctttcacagtgcattgtctcatagtcagtatttctggtatacaaatccttctcctcttcagtaaaataaagataaacataagctttactgttctatgactttttccattgtctataagtatgtaaattccaattcccttagtgccttaccacaatatgactttctcaaaacaattccctcttcttctctatttcttcttcttcttctactttcctctcctaaatgcctcaaaaccaaaacgttgctacagttcttcatgtggaggaaacaaccttgacgttagcttccctttctggctatctcctgagcaatcttcgtcatgtgactacccaggattcaacctccattgtgagacagccttaaagcttccaaattccagacgatttctcgtccaagacataaagtcgcagcgtattcaccttagagaccccgataactgcttagccagacggcttctcagcttcgacgcttcaatgtctcctttttctcctcttcaccttgtcaactacactttcttgagctgtcataacgaaaacgtcaaatcctcttctttggaacccatccattgccttactaattccacaccttcagatctcaccggttcaatgccgtcctcttgtcaaaccttgaagacactacttcttccggtctcttcaccactcgcaggtgatctcaacaaacaagacctctggctgaaatgggactcaccggattgcacaggttgtgttgattttagtccgttatgtagcttcataaacaataccatcctcaaagtcaaatgcttcacatacgttgattctggtaaccctctcgtcctataagttctcacatatacaccccaacttgaaatcaaaatcttggcttcatcaagaacatatcaaagaacaatttttcttaaaaatgttagacttttttctatctttcaggaaacccttggttaataacgttaaagatattatgcttatgcctatccgtaccattcttcatagtgataactcctgccgtctgtatcatttttatcccaatccaacaacaagccaagagtgtcccttggcgaaatgacactctctgtcccatttgtttatcagaatacacaagtgaagagaccgttaagtgcttacccgaatgtgaacattgcttccacaccgaatgcatcgacccgtggctcaagttgcataactcttgtccggtttgtcggaattcgccttcatctttgccaaataaagctgccacgacgaacgttgtctagatttgattcgagccactattgattgtttatcgtaatttcaatgttgcgcattacgcaatttcagacgaacatttcccaagctttactaataaatggatagatgtgaatttgtctccgatattagctagtagtcgtctcagtccaacctttgaagttcgtgaaacacacgcacgcgtttctaagcgagtgagcgtagtacattgtatagctttagtcttaaacgttattggacttcaaacattattgggcttctaacaaaattcgctagaccacgacaacattttcataaactttggttagaaaatcgtacataaaatatgggagtcgaatttaacatcatcaaaatgattctgttataacgactactaacttacgggttcaattgcaccaataatttaatgacggagtattttagaaccataaataactaatgagatattgtttttccctgtaccaataactagattctgacccgtacatacgtgcgggatttcttattttaggaaatatattggaatacattttgagtgaaagatattgtaatatataaactagattttaacccgcggtataccgcgagacgatttatttttttaaagtaatatatattaaaatttgcaaattttatttttaaaaaatatttatattttaaagtttataattgttattaaaaaaaaaaagaaactactgtgtgtaaaaaaccttttctctctcttccttctgggcgattctacagcgatcctccaccgacttccaccgcctcaattttctggtgatctctttgtcgtcctagtgcggatcttactctccggtgtctctgccggtccgttcgtgttgttctctttgactgttgttgtcttctctgaatccatggataaagaattatggcaagcgcttcaaaatttagatctaggatctgagagagctcctctgaag

SEQ ID NO: 2650 - DNA, 3000 bp, Unknown
  misc_feature (1)..( 3000): cDNA_ID_2167449_gDNA_ID_1620571_Annot_ID_160849 3000 nt of promoter + ATG
acaaagagggcaacgcaaaagctgtaaatctgaaaaatgagataagccacgttacagtttcttcctgcagctgacaaagtttctgaagatgatgatgtataagaaaattttcgtacctgcaatccaaataccgcttttgatgtcgttgataagacatgaaccactggattgtaacatttgttctatagttccttctgttgggactttcagacgaccactcaaactctcagtcaggaatgaagttcgagagtcaagaacaaaggcaccaagacgcatccaatctataatcacagtgtcaaaaccatataaagatctgtacaacatctatatttaacatgagactaagagagtatgatgaatccaattcatggactaaccaatatgcttctccttctggtggaacaagtaagagtgactcccatctgcatttttccatatcgtgttttgagtttaccattgtttcagaatgtatcataagtcatgtgaaacttaccaaaagctgaagcataaatcttaatccaggtggaagaaactggaaacgtctcagggacctgaagatcacgcaagcatgcaaacctccaaacagtatcctccattgcaatcttatagaaccatttgttcgttgctcccagcttcaccaatgatttaccatccaaaaaccttgttatgtatgtccatatatcttgctcatacctgatttgtcagagaaaattagatctaagaaatctgattcgaaattgaattttcaaaactcaaatcccaggtttcagcaaccacacaggtcacgaacagggatcgatataagcatctaattctcatacaaatcaaattgattccagaaggtatcaaagatgattgatcgaactctatttcctagatccatccaatacatgccgtacaaatcaaattcgagctcagcccaaactcgcacaccaaaaatatctgagaacagatctatgtagttcatagaggagaagaaaataccaggagaagcgagactggtaagtcggagcagagcaccgaggagatacacagccatggattcctctcaggatcttcccgttcttctggtcgctgctctgaatgattcttctctttgctccaccatcttcgtctctctgaatatcgttgctctgtaccaattttctcttctgtccaccatttccgtctctcaccggagctatcatcttccctctaatatctccttcggcatcaccagatctcgtattcattctctctctctctctatctcttctcactcagtatctcactagttgctaatttgttaagtgaaaaattgtttgagaatttggtttttgctctcaatcgtgtagctgtgatatatacctgcgagggagacacagcgaatttgaaaatttcaaatgttgaaaatgacgtatatacccctgtaacaaactttctgactgtatattttaaattttgaacccggtttagccgagagggtcccaagtaatatatacccagtgagtctggtttaccttgttaatgaaaaatcaagattggtgaaaatatgatggtgaaaatatgcgatataagtaaaaaaaaatattaaaggaagagttgtaatgagtagacgcaatttttaatttcttaacagttataaatagaattacgtagatatattaaacaaaacattatgataaacaaatgtaacatttttaattgttttaatgggaatgtatatttaaatagagattatcttattctctaaacgaattttgtcaattttttatatttgtccaatttgggacatgtaaattttattatttaataatatttattaatttatagaggttttattatattttgttaagtatttagtaggggtaaacaaacaaaccggaatagagaaccaaatagaagaaaaaaactgaattgaatccaaaattaattaaatatttgaatggatcctaaatatccaaagaaccaaataaatatttaaaatataattatatacccaaattattaattacatttagatcttaaataacctaattacccaaaattttgaataatctaaaaatatcaattatttatatcaaaataagaaatactcaaaatatttaaaatattcctaagtttttagttattttagtcaaaatttaaccaaatttattaaaaataactaaaaccaaaccaagtctgaattaaactgtaaaataaccgaattaatcctaaatgtttctatccaaaatattcggagtcgaaccaacaccgaatcaaatacggaataccccaagtccccaaagtctagatctcggatctgattggttcggactttggctttagattttagaccgtaaatgttttagctgtgattgtagttgtagaatttaaaattttggaaagctttaaataattaaattgtgtgttttagacagaaaaaactgctttttacagccaaaataataataattaagaaagtatgttggttgtggccttgtgggtaacaaattgattgattggatatatttcaaagctttagatttttttttgctttgtaaagactcttgtcaatcaggccctagtatttttttctctttttttttaataactaaggaaaggattaagcattggtaaacccaaacgtttgtctttgtaaagaaaaaaaaaaaaaaggagcatctctttctcttcttcttgttcgtggtgaagtggtgatgcttggaacttcctgttagacgacgaatcctgctttcacatccatcgtctgctttcattttcaaaggttttttcgttcttgactcacagaatcaatgtagagttatcaattgaacctaattgccccctttccgttttagctatagattcattaagcacatctgctcatagatttttctacatgggtaatcaaatttaggctatttagaatcaactgtatcggaaaaattacatttttgttcatttcttttcatatatagtgtgtgcttaagaaagttcataacgttgtttgatttgcaggcgaataaagtctttatg

SEQ ID NO: 2651 - DNA, 3000 bp, Unknown
  misc_feature (1)..( 3000): cDNA_ID_3069021_gDNA_ID_1620571_Annot_ID_160845 3000 nt of promoter + ATG
gcaatgcctgagggatgatgttcttgcagctggcattcggcagctcttgaaacagcttggaaagacgttgaagaagaaggaaaaagagactgtgaaggaaatactatcaaatgcacaggttgtttttgccactaacattggagcagctgatcctttgattaggaggttagaaacatttgatttggttgttatagatgaagctggtcagtctatcgagccttcatgctggatcccaatattgcaagggaaacgttgtattctttccggtgatccatgccaattagcaccagttgttctatcacgtaaagctttagaaggtggacttggtgtatccttactggaaagagctgcatctttacatgatggagttcttgcgacaaaattaacaactcagtatcgtatgaacgatgtaatcgctggttgggcatcaaaggagatgtatggtggatggttgaaatctgctccaagtgtggcctctcatctgcttatcgattctccttttgtgaaggtacttcttctgactgtttctgctgtttgattggtgtggtatttatatgatggttacatggcatgcaatcacacatctgtttaccttcaaagcttttatttgttagaaattttccattttagcattatctggtttctcttgcaactctgttggtttgtctttcatgatactatctttacttgtggttgaaatatctactgattacagcttttttatggccttattgaaaagtgatgttgctcatgagcttgcaatagatgtttccctcttgttttgctggtaactggataatattaaacagtgtcacaaattaacttacctttgaatgtctaataaaatgcaacatcattgtagatcaaaagcacctttggtaacaccatgactcttagatgtaacatcattcttttcttgtacttactgcaggctacttggataacgcaatgcccactggttctgcttgacacaagaatgccatatgggagtttatccgtgggctgcgaggagcgtttggatccagctggcacaggctcattatacaatgaaggagaagcagatattgtggttaatcacgtcatttctttgatatacgcaggtgaaccatctattttcagttgaatgactgggatataacacaaaacaattaccagagcttgaagaatctaaacttcatgcatattaattgtgttcctgaatataagctcgataacctagtaaaaaacttgttggacatgattgtaggtgttagtccaatggctattgctgttcaatccccatatgttgctcaggttcaacttctcagagaaaggctggatgattttccagtggctgatggagttgaggtcgcaaccattgacagctttcaagggcgggaggctgatgcagtgatcatctcaatggtaaacattactctgcttcttttccattctgtggcatgaagatatttcataattaaaattctagcagatagtaaagaaacggagataacattaagaatctatttagatatgttagttgaacttgattgtgaaaaccaaaaccgattaacaaaattgtcgttatgaactcgtagcgcaaataagactcatgtacttgttgtgctgtgaacccattacaggtacggtcaaacaacctaggtgcagtgggattcctaggggatagcagacggatgaatgtagccattacaagagcccggaagcacgtggcagtggtatgtgacagctccacaatctgccacaacacgttcctagcaagactgttgcgccacatacgctatttcgggagagttaagcatgcagaccctggtagcttgggagggtcaggactaggcttggacccaatgttgccctaccttggttaaaaccgttgtaagtactacaaaaaccagaaccttctgcttactctctccctctctctctatctctcccgctgaaagaaacagtttccatagcaaattgtcgttgtacagaacaattgttaccacagaaaatagtctctgtatatgatgacaatatataattcatgtatatttttacaattaattcatgttaccacagacttcttccataaaattactacaccaccacttacaccgactaaaagccaattcacaaaccaaattgggaaaggatcttacgaccaaatttttttgggaaaagttgttctccgatattaacacggttttcttctagattattaaatcgacgcaactatcggcaaattatgggctcctgatgggccttctcctttctttggttcaacttggttctagacacttatgtgtttcaatctaagctaatttcgtttatgttcattgggtataaagcccaacctctaaagttagctttttttgtaagcacttttgttagagaaaacaagtttgaccaaacaaagaaaaaacaagtaagaacaaaacgatttgctagttgaacttaggaactcaattcggggtcctataaaatgacgtcgaagaaattaaagtccacgttttttttttattaacatatgtatatgatgtttataattagagtaaagtttcctatagcttactctaagtgtatataaggaacatgtatgattcatttgatcattaagaataatatacggaaaattcactttatctctctatagttaatatggtagcagagcacaaaagacattttctctcactataacagaaatctcagagtttcttcttccgccaaaactcatcttcttcttcgatttcatccaatttctatggaatcaccatcgttatcaccctaaatcttccatttcttttctttactgagctccgattcatcaatagaggtctcaaaatcaccaatcgcaatcacattcgcgattttcactaacagttgaagctcaagctcgaatctccttcatctttcagatcgattcgttctacatcacgatcgattcaactctaatcgtttttcggttcgtcgttctaatcaatttcagtatcatctctcgattcttgatttgtttcaatg

SEQ ID NO: 2652 - DNA, 3000 bp, Unknown
  misc_feature (1)..( 3000): cDNA_ID_2990875_gDNA_ID_1620571_Annot_ID_160848 3000 nt of promoter + ATG
taattaccattacattaagagattttattgtctataggcttatgtataattaataaaaagagtataagaaaaagtggtaaacaaatacatcacatacaaagacagcaagcatactattactattatttaattatatatttgtatactgttattaattctaagttatctttcataaaataattttattataacttattttaagtaatttaatatttaaatcactacgatgtcaccaaatgaattattttaatttctttgtcactaatgctattttaattttctggtcaattatttttaagcccatttttacctttttaaccttctcactaattttgccactaaaagtttattattggctaatgtaacccattgaatatatattcttttgacaaaaaatattttaggtagtatggttttaaaatatgacttttagaagattataaatgttaaattctatttatttaactcttaaaaatcaattcattttctttagtgaaaaataaaggcatctttgaaatcaaaatcccaacattattactttaagaggggtattcaataattgattttaacagaatgaaatggaacgagaaaagttttattataatgattatttctctcccaatttgtgaattagaaaacttttgttttctatttaatataaattataaatattaaaaactccacaaatcctaaactcattgaactaaaaaaagccccaaatcctaactagatcagccaggtgaaatctactacatgccatggagcacatcatatacaagcttttgtcccaaaggagacatatattggcagaatctagagagtactttcaattcctaatcttttgaaaattttgccattctttcggcaagtttgtaatccgtgttgtacacctcgaactcaactcgtatatgaccttgaggttcctcggtctccatatcacccctctatggagtgcctattgttgtagtcgtccttctttatgaagagaacaatatgttttctaccctccttagtccttatccaccttggtctccggttttccaaccgagaaccccccctcattactcctaacctgttttattatctttcgcgtaagaagtaatgtatctcacatgccagtgaaaattgaggtttcgactcatcatcttctcgtttgtggcaatgtatctaatcgctagtgtttttgtcatgaggaatttgatattatttgtgttttaaaggtctttttgtgcctcattacccatgaatatgtattatcatggaaaatatcaatgacgaaagaacttggatcttcttcccattttaattgtgcacatactctaaaattttcatttgatatataatataacattgatattttctcatttatctgtattaagtcttgaagttaatctcttatggatatagagatgctacatcattacgcgattactaggtttctgtattattaaatagaggttgtctgttgtcttttccactatatagtttaacaaattggtgaattgaagcgtccaacatgttcacaaaaaccattggaggcctagtttgcttagcatttgtataagagggactttttaattggttagttatcatcactagactaaattagacggttggatcaaaggttgagtaattgacattacgattgtacctatttttgatgcattagtattatgttgcatcaccgatattatatttctagttgttggagttctatctagtgactacatcaaattgatgtacactcaatatctatctagtaccaccgtgcatatgtccctaatgatagagaagcgttcaaagttgtcagggaaacattttcactcttatagaagtctaactagttttaagtcgtgctagtctttcttccttatatttcatataaataggtcagtggtgcttgtcgttaaatatacaacattgtctgaaaatatattacctcctacatggacatttctagtatctcctacacaagtataatctcatatagttacaacacaactatttgagcaaatgtttactattttggattcatatagttcttaaaaccaacatgcataatattctttattaataaataaccttcaaataacacaactttaatttacagtcaattagaagtgttgatgattgatttttagagattagacattcaggtatcaaattcaaacacctctctaactgatccaaatgatcaaatttaagctaaaattgtagctactgatcagaaaaatagaagcaacatttgttgaatagaaaaaaatagaagcaacatctgttttaaaaaacacattgcttcaaaataataggaaagtacaaaatattagatttaactaaagatattttaaattaattaaaaaagatatttggattatatgataataaatccaataaaaaataataaaatccagaatacagaaaaaaattgcaagaggggaagcagaagaagaaagaacaaaaatcaggagttggcattttgaagacgaaactcatcatcatcttcttcctcagacaacaaaaaaagcttttcactttctctccacccttctctctctccttctgaaagtctctctctttgccgtcgttagcctcttcctacacttggggctgcgattcttccaatcctccgatttcaatttcatcctctcaatcatagtttgaaatcatcgagcttttacggtgctgttggtgtttgacgccgtaaaattcgatccttttttatacatttgatgttgattttatcgatagttttgtgagatcgattttttagggtttcgagtttggcgctgacttgagggtttgattggatgagaataaggggttatgggacttgagtcaattgggtttgtctccctaatcatcgcaaattcctgatttctcagctctttggaaggaattaggattcgttgatttcgagttttgtgttgtgttggttgatgagagagttgggtttggtcaattgaggggtttaggtgttgttttactgttttgattctgatc

SEQ ID NO: 2653 - DNA, 3000 bp, Unknown
  misc_feature (1)..( 3000): cDNA_ID_2167443_gDNA_ID_1620571_Annot_ID_160846 3000 nt of promoter + ATG
gattttgatttcaaagatgcctttatttttcactaaagaaaatgaattgatttttaagagttaaataaatagaatttaacatttataatcttctaaaagtcatattttaaaaccatactacctaaaatattttttgtcaaaagaatatatattcaatgggttacattagccaataataaacttttagtggcaaaattagtgagaaggttaaaaaggtaaaaatgggcttaaaaataattgaccagaaaattaaaatagcattagtgacaaagaaattaaaataattcatttggtgacatcgtagtgatttaaatattaaattacttaaaataagttataataaaattattttatgaaagataacttagaattaataacagtatacaaatatataattaaataatagtaatagtatgcttgctgtctttgtatgtgatgtatttgtttaccactttttcttatactctttttattaattatacataagcctatagacaataaaatctcttaatgtaatggtaattatgaaaacgtattctctaaaattacagaggtcaacctcttataataataaccgttgaagataaattttaatgttggagatttgactagtatatatgttgtatctgtaaatataggtttagatggacatatgagttgattttttttttatctttaatttgggtctaattgtatagtttatactttaatgttggttatatgtttttttcatccaaaattaattagagattaaaagagtctctctatttgttgatgtacatgcaatatcatcatgttctagagaatttatcattttgttttcataattcatttacatagcaacgatatttcgaataatatcatgagagatatccctggctctaatcactatattttatatttctgtttaaatatttttttaaaaataggataaaacaaaaacataaaatttaaaagttttattggtaataatgaaaacatatggttcttttgggtttaactagaaaaatggtcaaatttaagagatccttttgtaattaaaaagtttatttcgatatataaagatatatataatattctttcaaatatgaaaccaagcattttagggtgttctaaagtttgattattttctaataaaatagtttgatgattttgatccacaacatccttttctcgcataatttttatgacgataaacaaactcaattttgaccatttgcttattttgcttgacaatttatgatgagaaacttctttctccacatattatttgtaagaattttattttttgacccaaaaaagaaatttctttagtgatggaaaaatgaacaagtaggatcttttcttcgggagacgcttagttgtctttctcaagtgatcttctctgccacatgttgcttcacccattattctacataggaccaataatctttggaaaaacagtttttcaaaaactataataatattccgtgggttacacacacccctatatttaatttgtagtactaaaacgaagacaagcttttcagtaaacaactactttctattaagtaacgattgtaagattataactcaaacatgattcagttgtttttgttttaccaattatattaaatttaaacatacctctttgcacgaagtgaatttattatctgaaatccaactttcgccgcaagtgaaagcatcagacattaatcgccgagctataaaatagctattttattgtttcacaagagtcttcgatcaaccaaaaacaaaaaaatgagtattcaaagtcgctaagaaatcgccaactcactatagatttactattagaagtttaatatgaagccaaatatagtcttatgagtaatccgaaagccatgtaatgttctatgtaactagggttagcaagataataacttatatatatagttatgcatgtaatgagaattttgattgtaacttcgagacatatatatatagttatgtaatgagaactttgattgtaactttgagagttatctcaaaacaactctctttctctttattaaagtatcaatggaattattgtgtttttggtgacaacaaagtaatctttcctttttaagtttatttgaataataaactcttaatgaactatctaatttccggtttatatttctcttaataaattcatttgagcataaacattattgctttagaaatatcatcatctacctcgtctcatcatatgatcggagaagaaaagcgtttatcttcgtccaccaacccaactatcgacaatgaaaagactttaatgcaaaaacggcgaaaactaaactcatagatctgtttttttagaggagatagaagatagagaatgatggaacgattgttttttttaaactaaatttttgtgagattttaaataaaaataatcttaattagttcaaaattaaggtcgaaaaaatttcgtgtagtatttcaaatgtgctatatgaatgatgtagcttgtaaaatccacagatcagttggatgcattctaccgatccattcgatcaattctaaaatccaacttaaagggtctccaaagaagaatctaaaaatacaggggtataagtcaacaaacaaaaatataaggataggacagtaattaaacacgtcacctgcccacaaagaatcaatactagccaatcacaactctccactacgatctctcatcacgactctctctgtgctatgtttgtgacataaagtctcaaaaacaaaattcgtttcaccaaaaaatgaaacaaaaataaaaatatttctgagaacctcaagtttaattttgcggcttagatttaaattcgtctctcaaactcaaatatctgaaaaaacctttctccaatatataaataagttacacgagactttcaatttctctgtatattttccttttgattcccagaaaatgtcactagattccactttctagcttgcgttttctcgggaatctgaagtttccttttgtgttgaatcgctgggaaaaatctgatg

SEQ ID NO: 2654 - DNA, 3000 bp, Unknown
  misc_feature (1)..( 3000): cDNA_ID_2167783_gDNA_ID_1620572_Annot_ID_160864 3000 nt of promoter + ATG
cttgtaatcacacagagacataccacatatgtctccataattttcctcacggtcatcttccttacaagatatctaagcatcaaaaaaatgttttcattgtgcttaatgtttttaaccttctcatgatctctctgtggcttctcatgattttaccctgaagattgtacaccgttggcgttttcttgcgatatcttccccggttttcttaattaggggagagaccgaaagaacttgtgtctccgacttcttaaccgattacacgaacgtaggttcggtttacctttggcgacatagtttttatttcattattttggtgttttgttcttctagggaagaagagatgatgaaaagaagaagaagttatattaaaaagaaaaagaaaaatttatcatattagcaaaggaaacgtagatttatagagatattagggaagttaggattctaggaagatttcataatcgtggagaaaaaagtaaatggatattctgtttccaaaagaatattagactacaaaagttattaaagatggcaattaaaaaaaatgaagtgatgtaaaatcataaaagaaatgattcttattaaattaacttaagaatcgataaaaaaaaattatgtagttaataaattatttattggcatcacttttttattgatgtaaaatatatatcattttttaagtgatgttaattaaattaataaacatatcagttatttaagtgatgtaaatttatatatttatatcaatatgtaaaagtgatacaaactaacttagatttgcatcagttttaattaattgatgcgacacaaattaataacagcatcagctattgtaactgatgttacattttaatatttgcatcaattattaataagtaatttaaaataatatcatttagttttgtgattcaatataaatgattcaattcgactttttttttgtagtgacaattgaccctgtacaaaactatgaaataatttaattgacatgcatgccaagttctgcttgtttttttttcgcatagttatgatatatatgggtacgtaatatttttgtttaactgttggttcggtattctgcaaagtttggaatatatgtttattggcctataaataaagtacgtaagacgttacaacctaaaaagaaaaaaaaaacgacaaaacctattataaagatgaacaaaacctaatataaaggatagtgtaaatctgcaaacttagctaacagaattcttatagcgaagtcagaaatagtacttctccaatacaatgaatttataaccccaagaatttacaacgcagtatatatgcatgcaccatgctctataagtctatatatgacggcaatttattaatgtatttttttttggtgagcaggcaatttattaatgtatgttaaccgtatctcggaatctggagcaaaactatatacttattggatatagtatatgacacatatagtaaatgatgtcaaaatagcgagttgtgttgtgaaaggctgcatgtaaggctgataggtacgcacatgaccaagcatagggaattgctctcaggttttaatgtcgcaagaagacgaattcaattccattcatgtgctttactgggaatgataactgataactcatgaagttgtacattttatatagaaaaatggaatatctaaaatgttttatgttgcgaatctccttcaaatcgagagttgcaattattatttttcactcttttgtctctctttttttttttttttttttaagaaacaacgacaatgaactacataaggaacacatcctttaataagaataagcataactctaaaatgtccagtgattagtgaataaggatcgcgggtcacatacataacggatacacaagatcaagctcgacaactaaacaatttctcatttggattaatcatgatcactcgtctctatttattgttgtgcgctgtggctttaaaattttaataatagatctaatacataaaaaatatagtgtcctctataaatcctgagtttcacaaaattttaatttattaaaactgtatgagtgtgtttaaggggtctgcggaatcaccagtcacccattaatcatcaaatattcgctttgaattcaagtttattttacagtttactggcatctacagaagaaccgatcactcttgaatcatcaaaatatttgctttaaatttgagtctatattagcaataaataatttactgctagtattgaaaaagctaaggggtaaaagaagtatgtgcaaaacaatctgaaacttcctaactaataaaaaatcttgaagacgtgctatttttggaccatttccaattttcatctctatattttttttattttaaaggtattgtactctaatggtcacctctaaaatagagttttctcaaaactaaaggaaaaaatagagatgaattgtagaaatctctatttatagagataaaaagtaaatatctctatttttttctatatttgagaaaattttatttttgactattgaagtacgatacctctaaaatagagttacttttataaatagaagaaaatatagaaattattattggagatgcctaaaaaattatatgagacaaagtaaagtggagacaaaaaatataacgtttgatggtgctagagtctcttaaaatatattacttaaaaaaatccaagacttcatattaatagtttaagggtgttgatatatgggtattatctctcataccaaaaaaaaatcgatatatgtcctctccctctctctctcaccctatctataaatagcagccggctaccacatttgatcgacgagatgtgaatgaagcattcaacaaaaacatcacataaaataaacaaaggaatccacaaaaagaaaaaagcaaaaaaaaaagtttcctcttagagaaaaagagagagagagagtaacaaactcttgtcgtttcgttaaggtcaaggtgtcgttttgttctctctttctgtctctttaaacacacacaagaaaatg

SEQ ID NO: 2655 - DNA, 3000 bp, Unknown
  misc_feature (1)..( 3000): cDNA_ID_2167832_gDNA_ID_1620572_Annot_ID_160878 3000 nt of promoter + ATG
tatactaatggattgtggctattacttaagtgacattttttatagatgcactcaaaaagttatagattattctattgtaatcactttggtgataaatgaaattagttactaatttagtattattttaataaaatatttatttgtatactaaactacaacaatagatatatttttatttggtggaatccttggttctcttggtaattatcttggattccaaagtccaacacttaccggtttaatttgactatgttttaaccttttactgataagttgctcttggcaatcacaaaatgggctttgcctttggtcgttttggcaaagatattccttctggctcaaatcaaatatagaataacaaaagacttatctgtcttttgtgctcgtatggtttgacataaaaaaattttgttttaaggaaagctttttgttccattgttgaattcgagagatataaaagatttttgttccattgttgagaagtggagattgatttctagattgtgggaaggttgcggttcttctcgaaaaggcaaaaactttctcttgtaaaatcgttttttattttaattttgtttaaaattaaaaattttaaaaatctagaagataaaaatttgggacttaaaccacgcattcgatggaatgggtttcaatttttgtagaattaacttgtaatttattagataaaatgctacaaatcaaaagttttgaaattcagtacgtcagattagatgtatcgtggtgagaaataatacatgaaatacttaactaaaacaagcttaacaagaaaacttcatgatgtgaaatacaatggtcaaaacttcataacatttttagtcatgcctttataaacttttgtattgttttgtttgatgttggcacacaattgtgggagaatctcaagaagaaataattcgttactttactaggaaataaacaaatagagtggtcttctttatactactagctagtttaaatctaagtaaacgtttttgatagagttctgagtcattccaatcatttttttgccatttgtaaatattataagggaaatttgcaagtataacctaaaaaaatttaataatttggaaactaacacttcaaaaaccataaggtgatattgtgtatattatatgtaataaatacaattatatcctcttcttcttctttcttctgcatgaacatcttctctcttctttcttcttttcttccacaaccaccacaaccaccactacttttaaagccattatcgccggaaaatcgtatccgaagccaccatcgccggaaaatcgtcaccggagtcatcatcaccggaaaatcgtcaccgaagctatcatcaccattgtactattctattttgctgctagatttttgaaaattgaaacttgagatgatttcatttcgtttaatgatttttgtttgggttccatgtatagtatcttagggtttagttttcttaaatcaatatatatttgtaattatcttttcgtcaccggcaccgccattgtagtcaccatcgccactgacaccgccattgttgccgtcaccatcaccaccggtaccgccactgttgtcgtcaccatcgccaccggcaccgccactgttgtcttactatcgccatcggcaccgtcgctgttatcatcactattaccatcggcaccgccactgttgtcgtcaccatcaccatcggtactgtcattgttactattaccatcatcgccatcttcgccaccatcacgctagccaacacttttctcttttatttatgtccataaaccgaaaagagtgtcaaggatcacgtcactcttcttctcttttcacgcgcgtgttctcatgttttaatgaggagttacttaacttttcatccctctctagtgttatttacttagttttatatattaaaatgctatattcttaaataaattatcaaacatggtcatttctgcaaatcaccaatgttataatgacaacaaacaatttagttttgtaaataataatgtgtatgacgtggcagttgtgagtcattgattatcgagaagcctcttctctagtcagagggtccaacgtgaaaaataaatgttccccttaaattaaattaaatgcgaaagacggatctttcaattgaagattctttctttgaattcgagattgaacccgacccggatccgaatccgaatccaaatccaacgccagctctcaacccacatcggtgcttcaattcgcaattgccgtcatcaatctctgttgttttaccggaagaaacatctaaacaatcattcgaaaaattcgaactttttattcccctcgatatacgatttgattttgtatgattttgatccctggatcagagatttcgtcagagtttgtggaatttggtttaatcgacgagaagcaataatggaaattgggttttctcgagagtgaaggatgatccagagaagaagactggaactttccaaaggattgatttaaacaatcatgtggctttccttcttaagacccagagatcgattctccttagccgaactcaggtttctttgatcgcctttggttttacaacaagtttcagtttttttttccgatttatctctcttttggttcatttgaattgtggctgagattatcctttgattgtgggggaaaaatgtttcttttaagggtgtttgttgaattggtagtttgcaagtagtttgctagggttgatgatttgagtggtgccattgtagggaaactatataagttcatcttccctagtctcaggggtcaaagggactatgttgaccattgtaggagaatgatttgttctcagaaagttcattgtgatcgtagtgttacgacattagttgttataccagatgatgatgaaacatagtaagtgttgaaagttttggtttttatataggtatttgactgaccagctgagaaagattcagatagtaaacgaggctaataaggttagtggacattgtcttggcattgttgttttgttaggctttgatg

SEQ ID NO: 2656 - DNA, 3000 bp, Unknown
  misc_feature (1)..( 3000): cDNA_ID_3069038_gDNA_ID_1620572_Annot_ID_160882 3000 nt of promoter + ATG
cactgattgttaacctttgagtttgaatggtatggttctatgtatgtgtaggatgatatagtaagtaatgtggaggcaaaacttgctgcgtggacctttcttcccgaaggtatttttggccatatgtacatagatttcctaattctgtctctttgtttagactttagttgcttacaacttctcatctcttttttgtctgtgttgcggatcagagaatggtgaatccatgcaaatattgcattatgagaatggtcaaaagtatgaaccgcattttgactactttcacgaccaggctaatctagagctcggtggtcatcggattgccacagtattgatgtacttgtccaatgttgaaaagggaggagaaacagtgtttcccatgtggaaggtaaagacatatattacttctggttccttaaattttcatctaatatttcgatttcgtttcctgagtagcctcatttcagtttgatcacacattcttgtagggtaaagcaactcagttgaaagacgatagctggaccgaatgtgcaaaacaaggctatgcaggtaagatcactgtatatagcttgcttgatatagaatactgtatcctgaacatgcgtttggcttaattgtgaaagctcaacacaaatggggattgtagtagtttgattaaatgataatgaaaggtataactatttttccaaatggtatattgctctatctgatttatgtatctttgcagtgaaaccgaggaaaggggatgcattactgttcttcaatcttcacccaaatgcaaccacagattcaaatagcttacatggaagctgtccagtggttgagggagagaaatggtcagcaaccagatggattcacgttaagtcattcgaaagagcgtttaataagcaatctggatgtatggacgagaatgtgagctgcgaaaaatgggcaaaggcaggggaatgccagaagaatccaacatacatggttggttcagacaaagaccatggatattgcagaaagagttgcaaagcttgctcatcttaagaacaacaagtaaaatcaaagctcttattaaaggatcaaaatttttgtatagcgaaaaaccgggttttcgccattcgggtagataaacatatcgtcaatagaatgaaaaatttagaactatatactaaaaaaataattctgattctatgttactggtttcatgtgcaagttatgttccttatggttcataactagaccaaaacttaataaaagtcggtttatgttatcatcaacctgaagcaagcgatacatgataactgaattaagtattatacaatcagtagtagtgtacatgagatgatagttgccaaaactacgtcatgcacttcgagactctatatttctaatgaagtgtaacaatcatgcaattaccgttaattaggagccttcaagcatgagatcctcaccttctctctctttctctctcagagcttttgcattgcatcactctatttccataaagcctttgttgttgtcctttcagacatttctcagcttcttcttcttcttcatcttctctcttgtgtttgaataccaaaaaatgggaagacctccttgttgtgacaagtccaatgtcaagaaaggtctctggaccgaggaagaagacgctaagatccttgcttatgttgctatccatggtgtaggaaactggagcttgatccccaaaaaagcaggtttttccaaaaaaaaactctctcatttctcttaactcttaagaaatctcatttcaaacaagtctgagttatttttcgttcttcggcgcaggtctgaatcgatgtggaaagagctgtagactaagatggactaattacttaagacctgaccttaaacatgacagcttctctacccaagaagaagagcttatcattgagtgtcatagagccattggcagcaggtaatgaagcaacctaattgctaactaactttttaacaatgacaagaatctatcaaactttttatctcattagtaataattgtaacctctgatgttttcaggtggtcttccattgcacgaaagcttccaggaagaacggataatgatgtgaagaatcactggaacacaaagctgaagaagaagctgatgaaaatggggatagacccggtgactcataaaccggtttctcaactccttgcagaattcagaaacattagcggccatggaaatgcatccttcaaaacagaaccatctaacaactctatactcacacaatccaactcagcttgggaaatgatgagaaacacaacaacaaaccatgagagttattacaccaactctccaatgatgtttacaaattcctctgagtaccaaactactccatttcatttctatagccatccaaatcatctgctcaatggaaccacatcttcatgctcttcctcatcatcttctactagtatcactcagccaaaccaagtacctcaaacaccggttactaacttctactggagcgatttccttctctcggacccggttcctcaagtagtgggatcctcagctactagcgacctcacttttacgcagaacgaacatcatttcaacatcgaagccgaatacatctctcaaaacatcgattcaaaggcctcgggaacatgtcattccgcgagttccttcgttgacgaaatactagataaagaccaagagatgttgtcacagtttcctcaactcttgaatgatttcgattattagatcccttcttttccctattgttgttacttctcttgtaactggtttatgattttcaagaactatgttttttcaataagttatatctcttctcttattagtacttacttagtacttaagtagtaaccaagtctcttgaaatacaaagctcaaaattaaacaccttttgatacagaaatagatcctctggctctggaagaaggttttaactctatttctatcattcgtcttctctgcagacgatttctctctgcaagctcccaaagtcgaaaactttatcagcaatg

SEQ ID NO: 2657 - DNA, 3000 bp, Unknown
  misc_feature (1)..( 3000): cDNA_ID_3069042_gDNA_ID_1620572_Annot_ID_160881 3000 nt of promoter + ATG
cggtgatgatgactccggtgacgattttccggcgatggtggcttcggatacgattttccggcgataatggctttaaaagtagtggtggttgtggtggttgtggaagaaaagaagaaagaagagagaagatgttcatgcagaagaaagaagaagaagaggatataattgtatttattacatataatatacacaatatcaccttatggtttttgaagtgttagtttccaaattattaaatttttttaggttatacttgcaaatttcccttataatatttacaaatggcaaaaaaatgattggaatgactcagaactctatcaaaaacgtttacttagatttaaactagctagtagtataaagaagaccactctatttgtttatttcctagtaaagtaacgaattatttcttcttgagattctcccacaattgtgtgccaacatcaaacaaaacaatacaaaagtttataaaggcatgactaaaaatgttatgaagttttgaccattgtatttcacatcatgaagttttcttgttaagcttgttttagttaagtatttcatgtattatttctcaccacgatacatctaatctgacgtactgaatttcaaaacttttgatttgtagcattttatctaataaattacaagttaattctacaaaaattgaaacccattccatcgaatgcgtggtttaagtcccaaatttttatcttctagatttttaaaatttttaattttaaacaaaattaaaataaaaaacgattttacaagagaaagtttttgccttttcgagaagaaccgcaaccttcccacaatctagaaatcaatctccacttctcaacaatggaacaaaaatcttttatatctctcgaattcaacaatggaacaaaaagctttccttaaaacaaaatttttttatgtcaaaccatacgagcacaaaagacagataagtcttttgttattctatatttgatttgagccagaaggaatatctttgccaaaacgaccaaaggcaaagcccattttgtgattgccaagagcaacttatcagtaaaaggttaaaacatagtcaaattaaaccggtaagtgttggactttggaatccaagataattaccaagagaaccaaggattccaccaaataaaaatatatctattgttgtagtttagtatacaaataaatattttattaaaataatactaaattagtaactaatttcatttatcaccaaagtgattacaatagaataatctataactttttgagtgcatctataaaaaatgtcacttaagtaatagccacaatccattagtataaattttcgtttgttgaaaaacgaaggccactagggtgaaagatgattatgctaaggtatattcacatcaaaatatatggtggttctatcattttcattgtagttgtgttcgtatataggttaggttagttaaaaactatttaaactttgtcatgaatattcctatataaaagtgcatatttgaccataccaaacccatacatacctaaccggctaaaccccatttgctctaacaaaaggtctacggtgacaacaccacacgcacgcatatgcaataatagtattaactattaagtatatgaaatacatatgaatatatgcttcttctttttttgttaactagggaaaatctagaaatctagaccaatgcctaaactaattttcgaaatacagaaatcgaattttctttccactagaaacgtttacgggtggctaatctgtgactgtgagacatatacatttctcatgatatgttgatattaagtgaggttgaggctgtgtcaaaaaaaaaagaaaaaaaaaagtgaggttgaggttttgaatctaagcaaagaaagatcatacacaaactccattgagatgcaaatttatctctcctaatccacttagatcatcctcaaggacgtatacataatgtattatgaattagatatttcaccttcgtgtccactacacttcattggtaacaaatactctctctgaatttgaggttttgagttttgcacatctattaagaaaaagtaaattttatatttttagttattattttgttagtttaataatattattattatttatctcattcttttattggtcacaaactaaattaatgatgatacttttacagaacattaatcttaatggaataaattaaaaattcaaaacattaaatttcttggaacagatggagtatatcattaggactaatgattgcagatagtgtgtaatccaactatatcatttggactaataattgcaactagtgttttaagaagaataagttctagctagtaattataaatgacgtttatcgagatatcttggataatggaattaaacttttaagcgtcttccttgtatccaatgaatttttataattttatcaaattaaacatgccagttttaatgctattgtcatcttgttgttataaaaatatcacactccaaaaagattgtaagaatccttaaatatcaaaattaaccaataaaaataactaccatcatggttgacagaaaaaaaatttaactaccactcggttcacaacaagcatatgatttactgcaaaagctcaccataatatatatgaatcgtttccgtgactttttccaaaacaatataaagacggtcgtaaaactttatcatctgcgtaaattgttgtaacaaagtttttttaattgtttctatttatgtgattttctaattttagatctattatatttatcaaaactttagggttttatatgtttatttttgggttttttgagttatgagtccatgagtttgctcaatttgagcttaatactgaaaacacggttctgtagaatcgaaaaaacaaattcggataaaggatatatcacataatatttgtttcgtttttcgttgttttgtcgacggatcatggaaaggaaatgacaagttttatggataagagtgattttgcaccttattaaataggaagtcgctaacc

SEQ ID NO: 2658 - DNA, 3000 bp, Unknown
  misc_feature (1)..( 3000): cDNA_ID_3069052_gDNA_ID_1620572_Annot_ID_160871 3000 nt of promoter + ATG
atcttttgacatcaaagaggaagcctacctttagatgttaagacaagatggaattcaacttatctcatgctagaccaagctctgaagttcaaagtggcatttgagaagatggaggctgaggataaacagtataataattactttttgctgaaagtggattgaaataaaaggatcggaccagcagtatcaggtgattgggaaaagttgacaggttatttcaaattcttgagattttctataaatccacattggttctctcaagttcaaactttgttgcttctcataaactctacaatgagatagtctctattattagaaacctaggtacattaaaatatagtgatgatgccttaagactaaagtcgagtctatgttagaaaaggtggataagtattgggatgcatttggggaacaagtggaaatgaataggcttgtaatagtggaaagtgtgtttgacccgaggaagaaaatgaaatttgctgagttatattttgaaaggctatatggtagagatagtgtggaggctactcatctttcagattcagtttataacatcatgactgatttgtatgatgagttcacacgagccaatttagtgaccaaaagtggtagcggttctagtagtggaccaactggtgggtcatctactcagcctcagtctgaaagtggttggagtcagtgtcaagattcttttaggagacctgttttgcgtaatggttttttatatgaggatatggaaaatgtatttgtagagactgtgaaggagacatggaataatacatcacatgaggtggatgtttgaaagagaatgtggagacactggtcattcctaaaggtatataatatgatttgctatcttggtggaaggtctataccggaaaatatcatattctctcactcattgccaaggagatacttgcaatgcaaatggcgtccatagcataagaatctgcattcaacacaagtgatagagttgtgaatccattcagaagatgtctctcgcattacatggttgaattgttgatgtgccttgagcaatggttaaaatgtgaaatccatatcaatgaaagaggtgtctccacaataaagcaaatactttctgagatcactttggaaaatggtcttatgagaagtaagttctgattttaatctttctttttagttctatcatgaggttgtgatattgtaattctaattcatgttcttttattttgcatagaacatgaacttggtgaaatagatttctttttcaactatgatggagcggattgaagatctttacaatagcccatgaatgtgtaatgtgttccatctcaagtttcctacttcaacttctatgttttttttcattaagttattacgcatgaacatattcgactaggttttcaagttgttttttctttcttggacttgtttcttgacaattgggaaggttttacgtctttaactttttctatttagatcattggatgattgcaattggatgttttaagtaattggattcttattgttccgttttagcttttatatgtgttgttgtagtgtaaacatacccaagtagggtaaaaattgatttcatagagtaaatagggcaaaaaacccgatcccgacccgaacccaacgaagaacttcaatttctcgggtttttttacggttctcaaatctcaattccgaatctgactagacctgaaccaaacccgaaccgatattttcaatttaccttcttgggtcctagactaccatacccgacatacccgtacccgatcgggttttactgaacccgatccgcatatccgaatgtccagaccgaaaaggaatggcgatttgtttaggtaactaaaaattggtaaagttggtatttgaaaatagaaaatgggtatatatatacaagaacaagtaaaaaaatgagtgtaaatgtaatacatttttttggtattcccgcgtatggatatatcaattcttaacaagttacgtacgtaaaagtctattgttcaggaatcgtttttgtcggagagttatgtgtggccatggaggctcttgttctaatcactgctctgcgagaatgttatctaaagacattcaccatccaactaccaacatctccaagaccctaatcttgtgctttcaagaaaaatctgatcttcttttgaatgatctcgaacctcggcttttgctttatatcttaaagcaaacctcatttgactatcaatccatagtctctccaacctacgctgattcactacttcacattctcaaatcggcgagaagttcaaccgttgttcctttgttaacgtgaccgagtcttttattgacagtgaccatcttgtcatccatcgattcgttcgtggaaaatctttcaacgaatcgtgacttcacatgtgccaaatcgccttctagcatttgtctcaaagctctcatgaaactttgttgaatcgttttcgtggcattgaagaatgccctcatcctttgagttttaaactttggatcgttgatccctcattctctttgtatttggttccttcaatgaatacaagtattttgtacacacaaaaaaactactccctcggtttttatttatttaaaatgttaaaagtcaataaatggatttgtaattttcttaaatattacgtttttcattttcataatgtgcaaatactctaaaagtaaagtgaataaacaattagaatagagtatttgatggtataaatcaccgtaatcacgcatctcataataatacaaattaatgtttcatacatattaaaagaccaacggtctccctttgtctcacaaacagccaggaagacgtgaacgaacaacataacatgataaaattaaatactctaattgtttcctctttaatataaccgcaagaggagagaaccttttgctcttcaagaaaaggagagaagactgcaagctgtcgtttccctaattaaggtcaaggtttcgttttggtattttctctgaaatagaaaggaaaagattacgtggaggaagatg

SEQ ID NO: 2659 - DNA, 3000 bp, Unknown
  misc_feature (1)..( 3000): cDNA_ID_3069062_gDNA_ID_1620572_Annot_ID_160868 3000 nt of promoter + ATG
tatatatatatatatatctgttcccctatctatcgtacaatatattcccttatgaaaatgtgtataaacaaccatacgaaaaagaaggccaaacaaaagatggcactgttcttggagaatctatgagcaaatatatgttcttaggattcacataggagccacgtcgaatccaccatctgaaagttatttttttcgatgctaagagttaaattgcgaaattgactattgtaaactattgttaaactgaaattgactatataatggaaaacacgttaaactgattaaacgtctcatcaataaaatagcttattgacatgacactttggagatagaggatttcttcgtgatacaactttagttaagatgtggaggatatgaggaaagagttaaccagacgtaattaacatgaatacaaaattgaaaaaatccattagtaaatttagaggactttaggacttttaaactaaagtgcataccgatcactcccaataatccagtggacatctttttctcaatctgctagtgcgactatcttatacataattcgactaataaagtggaaatggttttcgtatacactaataaattcaaaatatttctctcaaagataccaccttttacataatttagtttgtagtaaaataaacaaagttctagtaatgatttaacggaaatggttttcgtacaactattgggtgtgttattaatttttatttcttgtttggaaaagttctaattttcgtaactcttctatatattttttacaagttttaaaggggtcatagtggcggttagaacgttacaaaaactatgataacaactatataactaaaacagtaaaatagatagttgccctaattctacgttgcgttgtcacttttgtcatgtcatccacttgggaaaagaaataacatttatatcgagcaagaacttcagtagtgacaaattcagcatacgaggaaaatagcatattgacatgacatgagacttaagagatagatgatttcttcgtgatattacctaagatgtggaggatatgaggaaagagttaagcagacattatttaaatgtcatctttcactataaacgtgggtcttatctctaatctcatcggctttttaattagttatctttggaaaaaaatcaggtttttgaaattttgtaagcggacaaagaagttcatttgtgatatctcacatggactttcgtgagccatcagatatttcaagtcatactatatctgatttcaaggcttggaaggaagctcaattaacttgccgatgtaatagttcaactggtaaggtccataacacatgaaaattttcaagtggatggatcttggaaggattgccaaccctagttttgtctctctttatttagagtttttaaaccatgttttttgaggggatcgagagactagattttgagactgattgcgcggagttgatcaagatgatgcattgtcttgttgattgacccgtcttctctagctttctagatgagttcggactacttgaaatccttttattgtttctcgtttttttcagaaataattattgtaattgaaattatagaatgtattgcatattttgttgagtacgtacttttctattgattaattataagactttgaactacaaatctcttgatagaaatcacactttggcagtggaaaacatggaattataaacatggtggtagagaggaagcattgattataatatttcacttccatattgtatatttcttggttttctggttcactatcgagtcgtttttactgtcttctttggtgggcaacatggaatctttaaaagaaagagcataatctaaagagattagcaatcactttcataaagtataagctaaagagattagcaatttactattgtttccaatcaaacattaaacttttaacaacactcccagagtgattgtccatataagatttcactacagaaaatggatgacgtcgatttaccagcttcacttcgtaaaccaacgtaaaatttttaatatatgaaggtccattaaaataaatgtccactacataaatcagagtctaaactgtttatttgatttattagcttatgcttaagaacttttacgagcttctttgtaattgactttaaagcgagacaatattaacgtcatacaataatacgacggtctccaaactgacggtagaagttttaagtcagcttatatataactgacgttacacttaatattaaccgacgtaatttgccgtgttctctttgtaatgttgcgagaaagacatctataaaaattagatcataaaatttgagtctagaataacatgctaaacaatctcctgtactatctttttaaatcgagtagtcgctggtgacgtccacaagaaaaattgcggtcattttgccaaatcatgagaagtccctttaactttgcgaaagtatgcaataaaaactcaaataagtatgtttcctaaaaaaaaaaaaaaattgtatggtatgagaaatttaaactattttgatattgacgttcgtcgttatgtcgtaaaatcaaatcaatatctttacaaaagcattgtgaattaatgaagaaattaacctaattgtttatcaaagaaaaagaaacagcaatacacgaaagtatttgaagttcatacacaaattaaattttgaaaactaatttattagcttaaagccttgaagtactcagcatatattattttatttgttttcttgtagctaggttactgagcctggttcgcgtcttcgcgaggagttgtataagttttaccgaattaaaataggtactgcaggtatataacagatgttaacaaataatattatatatatcatatcatatcactttcggtgaagtcgctctgtctcggctactatatatagaacaatcaggaagacggaaaaaataacattacacttgaaaaaaatccacaaatataaatgaaaagagagaatcttttgttcttgaagaaaaagagagaagaagatg

SEQ ID NO: 2660 - DNA, 3000 bp, Unknown
  misc_feature (1)..( 3000): cDNA_ID_3069056_gDNA_ID_1620572_Annot_ID_160870 3000 nt of promoter + ATG
cagctctatttggggccgtacaaccaatttactcgtattcttcggggtcaatggtatcagtgtatttcctagcaagccatgaccagatcaaggagaaaacaaggatctatgtgttgttatttgtcggtctagctttgttcactttcttgtccaatataagtcagcattatggttttgcgtacatgggcgaatacctaacaaaacgtatccgagaacgtatgctcggaaagatactaacgtttgaagttaattggtttgacaaagatgagaattcgagtggtgcaatttgctctagactagcgaaagatgctaacatggtatttcttctgcctttctaatttgaacttcaatgaacaatctattctaatctatgtattgatcttggaatggtttgttatgataggtgagatcattggttggtgatcggatgtcattactcgtacaaactatatcggcagtgagcatcacatgtgcaattggtttggtcatctcttggcgattctctatagtgatgatgtcggtgcagccagtgattgttgtgtgcttctacactcaacgcgttctgctcaaaagcatgtcgagaaatgccatcaaaggccaagatgaaagcagtaaactagctgcagaagctgtctccaatattcgaaccattacagctttctcgtcacaagaacggatcattaacttacttaaaatggtccaagaaggaccgcggaaagatagcgcccgccaatcgtggttagcaggaattatgttggggacttcacaaagccttataacgtgcgtttcagctttgaatttctggtatggtggtaaacttattgctgatgggaagatgatgtcaaaagaatttttagaaatatttttgatttttgcgagtacgggtcgggttattgccgaagctgggacaatgacaaaagatctagtcaagggatcagatgcggttgcgtcagtgtttgcagtattagatcgcaacacaaccattgagccggagaacccagacggttacgtccctaaaaaagtaaagggacaaataagtttttccaacgtggactttgcttacccaacacggcctgatgtgattatattccagaacttttccattgatatcgaagatggtaagtcgacagcgatcgtgggtccaagcgggtcaggtaaatctactataattagcttgatcgagcgattctacgacccgttaaagggtattgttaaaatcgatggacgtgatataaggtcgtgtcatttgagatcacttcgtcaacacatagctttggttagccaagaaccaacgttatttgctgggacaatacgtgagaacatcatgtatggaggagcatcaaacaagatcgacgaatcggagattatcgaggcagcaaaggcagccaacgctcatgattttatcacatcactatctaacggctatgacacatgttgcggggacaggggagtgcaattgtctggtggtcaaaaacagagaatcgcgatcgctcgagcggttctaaagaacccatcggtgttgctcctggatgaagctacaagcgctctggatagccaatcggaaagcgtggtgcaagacgcgcttgagcgtttgatggttgggaggacaagcgttgtgatcgctcataggcttagcaccatccaaaaatgtgatacaatcgctgttttagaaaatggagcagttgtcgaatgtggaaaccactcgtctttattggcaaagggtccaaagggagcttatttctcattggtcagtctccagagaactctcttttgaacttgaaagttagatttgtatcaatatgtctctttgcctaagttgctagattacctacctatgctctctattctcgaaaacaccaaattaattataacggaacactatcaattgtagactaaactcatttacatatttttcatatttttgcaaataaaatgaataatatttttaaataagtcctttgcacaaatttttatgaaaccatttctttgattattaaaactgtttagtagttgatttgtgaatgttatagagaggatttgaaaaaggccatgtgaggtataagtacgctgcaatctattattgtagtcagcactagatcaatatttgatgttatataaaattatttccataagataatacgtaaagacagctaacgtcaatatgacatgtatgattaaacaatatttttgttttaaaatgatcggattggtctttaattaatggtgtgcctcggtaaagggtacgtcaatcgccggaaaaaaaatctaaaatccgaagaaagtgtgatcgatcgaaaagaaaaaaatcaaacggtcgagtaaaaataaaaacctgccgtgaataacacgaatcctcggtattgcagtatggtcattcgtttgttcaggttacttttatctttactttgaacatatgtagttttgctccgtggtccgtgtctagtttcaacatcggtcaacaccggtcaacactggtcaatgccggttctgatcaaagtagaatgtatcggtcaatgttggttaacatcggttaacaccggtcaacactggtcaatgccggttctggtcaaagtaggatgattatggtgttggcaacatgacttatgtttgttcgtgtatgtccgtatgtgatatcaatacttcgtgtagctaacgagacatttttaaaatatgtacgtgtgacgatgtgttggtttatacttcgtgtaactaataaacatttttctctcaaatctaacatatttttgttatgaccaaatttttttaaaaaaattaactcaatgctagaaatattttatttatgctaaacttttctacactagtacattaattatcttcacgtattgataccaatgttataataacttaattttcatacataataaaaggcctacgatctccctctgtcccggctgctatataaaactgtagtttgtcgtttcccaaaggtcaatgcgtcgttttggtctctctctttctctctaaacaaaagagataatg

SEQ ID NO: 2661 - DNA, 3000 bp, Unknown
  misc_feature (1)..( 3000): cDNA_ID_3069060_gDNA_ID_1620572_Annot_ID_160869 3000 nt of promoter + ATG
ccactgccaaagtgtgatttctatcaagagatttgtagttcaaagtcttataattaatcaatagaaaagtacgtactcaacaaaatatgcaatacattctataatttcaattacaataattatttctgaaaaaaacgagaaacaataaaaggatttcaagtagtccgaactcatctagaaagctagagaagacgggtcaatcaacaagacaatgcatcatcttgatcaactccgcgcaatcagtctcaaaatctagtctctcgatcccctcaaaaaacatggtttaaaaactctaaataaagagagacaaaactagggttggcaatccttccaagatccatccacttgaaaattttcatgtgttatggaccttaccagttgaactattacatcggcaagttaattgagcttccttccaagccttgaaatcagatatagtatgacttgaaatatctgatggctcacgaaagtccatgtgagatatcacaaatgaacttctttgtccgcttacaaaatttcaaaaacctgatttttttccaaagataactaattaaaaagccgatgagattagagataagacccacgtttatagtgaaagatgacatttaaataatgtctgcttaactctttcctcatatcctccacatcttaggtaatatcacgaagaaatcatctatctcttaagtctcatgtcatgtcaatatgctattttcctcgtatgctgaatttgtcactactgaagttcttgctcgatataaatgttatttcttttcccaagtggatgacatgacaaaagtgacaacgcaacgtagaattagggcaactatctattttactgttttagttatatagttgttatcatagtttttgtaacgttctaaccgccactatgacccctttaaaacttgtaaaaaatatatagaagagttacgaaaattagaacttttccaaacaagaaataaaaattaataacacacccaatagttgtacgaaaaccatttccgttaaatcattactagaactttgtttattttactacaaactaaattatgtaaaaggtggtatctttgagagaaatattttgaatttattagtgtatacgaaaaccatttccactttattagtcgaattatgtataagatagtcgcactagcagattgagaaaaagatgtccactggattattgggagtgatcggtatgcactttagtttaaaagtcctaaagtcctctaaatttactaatggattttttcaattttgtattcatgttaattacgtctggttaactctttcctcatatcctccacatcttaactaaagttgtatcacgaagaaatcctctatctccaaagtgtcatgtcaataagctattttattgatgagacgtttaatcagtttaacgtgttttccattatatagtcaatttcagtttaacaatagtttacaatagtcaatttcgcaatttaactcttagcatcgaaaaaaataactttcagatggtggattcgacgtggctcctatgtgaatcctaagaacatatatttgctcatagattctccaagaacagtgccatcttttgtttggccttctttttcgtatggttgtttatacacattttcataagggaatatattgtacgatagataggggaacagatatatatatatatatatacattatatttttgtgggatttatgcattccatagcactaaaaaaatcttttgtttttgtccaataacatatggagtttttctctatcaaaaatcattttatactttaaatatatcataaatatttaaatatatatgaccctgtaattaaaatttatgctttaaatgtatcatttcatactatattttctctattagaatatagggtgagcggagccagaatttttgtttacggatcataaatatttaattatttttatttaaatataatatgatatgatatatttaaagtataaatttttaagaagagatgaactacaaacaaaaatctgaaacaaaatgtctaaaacagaagaaacaaaattaatatgtaagaagatgttagaaatttttatccattttgaaagaaaaaaaaaataaaaatggaaagaggattaacatttaattgaaaaaatgaaaatgcatgggtcaaaggcatggttctagtttctaccatcataaaaaagaggcatgattctagtactatttatgggggtcattatgacaactttaaagaaaaacatctagaaatcattatctacgttataattaaaaaattataaatgttatgggggtcaactgacccccttgccaatacactagctccgctactagaatatccctatgctcctcggttatctctcaatggatcatgatcgtttgggttgatgtacaattgtatttataatttatgacatacaaccccacaagttttttaggcctgttattaaaaaaaaaacgtaaatttgaactattatcttttgaaattaaaatctattgtttttactaataggacaagaaaatacttttaaaatgcacgccgattatattggctatataatctatggccgcacgcagatgcttcatcaatttttgtccagggcggctatgatgacataccataacgtttgctactaactaatctccttcatcctctaaaacatcctcccactggagctatcactaatttgtcgactaaacctagtttcacattcgtcatccactctccataattccttttagtgaagaagattcacctgatcatgttttgaaagtagtcattcacgtcaatcaaattaagtttcatgagatttaactgaaatatgggttagatacaattttcatgacgtcaattttcataaatacagtttcgataaccctcgataatttgggcctccataaatatgggccgatatttctaatttttcgcctctctcatagacgcgaacagttttagaaaggaaccgagatatttttctcagtagagagcttgaacacacgaagaaacc

SEQ ID NO: 2662 - DNA, 3000 bp, Unknown
  misc_feature (1)..( 3000): cDNA_ID_4255199_gDNA_ID_1620573_Annot_ID_160901 3000 nt of promoter + ATG
accgaaccggattctaattgtaccgactttattaggtggtaaatgtttcacttttagttttattggggttgtttcgttagataagattagatttgggtccagaatgtaaataattttgattttcgttgaggttatttcttcgtagagcgggttgttcgataacaagtcagtcattaataataactgtagcgagagtgagaagtgcttcccatgttcagagatcgattccagagatattaaaccacatgctttgataatataaacaagttttgactcattagcacagtgactttagggagcgacagcttttgttcctcttttattatatagttttctacacaaataaaaatattaaggtatgattttgcatgttagagacaaatccaaaatgcaaatcctctccgtatcggcttagttcatctactgcactgtggttctttattttaatcagtgtcaacttagtgtaattatttgatgatgaagagacagctttaccatgttggcctagattaagattaactactacatgttgatctccggtgaaaagatatttatatactcgtggatatgtaacttcaagcagctttgaaactgagggacataagattaacgaaacgaaaaacaagaaactgaaaggtaaaatgggggatggtcaaagcgtgaagaaagatgtcagtcatatgagctgcaattttttcgagtaaatgaagttttggctccaataattttatcttttttcaaatatatatagtacacatcacaaataaaagttgctggtcgttctcgaacactgtattttcaatcccatccgttggatgtttccttcgtcctcacctcaatttagtgaccacaataatataagtacatacacacatcacagaaaagaacaaggctacaagttcacgattttttatttttgggttttaatgtgacgctagaagttcttgtttatcaatcgttttgaatggttgcacgtatagaaggaacggattaacttccttgtgaattagacccttttgttttgggggcggataataatttataccattttttccaacagttcgtaattagtttatagcaggaaaaaaatgatttcgatgcaaccatataaaactattgtttgaagtatcagaaggttaatataaatttatgtcaaattttgttattagtaggtgacaaactaaactagcatataaaaagtctagtagtgtgaaatactcaacatgtagaaatgtcttttgaaagattttgtttcaaagttttaaccaatattgtaaacatagaaaaataatatatagttttaatacaggttcttaggaatcgtcttggactaagagaagttttggattaatgatactcctaagaagataatatagtatattcatttcacagaaatatattcatttacacaaagtacactacggtaagataatgaacctaaagaagtattacacaaagtatattagtgtatgcatgtatttgatgtattatttactaaagtgtttggatttaatttcaatatgccatataacaaaacagagtccgaaaacaaaaatctgcaatggtctttttgaccggtcttgaatttatggggacccatcgtcctcttgccaattatttggatttggaacgtacaacactacaacatataaaaacagtacagttaaacactgattactacatttttgtttttcaaccacatattaccacaatttcaagggatgttctcacgagtctccttcaattccaatggtgtaaaataattgaattggctaattctatgaattatgtatataattaaaacatttatgtatgtaagcctcaaaattcgacagaagtatggaaatgttttttctatatgtggtgtaactaaacctaattcatattggtcattggtcaatgtagcatccagtccggtggtaaaatttcggcttactcgaataagacattctagcagtacatatcgattttaaatcagatagctagacaaacatactcgcggattcatttgaatcctaagacaaatgtggaaaacaaatgctagaaaactttttgaacaataaataatttgtttttttttttacgaaacaaaagtaataataaggacagaaaagtaagagtaaggtggggaagatgaaggagagaacgtgatacatcccagtcttgtgccctctgatagattcgcaatctcttatttgatgctttcattcatatgtctctttgctctttttattacatatttgcgcatttatatatttattgtttatatcggagtaacgagccacgacaaatggcctaagtagaaaaggccgacaagaaaggagaaattagttagaaatagatactatgcctaatagataccgagtttagtacgtcaaaatggacattaacatgttagagttaggacaaagacaaataccataatccatagataatctaattatttagaaaaactataaacctaggtaagaaacgtctttttgtttctgctagctagacttattaacatgttacatgttcaatcatgcatgaaacctaaactataggattgttgtgagattaaagtgtacaatcgaacaatatgctaatcaatattttggcacttaataaggcatatatatatgtttgttttaggattcgttctctatatatatttagactttgatgtttctcgttattggagagagcatgaaagcgagagaaaagtacgtaagaactatgatgggaagtggacatcattttcgcgttgaatatgaaacactaataataatatgtggtttcaattcttgttcttttagtcgttttatgagattgggggaaattacgttatacattaataatgctcgtgacaacaccacccactctatatgaattgaaacaatgcaggtccttatcctaattgggcaacaattgttatatacaagtgtgagagtgatgataaagatccacagctaggatgctatgtaatatctaatgcagaaagatagtaataattccatg

SEQ ID NO: 2663 - DNA, 3000 bp, Unknown
  misc_feature (1)..( 3000): cDNA_ID_2167593_gDNA_ID_1620573_Annot_ID_160913 3000 nt of promoter + ATG
atcaagcctgggagtttcagcgcggtctgtgatagccagctcaagttcatcagacaggaactgtaattccatttgatctgataagcaatagctgtcattcgaacagccaaaatcatgaaaatcgccatcggaacaagcatctccagaaagattaaggaagtctttgagaagcgacccggagttgcctccatcacattgattgcccaaatcctcagtgaaaatagatggagatcttgcagactccacaccagaagctgagtgggtgtaagaggagggatcagggaggaaaggaagactgtttcctagatgtttctgagtctcagaggttgaagatgatgacaagtagaggtttgtgcaaaaggtggaagaccgagagaaggtgctctgagaactattctttggccatagctgaccaggtgaatctggagattgtgaccttatgaaaggagttttccggtgttctggctggacattcagaaagttatggactggagataaagaagaagagcaagcttgaccaagttttttattgcattcatctgttgccgctgagagaagcctgtgtctgttcatgattgctttgatgtacatcaacaatcaaaactgtctcttgacaagatcccccattagtttgcagttagcatccaagccgctgagaaccaaacattttgatgattaggataagaatggtggggtcaataaacatgttagtgacaagaattgagtcagtttgtttagttaactttcagaacaaggcatacagaatcatccagtgatccatcttggctggatcttgacaagttaataagttccttgagaactaaaaagctaagtaattggagcaacaagagtacatccgagattgagatttaccatatatacagacacagagagatgcaacgattaaatatggtgttccaaaaaatgcaaaacgagttgccgacacatggaaactttaaaactcgaacagaggaatcaaatcaggttacgcaaagacacgattacaggaggacagaaacgcaaagagaaatgaggtattaaattctaaattcagaatgttgagactgacaagtagtagtacgaatcattcacagagaaaatcaaaagcaatttatttgattttatatttgattttatcaaagggcatgatagaatagaaacggacctgagaggatgataaagtcttcacctttttaatacttgctgcataacaaatgaagaaaaaactaacatttgagaaaacaagctgaatcccatcaaagagatgaagttaattcgaatgagaaagcaaaagaagaagaagaagagatggggttaaaggaaggagacggagatttcgctacgaaatcgccgtcgaagtgtgtactgttggctttgcttgattggtctccgtcttgctggacctctttcttgttccacccgctctttcctcgactgtaactcacggaccaattcaatccgttagttcatttgccacgtaggattcaagtgctcgtgcgttttgccacataaattttattttattttatcgacatcacgcttagctctctctcgtattctcttcctaatcacatttcatacctggtcaaccaaattattggttttaaaaaaactatactacttctttgggttatgagatttgaggatttttttaaaatcatttatcattgttgattcgaattatttatgtgatcgatactagtagtacttcgtaagctttgttttttcttttccaatggagtacatactattgtgaactattctctgcttttctttttcagttagtattgatatctttatgttgtaagaaaaatcgtgacacaattacgaattattgatataaaaacgaatgataatgattaatgaatatgaatgagaaaatggttgcccaaaaatgatagtgactgatctgtaatgcagtttagtagaattagtttcttttaatagcaaaactaatgatcattaatcttccaaaaggaaagacaaagtagcatcatccattaacttgtgggtcatatctaaagccttagccacacaaatccatccaattttttttgttttttttttgtctttagtcttttttaccacataagtaagataatgctaatttaatgctcatcatagagaatgagctcagcaaatgctttctacctgattatttattatcttcaaaatagtcaagtttgaggcatcaagtggtagaatgtctaaatccttacataatttatatttatttttggcaacatacataacataattcaacactgttctaagtaatacatggctagtgggttatataagattatatacttcactaaaggttgataaatcaattctcagtttgcattttgccaatatacctcaatttatcatctttagtcccacaaatgatggccacttttgtcgtactgtatgtttgttttcgacttgtttaagtgttgggtcccctcattgatcaattattgaaaaataaaatgggccttactaaaaacatatatttgggttaactagagagaaagcccaaatacaaaaagagaatcatcagcgattcaacagaggcttgaacgcgcgtcaaaaagcttagctcaaagattgaattttgattttcacatgtttttcttcataggccaaccattaatggcgttgactttgtcaattctctgacaattgtaatttcgttctcctgaaaccgtgggagaaaagaatctgcatttccttcaagttcaacgtcttccaggtttgattttgatttccttttcccaattccatgacttttttgatccgtatccagtaattgaccaccgtgattcgcgaatcatgattagggtttcgttgttaatgaatggcctttggatgatcaatggtggtgtttgagatttaattgggatttagttatgccctcttggaatttggtatcagcatgagtgtggagcatttagtatctgaatccgattgatgaaaggttgacacttttctcttttgttttttccagattttgaa

SEQ ID NO: 2664 - DNA, 3000 bp, Unknown
  misc_feature (1)..( 3000): cDNA_ID_3069070_gDNA_ID_1620573_Annot_ID_160916 3000 nt of promoter + ATG
aaatcaggttggcttcaatgagaatgcttctctggtctaccaaacgggatatggatacaaccctcaaatgccatatgggccatattcccctgcagcaagtcccttgccttctgagggacagttgtattctccacaacagtttccgttttcaggggcatcaccgtattaccagcaggtagttcctcctagcatgcaatatattacttctccaactcagcccgagctcaccagccttgtcggtgttgaccaacaaggtgataacatcggaccacgccaatcctaccatcctcatcccattggaccgtttaatggaaaccagccaaaccttggttttcctgaatggcagcaaggttttgacgggggaatatggtcggattggtccaagccttctgatatgcacaggcattcttcttctatttctccggctttatctcctcagccactcggctcatatggatcatatggccagaacatacccatggttggttcacttttcttatctactcttatccgacatatggatagctttcttctattcatggttacatattggattatatgttaaaagtagattgttctttaatttgtcaggggtcacagcgacagagatcattttacggttttggatctggttcgaactcttataacagaggttatatgcatagtggtggtcgtggccagggttctaactatggaagtagactaatttctaatgtgggtatgggaaaccaaggctggattggggttgacaacagtcgagggcgtggaagggttagtgatccatctttgggtggtgcttataatggtacttttgatatcctcaatgagcaaaatcgaggaccaagggcttcaaagcccaagactcaggtcttagaggagcttgattctgctgctgattctaagaaaaataacaaaggcagtgcaaaggagcacgaggaatccaacaacgcagactttgtcaccgactacactaacgccaagttgttcatcatcaagtcttacagtgaagacaatgttcacaaaagcatcaaatacaatgtatgggctagcacccctaatggcaacaaaaagcttgacgctgcttatcgtgaggccaaggatgagaaagaaccgtgtccactttttcttctgttctcggtacgagtctaatccttgatcaagtgaaaaaaaattagtttttcttctttttgcagattgcttacgggtttgtaaattcaggtaaatgcgagctctcaattctgtggtgtagcagagatggttggacctgttgattttgagaagagcgttgattactggcaacaagataaatggagtggacagttcccagtgaagtggcacattatcaaagatgttccaaacagccagttccgccacattatattggaaaacaatgacaataagcctgtgactaatagtcgagacacccaagaagtaagtagcaatttgtgcctatcaagctttcttgtccataagatacctcttttaagccacaccataaccacaaccaaaaactacaggtaaaactggaacagggcatcgagatgctgaagatcttcaagaactacgacgctgacacgtcaatcttggatgatttcgggttttatgaagagcgggagaaaattatacaagaccggaaggcaagaagacagccaagcttgccatctgcaggagtagtagcaggagaaaatgaacataaacctgcttctgctgcattacccacagacttcatgaagaacatgtccaagagttttgcgcaagttgtccgcttggacgaaggcagcaaagaagcagtcaaggccagttcatctccagatgcaattacaacagcagcagtctcttctggtcaatccaactagtaagtaaaagacatcaattagcaaagactatgttttcaaattccataatatgatcttttgtttgttctaagaaggtatttcaaatgaaattttacgtctgaccgggtctggtttttgtgtaaagtaagcctctttcctccgcccttttctgcttcaggggtatttagccaaaatttgattcatttccctcttttcaatgttctataataccctcactcttctgagttgatagaagaagaagatgaagaagataatgtatgaaagacaatataatgtttctcttgtaaagttggcctcatttatctttgcaggcagtttttcaaaataaaaatgcagattacacacatcaatcaaattcaaagctctcagctttccacatatccaaagtttgtttctttgtgtgttttttctacacatatcttagtttttgagagtccgattgtgaacgtgacaagaaagtcaatcaatgacttatccatatgaatgaattgtcatcaaaagggacactgaattgtgtggttcatactcatagcatgtcaatatattcgtgaccctttttacaagcaagacagattcagatttgtgagatgttatgattcactaacaataatgtggctaagggatcagttgtaattgatattatccatttgtgagaaacaaataaaatagtttcatataaatctaaggactgtctatgtcagtccttagtctattttgccatatttctagatctaatcgggttgcattattacgtagatagatatgatctacttactgatgatttttttttttgaaaccttaatgtataaaaaaatggtttaaaagtactaaccattgttggtccacaaaaataaagggaagaaaggagggccaaatcgtaacattaataaaaaaggggccaaactgtaacaacaaaaaaacaaaaagggccacaaagaaaaaagagagaaaataagaagagtcccggacaggaccgagcttgaggattcgttgttgcctttatgactcagccaacaagaaccagactaatcctagtcctagtcctagtccacgcgcgaatatacaaacgtcttaaagccatttgatagaaccgatttccaagggttttgctcagaaaaaacacagagagagattttggaattcg

SEQ ID NO: 2665 - DNA, 3000 bp, Unknown
  misc_feature (1)..( 3000): cDNA_ID_2167587_gDNA_ID_1620573_Annot_ID_160911 3000 nt of promoter + ATG
aaccctttcctgaggaattcaaggcacaaacatcaaaatcaaatgaagccacaatgcatcataaacagaagaatatgacccaaaacaaagtccattttagcattgattgatgaccattgacacaagacacacagaaatcggatgaacaaaggatggtcataagctaaacagtctgaaattcagcattagacaaggtcagagatcattcaattcaagagctcataagaatatgaacatttacggaacaattcagccgtcccctttctacttgaggtaccaagaaacttatatcaaagacaacaagtatgataaaagctacctgcggccatgtttatcagaaacaatgccccaagagtaagcaccaatgagcatgccagcaaaaacgacgctagttattaagctttcctggcgtgcagagagattccagagagattgaacagcaggtccaacgaaagagagaagcatcatctccatggcctctgcaacccaacccattccagcgtaagcaaggacgtaaatttggaacttgccaaatcccatcgccacaagagcttcatccaccgtgaatcttgtgttcccatctgccatttcaaaatctggaaaaaacaaaagagaaaagtgtcaacctttcatcaatcggattcagatactaaatgctccacactcatgctgataccaaattccaagagggcataactaaatcccaattaaatctcaaacaccaccattgatcatccaaaggccattcattaacaacgaaaccctaatcatgattcgcgaatcacggtggtcaattactggatacggatcaaaaaagtcatggaattgggaaaaggaaatcaaaatcaaacctggaagacgttgaacttgaaggaaatgcagattcttttctcccacggtttcaggagaacgaaattacaattgtcagagaattgacaaagtcaacgccattaatggttggcctatgaagaaaaacatgtgaaaatcaaaattcaatctttgagctaagctttttgacgcgcgttcaagcctctgttgaatcgctgatgattctctttttgtatttgggctttctctctagttaacccaaatatatgtttttagtaaggcccattttatttttcaataattgatcaatgaggggacccaacacttaaacaagtcgaaaacaaacatacagtacgacaaaagtggccatcatttgtgggactaaagatgataaattgaggtatattggcaaaatgcaaactgagaattgatttatcaacctttagtgaagtatataatcttatataacccactagccatgtattacttagaacagtgttgaattatgttatgtatgttgccaaaaataaatataaattatgtaaggatttagacattctaccacttgatgcctcaaacttgactattttgaagataataaataatcaggtagaaagcatttgctgagctcattctctatgatgagcattaaattagcattatcttacttatgtggtaaaaaagactaaagacaaaaaaaaaacaaaaaaaattggatggatttgtgtggctaaggctttagatatgacccacaagttaatggatgatgctactttgtctttccttttggaagattaatgatcattagttttgctattaaaagaaactaattctactaaactgcattacagatcagtcactatcatttttgggcaaccattttctcattcatattcattaatcattatcattcgtttttatatcaataattcgtaattgtgtcacgatttttcttacaacataaagatatcaatactaactgaaaaagaaaagcagagaatagttcacaatagtatgtactccattggaaaagaaaaaacaaagcttacgaagtactactagtatcgatcacataaataattcgaatcaacaatgataaatgattttaaaaaaatcctcaaatctcataacccaaagaagtagtatagtttttttaaaaccaataatttggttgaccaggtatgaaatgtgattaggaagagaatacgagagagagctaagcgtgatgtcgataaaataaaataaaatttatgtggcaaaacgcacgagcacttgaatcctacgtggcaaatgaactaacggattgaattggtccgtgagttacagtcgaggaaagagcgggtggaacaagaaagaggtccagcaagacggagaccaatcaagcaaagccaacagtacacacttcgacggcgatttcgtagcgaaatctccgtctccttcctttaaccccatctcttcttcttcttcttttgctttctcattcgaattaacttcatctctttgatgggattcagcttgttttctcaaatgttagttttttcttcatttgttatgcagcaagtattaaaaaggtgaagactttatcatcctctcaggtccgtttctattctatcatgccctttgataaaatcaaatataaaatcaaataaattgcttttgattttctctgtgaatgattcgtactactacttgtcagtctcaacattctgaatttagaatttaatacctcatttctctttgcgtttctgtcctcctgtaatcgtgtctttgcgtaacctgatttgattcctctgttcgagttttaaagtttccatgtgtcggcaactcgttttgcattttttggaacaccatatttaatcgttgcatctctctgtgtctgtatatatggtaaatctcaatctcggatgtactcttgttgctccaattacttagctttttagttctcaaggaacttattaacttgtcaagatccagccaagatggatcactggatgattctgtatgccttgttctgaaagttaactaaacaaactgactcaattcttgtcactaacatgtttattgaccccaccattcttatcctaatcatcaaaatgtttggttctcagcggcttggatgctaactgcaaactaatgggggatcttgtcaagagacagttttgattgttgatg

SEQ ID NO: 2666 - DNA, 3000 bp, Unknown
  misc_feature (1)..( 3000): cDNA_ID_3098973_gDNA_ID_1620573_Annot_ID_160904 3000 nt of promoter + ATG
gagctcgtctgtgactacttaatgagaagaaccgttcgcagcctctatcaaccagttgtcttgatcgacgtcgatcttaacaaatgcgagccttgggacattcctcgtaagtaattctgtgtttacacaacatctcgcaactctatatcatatagtttaaaccattccatcggtagctattaaatccataattcttgtttccaacatgatctggttattgtttcttctacaattcgagtatatgtggtgtttagaaaaaaaaaaaaaaaaaagttcaacttgcaagccacctgcaaattagtattttgttccttactaatttctcgtgaaaagaccatttagctgcacaattataaatgcttagttcacattcattagacgcatatagtttattaatttagaatgaaaacgataccgtccgtttacataataaaagaacaaatcatcctaatcttgcagacgtgttggatgcctattcgatgactggttggttaagatatgaatatatgatacggatagaaaccatttggatattattgaatatgtcattaagatgaagactatttctgaaaagagaattctgtttatatatcttaatcttatcataaagtttctaaaatatgttggagaaaataccccctcccttaatagaaaactaaaatccattaatgtatgttagtatgtactatgtaatatacaaagaaaaacattcaacgcccaacttcttatcaatagttaagtttgatagtatataaaaaggtcattttcagaaacggcgagagtgggagggaaagaatggtacttttacagccaaaaagaccgtaaatacgcaacaggctacagaacaaaccgggctacggccaccggttattggaaagccaccgggaaagatagagcaatccaaagaaacggtggtcttgtgggtatgagaaagacacttgtgttttaccgaggtcgatcccctaaaggtcgtaaaactgattgggtcatgcatgagtttcgtctccaaggaaaacttcttcaccactcccctaattctctcgaggtattactcgtaaaaccgattgggtcatgcattaattagtccctctctttagtccattttttcctgcaaaataaatgtctctttgaaatgtaaatatagtcgaaattcaaaagtcaacttttctaaaatactccacaatagaacaactgatttatttttatgtcgcataaaaaaactaaagcaacatttagtattacattatatatcggctcattagttctactctttcgtaaatagctactatgtgcttttgaatgtaaatactaaatatcaaatgacgcatgaatgaagcaaacagccagagatgtcgcaatcatattatcccatgacttaaggcaaaagttttgactttatctttctttcacattcaacctaaatgttaaatgtctttaagggattttgctgacgattttgcaaagatttatttgtggctgatttaagatgatctatgacttggcgcacatatctactcttaaccataattttgacaaaattagttttgctgggacaaattaatgaaaacaggaagagtgggtattgtgtagagttttccacaagaacagcaacggagctgatatagacgacatcacaaggagctgctctgatgcaacagcttctgcattcatggactcttacatcaacttcgaccatcatcacatcatcaatcagcatgtaccctgcttctccaataatttgtcacataaccaaaccaaccaatccggtttaatctccaagaactccagcccattgtttaatgcttcccctgatcaaatgattctcagaactttgctaagtcaactcacaaaaaaagtcgaagaatcacagagtcgtggagacggaagctcagagagccaattgaccgacattggcatcccaagccatgcatggaattactgattatgaataaggcttaccagatatatcactatgtataagtatcatattcatgattcgaaacaatttattcaaccctcttatgtaaactgttataccattatattagcaatccaatcatatatagttgctaaaaaagcaaaaaatcattaaatttctgttatataatattttatttacgttatataatatgaaacggtaggtcgtctcgtcccataaacaaataatccaaagttacttaatcattatgaaaatagaagaggaaaaaatcttgaaaatttcccttcaatgggaaagtaacgcattaccataataagtaatttccacttggcttttcgacttttcatgtgattgactttgtggaagagagagaaaacaaaaaaagtaaaagcttcttcggtctggatatttatttgattgggtaaaaccgtaaaagtgccactggtgttgtgttctgtccgttggattttaatatttccgtttttcttttcttactggaatctattagtaatatatattttgccataattcataggtcggtaaaaaaaataaagatcggcgtatcgtaccaaaaaaggatattttgtttaacccggtcattatcctacgcgcaccgacctttctcattctccgtcgtcgtccttcttttgtctttcgccgtttctttccttattcggcatcgatttttccggctttgatctccttctccgtcgtgttattgcgaattgcccttttcggattgaaatcgttgttttcccccaaatttcaggtttagttttttttttttttcaattgtattggtctattcattctgagctagggtttgtgttgaaatcacaatttttccccaatttgatttaattggatggtttcgcgaatccgggcaatgtaatttaatttataacttggtgtaattcacgagttgtgtgtattttgttccgtatttctgtttattactgcgaactcaaatctctttttgtttttttttgttttaattgtagactccagcttattgtggtggtgatgatcgttctttggcaagtgtttgaatcatattgaga

SEQ ID NO: 2667 - DNA, 3000 bp, Unknown
  misc_feature (1)..( 3000): cDNA_ID_2167574_gDNA_ID_1620573_Annot_ID_160908 3000 nt of promoter + ATG
gaaatgtacatctcctctgactgacggtctgcgcttgttttcaaatgccgacaacaatcagcatgtcggatatatctatgacactttggacggcataaagctgagtatcaagaaggaattcaatgacgagaaaaaacattaccttacattatgggatgtgatagatgatgtctggaacaagcacctccacaatcctcttcatgctgctggttactatctgaatccaacttctttctactcaactgatttccatcttgatccagaagtttccagcggtctcacccactctctggttcatgtggcaaaagaaggtcaaattaaaattgcctcacagcttgataggtacagactcggtaaagattgttttaacgaggccagtcaacctgatcagatctcgggaatatctccaagtgagtgaacttgttgactttcgatatagttgttttgtttgtagagatacttgtgttgttgaatcagtgagcaaaacattatgttgtcttaaaatttatttgcagttgattggtggactgaaaaggcgagccagcacccagagctgcagagtttcgccattaagattctgagccagacatgtgaaggtgcttcaaggtacaagctgaagagaagcttagcagagaagttgttgctaactgaaggaatgagccactgtgaacgaaagcatctggaagagttggcgttcgttcattacaatcttcatctacaaagctgcaaagcctaactaagctaagagcagtgaagagattgtgatgcaaatgtggactgacccgttcagcttttagtcattgtgcagatttagttttggagtttgtattttcttttgttcattacaatttccatcaatgctggtgaatatatacatgaaaatgttaatgcacttattttggttaattataatgagatttgtccttgtaattagatgttcgcaggtgtaggaatgtcttctcttacctttttatcttttacttagactccatgtgctgagaaaaaccactgtcaaatctccaaattcttgtgcttagtagacaaccaaattggtctttttctctaagtgttatattatcacatgtattatgtgatttatgcagggattatgtaatttaaatcttttgtacttaagaaaagaagctgaagtacatttgttggagaagtttaacttgtgagaatgtatgactctcacgttttgaaatctaaagttaggattaccattttttgcatctccttactagttgactgaatttgtttccatttcagaaactaactccagattttacctgttgaatgaatatatgcagttcttggaaaaataatctgagtttggttgcttaatttgtacagggcagaattattcttcttccttaagatatatgaatcattcagaatccgacttgcatcaatcagcagaagacagtccatatcaagaccaaacagtccaacaccaagaatcttcatctgaatcatctccagcagagtcaaactgttgaggtattaactgatattcttccttcttttgtacctttaggatggtctttttaaaagaaacagtttacatgaaagaaaaaatgtatctgcatactaaaccagaaagcattggacccaagtaatcactttcttgaaaggaggctaatgagaaaagacaaatgcaaggaagctacctcgaggaatgccacctaagtacctgtgggatcaccctaatctatcgtctgagatatggtgagatatatgttttaagaatatcttcatgtcgcttgctgatccaacggtaactatatatgaaagcttatactaagtaaggcttactatttcctttctttttttaaaaagctactggatattttttcagcatctccttactaggtaattgaatgttctcagtaggacgttcccattctagacaaaaaaaaatccagggcatataaaccatgttagagatatgaacaaacactgaattgttttcatttcaaaaccaactgttgaataagagcttgcttgcttaatttcttactcggttctttggggtttgaagtaaatgattcaccactaggtcgagaaacacgaaattttgttaaatcactttttcttcatataatccattttgatctataaattggttaattatctcctaaccccaaaagttatagtcacatggctttaaatttcttaaaaacaaaacaaacaatatgatggcattcaacattgtttcaaaatgtagaaatgacttgccgtaaaatacacgcatagggcgagggaaattacctagtataaaattcaaaagtaaaagactaatttccattagaagcttaattaatgcattttttatcttcattggactaatgagcgagagactaatgttcaacatcacttcaaaagtagaaataacttaccgtaaaatacacgcatactgcgagagaagttacctagtttaaaatattttaaatttttaaccaaaaaaaaaaagaaagtaaatttaaaagtgaaagattactttccataagaagcttaaaaaattgcatcttcttatcttcatttgactaatgagagagccactaatgttgatttatagatatccaacaaatctactaatgctctcatgtacacacaaatattatttacatagtcaaaacaatatttatctctcaacaagagtttgtgacaatttgatctctcttcctgtaatccgacgcgacgttttcactccctctgacacaaccactctcaggtttttattctctcatcatgcatatgttccagtttgttcttgttttttgtcttgctttcgtgagttcttctagaagaaaattgtttgctttgatcttctgtgtcatcatagtcaatatgagccatgtttgaagttagggtagattttttttgttttctgataattctcttaaaaaccaaaatttcgataattcttaagatatgggtctgtctaccatttcgtttgactcttttgctgtaggttcatttaagtgaatcttttcaatg

SEQ ID NO: 2668 - DNA, 3000 bp, Unknown
  misc_feature (1)..( 3000): cDNA_ID_3099004_gDNA_ID_1620573_Annot_ID_160907 3000 nt of promoter + ATG
gctggtcaagttttctggtctgtgagtctttcctattgcttaaagcttatgctggtggagattgggaaaatgtattcctttgaagacatatttgaaaaggtcaagctccttctagatctgatcaataacaacccctcctttctatatgtcttcagagagaatagtcataaagtcgacgtatcctcagagtgtgagtttgttatgccgtatctaactctagagcacatttattgggtgaggagggcagggttgtttgctagtcctgaatggaagaaagaacaaggcatagcaatatccagttttgtgaatgattccacattttgggaatctcttgacaaaattgtgggaagtacatcttctctggttcatggatggttatggttttcaagaggcagcaagcatgttgcatatgcctatcattttatagagagcatcaagaagaacgtcgcgtggactttcaagtacgagagacagttttacgagccgacatggaatgtgatagatgacgtgtggcacaacaaccacaatcctcttcatgctgctggttattttctgaatccgatggcttactactccgatgatttccatacttatcaacatgtatacaccggtcttgccttctctctggttcacttggtaaaagaacctcaccttcaagtgaagattggtacacagcttgatgtgtatagatacggtagaggttgctttatgaaagccagtcaagctggtcagctcaatggagtctctccaggtgagtgaactttcttgattttttatatatatatagtaatattgttttatttgcagacatttaagtttttgaatctctttgcagttaattggtggactcaaaaggcgaaccagtatcctgaactgcagaatctcgctgttaagattctgagccaaacaagtgaaggtgcttcaaggtacaagctgaagagaagcgtagcagagaagctgttgctcactgaaggaatgagccactgtgaacgaaagcatctggaagagttggctgttgtacattacaatctccaactacaaagctgcaaagcctaaggaagtgaagagcagtgaagatttgttttgcatatgtgactccattgatcacaagctttagacaattcttggatcagagtactttttacccaaataagttccatatttctgtattcttgcaaggatttgcaaaaacatgagttcgtttagaacaaagaacacccaagagattgtgttgcaaatgatttcagtttttttagtcaagttttgtgatttatatatccaagtctcatctttatttatcacattttttgatatttcaatgcattattggtatcgttcaggtaaaacaatgatcaactatataaatatttagtttctactagaatcgaagtataagttccaaagtgaaaagatttaagacgcaacacaattatttcaacacaaaagtatatagcaccatgattttctgggaaagtgattctttactcgttggttttcaaatttcgaatataaaatttgaaggaaatattgaatatcaaaatgtcaacaaagaaaacaaaactcagaaaaaggaatcaggcaccagtccactaagctctgaccagaaagcgacaaaaaaatgtcttagtagttgtataaacatgtgataatgggatgcttcaaggtttggttttaaagtgagtttggttttatttgcttctctcctttttaaatcactttttactttgtcattttttgagagaaaaagacgtcaaaatccaagtgcccgtgtaaattgaaactagtgttacagattctccactgttctgttccacagtatctttgtcttgtactctgcccaattctctaactcattattttatttcatagcccataataacaagaaaaaatagagtcttctttttgtagttaagcattaaatgctgacacatatttgagaagtttttgaatttcaaattgagaaactttttctaagtttggaaaataaataagaggttttcttctcttgtactcttatctagtagtactatctagtaaggcagagagatagatattttttctgggggagaatctagcagaagaagcctactagggtttggtttcttgagtcacatagatcttcttctctatctgtctctcttggattcttcaatgttcactttcagtcattggaaaaaaaggttcgcttttgtccccacttctcttttctcttcgaattttggttgcagaaaattgattttggtcaatctttttgaaagtgtcaatctttttttgaccattgattttggtatattcttttgttgaagccaattagatatatttgttcgtcttttagggatagggtctttagcttcttccttctttaatgtcttgtcttttcaatggaagttatcattatgtatatttcaagctcaatatcttatctttcaatcaaattaccacaagaaaataaagaaattcgaccttcggattacacaattttttttaaactcctcaacaaatcttgaattgcatgttaacagactgcatatttgtttaagctgctggtccttgtgttaatctcgaacgaataactgattaacctgtcaaaacctttcagtgtgaaatgttgaccatgtgactggttttgccgtctggtcgtttttgaaaaggacatgttgctgcacttattttgtgtaaattataattagatttgtccttattagatgttcacaggtgtaacagtgtcttgtcttgcctcttcatcttgtacttggactccatgtgctgagaaaagcctttgtcaacctcaaaaatttgtttagtgtcttgtgcttagtagacaacaacattggtcttttcctctaaatgttatcttatctcatttattatgtgaatatgatttatgcagggactatgtaatctaactctttttgtacttgagagaagaagctgaagtacatttgttcatcatttggttttatagtattaataactgccaaactccagagctttaagatg

SEQ ID NO: 2669 - DNA, 2129 bp, Unknown
  misc_feature (1)..( 2129): cDNA_ID_2167611_gDNA_ID_1620574_Annot_ID_160924 3000 nt of promoter + ATG
aacatggagcaagtgtgctactctcctgagatattagaaacacaaacctattacaccatttcgaatcaaattctacaaccattactgattccggcggcgagcaaagccaattctgacggtgaagagaggcaaaatctgggcacgagcagccgcaaatttccaatcaaattattctcagccgatctcagacgccatgactggaacgggacaaaagcttaacatccgacgacgggttggagaggtaaattctttgtctttttgttgtttatctccgacaccgacaagcttagacgtcaaattcatagtttttctgttgtgttgtgttgatgattatttctgccttatattgaacattcaatacccttatgaatctgtgttctccttctgtagtgcacctgaagtggagaaaacaatttgaatgaagcagagatatttagttaaatctgatggtagtgtaggtgttaacggatatgtttgtgaagtgatgtgcgacgctatggctggaaatacgaagatgtcaccagtggtgactcaccactgagctccaggttcttcttctttcctctcattctctccccatctgctttccacttttttgcaaatggtcatacatcttttatttggcctatttttcagaaccggtgtgtaaatatgatagcaaacttgttccatgctcctgttggacaagacgaggctgttattagttgtggaattgttgcttcatctgagtctgctggtttagctttcaaaatgaaatggcaacataggagaaaagctcagggtctacctattgataagcctaacattgttactggagtcaatgttcaggtctaaatatttacttattcttatcctccaaaccatcacatttgctttggatagtgatctgtttctttcaaaaatcagtacattttcaaactttgtttcatccgctcaggtgtgctgggagaagtttgcaaggtactttgaggtagagctcaaagaggtgaaactaagtgaagactattacgtgatggacccagctaaagctgtagagatggtggatgagaattccatctgtgttgcagcgattctaggatccacatttactggagagtttgagtatgtgaagctattgaacgatctcttagctgagaagaatgcaaagacggcttgggaaactcctattcacgttgatgcagcaagtggaggattcattgcttccatgggtgaagagtatcaatgtcagtgatcataagtatggacttgtgttttattgttccgtgatcaccaagctaagagtcatcaacccacaaaccataagcaaccatatggttggtgtaacgacaatttgcctccaaatgaaatagtgacagtttcacaaatgccaatatagcttaatattaatgcgtaaagtgggaaaaaatatttttagtgtcaataagcccaaatatattaaacttttagtatatatattaaggggcccaaaatgtttttccctagggccctaaatatcgttgggccgggaccttactgtactacttaccactacaaccgcagaaagcagcccaaattccatgtatgtttcattttctacttcatagtcacaaactagcttgagagtcaagttaatgttgctgatacagagtctttcttttactctctagctagttccatatttgtctgtatgatggtgctaactgctaaaggttggactaggcgatttgcttcatctgatcacatgtacatgtaaaggcagatatatgtctataactatataagtatatattatgctaataacgagatcaaacgtgatcctttttttataacgaaggaattgcaaggagcttgcaagtaacgtttgtcaagaatctccaaaaaagataaagcgaaagataaaaacaacaaaaagaagaacgtccagaaaaaagaaagaaagagagagatataataatataagtaaagaaaattttaataattaatcaatctagtgaccatataagttattaatgtatgcggtcaagaaagaagaatatatatatatatatatatatatatatataagtttgagtaagagaagataaatgaggtgaagtcataagtacgtacccaagtcccaatattgttaattgtctctgagagttataatg

SEQ ID NO: 2670 - DNA, 3000 bp, Unknown
  misc_feature (1)..( 3000): cDNA_ID_3069096_gDNA_ID_1620574_Annot_ID_160931 3000 nt of promoter + ATG
tttaaccgatccgctccagctctttagacgggcctatatatagtgttccacccggctcatccgatttaagcaagaccagcatgcagttaactgccaaatacttaaaccaaacagataaatgagccccatgactgaaccatcaaagcccagaacacccagatcagctttgctctggcagggctgtctctcaagtcaatctacagacatttgcaaattttactcggaccactaattcttccttcactactattagtacaggaaggaaatcttatttcttgtaacaactataatctgtaaaggtgaattctggacgtgaaaaacagagcctgttgttcctccaaaaagtaaaccaaaagttgcagaaggaattaacacaaaagggtctgtgtaaaaattttctcaagatcaaatcatgctctcattcagtttttgggactactcacacgccgagtgatactataacagtagtaccagactctcagttgggaagatttctactcgtccttgtatctcttctctaattgctccaaacgctcaaggtctttgtggtacttgcagatgcggaagatgcacctgtcagtgaatacgagagaatatcagtaaaaaactaaacatacaaagttccaagtgagttatagttgaatgatgtaccagtagagaaggatcccagccgcacacagaaccccattcctctgagccttatagacctgaaacacaagtaaactactagtaagcaagctgaactgagacaatttagggacagggaactgaagctttgatgtgttgctaataacagatggaagacataacacatatcgaaaaggctcgggtagatgttttaggaaagaggtacaattggagtggtataatttcatcaacaaccaaccgccaacaagttcacaagaacagggcataaaatgaatacgacatcagttcctttctcacataatttatcaaagaaacttgtatttccaccacaagaagattccttgcagcattttatagctcttaacaacagcaaagtgatgctataaacgcgagctcagaagagatcaacaccaagcagtagcactaaccctgtgagtctctgaccaaatatgcaattggtaatgctgctactgagaactcaaatgttgtatgaactaacactcgcttcaattccagtatcaaagatcataagtgaaatgtttcatagatgaacttacggatttctcgtgacgatcccgctctgtagtagtgcaaacttcagatgagcacaatagcctatgctcattcttccagtaaatatctgaataaaccattaccaaaacaaaaaaaaggtaccaaaattaatcccaactcgaaaccttaattataatcgatccagacgaagaaaaagagtgggaaattagacgatctaagaaatagagagagagagagatagagaggcgattaccgaggagttgaaatccagcgaaggcgacgatggaagcggcaggattgagtatgagcgagataagtgatacgatgcgtttcttcaggagcattgggtaagggagagtcaagatgacggcgatcgctacctcggcggcaaccacatacgacagaatcagccattgcaatgccattattcccccttcttcttcttcttcttcttcttctagatctctcttccgatccaaaaacaatatattctgatttgtgattatgcgcgcgtcgaccacgtatctacgccgtgagcgtctgccggccggttttgactttttaaaaaataaaataattgatgggcctttttacggcccaattgttgaccatgtattgacttcattgccagacccactaattaacttccgtttcagaatggttcgtcaaaggtgataatcgaacttaaaaagtagctatgactcctaattacaactatgttaggaacttataccattcatgtataactcatactgtatagctaataaccaaactttatatagtataggttgtagaattaagaccaaatgcagaagagaaaacattattaggataacttttgaaataccaaaatatgatattttaagaaatgaatcgacatgtgaagcaaatcaagacattcaacgaagtctaaagttgatttcaaactttgaacaaaacaacttctagaacatataaatttgaaaaaagtatattaaaatgttaaaaacttatatacgatgaactctttggggaataaaatgttaaaactgtagtttcaaaataaaaataaaaatttgaagtttcatcatccaatacaaattacaaatacgcagtgacacggcagaggcgagcgcgtggcacacgacgacgtactcatatcacgtgttcaccacacagtgaccatctagagtctaattaggtaataaacctatgaaaataaagtaatatacaaactcgtcataatcaatcttatccacttaaattgggcctggcccatattagttctgcaactgtcatttatttaagtttggggtttctcgtacggaacaaactcccatttgcgtctctcttcttcttgctcctttctcttctctctcacgcgttgctgttgttgactcttatttctctctgggtttccttaaaccttccgctacaatcttctcctcttacatgcgagcttctccgattctcaggttttgatagcggcttaatactcgcaattatggatttcgcagccaagaaattcatcaacaaccccaacggttcgttcttcttcgtcttcctccttccttttttttcttgcgtttctctgttattcgcatccccgacattttactttctccggcgtagattaggtcgattagaattgtgaacgctctggcgaactgttgacctatgttaattttgtttcccgattgtgttactgtttgcgaaatgatttgcattgcgagtctcttgctcataaaattcgccttggtctatttatccacattttccccccaattttgttctggatcctcgaaaatctgcttcgtcaccgttgtgtttcgttgcatg

SEQ ID NO: 2671 - DNA, 3000 bp, Unknown
  misc_feature (1)..( 3000): cDNA_ID_2167630_gDNA_ID_1620574_Annot_ID_160929 3000 nt of promoter + ATG
tctacataccgaaatggaagctcttctttgggcgatgaagtgcatgattggagcagataaccagaacgtagctttctttacagactgttcatgtcacgtatgtaaacaatatcccggattgactcttttgagttttaatttatatcggttgaaaaaaaaaaaaaaaaaaagataaacacatttaataaaaataaacgaaaaaataaaataaaaattggcattattatttgcgcattggtggcgttgataatgggatgtccaaggaggagggaagcgccgggattgcagcataagcaaatttattaagacgaagaagaagaagctccattagattttgcagaacaaatcaaaagaacttcaacaaggaatattgcaagaaattgattgaagctgctcgaattagatctgtaagtgaaaatgattgctcgacttcgaattctgggttttttgttttgttttttatggggtaatattcatgagagaaggagaatatgcttttgttagggttctgtctaacgaattttcgtactagtcactaagttgcttaattttatctttctgggtttttgtttggagggaggaattatttgagattcgaagaaataaatcatggagtttctgtttgtgtaaatgtttctcaggttttgtgaaaatttgtttctagagatttggggaaatggaggattcgagctctatcgattcgattttggaatttttgcggaagaatcattttatgagagctgaagctgcgttgattagtgagctttctaagaaaccaagttcaaatgggtctcttcaaaagcttaactttgaggataattgtgtgagcaagttgttggataagaagaagcaaggcgggagtagccaagcattgggtcttcacaacgatagtcacatttctgatgaattggttgtgaaagagatacaatgtggagctgccaataacttacacgagagtaatcttatgaatgatgtttctgttcagacacaaagtggtaatgcagatttttgggaggagagattcacgtttgctgaaggatttgaggataccgagctcgatttacctccctggaaccatacctctactgatattgtagctgactctgaggaatacagtatcaatccaagtaaaagaggctttgtgaatccacggagttcaaagcaatcaagtcatgaaaaggttcctgaacctggtaaaagcaataaagtggttgtggaagacgtcttctcttcttttgagaagatacggactggaagctctagccaggtatctcagtatgaccatggcaaagcatgtcaatctctggaagttgataataaggttgggaactctgcaatacaagaaggattcgtcaccacgtcatggtcaagaagcgaagagaacattggtgcttcaccagaccattggaaggattgttctgttacaactgtttttccgttgtccaaaggaagcacgtcaacaaaagataatggtgtagccattttagataaatggcaaggaaagaaactggttggcgcgagtgattccaggattcttatcaaggagcaggaagatgatgtggcaacagcgctataccttgggaagtcacagtctggttatgaacataagattccaagcagcttagcattttcgctggctcatgatgctccgagggaagatttacctagactgccacatgtaaaaatcaagtcagaggataaactaatgaactttacttgggaagaaaaacacgagcgagacatattggacgagaagctgattaatactgataatgctttcctattaggctcttatctagatgttcctattggacaagaaataaattcatcaggttagttgacatgatgatggctaccatccaaatcttaaaactttatgttctgtatgagtaaattatgttaccattggctagcttttgcgtacaccttttcttttgttttttgcaacctataacttaccttttctattgtgatggtgtcataggtggcaaaatggctggtggaggaaactggttgtctgtaagtcacggaatagcagacgatgcatctgacttgatttttggctttggcgatggcttaggtgctctcaatgaacattcaaatgagtattgggactctgatgaatatgacgacgatgatgatgttggttacattaggcaaccaattgaggatgaggcatggtttttgggtcacgaagtcgactatcctagtgataatgagaaaggcacagagcacggaagtgttcctgatacgcaggataaaagtcaaaccaagaatgatgatgatcattcatttgccgaggaggattcttatttctccggtgagcaatatgtactcgctaaaggcattgagccagttactgcttccaatgatccgatgggtctctcaatgactgaaacatacagcacgaccaagcaagctgatttggttgctcgatatgacgggcaattgatggatgcagaggagctaagtttgatggacactgaacctgtgtggaagggatttgtcagccatgaaaatgatgtaattttgttgaagaaagggaaagtcgaggacaactctggtagaatctgtcggaaggatatccgcgcagaagatgatcgaaatgctgcagttaggtcaattggtgtaggaatgagcgatgatgttgatgacaatgggagtataatacctgaatactttcctggagaaggtagtgaatgggatctggagctccttccttatcgcggagttggagttgctggtgttaagcctccacctggtaaaggtgcgagtatgctgcttaaaaactttgcagatggtggattctcatttccctctccagtagctgatagacagaagtcccaggatgattctgcaaaccctgaatggtcaaaccattgcgatgctgttgtgagaaatgaaagtgatgaaccaaaggggctaatccagtccgatagcatgattgtctcttcgacaaaaagatgcagtggctcttcttctgaaagaaatttaagagac

SEQ ID NO: 2672 - DNA, 3000 bp, Unknown
  misc_feature (1)..( 3000): cDNA_ID_2167620_gDNA_ID_1620574_Annot_ID_160926 3000 nt of promoter + ATG
tatcctgcgtatcaggaacacttccgtgctctgtgcctttctcattatcactaggatagtcgacttcgtgacccaaaaaccatgcctcatcctcaattggttgcctaatgtaaccaacatcatcatcgtcgtcatattcatcagagtcccaatactcatttgaatgttcattgagagcacctaagccatcgccaaagccaaaaatcaagtcagatgcatcgtctgctattccgtgacttacagacaaccagtttcctccaccagccattttgccacctatgacaccatcacaatagaaaaggtaagttataggttgcaaaaaacaaaagaaaaggtgtacgcaaaagctagccaatggtaacataatttactcatacagaacataaagttttaagatttggatggtagccatcatcatgtcaactaacctgatgaatttatttcttgtccaataggaacatctagataagagcctaataggaaagcattatcagtattaatcagcttctcgtccaatatgtctcgctcgtgtttttcttcccaagtaaagttcattagtttatcctctgacttgatttttacatgtggcagtctaggtaaatcttccctcggagcatcatgagccagcgaaaatgctaagctgcttggaatcttatgttcataaccagactgtgacttcccaaggtatagcgctgttgccacatcatcttcctgctccttgataagaatcctggaatcactcgcgccaaccagtttctttccttgccatttatctaaaatggctacaccattatcttttgttgacgtgcttcctttggacaacggaaaaacagttgtaacagaacaatccttccaatggtctggtgaagcaccaatgttctcttcgcttcttgaccatgacgtggtgacgaatccttcttgtattgcagagttcccaaccttattatcaacttccagagattgacatgctttgccatggtcatactgagatacctggctagagcttccagtccgtatcttctcaaaagaagagaagacgtcttccacaaccactttattgcttttaccaggttcaggaaccttttcatgacttgattgctttgaactccgtggattcacaaagcctcttttacttggattgatactgtattcctcagagtcagctacaatatcagtagaggtatggttccagggaggtaaatcgagctcggtatcctcaaatccttcagcaaacgtgaatctctcctcccaaaaatctgcattaccactttgtgtctgaacagaaacatcattcataagattactctcgtgtaagttattggcagctccacattgtatctctttcacaaccaattcatcagaaatgtgactatcgttgtgaagacccaatgcttggctactcccgccttgcttcttcttatccaacaacttgctcacacaattatcctcaaagttaagcttttgaagagacccatttgaacttggtttcttagaaagctcactaatcaacgcagcttcagctctcataaaatgattcttccgcaaaaattccaaaatcgaatcgatagagctcgaatcctccatttccccaaatctctagaaacaaattttcacaaaacctgagaaacatttacacaaacagaaactccatgatttatttcttcgaatctcaaataattcctccctccaaacaaaaacccagaaagataaaattaagcaacttagtgactagtacgaaaattcgttagacagaaccctaacaaaagcatattctccttctctcatgaatattaccccataaaaaacaaaacaaaaaacccagaattcgaagtcgagcaatcattttcacttacagatctaattcgagcagcttcaatcaatttcttgcaatattccttgttgaagttcttttgatttgttctgcaaaatctaatggagcttcttcttcttcgtcttaataaatttgcttatgctgcaatcccggcgcttccctcctccttggacatcccattatcaacgccaccaatgcgcaaataataatgccaatttttattttattttttcgtttatttttattaaatgtgtttatctttttttttttttttttttcaaccgatataaattaaaactcaaaagagtcaatccgggatattgtttacatacgtgacatgaacagtctgtaaagaaagctacgttctggttatctgctccaatcatgcacttcatcgcccaaagaagagcttccatttcggtatgtagaggagataggcttctacgaacgttgacggctcccatggttggcgactctccaagagatgatagacagaaccatcctgttcctgagaactggtcacttgctttccaagatccatcaataaaacaccgatagccagaaaaagttgtatcttgtgatacatccctcacccgaattcgattatctatagacaaagaaccatgactttcactatggagctcgaattgagcttcctgccacgattgagcctcttttaccgctaaaagcaatatttacgcctgaaggaattctccaaaacaaatgtgtttaccttctccaaaatgtgtttacctttggatccatggaaaatcattagttttggtgggaaataaaaaagcaaaatgacacttttgccaatttttattagactgtcctaaatttatcacaaattttagtttattctttacaatattgcacgtggtttttatactttttgctgtactttttcataacgaattaacgagtaaaattaaatatggcgtaataattaatcaataaatatttaccggttatgtagtttcgaattcaaattcgaatgttgttgaacattaaacaatgagtaaattctttcaatgttaatagagcccattaattatttatataggcccaataattaggcctattcagtattcacgatccttggcagaaatatatagcggcacaaaaaaaatacagaatcggttttgttttttccggtggatgtaatg

SEQ ID NO: 2673 - DNA, 3000 bp, Unknown
  misc_feature (1)..( 3000): cDNA_ID_2167626_gDNA_ID_1620574_Annot_ID_160928 3000 nt of promoter + ATG
ctagaacgagttcctgttggatggcagcagaatccaatggttcagatgttgtatccacctgcataatccaataaatagaattagaccttacaatgtcaaactgctattaatgagaatatcaataatgccagcgattaaagatagtggggaaacaccaaacgacttgtgacagtaaacagtacgtaatgaagtgattcatcaacccttatcagttagcaccataaaataagaacctgcctatgtcgcttgctgcaagcagaagaaagagcctggatcgcataagaatacagcctcctcacttctgatactttgaatctggagaactccccttgaacaacacataaaaactccctccataatttgtagcttgcggaattctgcataagtgccttttcccacctactgattagtacatcagcgttgtctctgcttcggtatgccttgagcagagcaagcaacagttcttcgctatctgggttcagctcaaaagccttctcaagtatactaatctttttctctaaagtctgcaggcgaactcctttctgagattgcatacttgaaaccttgtcttgaaaatcagcaaatgccagccatgcctttgcatcatggggacgttctctcgtcactctgttgaactcccgtgttttattcagcacttcatcctcccatgatgctccaatcattgagtcctttgataaaacatcttcttcgtcactttctggaacagtcacgtcttcctccagtggaatgaaattatcaaaggaagaatccacagcttcacttgcagcagataaacgaatacgcttgaaattcttgttgcgttccatggcagcatgttttgcataccagtatcgggtatcagactttgctctcccctccaaagaatcaatatcaatctctgtgtcaagcatagaactacgtcgattccgcaaataaaacctcagagaacctgaccctggaactctctgagaattgtcaagtttataacgaggaacattcatcctgtattatgcaaacagaagcaaaatttcaatatccctacactcttaaaacgccttgcacagaatacagaaaatgaaaccaaccataactagacaaattataagcaaagtacctgtaaatagagccataagccagattatctggatcaggacgagtgtccaagtaataatccttcacaggtttcgaatagtattcatcagatttacgagaacgagattcatccgaagcattatcactcttccgtttcttctttttctctcgcttcctctttaccttgtcgtcatcagactccaaagacccttcttcttcaaccaaattataaaccctagcctgattagctaaaccgatatttccatcagctcctccttcttcatcttcgtcgtctccagcctcgacctcggatgaggaaggagccgtcgaagcggcagcgttgatgacagagagatccgtagtgaagctagcgttgcgaagccattgaggagcattcgaaatagctgagatggagttcgccgaagtagggaagacggggaacaagccgcctgtagttacctgtgctccgtcgccgtcttctggtgtattcgacattacatccaccggaaaaaacaaaaccgattctgtattttttttgtgccgctatatatttctgccaaggatcgtgaatactgaataggcctaattattgggcctatataaataattaatgggctctattaacattgaaagaatttactcattgtttaatgttcaacaacattcgaatttgaattcgaaactacataaccggtaaatatttattgattaattattacgccatatttaattttactcgttaattcgttatgaaaaagtacagcaaaaagtataaaaaccacgtgcaatattgtaaagaataaactaaaatttgtgataaatttaggacagtctaataaaaattggcaaaagtgtcattttgcttttttatttcccaccaaaactaatgattttccatggatccaaaggtaaacacattttggagaaggtaaacacatttgttttggagaattccttcaggcgtaaatattgcttttagcggtaaaagaggctcaatcgtggcaggaagctcaattcgagctccatagtgaaagtcatggttctttgtctatagataatcgaattcgggtgagggatgtatcacaagatacaactttttctggctatcggtgttttattgatggatcttggaaagcaagtgaccagttctcaggaacaggatggttctgtctatcatctcttggagagtcgccaaccatgggagccgtcaacgttcgtagaagcctatctcctctacataccgaaatggaagctcttctttgggcgatgaagtgcatgattggagcagataaccagaacgtagctttctttacagactgttcatgtcacgtatgtaaacaatatcccggattgactcttttgagttttaatttatatcggttgaaaaaaaaaaaaaaaaaaagataaacacatttaataaaaataaacgaaaaaataaaataaaaattggcattattatttgcgcattggtggcgttgataatgggatgtccaaggaggagggaagcgccgggattgcagcataagcaaatttattaagacgaagaagaagaagctccattagattttgcagaacaaatcaaaagaacttcaacaaggaatattgcaagaaattgattgaagctgctcgaattagatctgtaagtgaaaatgattgctcgacttcgaattctgggttttttgttttgttttttatggggtaatattcatgagagaaggagaatatgcttttgttagggttctgtctaacgaattttcgtactagtcactaagttgcttaattttatctttctgggtttttgtttggagggaggaattatttgagattcgaagaaataaatcatggagtttctgtttgtgtaaatgtttctcaggttttgtgaaaatttgtttctagagatttggggaa

SEQ ID NO: 2674 - DNA, 1490 bp, Unknown
  misc_feature (1)..( 1490): cDNA_ID_3069156_gDNA_ID_1620575_Annot_ID_160936 3000 nt of promoter + ATG
gatctgtcttctttgatttgatctttcttattttttcgtgaacaatctctaaaatattcccattaaggcattaaccatgtgaaaacacttgtacgtgtggactatatagttcacgtgtgtatgagtacgggagcattgaataattatcgctacggcaaccacaaataaattgatgtgaacaacgctgaatactttccatttttcaactttgtctagtaaaaaattactaaaataatgttccaattatggtttttagtgaacatcttattgtcattggtgattcgataatagatgctacgagacatgttatttgttcttggaagaaagaggtacgtaaattctcaaaagggtctttcagtgtaaagaggcagctttgactttgctaacacaaaaagtctccatatgattattttctttttcttttcagaagttaatattctcaatttctcataaacattttcaattctttcttttgttattggttgaataattttgttgagttttataaatgatgttttaatgtgaaaaccaagaaacaattgatcatttaattagtttcttgattagtgtgctaaaaccttaaacatcaactaagatcaaaaagagattaggtagttgtggtcaaccacctttgatgataactttctcatttctagttttctaactattttgttcatactgccttttttttttccttgtactcgtagaacactttttatttacttactatcactttgtagtactcttcacaaaacacttttaagttttctctaaaaaaaactatgagtgtaaataataaaagtatacgtactagcgttaaatggcgatatttgtaaaaatagttattgtactatttgtatcacaaaaattgcaagtagttgattcaaatggtaacctatctatagacgaattggtaccaatcgtcaccaaaagaaatttcagttattactactcattaatccgctaaaatccaagatcaataattcactaaattctgctataacattgtaacattgttgctatcaataatcaaattattctattagcatataattattagatccacaaaacttatctactagagcagaagattccaccaaaagttgcttccgacccacatatccaattctttaggacaaaaatatttattacaatcttttaagaggaaaacaatgtaacatggacaccaaaataaagccgcctttaacggtgacggtaacggtaacggcgtttgagtgctcttgacaatacatgaaaatttagtaatagagttaagaaatgaaattaatagagtttggagtgagacaaagagagaagagaagattagagagaggagaggaagggtcaaagaatacatagcatcaccactagtcaacgcttttataaaacttcttcttcgtctcctctccttctcacatctctctctgtctttctctctcaaacctaacaaaagcttcagacttcaattctttagctacctctctcccatg

SEQ ID NO: 2675 - DNA, 3000 bp, Unknown
  misc_feature (1)..( 3000): cDNA_ID_2048995_gDNA_ID_1620575_Annot_ID_160971 3000 nt of promoter + ATG
caaaacaaaaaagcaacaaaaatatgtttaatcaattgagatcacaataatcttcataatatattaagcctattaaaatttcctaatctaaggaattaatcaagatgtgaagaaatttcaaagtatatttacgttggtaatttcctaggttcagtccaaaaaaaattgaactcatttttctagttaattaggtctgactgatatggatttaattaaaagagctgagttcgatattatcgaattctaaacttcaaattatttgctacaagttatataacatagttattgatattttgaaaattaatgtagtattacaaactcttttcttcggaaaaagatatatgtaagaaattaagaaaatatgaaatgtcaatacaaacctagtataagaaccgtgaagacaataagaacagtaaacgagagttgaaaggatttgatcatcgtaaatgatagaaatgaattgatagtactttgaaagttacaaaagaaaaccaattgtagttatatataataaggaatatgtatctcacattcaaacacatatatctattttaagatttttactactttgtactccgaattaaaagatctaccttgactcaggttccaggttttttgcttatatgataagtaaaagtgtcaaactcttatttcattttttattaaaaggttgtaacttgtaagccaaaaggctcgataataacatgtgatattattattattttttaacgacttcatttcattgatagaatcaatgatcataatacaaagttgatgttatgaaagcgggtacatagtagtgaaatttaaaactctgatttggttgaagatgatgctttgcgaggatatctgcaggttggttgtttgttcttggaacccatttgaagacagcctcctcaaatcgtttttgccaaaatctgccttctcttatccagttgaatcttccaaagtttagcttttcgttgttcataagctcttccacttgtttactgtccccttcaaagataactttgcgatagccttggctccaagcatgttgcattgctataatcaaagcctgaaattcactctccaatgagtctgatgttgttgatcctattgcttgacccgaacccatgtatactccattctcatctctcattagccagccagctttcgcatttcgtgtttggtggttgaaagctccatcataattgtactttatccaagtgcttggcggccgttgccacttcgtacgtgccatagttggttgttgatgtcttgatgaatgcacttgttggttgagactctgaacataagtgtttgtgtcttcccactcttgaacatcattccgtgcacgttgtagggtgttttgccatgatatgcttttttgttgaaacaccaattgatttctgctcttccatagtctccataagatccagatggccaaattaaaaagttgtggttgtctgttggctaaacaactcgataacagcagctccatctttgtctccattgtaattcctgtagttcgtaactcttggtgtggtatccctgaagctcgccaaacctgttgggcataaaaacaatcaaagaataagtgttgagacgtttcgtcctcttggcagcaccggtgacattgcgggtgattccgtatatgtcttcgttttagattgtctcctgtggctaaggctcctgagagtagcttccagaggaagtgtttgatttttggcgccgttttgagtttccatatcttagctttaatctctgcttttcctgggggtggttgaatttctggatccatgaacacttggtttgctaaccagtaagccgacttgactgaatagatcccatcttcagtgtaatgccagcctagaaagtcttgagtagccgctgtacataacttgagagacaaaatgatttccgcatcttcttctgtaactagatcgcgaactaagtctctgttccattgatttccatgaagaatccaattgttgagaagacagtgttccacttggttattctttggtttcggtggtcttggagggtgagttggcaaccaagggtcgatccaagtactgactgttgaaccgttccctacatgtgatattatttatcatcgaaaatttgaagcagtacaaagaaataacaacttggtattaaaaaaagtggaaagaaaaataaaaattaatataaaataataagatataactatttttgaaaataggtgtaagaaattaaatgtatattaattagtcagatcatgtaacaaaaatataaattaaatataatatatttacctaataatagagaagaaaatattatgtaaaattaggtatctatagatttgtattcattaaattatgcttaagagattgatcgataagtaattctaaacaatttcacaaaagtaaagtgttataccaaattaatagatatcttctaggtaatgcattcatgtataacgttatatctattttatatgatatttacattttagcgcaaaaaaaaaaagaagaagaaaggaagcataaaatgtaaaaagaacaatcgaaatcagtttttaattatctgtattttgaaagttttggcatatgagtaaacaagttttatcatatactaatttaagatattatgttaaatatatggttcatttatttacatatatgaattcgagatatcttaaaccatatatatacttttctaaaatctataataaatgtaaaaatcttgataacttttgtaagattagtttataattttttatattataaaataattatttgtatatttatcaacaagttaataatatatttatatatttttcctttttcactaaaaggaggtctaaattggccagcatgtttgacaaatgtcacatgtcactatgtcagatttagattgatattagctacatataaatacttgttcactactatataatgtgttagatttatcgtgttcataagatacatcgaaagcacatatacacgttgaaatatcatttcatataacaaagct

SEQ ID NO: 2676 - DNA, 3000 bp, Unknown
  misc_feature (1)..( 3000): cDNA_ID_3069112_gDNA_ID_1620575_Annot_ID_160966 3000 nt of promoter + ATG
tgtcactgatccacttgacgacgacgcgaaggctcggatcttgagcagccacagttacatcctagaccaagattctcctcgactctgcgagctcgtacacgggtttcttgaggatggtcctgaagagtcattctacgactctgaccccgacctgtctgagacttcttcagctgaacattctggtgaagctagtgtggagatcgtgagaatggcggtgagcttctccgattccgatccttaccggaatctattgctagctcacgttttgagagccgtggaggtatattccggttttaggtcaaggaacaaaactgttttccgggataaggtagcttcgtttctgcgagagcttggtcacgacgccgcggtttgtgtatcaaaatggacctcttcatccaaactcatcgctgggagttaccatttcattgacgtcgttcacaagccgtcagataatgatcagaaggccgtccgttacttggttgatctagactttgcttcggagttcgagatcgcaaggccaacgcgcgaatacacgcgtgggctgcagctgctgcctaacgttttcgtaggaaatgaagagaatctaaggacgatcgtgagagagtcatgcgacgcggcgaagcgatcaatgaagagccgtggcttgtctcttccaccgtggcggagaagctcttacttacagcataagtggtttggtccgtacaaaagaaaggtgggatctagtttgggagtgaagccgttgaatagtgacgccgttagttgccgatctttagggtttgatgacggcgccgtcaatactcgtttgttcatcagggcatgatccatatgcatgtggtatgaagtagactagtataaagtgtaggcgaatagctggagactacacttctttttattcaatctgactgactatgtatgttctcgtttaatattaaaaaaaaagatttgttctaaatcagtaacttaaagactaatagaggtcaaactattaatcagtatcttatcattaattagaccaaaatgtaaaatacttaaatgtatcaatcaacctggattatgtggcattcatttgcaatgaaatctcgctagtaatgttgatgtgtgatataaaaaagaatatgcaaatgaaccataacagtgtcagttgacagttaatatgtgaagaaagaaaaaaaaaatatgagtttagatcatcaagatcggaggctagaaaaaaaaaaagatgggaggctagagactcatatgtcaagctttacttcttatactttttaattaaacttccaaaacatcaaggtcctttcattttcaatttgacttctaactttattccaaattttgaccgagactataggaagtcaaatatgagtttgtgagttaagtttgagctctcacaaccgctgggataatctcaaaggtgaatatcttaggtataattattttcatccgagtgcttactcacatgaatttgtgtctaaaggttttgctcggattttacatattttccgctacatcatatttcaccgtcggataatcctaaaaataatttggagaccataaagatttttgagatagcttccaatgcaatgagaatcaaacgatcacttttgactaagactttaggaggtgatatgtgagtttgtaagtcagggctctcaaagctgaatatcttaatatatgtttcaattatggcaactgtccaaatgagcgaaatgaaactttcatcccaatgtagtactcatagaacttagttaatatacgttttgcttgcgttaaattttcttaagtaatgagaatttgccgtttatctagaaattacctaaacgccgatggtttttggttcattcggttgggtttctgaatctctcagtcgaatatcccctcaaatgtactaacttgtatagtttatgtatcccattgaacgggaccttaactgctttatgtatcataaaccctgaatattgtgcatttcaaaatatatttctgaaattatttagttttggctaatcgtttccactctataagactataactactgttgatacgagattctcatcagattgttcatgtttgatcaatcagtcatctagttttgtgaatcgcttttttttttttttccttttcatataattttgtaaatattctcttatatatatttttttcaactttttctatttaaaattaataattattcaaaaaatatcatgtaagttacaaaaatgtatccagattctttttgtagtgataaatattaaaatcaacagtttgttaattttaaaataacttttgattttagttttaattattgttttttaaacaaactatctacaccagtaaaatacctttttaacacaccaaataatatgagattacattccaaaagtatacaatgttttgagtcttgactaaaaaagtataaaaaaaagaaaaatctctgtttccttactctattcttaaaattagttaatcaatgcaatttttgggccattgggctttagaaatattgaagtattccattatactctttcgctgaccggtcaaaaagctttaacgctcgaaggccgccgcgtcttccaaggcattgaacgtccctcctccacgccttctaggttctttcgcctccacgtaaaacgtcacccctgacgtcacatcctctagaacaccacgtgtttgtcttaaacacgacgagtaattacacatttggtcaaactcaaaccaacaaaacactttttaaacaaggctaaattggtcaaacgcatggcaacgaatctcaggcgttttttcgttttctttattattgacttatttttatttttattttattttgcttctttgaaatcttccccggcaaggcaaagcaaacgagtggacgtttttgaagattcgttaatttttctctctctctttataatataagaagtcgcctactacgtagaaccaaaagagagacaaaaatacactttcattgctgtcttaactctaacggagttaactaacgtcgacatt

SEQ ID NO: 2677 - DNA, 3000 bp, Unknown
  misc_feature (1)..( 3000): cDNA_ID_3069116_gDNA_ID_1620575_Annot_ID_160965 3000 nt of promoter + ATG
gaatcatcatgtataaaacgtgaagctaaacttattagtttaggcgatgaagttgatatatctcaagtctttcactgcaacggtttattgttattcatcagcatcaccaaagacaagactaggctagtggtttggaacccgtatgattggggacatacccgtacgatcgaacccacacataactgccacatattcaataggtataatatatgtatgctctcggatacaacaagagctagcagctaatcccacaaaatcttgaggtttgttacttactggatgagggttatggatgagttcataatctacgattttaactctgattcatggagggttcttgatgtcactccagattggacgataagttatatgaaccttggcgtgtctctcaagggaaatgcatactggtttgctactgagagatattccgaaacagacgattatttcttagtctgttttgatttcacaagagagacatttgggcctcttttgactcttccgtttgtgtttgttaaatctgaagatgttatgtgtgtatctaatgttagagaagagcagcttgcggttttatatcagccgtgggataaataaaagatggagatctggattacgtctacgattgagcccaacgcggtgtcgtggaacagcaaggtgttcttatcagtgagtataagaaaactcattggccctccgtttcagttttgtttggggagtttcttcattgacgaggagaagaaagtcgctgtggtttttgataaagactacaaagataagcgcaacatagcttacatcattggagactttggagtcgatggatcctttaaagaagggatctcggagaatcagcctacgcaatgtgttacccacttatgtgctcttatgttccaacttccaagtctagtgcaatttaattagtcgaccatctacttcttgcatatttttgctcgtttttttttcctacctaaccatctagttcaaacattatcttttgctaaagttgggaagtgtggtggaaatgtcttctccttttttttcttgtaatgagtcttgtacggtggtggttatatcgatctacgtcggttgtgttcccctcggtgatctcgacctcagcgtaggtggcgatcaatgttggaaatgaaaattcctcctctggattatcagtctatcttttattggtatattgccatatatgtcttcatatggtattctgctatctttcaatgaacatcacaaaaatagtgatgcttaatgtcttcatatgattcccctaaagttagtgcttttgtgttttgtgtgacatatgggattgtcatatatatttcgaatctttttcgtttgttacacaattaattgccttaaaaaattcaaactattaattaaaaagaaaaatcagataattaaaattcagtggcaactattgtaaataagtaccaactccaagatttatttcacaaaatggctgcaaaatgtatatgtagatatttagcttaaggaggagtctaaatttaactttagaatttttttagaatataatgtatattagagtaaaaacatttagaatatacatataaggattaaattatattgtgtattattttttactgcataaaattgatttgtaattttgagaaatataagataaatttgcaaaaattaacgaattggaagattgttttgcaaaaaatccaaatattttgatataaattatttgatctattgttaccatatatttttgaaccatttaatccgtatttttccttgaaatgtgtttgatatggtttattttgcataaacaacttgatttgtgaatttcattttcctatttgaaatctctttactatataactagccttgttgggcgcgatccacatatgtattatatgatacttttgctcattagttaaaaaaaacaaaatgaatagttattagtcaaaacccaatgtagagatattgccgacgtagtcaacacatatgaatatgatatgatcctgcaaaaaattttaacgacgttagaacctaaagaacatatgtgttctggaaccacctttctgtcacttaactctgtcatcacctttcgaataaatgatttaaggagttctctagaagactagaatcttccgtaacctaaaactcaacctcatgtagaaagactcacaaatccaattcctctattctcctgcgaaaaacggtttctttatatctctcacgatttgatttcctcttcgctttttttaattgaattgagattgatggatgataattttaatttcaagatttttttgttaatcttgtaatggaaaatattaaaaataattgcttcaatattgcaaagctttgatattttagaaaacaattttatttaataaaagtgatatatatatatatatatatgttatagtatattaaaagtaaattagatttaaaagaaagtgagtgtataagagacaaaacacgaaaaaaaaaatatgattgaggatgacaaatggattataatttcatatatatacataatgaattcaagcttgtaacttatgaaaatttagggggataattaatactcaattctagatttatttatttgcaacgtatccatctatacctagagaatttttaataatttgtaagcaaaaaatcttgaaagaccacaaatggatttgaatttgttctggatttgtactgtgataatccattttgctttgcttgattagtttttactttttaccattggtaataatttgggatcatgtttagttgtttactagataaccaattttgttgggcctgatccaacaattttgccgattataaagtaaataagtgaatagttaagcccaatataaatttacgagtgacggatcatctgtgttctcgaaccatctttttaacgaactctctagaaccctttttctttttcacccaaaacccaacctcgtataaatctcaccaatccatttcttctcttcttctttgcgttttttgtttggaactgaatcgaaaaag

SEQ ID NO: 2678 - DNA, 3000 bp, Unknown
  misc_feature (1)..( 3000): cDNA_ID_3069124_gDNA_ID_1620575_Annot_ID_160962 3000 nt of promoter + ATG
tttattaatatttttacatctagatttggggtttgagttttaaaaaataagattaatgatgcaaagcttatcgaatgtccaaaataccacatgtagagctgtttgtaatggtttgagcgttgtagagaaagcatgtcatacatacataattatgtccatcacaaggatgtcatacatacataattattccttgaaatctgaatattgtggaatgagttgcagcgtggaatcgttgttcgtaagaactgttcatcgtaatcacatatgcgtagttaagtatcattataataattaataagaatagattacatatataattcaaaaaaaatcattaaagtagaatgatataattgtgaagaaaaaaaagtataaaataaaattttagttgaatgaaactatgtttgaattttatttttttaaaaatctttgattgattgaattcaattttcgaacccaaaataacatatcgtttaacacactttgatatcttgaattttaatttatataactcttattttctttctttagttatttttcccttattctttttccagtttatctaaacaaaaggtaattaatttcaaaattcgataaaccctactatttgacatcttctacgaacgggcacaccggagaatcagcttctcgttccgtacgatgtcggcgacactccgacgcctcattcttctcacctccacaaatcgctcccgtaatctatctccgccgtttctttccaccgccgtgaaccacctatctctatcattctcttccgtctcatcttcaccggaatcacacacttccccttcccggatccgaacccgaacaccactcgaaactcaattcgaaacatggattcagaatctaaaaccaggattcacaaactccgacgttgtgatagcgttacgagctcaatccgatccagatctagctctcgacatattccgatggacagctcaacaacgaggctacaaacacaatcacgaagcttaccacactatgatcaaacaagcaatcaccggaaaacgaaacaacttcgtcgaaacgttaatcgaagaagtaatcgccggagcttgtgaaatgagtgttcctctctacaattgcatcatcagattctgttgtggtcgtaagtttctcttcaatagagctttcgatgtttataacaaaatgcttcgatcagatgattcaaagcctgaccttgaaacttatactttgctactaagttcattgcttaagagattcaacaaattgaatgtgtgttatgtgtatctacacgccgttagatcgttaacgaagcagatgaaatcgaatggtgtgattccggatacgtttgtgttgaatatgattatcaaagcttatgcaaagtgtcttgaggttgatgaagctataagagtgtttaaagagatggctttatatggctctgagcctaatgcttatacttatagttacttagttaaaggggtttgtgagaaaggtagagttggacagggtttagggttttataaggagatgcaagtcaaaggaatggttccgaatgggagttgttatatggttttgatttgtagtttgtctatggagaggagattggatgaagctgttgaggttgtgtatgatatgttggcgaattcgttgtctccggatatgttgacgtataatacggtgttgacggagttgtgtaggggaggtagagggagtgaagctcttgagatggttgaggaatggaagaaacgggatccggtgatgggtgaaaggaattacagaacgttgatggatgaggtttattttttgaataagggatgattgattgggttctgtttatctgaaaggcgatcaatcggctaagcttaagggctacaagatggggggggtttgttgcaaagtctgtgttctgcactctagttagtgaaccccaaatctcagtaatgatctgaatcataagggttatcaagttttgagcttcaagattctgtgttcttgagatacataacaggttgaagcatagtgtgattggaagactgaagatctcaagccatgatagcttagagatattctgtaattgcaatttgattcaaggattcaaaatcatgttgtctttgtatcatgttctgtgtaaatgaggtcttatgacaatcaaggatatcaattgttactgacactacttgcaaaccaaaagctgttcagcatgattcttaacgcccttttgtgtattattactgttgatgcacaactataacatttgctgttacaggatctacattttcagacaggtcacaagattcttatgttagctcaatatctcatacgagcattggttacagtttattctattttaatgctctagatatatctctttgtggttttattgattctgactggattctgcatctttataggggattctcttgttttttgggaagtcaaagaaacagtccattatttctcgcagttcttctgaaacaaaatacaaagcaatgactcatggacaatgctgcaattatttctactacacattgctaagaatcatgtttcccataaaagaatttgaacacattgttcttgaatgcattagttctgatttcatgaaaactttacatgtttgttctaaaaactccattttggttggaaggtttaaaaattgatttgtaacatatatcgtttctggaagcttataagttattagaagatgataatggtcatagttacgttttctagtttgttcaatgactctggagtacacatttgttcattcaatgaaactgaaacaaaggtacaaagtacaatgtgaatgactccgtgatctgccgcttaaaacacgttagttttttcttcttgggacaccgcttgaaaacacgttaattaggtgaatctgtggatacacatatgggcttaatggcccctatatataatacgatgataggcccattacatttagttgtcttccacaacaaaagagtaccctgaaacagatctttcgtataatcagtgacgtagagatcgaagacg

SEQ ID NO: 2679 - DNA, 3000 bp, Unknown
  misc_feature (1)..( 3000): cDNA_ID_2049070_gDNA_ID_1620575_Annot_ID_160947 3000 nt of promoter + ATG
gtaaaaagttaagtttttaaggacaaaagagattgaaaaagtaagaaccattatgggtccatttagaagaagtagaaaagataaagtgaagagacaaaagaactaataatgatctgcacttgagtacccattatgttttatttcccatatgcaaccactaagagtactctctttggtttgaggtattagtatgaactaactagctccgtgattgtaggtgttttaggataagataattgaatgttgttagtacactcataacatgaattgggacagtttggttaggctcttgcatatgacattatcagtttggttctaattaaggagataaacatgctaaaactttgatgatctatgtttcttaggacttgatcacaattcacaatcactgcaaattgttgtaattgttctgatcaatctgtttatggttttgatttttggtcaaggtaaggaacatttagactgatcaaaagaaaaaggcaatggatggtggtggttattgaaatggccaaacagatgaaaagaaaggtaactttcaaaagttgctttctttttttcttgtcactgtttctttatctttctctttctcacacatctctttcttatacccacaccactcttgagagagcagatcaatagagaaaaaaacttggctagtttttctccacaaggttttttctgcaaacatgtctgaacttgcattgtcatctcaagaagagtctccaagtagtaataagattggtttatcttctcttcttctctctgactttcatctcttttgctcatttatcctcactcaccctttctatttttcttacttgctcttcttttcaccttacatcttcaagattctctcttttctttcaccactctttgtcaccaccacactcttgcttcttgccttattgagtactttacatgttcaagacacttgtctcgactctgaatcactagaaacacaaccaagcttccttttctccttttgtagtaagcttggaagtgtcttggaacacaagtttgatgtcaacaatgagggttttaagtcattggaggagttggaagcgtataagatggtcgtcgaggcttgctcgatggaatgtgcgtccgagaatgagatatgttcggatgaattgacgtttgttgacaaattctgtagccatgagagcacggtgtcggaatctttgaccgatgagacccttgaggagcaagttgagatccaaccgttgaagtttgaggatgtgattgttttggagaaagaagaagaaaccaagaaatgtgaaaaggaagaagtagaagaacaaaaagtcaagcataaaagtgacgttgtcctcgataacagagaagagccgacaaaagaagaatccaaagctcaaaaagttgaccttgtcggagatagtaataatgaaagttatgatctcccaaaactgagcaattttctcggagaaggagaaggtaaaagaaatgtagtgactaagaacgaagaagaagataatgtttctctccaaagctttggatcaatgagaaaagagaaagaatggaggagaacattggcttgcaagctatttgaagaacgacacaatgctgacgttggacaaggcatggatcagctgtgggagacttacgagacacaaacagagaagaagcagcaaaccgaagaagagaagaagaagctcaagaagaagacgaagtcgatgatgaagacaaagagtatagagaaggaagttatagtggaggaggaagatgatgatgggattgatcatcagcaactttgttgtttacaagctttgaagttctcaacagggaagatgcatttgggaattgcgaggcctaaccttttgaagctatctaaggctttcaaaggcattggacgtttttacaatgctaacaaacattccaagaaagcttgaaaaggagatgaataataaaactttgtattaattgggatctataaacaatgtaacttgtaagtttccattgttttgggcaagttctatgaacaatgtaagggaaaataaaaggtaaaggctaggattttgccatatgtgtttagctttgatcttaactttctttcctatccttgtatattttgggacggataacccgtaatggcccgtatcgattgagaattacttgtcccataaggcatgttaccgttgaaatatttaccttttttaaaatgtaaatttttgtttaacaagtaagggattgggtaaaaaattcaaagatatccgcattttctatattttccgcttgagtaatataatatttacaaagtgtataaaaattatccaaaatttcttcatatacttcataaaaactatttttttcaaaatttcaaaaaaacaaaaaattccgtcttgccgtagagttttacctctttcgaaatcgacactcacccaaattaatgagagtttgagaattgaatttagatacccgaatttcacattctctatacattacccaaaatatttgtcccgtattttatcaaaaatagttctgatcatgtttttcaattactacctgaactatttttcgttctgatatccgaaataaacatgtctattcattatatctcttctaatgatctaatcccacaataattttttccttaaactgtaattttaagtcatatatttcattaccattcattctattaataaaaatattgtaacattttatggttgcataaattaaatccggcaatggaatgtctaaaagtagtataatcggtcttgttcccacttttgtttcctagttgaacagatttgaatctcagatctgatataaaaattcactaatcgacaacattttactacaaaatttaatagaaagtcaaaatatgattgttacacttcaattaacttaaaaaaagttgaaaaaatggttaccgacatatttcatagtttggccgcgtacgattagtgagacactccattaaatagcttataattgaaaattgaatgacactgtgagattcaagtgtaaagtgctctctcccca

SEQ ID NO: 2680 - DNA, 3000 bp, Unknown
  misc_feature (1)..( 3000): cDNA_ID_2049062_gDNA_ID_1620575_Annot_ID_160949 3000 nt of promoter + ATG
gaagacatatttgatattgaaagacaccgtacgtgtcatcctatcattcgttatttgtttttttcttttctccatttgcaattttttctctctctttctcttccaatctcagctccaaaaaactgaaacacatgagctaaacactcatccggcagatctccgatgacatcccgctttctaaccgccataacatttcccaaaaccatcgattctcctccaacaatatgcaccggagaatcgccgtagatgacggcgcttgggccatcaccaccgaatgattgtgttttcctcctgatcttcctctacatttatttatttattcatttggctcatattctcaatcacacacaaattcgggactctttctttcccaatctcagatcgaatttgtttcatttttctgtgattcatcaccaagttttggtttttaattgttctgttggggaaaaaaagtaatgagacacccatatttaaagatgaccaatggaaggagaaaaaataatacataatttgtaagagtcttcagctttaaatagtactattaattttatattaatttatagtaaagacatcttaatgggagtcaccaatgtggacggtcttaatgagctcgagtcctctgctttggattctactcatggagttatatcattttaacattgggatcaacactcatttttgtcgaatatatatatatgttgtagatggccactacaaaaatatagttagctatattctttgggactgtgaagtgtagcatagtggatatccatgacatgaaaaacctactacttactggttataagttataactatctatatttttgtgtttactttgaagtgtatggtagtagatatacaacatgcaacctattgaatcaaatatcatcaatataggatggggtgatatataagcagactagaaatcaaatctcatcaatcacatatgtatttattaattcaaaagaaatttggctgtaaaaacaatggaatcccgaaaaagcatctctagctaaaaaaaacatttttcacatccttaacttagaattattttttctttcaaataaggaatagctaaaactagcatatgctctaagccctatatgtacccatatccacatcacaaaaaaaaatagagataacaaagaaacaatatttgaaatcgccaacgagagaaacaaaaagaagaaaaaaatgaagacatttatgataatcttgttggtgatttgtagcatcttgattgtaggacgagttgaggctaacgataacaagagaaaatatctactactcgatccatgcttgcgtcctaatgctccaccaggatgtcatcgtcagccatataaaccccgtactccggttaacgtatatagtcgtggttgcaccacaatcaaccgatgccgccgagtgcagaatccgtgagatctaatgacatattttatggacttatgcaaccacataagtcatattatgtatatgtttccaaaaatttcataggattgatcttcagtattgttgaggctcatgggggtttgaatttaattgattcatgtgtaatagtaactaattttttgaacgacgccaaatgacaatttggatatatgggatctaattttttcacaatatatgtataaattctttgatatatgaaataaaaattgaatttcattttttgtctacttttattattgaaatatgaaaaagccaaagaagtacaagccataaccaaaaaaaaaaatccagatgatcaacaaattaaccccttcataattatatttagtaatttaagtagattttgcgagagagaaatgaaatgtgtcatgggtaacttcatctcacgacccccaaaagcaatatgaactcgtgttgtctatgcctggtatcgtagctctccacgtttacgattgcttctacaaagatagtttggttctcgtggtatggtttaaattttggtcccaactttggaacctcccttctcttacactcttgtaaataatctgtcatggttttgttcaattgatttatcatttcatcagatttattttgtatacgtaaatttgtgttttgttatcatttttgttttgttttaattagctatgttgagaatgttcaaactttatattataagattaataaaatcttgatttctttttccggtaagagaaagaatttttactttttctaaatatatatatgaacaaaaaaaaacccaatagaattaaggttatgaacatttttttatacctaagaaaaacaatttaatatagaaaaagaaattcttctttatttatataaatagagatattattttattatattaaaggttaagaacttttatattttattttaagaatttatatatacactaacagtatttaaacttgacacataacagtaatttatgttttacttgacacacattatgatctatgtcttaataactttgaaaaccaaatttcatgtaataagattttagttacctaatttttagctaaaaccaaacacaacaaaacgaaaattgtatcaaaccaaaatatatatagttttgtggcaattttttaaaaaaataacaaattcagaaaaaaaaaaaaacaaagaaaccgaaccgaaactaaaccattaatcgataaggctggaaattagagagattaagttatttttggcctccaaatgattccgataatcttacaaaacaggcaataaaatagtcaaaatacataactttatttcctaataaaaagatctttaaaaaccaaagatttgcaatgaagatttgataccacaaacaaaaaaccattactcacaagtgtcttaatacgattagttgatcagatcagaaaaatacgaccgccacgtcatcgaccgcatgccctcgtcgtgtcttcgctcactcaacaaaacgtatccttcgctttcacgaacgtcgcataaaagctctgcaaaacacacacaacacaactgagagagatcagagaaagagagatttgtaataatcaaatcatg

SEQ ID NO: 2681 - DNA, 3000 bp, Unknown
  misc_feature (1)..( 3000): cDNA_ID_2049052_gDNA_ID_1620575_Annot_ID_160953 3000 nt of promoter + ATG
accctaagtttgatgtaagcattaagcagagagcacaagtatttaaaaggcaacagaggctctctcattctcactttctcccagtttctctcactttctgtaatttccttgcgactcacgattttgttctcagaacaacttgaagttttcggttctaatcacaaattcacaatgactagtatgtattacaatcacgatcatctcactgcttcagggaagaacatgtggtcgaatttctatgtactggttgatacggcggtgatgttatatgaagaagaaaaacaacgtcgtaagattgtctctgaagaagaagaagaaacacagaagagaatcttttgtctcttcccgagaaaaacaagatcgtctttggtaaagagacaacaaaagcttagtgggtttttaacttcagcttcttcatcgcttatcgatcttaaccagttcccttctgattctgagatcgaagacccactaaaccatcatcagttgctatcttcttcatgtttcatcgccgctgatttcgagacactacaaaaccctagttccgaaccttgttcttcactcgtactctttgattgcaagacggctgggtccgagaagacagagacgaaagacccaccaaaccctaatttcccatgtcctctgtctttgtgcctaacggagaacaaaaaccgcaagagacgtgctgtggaacagaggaagcgtactggtggagtcaagaaagcaaaggttgctcctttttcacaaacggcgagagagacgcctgagtggcttgtcaatgtgatgagagacatgaaagaagccaaagacgctaaattgatctttgagaagactctgttcgttactgatgtaaacccaacacagaaccgtctctcaatgcctttcaacaacttactccgcaacgatttcttgacttctgtggagtcaagaatcatagacaaagacatcaaaaacgataagaagattggagtgggagcgattcttgtggatcaacggtgtaagaagtggggtgtgatgttaaagagatgggagatgaagaaggaatcaggtaaaggaagctggaattacaatctaatctgtgggtggaacgatattgttgaggctaatggattgaaagaaggcgacaacattagtctttggtcattcaggtcctgtggaatcctctgctttgccatggaacagagaagcccttcccttgctctctgtctctgctaagttccttgtgtctcaacttgagactataaattggttgatcaactcgtatggcgatctaagttcaggcgattatggagtttttttttgtctagtaacttgttccttctattgtttagttaagaaaattaggatacctctctattgttagtaacttgttccttctattgtttcagatcattatatcatgaatctggtttgttgtttggtctactttaatactgcattgttacctatcgatttcttgtaatatatctcaaagtataattttgtgtggtcaaagtatactgcgttgtctagtaagaccatcatgactcttattattccttaagcacggatctttaatataatgctgcaacagatatcacctgagcactgtccaaagttttactggccacctgaagtatttattctcaaagggctttctctatccttattactcaagcttgcatcatccaaatcctcgagaactccagagaatttaggtctagttccttgtgaccgaaacaacattacccgagaggcagattctactatgcattgtttaaacatgtccaaagcaaaaatactttgccatttccaagacagcaagttgagatgctaaccaagacaagacttgaatcaacaagactggacactgtcaaatgttatacttttgcaactactcatactcaccaacggcattagcatcagacagactctataaatccacaagcttctttcacagccgattgtagacacaacccgaaagagtgattgtcgtccctgtggagaagagaagagtggtctaaagctagattttggaatctaagttcgttctttgacattcagacaacaaggattgtaaagaagatagtgtaccggagatggagtaggtgttaggattttgaagaggaggtcgtaggattagtggtggaagaagttcggatttgggttttcatattaacggcgacgattagtgctaggttaaacaaaattgtgctaaaccgagtaaaattcgtaaataaacctagaaactataatgtgcatttacattgataagtgaattatatataagacgaaataactataattacagccactaatgtcagacactaatcgaaaaagcaagcataatctcctttcacacattccataagttgggatatatatacacagcagaccacatattccacatgctcctatcctacgtgacaccatcataaaacgaatttctatgtattttatacgtgaacatcattgaattttatatgtattttacacgcgttatcatgataaaacgaatttgaacatctttggatcttttatttttctcgtgcgttatacatgcctggaaattgatatgtatgaaatgtcaattcaaatgtgaaacttgcgatttttaaggacggccacacatataaaatcacatgactattagtcgtactatgtactaatgtctctttgtcatgtatcatgtatggtgtgaataaaataacgtacagactttctcaatagaaacatcaacgaaaactcaaaatatctccgacaatttgaaggaccatctttgaattagctagctaggccctaaccaaaccaaaccccacaaaattgatgatgtctttggctcttatcaatacgtacgattacatggagtctaaactctaaaggttatacgcgtttactatacatacatatagtatagtaaatgaaagcgacattacctcatagtccagaccatactactatatatacgagtaaaagaaagatacattctcattatcccatacattaaacaaagtgatcaccatg

SEQ ID NO: 2682 - DNA, 3000 bp, Unknown
  misc_feature (1)..( 3000): cDNA_ID_2049039_gDNA_ID_1620575_Annot_ID_160957 3000 nt of promoter + ATG
ttctagatgttgattaaggatacattataaaagtaattcttacatcaattagaaaaagaaaaagaatttaaataaaaaataaaataaaattgattacaatttataactatacagagcggttaaataaagattactcttctgtaatctcacaataattatcaatggtgttagaaaaggaaaaataaaataaagattactcttttgtaatctcacaataattatcagtaatgttagaaaaaaaaaaaaaaaaaaactagcattaggtttcgtaggttatatataaagcataaaaagaaggacacaaacaaaacaaaagaagcaaacgatggatacattgttcgtcaacaaagttttaattccgttaggacttttcgccgtatcttgtcttttttcccttgtggtgttgaccattaagtgtcgtcgttatgaggatccatacgatctaggaacgaagactcgttgcatcaatctccttcaaagtcttaatttatatttgtttttatgcacttgtatgattcttttcttctttttctgtttatgattatacgtttgtatttaagatttgtatttcatatatgtaagattttgtaaagtttggaatcgtttgaattaacgtgaaaaaatcatcgaccaagctgtatcgatagtctattttgaattagggttataaattttcttcttatgattctttgaatatatgttttggttgccaaacgaatctttacttctcgcatggtttaattatattcaaaatccatatgccttaagcctatcgtcaagtctgtggctttgccagctccgatcagtttcatgatcatcaaaacttcaatccaaaacacattatcctttctttcttttcacgaccaagatttttaactttttgaatcattcaatacccaaattttgctttgttaacccatgcatgtgtcccttacacggactttaagataggacttgagaaaactagctagggtaagtgggtaacaaggtctctgatctttatacatatatcacaagtgtttgatctagtaatgttatatgctcttagtgttaacgctgaaatccactactatatatgagtccttctcgtgtgagctagctctaacagcaattgcatgcttcaaaataattagatgtcatatgcacttgcacattagagcatccacaatgagaagttattagcaaaggctcttaccaatactttatgaattgattttgaaaattttgaagttaagagtttgggtaaaagtttaaatttttttgtcattgtccaataacaatcagattgtgagaggtaaatgaagagttctcaaatgtcttgagtgtaaatagcgtttcctttatggtctagcttgaacaccattacaccttttgttttcatgatctttcgagaggtcttcttgtaccacttaaccaagaaggtttcattggttggttgtgactccagcaagaatacgctcgtcaagcaagattccagaagctcgcgttgggtcttggtcggttttggagccgcaacctctgattcttttgcttgtgtctgtggagatcccaagatccgatgatgtggcctccagatccaggaatacgaaacatgtcatctctcttggaaaacatgacttgggaggagtaaaagcaagggtttgcgattcttacgttggtccacccctcaaagttgctttaagcaggtctgaaaaagctgagttgaggtcccaaaaacttgacagccacaacacagtcctcgtcctcaggagaagatgatggtgacaatttgagtttggcaacgaggtaaagttacaaaaggaggcgacgagtattgtattggtactgctatatccgactcccatgtacatgtatcatcaaagaaagataacattccgtcgtgaatgaaactagctgccacgcaggggtaagctgaccacattatttcacatttatcctcagtaaccttctttgccaaacaagtgtggcgaccttgagtcacgactccacagccgttgatggaagaaggaggaaattgcagtgaagaggattagaaaccattagagagaaaatgagaggaggatctcatcaacgcaggttggcctaggcacaacttggaaggctggttgagaaacagagacatgataaaatagtgaatgatcgatcttagcaaaaggcaagagatttgggaaaaacaaaacccttattgaagaattcggtagtgatatactgatatgttaacttttagtcgctacattattaatacagaggaaatggacttgctcaccaagtttaccgtctccaaattaggtaaggtcagacacattaatacagatgaatgaacttgtaatgtaaattgattcgttagtcttttttcatttacgccacaaaaaaaggaaaagaaaaaaagaagaagatttgcatatgaataaaacttgtgagttgttgaggcatttggtatttgagaagaaaaaaagaagggaattaacaatggaaactttgatagatgtgatcatctttagtttagaaccctaaaatgcttttacacagatgcttggaaaacgtagatgcgaaccctagacagttgtgttttaagcgtttttgttataatagaacctttgcttcgtcaggtggatgtgaaactccagaagtcccaagtgtcgccatttttgttgaaaaatcttgctaaggatttggggaaaagtctgaactgagaagttttggagggaagcgtagggataaaggaagggagaatcatgggcttaatcatcatgggctaaaccatcatagggccaatattatgggcctgtatggcccaaacgtaatgaatacttcttatttaaaagcctcaaaatcagttttactaatcaaagtaactaaactagtcccctaataaaattgtaaatgttgtcactaagcacctctgaaacattctttagaaaaagtcataagcagtgcacgtcggttatattgtttttctttctaagccaaaaggcaaaaagaaaaagatcagagaagatg

SEQ ID NO: 2683 - DNA, 3000 bp, Unknown
  misc_feature (1)..( 3000): cDNA_ID_2049048_gDNA_ID_1620575_Annot_ID_160954 3000 nt of promoter + ATG
gaattggcaataaatatgtgactcatatatctttaaatacgaaatttttatctcattgtttttcaaacgccaacttatacatatagtaatcacatgtcatcaaaagagtcacattgtacttaatcataaaatataaatgatatattttaaaatatatatatgagctgaaaattcaaaagcctacatgctaactaataaggaaaatttgttaatatgattcaaaaaatagtgccagattggtgtaggtaataactatgggaaaatacgtatacataggtttctatttttatttttatgtgtgagtaaagtttagtgtttaattagacactagctacattacctcctcttgttcgtcgattgctgatagtgatgtcttatgttcaatagctctcttcatctgtgcagtttcaatatccctttgggtgcacacagacacaaactctccaatagccatactacaagcacccgcaacaaggccagcaaaaccaacgagaagcattgctttgacgtcttctttgatagaaccaacacccatcattagcgaagcgactgtgaccagaccatcgttggctccaagcaaggcagctcttagccactgagctctctgcatgtagtccacttcctccttctctgctctcggacgggttttctgattccttgggctgtttgtttctgaaagctgaacgttggaagtcatggtttggatttagtacaaagtagtgatgcttacttgatcttgattgatgaggaggcttgtggagaactcacgccttatatagaaaaatagagtatatagctttgtttattaatagttgttacctaataatatttttataagagaaaaagatagcatagtggtagtggtggagacggtaacgttggacactacacttatttagagtggaaataagaatcggatggataaaatagccacccaaaagtgtcatcgtgataaacaatactattggttaatttagtgaatcggattacaatactatttagtatttacctgtttccaatatataagaatttcgaacttttgaatgcgacctgtttgatatatacacacgtacataaccaattcaaatcttttatactttttgcttgagttgattcgttaataaacttgcaaatgaaaatattagtataaaaatttaggatgaatgtaaaaaaatgatattatttggtatttaccaaattatgttttataaaaggcaatttcactttttcatactaaaaagtcatatttacaagaaatatgaaaactaaattaacctggtgaaaggaaattttaccaggttaaagtgattctggaattttttggttaaagtgacgtataaaagcctaactctctagtgattataagtttaacaacttgaaactaatggatttagctaagtacaaccaacatttttgtaattttttaacctttatattgaaagcacacatttgtttgtgtgtgcaatgtcattgctaacatcattttgaatgctatgtcattgctaacatcatgacatgcataatctattttatgctttaattttcttaatgaaatcttatatgcactttttcttatagaaacaattaaatgtttttttttttcctttttgttgacagcagatttatttattaaataatcgttacccaaaaacatatgtactgcttagttaatagtagcaaggacttgcagtcacactcatacagtcatactatactcccaatgttccattttataagatgttttagttttttaattgtttcagtttacgagatgttttatatgtttctgtgtaataaataaatgtatgtaatattttataaatgtatgttttattcaaaaataaaaaaatgtatgtaatattttgtgatttttatattatgcgggtttttatgataggttgcaattgcatggtttaaaatatattttttagtgaaaagaaatttcttaatatatgtacttttaaccaaaaaatcttataaaatgggatatatagagtatcttttgccgcaaaatctagtttcctatcaattggaatgatttttttgaaagattttttttccaaactaaatgatgtacttatcatcttatgcaaaacaaaacaaaaaacaaaaaatatatttggcaaccatctgtatgttacagatattttgttatatgcttatttactttcttcatttgttagtgaaaaccttaaaccatcattaacagtaaaacagttaaagtattttactttaaaggtttgcctagctagaaatttttactttcttaatttgtaagtgaaaccccttaaacatcatctcagtaaatgaccaagtaaaccataaaacaaaattgatacactagcagtaaatttccttcatatttattaagataactcatcattgtgtcgactgtagatcagtttttcttaacttcttaaaaatatttattttcctattcttttattaattaagaaggaatgaaccaaacaaacaacacaagaagcatagttttaaaacaaccaaatagacaaagaaaaaaaaaaaaacagagcacgaaaaacaaaacccatttggatacattgtccggcataatatttgataaaagattaaaatatcactgaatatttctgagtaaacttatatttataaaggaaaaaaaatgttaaccaatcaaactgtaaactaaacaaacctgaagcaaaaaggcaaattacttacctgaaaaaaggaaataccgagtcactgagtcagtgactaaatcgtaattataaggttaatcagacaacggctataattagttactaatcgcagtaattaaactactaatctcaaagaaaaaaggaaaccctaagtttgatgtaagcattaagcagagagcacaagtatttaaaaggcaacagaggctctctcattctcactttctcccagtttctctcactttctgtaatttccttgcgactcacgattttgttctcagaacaacttgaagttttcggttctaatcacaaattcacaatg

SEQ ID NO: 2684 - DNA, 3000 bp, Unknown
  misc_feature (1)..( 3000): cDNA_ID_3069136_gDNA_ID_1620575_Annot_ID_160945 3000 nt of promoter + ATG
ttgtaacatgatcggatcatctagcgatgaattggtttatccaacgaattactaggacttaatccggattattgatgtaatcaaagaaaaatataaaaatttgcatataggtgtaagactaattaaaacagaagaattataataaccaaatatattgaccattatgcgtagttagcggttcatactagttagttgtatcataatcagagctcaaattcagaaatgtacgttatatcagtttaacaatggtaagccaaaagtcatctatagacaaaattttcgaacttttaggtaagcccataattaaccatgaatatatacgctttatgggtaggtcagcatacaaagatgttttcttatgtctcaagaaaatttttaccttgaggaaacaacaaaaaaccaaaatcctcctcaagtctcatctacaaggtctggaattactttcagtctttcacgaaacatcaccgataaacaaaattccaacttaagaaatttatgggggcaaaagagaaataatcttaagttggttaagactattctttgttcaatttgccgaggactctttcagggaatatcttctcttcatgagctttcttctttgctaaggcttcttcgtcgaggactttaataggagaccattcaggtaacttgaatgactccatgttacggtagctctctaacattggttttcctttaagggtagcataatcaaatgctgtgcctacagcagcaaaaactagagagtagcgaatcgcacccttaggacctcctgtaaacaccgataatatgtcagttccgagcttaataaccctaaagagactatcatgaaagtttcttccaattgatttaaatatggcagagttattatgatttgatctcttattgtaacagaaaatagcacactctcatggtcagactacttgagactgagagtattacagccaaatcttcagggacatggagtagaatagatactgccagaaaagaattcaagataacgaaccttgaagtcttccaagcaaagcaccactaaaaagtcctccaatagctgagttcattaaatcatcgtgttctgatcttcgagttattctcacagattcacgagctcctaccaaaaccaaaacattgcaacaatcacataatattcacattacatgagagtccaccttcttagagaaaatggaaacactcagtttcaatcttgataacacagatggaaaagagcaggtaccgcaatagcaaccggcgacaatagcaaaattagcagcgtaaacagtaggaatattgggatgagctatccggtgtttagacactaaaccagctcctccaccaattactcctgcacatgaaacatcttctcagtcactgtgatgcaaacatttcttacatgttctatgcaataattaagcaattgaatagccaatcaaagctggtgaactgaattatctatacaccaaaagttatgaattcttctaattaatggagcaataaaacctagaatcgaacttctagtaaccgatacaacaacgagaatctaattgcttctttccgatgaactttggctactttccgatgatatgtgcaaccaaaaatctcaaaattgttctaagatggaactcattatagagtatcctagttcttgcgatcaactaaacgtaataataaatcccgaaagtgagaagaagcattgcgaaacctgctaaaagggaagtgatcaacacacgcttcgtcggagttccattttcctgcacaataggcgtcggaggagataacgcctgatttgtttgttctggggatttccgatcacccaacgccatttttgacgccacggaacttcgagagaactccaatttcaatgcggtgttgtgaatcgggttgatctaaaacccgagattgaaccctaactcgaaacccgatcataactcttacataattaagaaattgccctgaaagatgatttaaagtttattttattccctcaatgtttgacaaatagatatttggcccttcacctctcaggagagattttctttggaattaaattttcctctgttttaggtgatattttccttttcgttacctttagttccttgtgcaaaggaacaactatagtatgagtcttccgattgcaagtgattctttttaaattgaagtaaaaattactaagcaaatactatttatttggtgtttatttgcaagtgacatgtatgtatagtactaatatctgttttatcttatacattgggattctctaatattggagatcaaaattatgactagtaatacaataattacgcaatacatatgtagtactaaaacaagaatcttttcactatgtagtactactatgtcattgagaccatgagatattccaatattgcttcagtttcactcactctctctctttctctaaccattttgcttttaccaaattgagatccgagtggataattggagagagaaagaaccaagtcttctcaagatacctctcggctagtaaaaagttaagtttttaaggacaaaagagattgaaaaagtaagaaccattatgggtccatttagaagaagtagaaaagataaagtgaagagacaaaagaactaataatgatctgcacttgagtacccattatgttttatttcccatatgcaaccactaagagtactctctttggtttgaggtattagtatgaactaactagctccgtgattgtaggtgttttaggataagataattgaatgttgttagtacactcataacatgaattgggacagtttggttaggctcttgcatatgacattatcagtttggttctaattaaggagataaacatgctaaaactttgatgatctatgtttcttaggacttgatcacaattcacaatcactgcaaattgttgtaattgttctgatcaatctgtttatggttttgatttttggtcaaggtaaggaacatttagactgatcaaaagaaaaaggcaatggatggtggtggttattgaa

SEQ ID NO: 2685 - DNA, 3000 bp, Unknown
  misc_feature (1)..( 3000): cDNA_ID_3069140_gDNA_ID_1620575_Annot_ID_160944 3000 nt of promoter + ATG
gtttttatgaagtatatgaagaaattttggataatttttatacactttgtaaatattatattactcaagcggaaaatatagaaaatgcggatatctttgaattttttacccaatcccttacttgttaaacaaaaatttacattttaaaaaaggtaaatatttcaacggtaacatgccttatgggacaagtaattctcaatcgatacgggccattacgggttatccgtcccaaaatatacaaggataggaaagaaagttaagatcaaagctaaacacatatggcaaaatcctagcctttaccttttattttcccttacattgttcatagaacttgcccaaaacaatggaaacttacaagttacattgtttatagatcccaattaatacaaagttttattattcatctccttttcaagctttcttggaatgtttgttagcattgtaaaaacgtccaatgcctttgaaagccttagatagcttcaaaaggttaggcctcgcaattcccaaatgcatcttccctgttgagaacttcaaagcttgtaaacaacaaagttgctgatgatcaatcccatcatcatcttcctcctccactataacttccttctctatactctttgtcttcatcatcgacttcgtcttcttcttgagcttcttcttctcttcttcggtttgctgcttcttctctgtttgtgtctcgtaagtctcccacagctgatccatgccttgtccaacgtcagcattgtgtcgttcttcaaatagcttgcaagccaatgttctcctccattctttctcttttctcattgatccaaagctttggagagaaacattatcttcttcttcgttcttagtcactacatttcttttaccttctccttctccgagaaaattgctcagttttgggagatcataactttcattattactatctccgacaaggtcaactttttgagctttggattcttcttttgtcggctcttctctgttatcgaggacaacgtcacttttatgcttgactttttgttcttctacttcttccttttcacatttcttggtttcttcttctttctccaaaacaatcacatcctcaaacttcaacggttggatctcaacttgctcctcaagggtctcatcggtcaaagattccgacaccgtgctctcatggctacagaatttgtcaacaaacgtcaattcatccgaacatatctcattctcggacgcacattccatcgagcaagcctcgacgaccatcttatacgcttccaactcctccaatgacttaaaaccctcattgttgacatcaaacttgtgttccaagacacttccaagcttactacaaaaggagaaaaggaagcttggttgtgtttctagtgattcagagtcgagacaagtgtcttgaacatgtaaagtactcaataaggcaagaagcaagagtgtggtggtgacaaagagtggtgaaagaaaagagagaatcttgaagatgtaaggtgaaaagaagagcaagtaagaaaaatagaaagggtgagtgaggataaatgagcaaaagagatgaaagtcagagagaagaagagaagataaaccaatcttattactacttggagactcttcttgagatgacaatgcaagttcagacatgtttgcagaaaaaaccttgtggagaaaaactagccaagtttttttctctattgatctgctctctcaagagtggtgtgggtataagaaagagatgtgtgagaaagagaaagataaagaaacagtgacaagaaaaaaagaaagcaacttttgaaagttacctttcttttcatctgtttggccatttcaataaccaccaccatccattgcctttttcttttgatcagtctaaatgttccttaccttgaccaaaaatcaaaaccataaacagattgatcagaacaattacaacaatttgcagtgattgtgaattgtgatcaagtcctaagaaacatagatcatcaaagttttagcatgtttatctccttaattagaaccaaactgataatgtcatatgcaagagcctaaccaaactgtcccaattcatgttatgagtgtactaacaacattcaattatcttatcctaaaacacctacaatcacggagctagttagttcatactaatacctcaaaccaaagagagtactcttagtggttgcatatgggaaataaaacataatgggtactcaagtgcagatcattattagttcttttgtctcttcactttatcttttctacttcttctaaatggacccataatggttcttactttttcaatctcttttgtccttaaaaacttaactttttactagccgagaggtatcttgagaagacttggttctttctctctccaattatccactcggatctcaatttggtaaaagcaaaatggttagagaaagagagagagtgagtgaaactgaagcaatattggaatatctcatggtctcaatgacatagtagtactacatagtgaaaagattcttgttttagtactacatatgtattgcgtaattattgtattactagtcataattttgatctccaatattagagaatcccaatgtataagataaaacagatattagtactatacatacatgtcacttgcaaataaacaccaaataaatagtatttgcttagtaatttttacttcaatttaaaaagaatcacttgcaatcggaagactcatactatagttgttcctttgcacaaggaactaaaggtaacgaaaaggaaaatatcacctaaaacagaggaaaatttaattccaaagaaaatctctcctgagaggtgaagggccaaatatctatttgtcaaacattgagggaataaaataaactttaaatcatctttcagggcaatttcttaattatgtaagagttatgatcgggtttcgagttagggttcaatctcgggttttagatcaacccgattcacaacaccgcattgaaattggagttctctcgaagttccgtggcgtcaaaaatg

SEQ ID NO: 2686 - DNA, 3000 bp, Unknown
  misc_feature (1)..( 3000): cDNA_ID_2167652_gDNA_ID_1620576_Annot_ID_160986 3000 nt of promoter + ATG
gcttttaagtttttctgaaacagttatgttaaaatgtatgagaaatttgagcttcattatactctattttgaagacatttcttattgcctatttgagaattagctaaacattaatattgccttaacagtaatgttaacggtaatataaagtctaattagtctaagtgagaatcaacataaatagtcttaccttaagtaaatgttctcaaatttcagaaactggaaactagccgtttgattattggaaaagaaaggaaacgaaaaggaatacaaatagctaaatctttgtgtaagatttcacaatctcttcttttgtgttatttgtttatatttgtgtctgagaaaatctgagatgaatccaaaaagatgtgcagcttgcaagtatctgagaagaagatgtccaaaagattgcgtattctcaccatatttccctccaaacgatcctcaaaaatttgcatgtgtccacagaatctatggtgctggaaacgtttccaaaatgcttcaggtatatatatctatacacatctttgtgtatcttcttctaatatcctatttaagatcacactttatgcatatatataagtaagtgtattcatggttggattttggtgatctttttgacagcaacttcctgatcagacaagagctgaagcagtggaatctttgtgctttgaagcaaaatgcagagtagatgatcctgtttatggttgtgttggcattattcatttacttaaaactcagattcagaaaactcagaatgaattagccaaaactcaagctgagattgctgttgctcaaaccaaacttagccaaacccatatttctgattttatgtaatatctctcagtttcaacaataaattctcctctgcattttcgtttccgattgcttctacttataagatagtgatcttctttaactttaactatatcagactcataatcaagaggccattagctatactaaaaaagtgtttcataaaacacaaatgtaaacaagttcgaatcgagtttattattatcacaaatccataactaaagggtgacaattatacagtcttgagtctcttggccgatattttgagaatcataatgtaaaaagataaatgaatctgtttacaaaatacatgacactattacaaatcgaatttactattttccctgcttaagctcccattccttttacaagtacatgacattacactacttttgaaggagcttttcttgtatagttacaaagatgatcaatgaatctgtttaatagacgaaaatatatatgtcaagagacactgaaccttcaaaatcggcctgtatcccacttggtgaacataatttgatgttggctcggagtttcgttcgtttcattcattccatccgtgtattcattaccaaatgaagaattgaagtctggatcagaatccatggattcaaccaagtttgaagctttctccacctcaagggcttgctccaacaattggatcatacaagcattatgttctcgaataggtgagataccgtaaacttggatcatccgagtaaagtacctcaaaccatcctttacatttccagtattcgcacaagcggataagacaccaacgaaagtgatagcgtctggttctacgcttgcttcttcttccatctcttcaaacagagacaaagcctcttcaccacatccatgtacccctaagctagtgatcatcgagttccaagtcgctaaactcttaccctgcatcacgtcaaatactttccttgcgtcctgcaagcttccacatttgctatacatatcgatcaaagcggttccaaggaaacaatcaagcacaaaaccgtttttatgagcatagtcatgaacccatcttcccatagacaagcttcctaactgagtagaagcttgcaacaaattaacaatcgtaaactcattaggcttgacatcatcaacctgcattctcctaaagagctgaaacgcctcgtcgggtctacggttcttaacgtaagccgtaatcattgcagtccatgaaacaacgtttctcattggcatttgattgaatacaatctctgcagaatctaactgagaattggagacaagaccataaagcatagtagtccatgaaacaatacttctcccaggcattttatcaaacaccttacgtccactatctggtttcccacacttaaagtaaagatccatgagagtgttttggaagaagacatcattaaaaaacccagctttaatagctaaaccatgaacttgggtacctaaacgaatcgacgaagaagcgagacaagctttgataacaaaagggaaagtgaatttatcaaactgggattgatgagagatcatcataaggataaagagaagaagagcttcacgaggtttgtgattaacagagagagatcttatcataaggttccaggtaaaagtagaaggagattgaagttgattaaagacgagagaagcgtattgggtttctccgaaggaagaagaaacacttatgagctgacgaactagtaactgatcgttggtgagattgtgtttgatgattttggtgtgaatttgtttcaattgagagaaatttgaacaagttcggagaaagtaagaagcttcgggagatcggaatggtggaggagagaggaggtttggtggtgaagacggcgacggagccgccatggattaacgataaatcaccaaattctcacattcactctttcctcgattgatcgtgtgtggatgatgatgaagctgcatataaaccgaactaaaccgaagtttggctgatttggttcggattcggtttattgtgtagcaagaggaagcataaccagattgattcgactaggaaccactaaaccaaacgaaatacagaaatttcgaaccaaaccggatcgattctacgtgtattaaacgtcgtcgtttttgttagctaaaaagaagaaatagtaaatatccattagaagaagaagacgaagcagaggaatctagggtttatgctacattgaagcaaag

SEQ ID NO: 2687 - DNA, 3000 bp, Unknown
  misc_feature (1)..( 3000): cDNA_ID_2992438_gDNA_ID_1620576_Annot_ID_160996 3000 nt of promoter + ATG
acagtgagttgatctcttttcacaattcttcatgttaaactgatgaagagaaatttcagtattttaatttcctactttctagattgggcctataccagctgatgatggtattagcaaagagattatcactaaacttacaaccaccatgaagacaaatggaacattttacacagactcgaatggccgtgacttcatcaagcgggtattagatgcaaaattcatgtgaagtagtttatttttatttttgtaacaaggggtattttgtttttattgtaacatactttgttacattttcttgcagattcgggacttcagaacagattgggacttgcaagtgtaccaaccggttgctgggaactattatcctgtaaggcatcaaacccatctgagattccttctcgtggtgtactaaggtcttgtactagactgagctgcactatatctggccttttgtctaatatatatattttcttccagctaaatctcgggatatacatgcaagataaaacctcagagctatccgtgttggtggatcgagctgtaggtggatccagcttagagaacggccagatcgagttgatgcttcatcggtttgtcaactaactttctctatataaccaagacaagcatatgttgttttgcttgtatttcacctttttttcattcatgtaggagaatgcagcatgatgacattagaggtgttggtgagattcttaatgaaacagtctgtctccctgaaggatgcaaaggattaacggtaagcttaagttctcatctcatttttagctgtccaagttgcaacgtatcagcttttaagggaacatgtgacagagcttgtttccaaggtggtattaaatcgttatagttggtcttataaccgttatggtaactctgaattgttttgcagatacaagggaagttttatgtacagatagataaacctggagatggggcaaaatggcgtcgaacatttggtcaagaaatttattctccactacttatagcattcacagaacaggttgctcttaaaaaaaaaaaaatacttacttccctccagttctataagatagtgaagtgagataaggtactttttttgtaggaaggagatagttggattaattcacataagacgacattctcagcgtttgaaccgtcatattcattaccaaaaaacgtcgcattactcaccctccaggttagttggattgtgtactgtatacatgtcaaagacggttttttattagtttgaccacactcacactatgattaattctgacattttcaggagttggaaaatggggaagttcttctaaggcttgctcacttattcgaggttcttacttgtcctctctatgcgtttccaccgttaataatgtgttatagctatgtgctttttggttgtggaaatgtagtttaacactaggccgattaaactagcaaataattagagatatagaaaaacttgtattactcagaaaacccaaatcttgcagtgtcaggaaaccagacaattagttgtatagagttagttcataaaaccaaaccgtaacgtttagggtgtatttttcacctaaaaatcaaactgttttcatgtttatactcgtaaaaagctgactatgcggttgatcatcgtgctatgtcatttggttttccttaatagttccacatgtgaaataagatgagacctaaagtaatatagaagggagatggtcaagtccactaattggttttaaattgagaacccatgaacttcgacagtgttgcttttttggttcactaagcaacgggtaaaatctaatgtggaatttgataattattttctatctcttctcttaatggtttcatcgaagttgagtccttctgagttactgtcttgttaaccttgtgaaggttggggaggatagtgagtactcagttatggcaaaagtagagctcaagaaactattccacaacaaaaaggttcgccaaaaaaagacgacccttctcttatttgtctcactgtatgttaacaaaaacaactgccgttctgtttttaatatgttttgaacagataagggaagtaaaggagacaagtctttccgggaaccaagagaaggcggagatggagaagagacggctaatctggaaagtagaaggctcggccggggaggaagtgaagagaggagaggcggtggacgcagagaagctagtggttgagcttgttccgatggaaattcgaaccttgttgatcaagtttgatgatcaaattgaaatggttggtgataaagagcagcaacataggttatgaaataatacacgttgttgttgtctttttaagtttaatcggagaagagaaaaaagtttgaatttagtgtctgatgcgagtttaaaattcgggtgattgcaacagtcacgagtgcgatcccggtaggagtatcgcaatttctgcattaacatttacgtttgctaaggggtgggcattttaaccgaaccgaaccgatccgaaccaaccgaactcaaaccgacccaaactaaacccggattaacactaaaattattcggttaggcttcttctcaacccaaatagttcggtttaaaaactttcctatcacgacaataaattttgtttggtgtttacataaccgaattaatcgtaccgaatccgaacttaaaccgaaattcccaccgttaacctggctatactgaaactatatatatacgtatatatatatatatatatacatgcgatgttgacaaatgaacacaaaagtagataaactcaaaccggtagttattacattaactgtgtaataaagattcggtatatcccacccgcgaagaaaaggaatcatatcacgggttaacgaatccgggtcgggtacacggagcaatcataaagaagaaacaaaaactacgacgacaacttttttttggccttggttaaaaaattttcataagtgaacacagaagaagcggtggctctgagccggcgaaatctcctttctcatccctaaaattttc

SEQ ID NO: 2688 - DNA, 3000 bp, Unknown
  misc_feature (1)..( 3000): cDNA_ID_3069167_gDNA_ID_1620576_Annot_ID_160997 3000 nt of promoter + ATG
gactgcttcaagaggtgtcctttgtgctttgtgatgatttctccaagagagttatacactgtttatattgagaacgtcaagcagtattctgttggagatcccatcgagtttgtacttttgactcgcaagaaagattcttttgctcctacccggaaaaatgagcatgacttggctgttcctaatggtgaaaatgagatatatgatccgttctcaaagttcactttcacccaagatgttgatctctctgtcagacaagcagtttcagagttagacagttggattgcaagagcagatcctcagctcgttgaagacttggagaagcatctttatgtaaatgccgctttagagcgtttggagcagagaaaattgtactggaatgagcataagctctctatttacagcaaagtgtgcacaacggctagaaatcagactcaatcattgtcacctcctgatgtttctcgagttggttatcaagcacccatggggggccatggagcgccagatagcggctccaatgatcaagataaatcaactgaagattcttcagcggataagtcagatggagaatctcaatcaagtttggaaaagggttgtgataatgatcttggtcatcctctagaagatcaagacgcaccgtcatcttcctcatgcaatggaagtaaaggtttcctgtctcaccaaattgacaccaaagacctgaaggacaacgacgcgtacaacttttatcaggtaatcagtttctgatgcatactgttgtgttttcataaagtactaatgagctgcatgatgattgttttattgctatgggctggtcaatctctataatctgaaataaatgttattatctgttttcgataatctaggtgggtttattaaataattgtggtggttctatccatatatgcttaatttgtcttacctttgtgctcttgttgtgtacctatacagtctgttgatggtcagcacattatccttcacactttgaatgtgaagtgccttctgcatcactatggaagctatgactttcttccaccaaggtaagattccaggtcgtttatgcatcacaattctcatttttcaaagactatggaataagttccaatgggatcttcttcgttatctaatcatttctgcatgtatttgggatgctgattcaaagtgtgatatatggcacttttcgttgattaatcaagaaccgttcgtataaagatccaactcttatttagtatgaaaatcagaacggacaatacattcaagtaaaaacggttcagtacaagatgttatcatctctagtttgttgttctaatagacttctgattttgatccattaaacggcagattgagtggaaagatactggaaatggaaaccattacccaatcagaagcgataaggagacgctaccgctttttaagtcatttttctttatcaactacacttcaggtatattttctctttgttgctcctatcttctgcatgtgttgctatatcttgacattttctcatgaggttatccttggtttggtaatcttttcagatatgtgagattgatatgaaggaatccttgcctcctgatgcatttgctccatttatacatgaaattaagaagcgtgagaagcagcggaaagaacgtgcttggaaggtattctcgttctaaccataaaacacaaccccacggtctacttcatctaatatctttcagattccaactcctattggctttgtttgctttgtgtcttattctcctatgtattcctttgtttaaggaaaaatcaggacttaagatcatatgatgttcatatttcaggatcgaaaaaataaaatcaaagctgaagtagctgcagctgcagagcttgtaccattgatggccagttttgggcagtcgtcttctagtgatgactttcccccattttccttggatgactttgaaggtaaacaagaggaatctctcgtctcgtaattggattttaggtttattgatctaataagaagcttttgttgtgtctctcttaagctctgggaaactctgccccaatatcatcaagccctccaaacattggagagagaagttccttctcacatgtgacaaggctcggtttcgcagctggtcacgactccccaaacctgaataacgagccaacaaacgttcaaagcagcagcagcagcagtgaagtctcaaacgcaaccacaggtaaccactgtttttagctctgcaaattctaaataggattctcggatgacctctaaacatggtttcaggtgcaagaaacacaaacataacatcctttgcgagtgtagcttcaagaacaacaacaccaatggcaccaaccgtcaaagagcccggtaagagagggaagaaacagagccgagtacttctatcgacaactagtgtacgccgttactgaaaaggcctatggatttgtgtatgtataataatcttttcatctaagaaaaactgagtaaagaaagaaccagagattatggtgagtgagtaagtgtaaaactcaaacttgggctttgtttctttttgcaacccatgtgactgataatgaaggtgtctctcattactactagtctactatgccatttaggacaattattgagactcaatcatatgatcctcttgactcagagaactagaaaaaaaaagattggataaaatttcttccaagagtgattttcattctcacatgttacaacaaagcatgaaccttatcctttaaaaaatatcttcttccttttgttcaaacttttatcttctttgtcatagaaagtttggaccactgattttagtccgttggattatcaattattgacctcaataatatcaaaatttacttcaatgagaataagattacaattttttatttttttttgaacaccaacaaatctgcttcttctctggctataaataaagcataaactgttccaaaaacagaaccaaaaaatatctaaaatcactaaacctatcttcttaaccaaaagatcaatagattacaaaa

SEQ ID NO: 2689 - DNA, 3000 bp, Unknown
  misc_feature (1)..( 3000): cDNA_ID_3069169_gDNA_ID_1620576_Annot_ID_160995 3000 nt of promoter + ATG
ttgtttcttcttcagcaattcagattcatcaatggtgggaacaaaaccctaattcgttactgttaatgacggaggctactggtggttattcgttggctagctattatacgtctttgggtttgtttgttatctctgttcctggtctttggtctctaatcaaacgctctgttaaatcaaaggttcgaactttactaattacaaaaccctaaatttcacttccaattcccaatttcttcgattttgaaaaagcttgaatgcaatgttgaggatttgtagatagtgagaaagacgtttgttgttaatgacgtcaagaaggagccaaagcaagtagctggagagattctatctttcttcacaaggaagaatttcaatatcactgatcgtggagaaacaatcacgtaagctacaaaaagctcgaacttttcatttgggtttctgtgttttgttactgacattgttttgataaaaagatttgaaggaaagatggttccaagtagaggacaagctgctctgcttacgttttgtacatgtataagcttagcaagtgttggtcttgtcttaaccattacagttcctgattttggaaacaattggttcttcatcattctccttagtccactcgcgtaagctctctctctttaaggtctctgagactgtttttttgtcaatgaaatggtgattattttgtatgtgtgtgtgtgttgcagaggagtgtattactggaaaaaggcgtcgaggaaagaggagataaaagtgaagatgatggtgggatcaaaagggagattggatgagattgtggttcaaggagatgatgttcaggtcgaagaaatgaggaaagagcttcagcttaatgagaaaggcatggtttatgtcaaaggtctctttgagagatcatcataatgataacattttagcctcccatttttgccttttggggaatgtgtctatacttgttttattaaggttgagattaatgactttttaactcatttcccatacttcatactaaacgaatcgatttgaatatagttcatttgattgagcaattttgttattttgaaagtccaaatccattttttcattaccaaagacaacaataaagccacaaatttactaagaattagtaagtatggtcttcctgagtgatcggctagtccatgattcccaaagccaaggttgttcagtactatatgccatcaatgatgagttcgaattatatgtacatatgaaatgggagatatggatacttcgatgccattgagaacaactcaaaaatcttggtgatcgagacttgaaataatgacagcattaagtgtacatctaaaatgtgttttggaacttttcgagatccttcagatgctcgaggtttgacacattttcttgaacacatgatgttcaaaggatcaaagctatatcttgaccggagtgaggtataatgattacaacaatagtagagacgaatacgtggagataagtataagtttgttatggaggctaataagaggttaaaacacgattgaaaaaaagaaaaaagaatcatgagaataagacttgatcaaacataatacattctatgaaaggtaaaacaccaagatgtagagttggcaaaaagaaactagaaaaagaaagtggaacttgttttttttttaatattaaattatatattttttaatattaaattatatattgacaacatataactttttgttaatattaaattatagaatttattttcatctttatttgaaatgttaattatatattgaaaacataaaaatagttacattatttgagtattttattatataaatcttggttttcaaagttagtaactcgtatgatcttgatcagatgatgcacaaactttgtagacatcatggttaacctaacataaatttatctaagttaatcaaaagaatcttacaaattaaaaaatgattaggtcgaggtgaagagaacaaattaccacatagtgttgtaattagacggacatatatgtttaagttaataatgggctttacctctatttgggttgagctcaaccttactcgattaacaaaaaatctgaaggtcgcgtgtttgatctacgctcaccgcaccatttgttaagaataagaaacgtaatctctatttcttaacttccgatacaccgtttcacaaaagattgagccaccggcacatcaccgattcataactctctctcacaagcgacacatacgttactaaacattcatcaaacaatgcataaaactaattacaagtctaatctcagtatttatatacaattgtttcttaatttttcttctttcttctcttcactcacgtgatcaatactaaactttgactctctcttgttacgaccacaaatttttgacgtatcgaaatggttgtcagtctaataaaaaaccgtaaataaaatctagtaaaatctctgttaaattaatagtgttggaatcaaaatattttgatttatagtgataagttatctctaaatgaatatttattattttatgatataaatgaattgttaatttgtagagacatttttttatttttttattaatatacgtatatcaccttgaataattaatacaaagatacttaaatgatactgtgtttatataaaaaaaaaaaaaaatcattagcaatcattcgattcggcttgcaataatctaaatggaccattttatcacttctccaacaagcaactctacagtgtttaattttaaattaagaatttaattatctatatcgtctcttctttagttaggaagtggataagataaagtctaatccaaattaaatcattaatacaaataaagttaagacaaatatttaatttaaataaataatcagaagaagagtgatgatagtgattcttcacgcgcctctctctcttcttcgtcctctacaaaaacacttgtctctcttctacacattgttcttcacgaacctctctgtatcatcttcatcttcttctcccgtaaagctctcgcgtct

SEQ ID NO: 2690 - DNA, 3000 bp, Unknown
  misc_feature (1)..( 3000): cDNA_ID_2167656_gDNA_ID_1620576_Annot_ID_160988 3000 nt of promoter + ATG
attttcttaccaatatatcatccatcaacctagagttgaacctcagcgtctgagccattctctgaaacatgattgcattttctcgcgagttccagcatttccattgttcaccgtaggaataatcttatcaggccttaagaactgcgcaataacgaaatcagttaatgctaaaagaagtgaaaaacttatccaggacagatacggatagataaaataatgacattcctgatacatacttgaacaaactcacgaagctctgtgaagcttgaatgctcactatatggcacccctataaaagttacataatcacctgacagtcagacaaatcggcctccacaagtcatcataatataatgatgatatttagagctaagctcatagagaatgtgcattataaaaatcaaacgcaccataaatggtgatttttccccttgaagttggttttatcagatcaaggtgttcacctatcttctcggagtaagtccaacctaaaaaccaactttacttttcataccaatagtctaaataaaatccatataaaataacagcaagggaaaaaatcacctgtgggcctaaatgccaaaactgctccatactgttctctataaatcttcaagtgttcatcgagtctcttcagggaaataatcagaacagagttatgatcatgcgaggttgacatggagtctatatagaataatacttgagataagcatcttagatttagagaaatacttcaactttcaatgacgacataggcagaacatgaagacatgtggctttcccatctgtagaaagattcttcgaaatatcatcccaaccaaaagattgcagtattcgtcttcttgaagcatttgcaaatatcttaacctgaaaactccaaaaagttagaacatatagagtcccaaaaagatggctaaaacagaaagaaaatgtctccagcattttataccccaagagctttggcaatagcaagataaacacattcttttccaatgctgtaagaaccaaccacaatcagagtcttcggttgcttcctgaggaaatcctttgtgattctcacaacataacttaacacatcttctttagaagggaatctgaacaataacataaaaaagaatggatcaaacattacattacgagcacacgctccttcaaatccatcacaagttatactatttgacaaatttttgctctcacttgtatctcggattgcaatatgttgtatccaaatacagaacatgaactcgttggttaaagaggagaggatgcgtttgcatctgtttagaagccctgaaatctccggtatgcagataacatgttccatctaagagacgaaagtgaataagagcagcaccagggcaatgattagcttcaattaaagtgactttaatcccattaatagtgtactcaacgtctagctccaatggatgaatagacctacacacagaaactaataaatacataatttcaagaaggaagtccttagtcacagacagctttaacaaagagcttacgagggattaacagagagactaagtctaagaagacgactagtgagagaggagcagtaaataggaccatgagaccaagctttagtgagaccaatgtaatgatcagcgtgaaaatgagtaaggaaataagcagaacatccttgaacacaaccatagcgaaaagcatccacagtgaacggtgttcctacatacaatcaatcacaaacttcatgaaattggcaaagagagaagcacatttaggcatatgaattcaaagaagaagaagagagagagagagagagacctggaagtttcttgtaaaatggacatggtcgaggcgagtcattgctaaacgaagagtctctacgcctttttccaagagcactcgtcgtcttcttcgccgaattcgaagcaggtgaagtgaaaggagaaggcttttgtaaaccccaactctgaaacaaatcagtttgtttcatcttcttcgttgtatcaggagaattctcttgtaaaccccaaatctgaaacaagttcgactgtttcatcttcttcacagaagaagaaacagtctcttcatcttccactaaacaagaccaatcagaaccagccttatagaaatcagacgcaaaaccctcttcttcttcattctcttcaacatcgtcgttaaacacaaaaccctcttcgtcttcttcttcttcatttacaccgtcgttgaaacgagaaccaaaacagttttcgtcgtcgtcttcatcagaaaaatccatccttttctgtctatagaggttcaatgaaaatgaaaggtcaaaagagtcaattttgacccgcccgccaaaggttgctttttggccattgagtgtctctcaacgagagagagagaagagaagagagtaaaaatggtaaaaagcccaaaacaaaacgtgaggagcagcaagaagacagatttaacaacacaaaagggcccaaccactacgtcattttgtatcaatctaacatcgccatcgtcgtcgtcttcgtcaccgtcgtcttcaagctttatcggcgattgggtcttccttacgaaaaatcaaagcttttttagaattttcaatttttggggaaagatccaatttttatccttcttccttttattcgacgccattttgtttggtaaagcttaaatctcaaaaaggattctctttgttgggagagaacttgtgcaatctgcatcttctgttagaaatcgatctggatctgaagctcctctatcgtcccttcgcaggttttgtctcattttctctttctctatgctaatcatcgaaaacccttgtttcaattttgtccatttgatctctgtttcaatcaaaggtacaagcttgtgtttgcaatcaccatctaatagcccttcttaggttttatgcttcttctcttgaaggctaagattcatatgagggaggcctgagctagttgattggttcaagtttgcagctttagatgatcctttaactgagctatcttcattctttaattaccaatg

SEQ ID NO: 2691 - DNA, 3000 bp, Unknown
  misc_feature (1)..( 3000): cDNA_ID_1019757_gDNA_ID_1620576_Annot_ID_160994 3000 nt of promoter + ATG
ttcttttcgccgacattcttgttttattctttctctccagggttatcgcatggtagtagaagcttggagcatcggtgaggaaaagagaaagagagagagaaggcagttttgttttccaaatgtcagcaattcttgcagctgccattggtggtgctgtaggagctcttgcattgattgctttgtttgtttttctcctttggttttgtgtctttcgtcgtaagaatctgtctagaacttctgagactggctcttctgatccatctactcaaggtaaatcacaaatcccatcaattctattcctctctctctctctctattgactttcttggatgatatcaaaatgatttagacttttttttcttttgttatatgtttgtgtgagttcagaaggaagaaatgttgcaattgagttgtcaatgagagaagctagaagatttgaaatggaggaacttgctcaagccaccaagagttttaccaataaaagtcttattggtattggcaaattcggcgaggtttacaaaggtttgcttcaagatggtgttcttgtagctatcaagaaaagacctggtttgcctactcaagaatttgttaacgaggtttctataattaatcttgttcaagtgtttgcttttagtcttcttagaccaagtgtattgattgagaggatatggtttatttcttcaggttcgttatctatcgtctatccatcaccgtaatctcgtcactcttttggggttttgccaagaaagcaacacacagtttcttgtctacgagtatgttcctaatggaagtgtttccagtcacctgtacggtaactctctgtccttaatgttattttcatttggtatttaatcagtttgagaaatgagtttggacgatgtaagcatcgtttaggtcttttcctctgttaggtgctggtggtaaagtacctggtaatagactagagttcagacataggcttgcaatatctataggagcagctaaaggtaaatcctctacaaaatcctcattgaagccagctctagcttgtgtcctgatcttgcatatacccttttgttatctctaggcttggcacatcttcactcgttgagtcctcggttgatacacaaggacttcaaaaccgctaatgttcttgtggatgaaaatttcattgctaaggttgcggatgcaggagtccgtaacttcttaggaagagaggatgttggtacatcgtctcacattgttgcagaccagattttcctctccccagagtaaattaaaaagatttcaccttctaagctctcatatgcttctttttagtatcaaagtttctcagattgtcccctttttttttcagggttcaagagttcaaaagattttcagagaaaagtgatgtctatgcttttggtgtattcctcttggaattagtaagtggaagagaagcatcagaaccatccccttcaagctcaacgcaaactctagtcgattgggtatgtaatcacactcaaaaccgtgccaatgtaatctattttgattctcattttgtatgcattgggagttgcagatgcaaaacttaacggattacgcagatataccaatgatgattgatgagagactaggaggtacatacacagcagaaggagttgaggaacttattacattgacactaagatgtgttgatgtatcaagtgagaagagaccaacaatgagttttgttgtgacagagcttgaaagaatattggataaagaagtgagcttaacaacagtaatgggtgaaggtactccaactgttactcttggaagtcagctttttaaagcaaccaagtgattattataaaggaaccatctttttacatatatatacatatatatatatatattatataagttctctgagacaagaaccaatcagagaacttaaggaggaagaagaagaagactgatcagctgttttgtgttaagtgtataaagaacagctgaagcttattgtttgtttgttttttccctcctttttcacttcctttggaggttattattttcagcaattatttttttgacaatgagtgcagaaaagtataactttgtaaaaacattatttattgatataaaggaagcaaagagtggaatgttgtgtgattctttgttacattttactctctacaaaagctttgaacttagcttgaaagactttattgccaagttggttggttgaataagttttgatgaaaagattccaattggctaactgttgaactaacagaaggtgataactccctgtctgaagaactctaattattatgtttgtacagaaaaactcagagctactttttcctataaagtagccaattttgggaaagattttgacctttagcttcaacctacctatgctttgatagcctttattgccaaaggggagatatagtaaccaagttggtctctaaagtcttgatcaaagattccaattggataacaacactcttggtcttggactagtatagttcctacatactccatttgctactagtgaaaataaactcaatgctctgatttattactctgtccctagttttgctaaaaaacctttgtgggcacacagaactataaacaaacagtctttggaacagattgcaaaatcaaaatcatgtttggtctgattttatgtcgggagagattgaagatctaatgataaagactcttcttctgtagatagttaactcgttaaattggtgggtctcacatttattattaccttccagattttgacctcacagaagcaaaaacacagtagtgattgaaaagcttagaaaagaaattacaaaaccagagattgttgattcttagttcatacatagaagaaagaaacagagctaatgttttgtcataaatactaaaaaccgttaaaagtatatttttaaaatgagaaaaaatgtgagccattcgatttttggatagacccatcatgtaaaggtttaagctttttttttgttagccaaagagaaagcctttttagttctattgaca

SEQ ID NO: 2692 - DNA, 3000 bp, Unknown
  misc_feature (1)..( 3000): cDNA_ID_1818871_gDNA_ID_1620576_Annot_ID_160990 3000 nt of promoter + ATG
gaccctctcatggacaaaatctttgcccgttcgagtccgtttcctctaaaccctgtaatcttcgaagataccattggcatcactagaatcgcagatgcatttatagagtcttcaccaaatcctagtgctgctaaacaagcagtctgcaacacaatgaagtaaagagttttaattagtactgttgaataagctcacaaatgaagatggttctgcttgtgggtacctttgtcttggcaattaaatcagctgctttcatatacattccttgtacaactactcttgtgtctttgctgtgtccatcttcagatgattgtggtatcaacctgttattgaagatcaaaatagttatagtagctaaatcatagaaaacttctgaatttctaatgagaacacagttttttacctgtcctcctcagttggcacactcgaggacacgatggagtcaagagatgatgaattatcttttgtctcattgcctcttgtatcatcaggtgctagtaaagaaatgcctatgaatacacacatcattcctaatatgaacattgttgttcttagcgcatcgaaaacctgtttaaggaagaagaaaattatctaagcgactatccctaaacccacaccattctgtgacaaaatgatcaaactaatcatctagatccgtattagcccgaagataaagaaaagagaggaaaagcatcacaatgtagtcaatagatgaacctgaaactcttgaaagtaaatgcatcctgtacagatggagaagaaagtccaagcaatctgaaacattggaactatgagaattgcatcatatagagacaatccttcattcaatcttgtcatctgcaacagaagcacatgaaagacgtttttacttcagtaactatatagtctcaacggcacaacaaagcaccaaaatatttcagtagcttgaggtttttttttacccagaatccggctgtactaagaaataaaagaagcatagagtatgtgaaccagctgtgcagttgatagctactagacatggccaatctcagcaagttcgagctacaaaacgaaactcaaatttatcacctgaaactatctgattttcaagtaaagcctgtagatttgcaaactcacagtgacttggcaaataaaactgaacatgatcctatagcacccgagaccactgcatatgagaaaggaagcagcattttccaataagagctaatttcttgtccaggtgtagatatcaaaacttctcccttcctgaatatttcgattaaactaatcacaaaagaggtcccgatagttgaaaatagtcaaggaagaatttcaaatgcaagactcacctatagaggaaatggtgcacggctactattaaaatcaaaataccacagtagaccaagaatgttacattgctatatttctctgccaactgttcgggtgtgaaaactgagcacagaagatttttattaggccacgctttgtgaaaaaacgacagaacaatctgttcaagaatagttacctggtgactggtgattaccaaaagctacaaggaaaacgtttccaagaactataaaggctgtagcaacgagtactctgtgaccaaggcatactaaagatattagaagagcagagacttagtaaatcggtaatgcatgttaaagattgcagcgaggtagtttgcatacttgacagtaaccattttgttcaatacaacataagcaaatgctatgttggatacaaattgaatggatccaagagctgctagaagggactgcaaagagagttcataacggtaagaaaaccaaagagaaaccataatgaaacctgacaaatcacgcaagtaggcaatgtcgagcagatcattctacctgagcagcataaccaaacgaaatgaaattgaggcaattcccaagaagaaagacaaggatccctgtaagattccaacaacattggagactcagaaaaagcttcatataaacttcaacggggaaaaggtttaagaccaggacataccaactctccaagtctgattatgtataattggcttcaatggcatctttcctccgccatcttgtagggctaacctttctctctgataatacacaaagtaagacaatacgtttcacgtgacgagatcaaatgtaaccaaacagtagtggctgaggcaaatgcagacctcattatgtcccaatttgagaaggtttgtgccaaaattaatagcaacacttccaaaaatgttgatgaaagctccgatgacccactctcccattggtaattaaagaatgaagatagctcagttaaaggatcatctaaagctgcaaacttgaaccaatcaactagctcaggcctccctcatatgaatcttagccttcaagagaagaagcataaaacctaagaagggctattagatggtgattgcaaacacaagcttgtacctttgattgaaacagagatcaaatggacaaaattgaaacaagggttttcgatgattagcatagagaaagagaaaatgagacaaaacctgcgaagggacgatagaggagcttcagatccagatcgatttctaacagaagatgcagattgcacaagttctctcccaacaaagagaatcctttttgagatttaagctttaccaaacaaaatggcgtcgaataaaaggaagaaggataaaaattggatctttccccaaaaattgaaaattctaaaaaagctttgatttttcgtaaggaagacccaatcgccgataaagcttgaagacgacggtgacgaagacgacgacgatggcgatgttagattgatacaaaatgacgtagtggttgggcccttttgtgttgttaaatctgtcttcttgctgctcctcacgttttgttttgggctttttaccatttttactctcttctcttctctctctctcgttgagagacactcaatggccaaaaagcaacctttggcgggcgggtcaaaattgactcttttgacctttcattttcattgaacctctatagacagaaaagg

SEQ ID NO: 2693 - DNA, 3000 bp, Unknown
  misc_feature (1)..( 3000): cDNA_ID_3052046_gDNA_ID_1620577_Annot_ID_161007 3000 nt of promoter + ATG
gtatttgctaaaagaccatataaacataaactaccgcttcatattcgacattttcttcacaagttcaaagaaaccttcatctatggcgttataaagctagtctattagagttgtttctcttgagctgtgatggaaaaactcttgtttggagcatcctttataaagataagagttttgttaccgcgaactaattcaagtatctctgtaacatatcttgtatggttttgtcaatctttagtacattttagacctggtttttttctctatcaggatccgcccaaaactgtatccaaacatctttatccagtccattacctacagtgaaaacgagtactaaacgtttgcagtttggttcttgagtggcaaacactttgatatgttactatatggtccatacctttctcatcattttccacttccacaaagccaatgttttggggatgtaggtagatacaaacctccaaaagaaacagagagcatgagatctcaataaatgtcctttcacctaacttatcactgtctcccacttaattctctcatttataaccttcactttcacttagtgtctctccactatcttgtcttgtttcgcctttaattctattcctctcctctggctctcatttataatcttcactccaaatgcacctttctttgtactcccatcactttctcttcgatatggtatttactttaatccgattcgaatattgtaactatgaaaaacaaaatgaatagtaaaaatatccgtttcgtatccaagcctatttttaaaagacacgtttgtataactctctctatatatagaaaggaaccacgaagctctttcaagagagttctattcttgtctgaaaactagttccctatatttcttctttcttcacacacatattctccaattcttacataaatatcaaataaaccaaacttgaaacttgttgtgcttaagatgacgaagaaatcactgacaatgtttctttttatacttctgcaatttctgctcgtaaactctctatcttcaaagcattcatcacccaaaccaaaaccagatgcagaaatcactataatgggttttgtttactgcgatgtttgctccaaaaacagtttctctaaacacagttacttcatgtccggtagtaactcagaacaaaaagatctctttaattaattccctgcaaaaactctgtttcttaacgtttctttacacaggtgtggaagtgaggatagtctgccgattcaaagcagcttcgtcaacaacgacagagactataacattctctgcaaacagaaccaccaacgagtttggactgtacaaggtagccatatcttctctagattgtgctgatgtggacagtctcgcgagttcttgtcaagcgagtttgattggaagaaaaaacttctccgattcttcttgcaacattcctggttatagaaccactacggatcaggtcttgtttaagtctcaacagtctaattcctgtgtttatggattcaatgctttgaatttcagaccgttcaagagggatcttgccttgtgtggcaagaaataaggtttttagaactacaaattatcattcactattattgaaactctctgtttgctttctactcaaatatatatatatgtctttcgtcttgttctcgaccattggctttggttaaaaacaaaatttgaatttttatttcgtatgctgtaaactattagtatgaaaaataaggaaaatgaatcactttttatttcacaacgtaatgaacagaggaaaattttggcgaatgctagaaaacacaccaaaattttacgaacaaatttacacaatttctcctaaaacgtccggaaaaattgcacgactgttactagttttaaagcacgagttaccaggtcacctgttttcgttagactgataattcatatttctacagcaaatttagtatatcaatctgtgtaaatattttattgatttataatatataaataaagttgcatctagttatgtcgtcataagtttacgcatacgtatatttggagaaaatgtcaaaaaaatctttaattgtaaaaaatagcataaaaagttttaactttatctcgagtaaaataatgcgctaattttcattaactttttattttaatcatatttttaattgacttcgcatttttaatcgctcattttgttgactttacccaatatgtcacgtagttaagttgactaacaaaacaaatttttagagttaaattttcgttgagatgttatgttaaactacacaaaaaaacattgtttaactaacaaataaaacttaaaatgaaattcaatcttcttactacttagataaactcatggatacgtcaatggtgacatacaaaaagtgtatattagagagtaactcaattatattatagtgatttagccctaagtttttaattctagaaaatttaaaaattttaatgattaaaacaactataagtttttaatatattggatgtatattattacaaacaataatatataagataacttgtacatgattcaccaaaatagtctagttgaaacaactataatttgaagttaaataggctaagttgaaacaactataattttgagattcaactattcttgggttacggatttttacattcttattaaaatattgtgttattggtttggggggttttaaatttcctcaaatgaatatcttcttatacgaaaagattagttttctttgtaattttattaaaatgatgattatatttagatgtggtcatgtggatgaaccaccaccagtgcaccaaaaacagaaaacgacgcctaccaacttgatgggcttttaatagatatagttagttaggcccagtttagtgttaatacgataccgtttgacgtagtttaacggccaccgacacgaacgaatccaaaacggcaccgtgtcaatcgcatccaaagctctgatgtaagaaactctacacttgttcgagtttcggagaaaagaaacgatgaggaagagatg

SEQ ID NO: 2694 - DNA, 3000 bp, Unknown
  misc_feature (1)..( 3000): cDNA_ID_3069193_gDNA_ID_1620577_Annot_ID_161014 3000 nt of promoter + ATG
ctttcaaatatattaattataatatttgtggtaaaaagaaatagtttaataaaaaacagaattacctcttatatatttttaaaatttggatgtttgttaagttaaagttcatattcattcgaattttgattcattttgatcttatttataataggactctaaatcattgtctaaacattttagccgatatggaacgttaaacatatattttttcattagttaggtaatatatgtctgttttaaaaatttttgaatcaccatatatgcagaaaacaaaattgagatatttttaaacttatgtatcatatgattattcaaagcattttaaaaaataatcaaacaaagatgaaaggagaatcataaatttaaatcagaaccaaatcttctaaatatctttattattaatctagataagtcccgcctaaataggcgggtatagatataaatagaaaaatttaccaatgaaattagaaattagaaatttgaatagtaaatagtaatgcacacacttttcttaatagttaattttgtaagttttgttttaaattgtttttcaatcttacacattctatttactatatacttttaactatctattttatcaaaataaactgaactttaattgtacatacttcattttacggataatatttgaattttaaataataaccacacacttttttatatatttaatttagtatatttcttaaaccaaatttcaatcttacatattctatttttgtaatacaatttagctacctatttcatcataatagattggattttaattctatatttcatcataatagataagtgttaacaactttctataaaaataatatgtatatcataccaaatcgatatccaatatcctagttttgacaatatcatggacgaatcatatatataaaagttgtccaactctctccatccttctgacacgtcaacactggagagagtgatacatgtcacatcaatctattaattatatttataaatttattatttatttacgaatttaaaatcatgcataatttacttatataaaaatttgacttgttttaatttattaatcaaagaatttcaatttaataaggtacaaagtatttcaaactcatatatgaattaacttatttaaatttacttatataaatcatataaacttatgcataaacataaaatcaatagaattttaatgagattttaaattttattacagtataagaattaaataatatgatataagaatttatttcatgtttttatatagtatataggattagtgacaatgaatattagttgaatttacagtttattttaaggtaaatatatcaaatcaatactactttttcgtttatttaaaaaataacaatttttttcttaaaggtaaataattgtaaataagttttaaacaatgtaactaagaaaaaaatagaatgaatcatactataaaattacaaaagaaatgtggcactatatatagtagaggttcctaactctatcattctgtatcatcttcatcacaaaagaatctaaagaaaacgaaaccacatcgtgagaatcatgagtcttcgtaggttactgtgcacgagtaggaaagttcctcctccagttgtagctgcgagaagcaccttggatctggctccagttaatcctacgggaagcgacctagatccgcacgacgacaagtgtgatccaatcaccccaattgatgacccagaactttatatttattacaagagttacaattctgcgagggacaagtgtctcaacgacactttttacaaaggagggacaaccgaaccggatgtttagaggtttgtctcataaattgcgtccaccatacacgacgctgttgagataactgaaactgagaatatgaggatagccaacaatggagcccgttctgcacaagagcaattcagttttttacctcctaagtaagaactaatgcttagtgctataagtgagtgtctgattttttgttatgtcttgttttttaataaatgcgttttgcatattagttgtctctaaagtaaacttagccatcatgcaatattaatgtgcgcaaacattttttgtacttaagtgtcacaactaattcaaaatttgttgctgaaaattatgctatctatttatctattgtatggtatgttttatgatttaattagttttatttacaatcataataaattttgtttattattaaatgtctctttctataggtctaagttttgaaattttatcataatttatatatatatatatatatatatatatatataattatatgagagttttataagttactactaaaccgagtctaaagctaaaccagaattaaccaatatagcatcattcgaattatttggactctagtatacataagtgcaattaacaattgacattgccttagagatctcacaaaaatgatatcaacaaaattaaagtttgacaatatcatggaccactatattcataatttattactagatttaaacctcatgaacattattttaggtaacaacattcacaacttgtaaggaattcaacaatttcatccaatgtatattaatagcaaggcccagcccaatactaaacatgagcccaacaaacaaaaatagtattaaacgaccgttacaaaattttagttgaaaaaaatagcaaaaggataaatactctgaagtctgaaacactaacaaagaaaagaacaaaaaacacatttatggttatcaatccaacagaaatatttatcgctttgatgtaacaagattaacgtaacagactaaaattacacgtgtcactttcttattcgacctactcaaaatacattgcgtctaatcttaagcttttccataactaacctccaaaatccgtcaaactcaacattttctcttccgccataaccaattttctctagatccacggatccatttttctcgggaaaattcgaaatccgccggtgaaaagaaactcattcattgaattagctaaaacatg

SEQ ID NO: 2695 - DNA, 3000 bp, Unknown
  misc_feature (1)..( 3000): cDNA_ID_2168035_gDNA_ID_1620577_Annot_ID_161030 3000 nt of promoter + ATG
catgaaagaggattaagatgttcccttttattgttgttctttttgttttgtgtgtgttattctttgaagaaacaattaaacaaaagccaaattgtatagtttataataaagatgtcgaatcaaactgatatttttaacataaacgcatgtagttggatttttaaaaaagttagagaattagatacgaaagcaaatcttattttaaatatatatgtcttcttttattattacataaaaaaaattgtacatgttatgtatgttcagaattaatgatggttgatcaactataaacagattttgctacacaactctttcaattttgtatctcagtcggcaccataatcttcatagacatttcaatttcataaattgtcttactttttttttttccggatcttgattttgtttctaaatttatttatttcttatttataagaaagccttttttataaaaaagtgatataatttaattttgttataacgattatcacatgtgatccatgatttctaaaaagtaatgatcatgacatatctcaacaaagttaatttggttagtaaatcttatattgtgggatcatttctataacatcccttcgtaattttaaggatttattttctaatattttcactaaaattaagaaaaataattaatgatgcagtaatcaatttacttttgtactacgaattatgttgctttccaataattctaattacaccacatattaaatgcatcatttttgagatctttcacatttcctctaaaactaaaaccatactctttaaatttacaaatttagttatatgagtcacttatttttgttaaaagttcaaattaagagccaaaactacgtttttcaaaaactaaaattttagaatggaaccaagaccagtaaaattaagttccattaatttttttatatatattgacatagatttacaccatttacttaaaatcatatattgttttcataattttaatttaaatttaccgcctcaaaaacaaaagaagtagttagagtactatacactagagtatgacttttgaccttctcattctaaatgcctacaattaattatgtattgtaaagttaaaatgcattaatgatttagaaaataaaaatactagaatatcaatcttttgatacaatactaaaattctagaaaatcaatctttgaatttgggaggggtataaaactaaattcagtgataactacgtacactaattcatagtccaatttgatgcgatctggaaaaaataaaagactatacctagatcaataataactcaatccttccatccaatgataattacagttgggactggtagaataaaaaatttcaacctatgaaataagggatttgagccttaacatacatccaaatagtaacatatgataaatttcttatcattgtttgattgaatgatcaaaactattatgtagatctataaatgtgtgtttataaatttttcaagtgaaactggataaacaattctgtctgacacttttttttcttctgaaatgtgaagaaacaattccactattttagtttgttattttgggatataactagttcaaattttaaaatattattaaaattctattaataattttgtcattaaactcttttaaattaattgagttatctttcctaaataaatatctacataaaataaatatacggtcaaaaaaaccaaaaaatctattttgtccgaagaaaaatatcttcaacaaacaaaccatcaaaaaatggttgtcacaaaaacaaatatattcaaaaatggtaaagataaaatctaattggtcaactatatcagacggtgaagaataagtcagcaatcgtagaaaactggatccaaagttgagctttcaggaccgattcgtaacgactgttatttatggttgtagaggttttgggagttacgactttgactgtaaaagctttgactgcagagactttgtttttaaagactttaactgttaaaacatgattggtaacaataaaattgtaactatataattatgattataaataattaccaaatatataagaaactgaatcttaaaagaacaaattttaaaaataattctaaatcaattgaatttttttaaaaagcaattaataagtatatgttatggaattttagaatcatataagaaagaagaaaagaaaaaataaaaacttttattttgtttatttctaaagtcactaatacgggacttaaaaaaaatttgaaaacaaagagtaaataaaaaaaggatgggaaagctttaaaaatttttaaagtaaaaaaatcttgattcacaaaaaaaactttgaagacttctaaaatcattttaaaatcttaaaaacctcaaccaatcatccccttcaattttcaaaattgaaagctactgtctactgaggcaatgacgcgtgtttgctacggcaatggcagaacaacgtaaataattcaaaagatgagggggtatttgggtaaaagagtttctgataaaatctcacagatccaaccaaccattgaggaccatttcttctctctcattctctcttctgacgtgtttcccttcttcggtttctcatcctcacgtccgccggatttcgaggaaacgaagaagaagaagaacaacaacaacaaaaggtctctctcgagtttctatgtttatctttttctataatcccttagtctagtgttgtttagactttcaattctgctccaaaatctctggatttttgaatctaccgttcattttctagagattttggtttctctcagtctaagagtcgtcttttgaaatcttgaatgatgaatctgagagtttctatgaaatttgatggaattttgtgtgttcagttgttgattagggtttgggattcaataactttcaaatttggtttcgattaggttcgatttggttatttttacctgtgaattgatctcgattcgttgtattaacgtctctttgtgtttttttattctgtttatgctagccttttgagat

SEQ ID NO: 2696 - DNA, 3000 bp, Unknown
  misc_feature (1)..( 3000): cDNA_ID_3069235_gDNA_ID_1620577_Annot_ID_161033 3000 nt of promoter + ATG
aagagcttcaaatgtatccaagcaaaaccaacttctcaaacaaagatagttcacttgttaatccaattcagttaacagaacaaaagaaaaaaaatgaaaatctttgctttgcatcatcaacaacaacaactaaccaatttcaaaactcttatgcctcccaacaaaccaaacataagcaacaaatatcttatagtaagatctttagcttcacatgtaacaacaatcaaccacaatttccaaagtaaaccaacttctcagataaacatagctcacttgttaacaaaactatataaaagtttaaatcttttggtttccactcacatcaacaacaactaaccaatttcaaaactcttaatcctaccaacaaaccaaccataagcaataatcgatgatgcatttgcctggacaaagtatgctaaactctatacttaagaagctgtaaccaaaccctaattagtcaccagaaactgctaccaacttcagaagattgctctgaaccaaaacttgttctcaaaacgaatgctaaattaggttaaaaggtataaagaacctgcaagcaattctcatctcatctttccaaccacactccaccaatctatctctcacaagctccattagattctccttctctccactctccaccaactatgacgatttcaaatttccaaaaacctttcaatcaaaagtccacaacagtaactgaaatcgatttcgcattacaaaatctgaaaccttgacgttgatgatttctcgaagcgtgaccttgtctttctcgaaaccatccgccacatcgtcttcatctggtgtcggaggccgattcaccgaatgtttcctgatcagaaaaaagcgagaaatcgaaagatgaaattgaagagtaacgattcagaagaagggaataagattgtctaatacatacatgtgtttgaatcgatagattcgtttcaagaacacgaatcaattgtgatggatgaacttttttccagagtcttcttcagcaaacccagaactgtatcgcacgacgaaggagaaagcacacaacgagtcgagatcattaaatttcaatattataaactacgtgccgtttgttaaaatttgccgaaacaaacaggctgttttgtttaagtccactggatagaaactacgtgccgttttaaatggactctacaagtagggaaaaaaccttaaaaaaatccccatcgattttctattttgccgtttaatacccaattatttttggttggaaaaaaatacacaaagtagttaaactgtgtgatttaatactcaaaaaataacatattattattgtcatactcacaatttcataacaaaagttaaatttcaattatacccgtattgttgaattaactattaatttgtaaatgacatgacaatcatttttattttttcaataaaaagatttatattttgttttactttttcttatttatattctatgaataaaatgacatggtaactactttatttataaatttcaaaataaaaaattatagaaaatctggagaaaaatagaatttttagtaaaattagtatacattaatatgattctcatttttaaaaattagtatatattattgataactgttttatgatcttttaaggtacgcattcaagaaacaatcacaaaaaagagttatcgattctttctcacctcctctagcattctcacatcctcctagccttcttctttgtttccaccatcttctccgtttccaccatcttcatttcctcagcctttttcttgtcttccaccattgtctcatggatctacttacctctcagtctcataatagatcaaaaccatgtattctcatagagagttatcacaaatggcgctgtatgggatgatcttctcgtttgttattgccttcaactcgtggagcaacactttaaacctaagcatcattataatacatatgataatgattttcttcaagtatagttgaaaatgatttatgaagttcaaagtacataatttggcttgaattttacattttaagttagaaattttatggttattagttttaagttagcaaatcagagttctgactgatatggcgtaaacaatataattttatatttatgtcgcaaaatagtaagtataagatttgtttttaaggagaaaggggtagatagatatgtagataatataatacttttatatattaagtatgttttaataaaaaacatttaaaagattataaataccaattagagtagaacaaatatgaaaatattaattaaaaacaaatttgaactaatccactatcaaatttcaaagttattgactaaactttgaactaatccatatatgataaaccacttatgtcatgtgggaaaataataatatttggcaactaatggttcagaaaaaaatattttctcgcataacaaataattcacttaaacgtcaatttcctaaattttgagtttttaaatcaccagagtgttaggtgaataagaatacttaaaaatgttgtgctatgaaataatcaatcaaacaaataatccaaatttttagaattttttcgtcgaatagtgtataagtgtacgaaatttgcaaaaacccaaatgttattttcaagaatagtaagctcttatgttaaacttaaatgttttcattgtgagaacgaacgtcttttaaacataccatttaatagtaatatgtactaatgttattgaaaacttactttctgctaatattggaagcccattaaactaaggcccatgaaagaaaacacccacaccgacgtcgtataggaaagatgtagtcatgtgaagaaaaaaaattaacggtcaacgggaaaaggaaaacgatggcgcgtcaaatgctaaaccattaaactacggttgtggacggcaaacgcttgtcgtctccgaaacgcaaccgcagagaacccaaatttatatcattctatatcttctcttcttcaccggcgtacaatagcactcaactcttaacttacgcacctctcttctctc

SEQ ID NO: 2697 - DNA, 3000 bp, Unknown
  misc_feature (1)..( 3000): cDNA_ID_2167723_gDNA_ID_1620577_Annot_ID_161017 3000 nt of promoter + ATG
gattgaaatttggtttaagaaatatactaaattaaatatataaaaaagtgtgtggttattatttaaaattcaaatattatccgtaaaatgaagtatgtacaattaaagttcagtttattttgataaaatagatagttaaaagtatatagtaaatagaatgtgtaagattgaaaaacaatttaaaacaaaacttacaaaattaactattaagaaaagtgtgtgcattactatttactattcaaatttctaatttctaatttcattggtaaatttttctatttatatctatacccgcctatttaggcgggacttatctagattaataataaagatatttagaagatttggttctgatttaaatttatgattctcctttcatctttgtttgattattttttaaaatgctttgaataatcatatgatacataagtttaaaaatatctcaattttgttttctgcatatatggtgattcaaaaatttttaaaacagacatatattacctaactaatgaaaaaatatatgtttaacgttccatatcggctaaaatgtttagacaatgatttagagtcctattataaataagatcaaaatgaatcaaaattcgaatgaatatgaactttaacttaacaaacatccaaattttaaaaatatataagaggtaattctgttttttattaaactatttctttttaccacaaatattataattaatatatttgaaagcattagaaagtttataatattatgaacattagaacatataaaaataaaaagtaatatgggaatgattatattgaagaacaaggttttatggtgccacggcggaacgagttttgagtcaacattaataaaaaatataaatatcattaactcgctgctttaatacgggacggattaaaatcaataactattttgaaattttatgaacatttgagcatatttaaagaaaatagcatgggacgggttatatggcgggatggactatattaaaattgtattgaggatttaatgtcaatacaattgaatttatgtatactagagtctacataattctgttttatgctattttggttaattttggtttagctttagacttggtttagttaaagaactcttgtacagtccattcaattttgaaagaagatattttacgtttttgtttctctttcgacctcaatcttgagagaagctataattgtatcggcccaaatttcaaaattcataaaataagatacataccgacaagaaataaaacgtttatatatatctagtccaataaagaatgaaaattccaaaatgttgcataaattgtagcctcgggaaattagttaagatcatagctcgagtgaccggttattaaaaacaaagaatacttaagtcgaactccgatgactcaagatccataagagtttaaagatggcggagatagattcaatagcatcactattacttaggtagaaaaagaagatttagctagattcttatatgttgtctgcgttgatcgttttataaatacgttatgtagtgtcatatttgaaactcaattcgtatttgaatataccaatttgtggtttgatatatgagcattatgcatgacgttttaagttattaccaatatatcttcgatatcatccaaacatagatatgtttgggttaatgctatactttcgatttgtggacgtcaattcatttacggaataaccgaagagattgaaaacttatacgtagcacattcagcgatcacaagtcttggactcttggtggcacctaaaatttgcaaacctacaagaaatacacgatatatacaagaaaaatgggaccaagaaagaaaatgtgaggaacgttttacacttcatttgtcagtttttgcatgtgaaacagtgcgacgataatttagtgtacgatacaaaacagtcctcacgtgtatcgatccatcattataagatatataagaagaagaaaaattataaaccttacgcatgaaatagcactttcttcttttgtttactttgggtcacatgaagtacaatatttataatgttgcctcttgttactttgttcaataataaagatgccttacaacatttcaatggcaacattgcacaacatatcgattaattaatctctttttaaccaagaaatttcggatcaaagctcataatctcttcgacaagagaccagaccattttttcaagtcttcttctcgttgccgatcctcggattcaagacttcaagtactctaccctcttgtttgccaactagatactctggtttgttcatatctttccagtttttcaatggtcatatctataattgttccttataattcaacactttctaactaatgtcggtgacgtggcaaaggaggacaaaatagtgggattcactctgtgaactagaggcttccaccattgcttgcacgccttttatttttagagattgaaaacaacatttccttcgaagatgtatcactttccttttggaggaaaaaagcatgcaagaagaaacagtacacaaacaataatacgattgtgttatgttgtgtcatttcatagaatatcatgtcatggcgtacgattatacacgtgtcggttgtgaaagaaggttcacaaaacatgtcccaacaaattaaaaaagttgaaaaagttggagacccttctctagtctctacctcggccagagacttccgtatagccacacacaccttttagcttgagaacaacctttccttaattttgtaacgtcccatcttacgtacttattactatttcagacaccacacgtaaataaacttcgataaatgcatatctaacaacacattacgacagaagacggagaatgccaacaaaactgatcatgtactattctaaatactcaatcataagaatagatccttctagctcaaacttgacctagctactttatatctacaactatttatatagttataaaccacaaagagaattgaaaagaaaaaatagaagctgagagaagacaac

SEQ ID NO: 2698 - DNA, 3000 bp, Unknown
  misc_feature (1)..( 3000): cDNA_ID_3069200_gDNA_ID_1620577_Annot_ID_161011 3000 nt of promoter + ATG
ctgaagtccccacacaagcaagcttcgatggatcccaagaacctaaatcgtcaccaagtaccaaatttcttgaacccaccaccaccaccgcgaaatcagggtttggtagatgatgatgctgcttctgctgttgtttccgacgagaatcgcaaaccaacaactgagattaaagatttccagatcgtggtctctgcttccgacaaagaaccaaacaagaagagtcagaatcagaaccagcttggtcctaagagaagctctaacaaagacagacacactaaagtcgaaggtagaggtcgacgaattcggatgcctgctctttgtgctgctaggatttttcaattgactagagaattgggtcataaatctgatggtgaaactatccagtggctgcttcaacaagctgagccatcgattattgcagctactggttcaggaactataccggcctctgctttagcttcttcagctgcaacctctaaccatcatcaaggtgggtctcttactgctggtttaatgatcagtcatgacttagatggtgggtctagtagtagtggtagaccattaaattgggggattggtggcggtgaaggagtttctaggtcaagtttaccaactgggttatggccaaatgtagctgggtttggttctggtgtgccaaccactggtttaatgagtgaaggagctggttatagaattgggtttcctggttttgattttcctggtgttggtcatatgagttttgcatctattttgggtgggaatcataatcagatgcctggacttgagttaggcttgtctcaagaagggaatgttggtgttttgaatcctcagtcttttactcagatttatcaacagatgggtcaggctcaggctcaagctcaaggtagggttcttcaccatatgcatcataaccatgaagaacatcagcaagagagtggtgagaaagatgattctcaaggctcaggtcgttaaaaggattgggtttttttttgtatcttctggatttgaaaaagcttttggcttttgttttgtgataatattgttgtaatttgtaccaccatggagaagaaaaagaaaaggttatatactgagtgagagtgataatctatacttattgaaacctctgcaaaaacacaaggtgagttcaatttgaggatgatgatacaagagagtggaatcttcaaacctttttttccgagtgtttgtgacaattttttggcagttgttgtttgaacttgcaggtggagtttgttgaatacacacagccagagatttttttgtttggagtctttaagttgcagagaggcttgtttttacttgttctgagttttgttgcttttgaatatcaagaaaccggcttttttcagatagtacaacaatggtaatgtatacttgtcttccatcacatatttgtagaatgaagatttatagctctcttttgctcagtattcttctattgcatctccaaagattgttctctttcgttcgatctctctgaatgagttaaagactttcgtttagagtcgagtgtaaaacacttcgctgcatgttctgattcagtggctttgagctgcaatggatttcacaatgatggtaacgttgtattctttaactcttacttacattcatgttattgccctgagtgtgccgttaactgtgggaaggttttgaactaggtacaaacccttcgcagttgggaaccaaataagctggtattgcatttactctttgccttgcaagctttttcaaagataagtataaattgttcaacgagtcaaaaagtttatatcattttactcattttgacttgaatttgacggaactaaggaaagagactaagagagagagagagagagaggttaacgagtcaaaaagttgcttgatctctatgatttgtccaaccaatcaaaacaagtgaagaaaattcaaaaacattcacaaagctctctctttcccttttgagcaatgatctaactcaacactatggtccaaatacaactccaatagatccattccaaagcctccctcatgatgagagcgtgacttaagttgcttactcttttaatttccattctcttcgacacattgggcaaggagcttgacttgtctacgaattcttccatttcaatatacagaagtgaagatgaaacgcgtggttactttgaggtctaagacatgcagttttgttcttaccagaactaaataaagcagcttagcaatgttccagtaagcatgagagacagtgtgtgtcctaattaacctatataaaagtgaaaacatgaaagctgattttacatcgaacaagtcattggacttgtgtgtgtgaaactgtaaaagtcttatcttatttttactatattggtgactgatacataacatgttgtgacaggaacttaatttacaacatgttatgtagaataaattttagtattgagacaacatagagacaacaaaaaaacctagaagaagattgatatcccaacttcgtaccaaaaccctagtaacatctttctcgtaacataaccctaatagtgattgaaatctctgatcaagggattgcatgatgatcatttactaattcttagtttagatcatctagaagattgttatacaagtaaacagaattatctgtttgacctaatatgggcctgagatagcccatcaatacccacaaccaagttaactccatctcaataattcgagaaaaggggtaacgtatttaataattttttctatgtattgaccgtttgcactacgtgacgttttcacgtagagtaaacgacgcgcattcttataaagaaacgaggaaacagctgctttttgtttgtcgaagagcaaatatgttttctcgatcgcgaccaaacaagtagagaagagtgattcttcgcttcgattcaaagacaggttttttcttttgttccctgagagatcgaatcgaagaaatcgaaatttttgtacttcgataaaaatctgtagtctctatagaaatcggagaagatg

SEQ ID NO: 2699 - DNA, 3000 bp, Unknown
  misc_feature (1)..( 3000): cDNA_ID_2167698_gDNA_ID_1620577_Annot_ID_161009 3000 nt of promoter + ATG
gacaggtaaatggatccacactggagaaagtagtgtctgctgttgaagttcttcacggcgttcagattgatgaggatgctcttgttggaaaatctactaatgctgctggttaccttgagaaagcaacacaagaggttgaaagagatcttagttcaggtatcaccgtccattggctgctacattactgcaaatgtattgatatgcttttttcttatcaagtgacaagcgacatagcttcagttttctacattcgtttgttttaagaactcagctgtttggtctatctttaaccacacaccctttgtatctgaaccgaaatcttaaaatttgcgtaacaatctcgtatctggtctatgtgtgatcttaaaccactaccacgcttccaattcttacttccatgatgctcctctctcatttttccaaatagtttttgccaaaatcatcttttaaacatggtggctcttaccatttgataggaatattcagcatatctttgtgtcaaatcatttaatgataagagcacttacccccaatccgcaacgagaataaccagtgctacacattttggttaattttggatccctaatttttgtcactacatttctgattactgggactggtctttatattaactgcttgtagatatattacacttctttacttgtaggatagagaagatccaattcttgttcaagcatccatttgaagttgttttcactatcttacttcttgagcattgctttaaataggacacgcccctgggccagcggtggtgaaggagttgcagggacaacatgtcatattgagagactgcatcgaacagctaggggcaatggagacatccagaacaagtcttatctcacatttgagagaagctttacaagaacaggtttacatttatacattttctttcaaaacaacatctttcattgcaccggccagaaacctcaccttgtttttgtttttgtgtccaggaactcaagctggagcaagtccgtaaccaccttcaggtttgaatacttaccaacaaatgtgatatttgttcctcagacattttatacatttcaatttacacaatacatcataacgttctcaatagtactttccgagacatgctggtctagcttcaagcttgtttagtgaatttgttcaaggaagatagacccaaatctaattagggttcttggttgcctttccaaacagaatgttgccttgtctttatgctatttagttgaattgatttcatttgtgctacgatttcagattgctcggtttcaatcagaccgaactggtgatctctgcagacagcttctagaccatggtggtagttcacagcctcctgctacagaagaagaagagtcaaaagaagttatcaaagtttcatccactgcagcagcaccacaaagcttcacacacagcgatgtggaacaatctgcaccagttatgtttgcctcaaacccaactcaatcgctggaagacccaagaaaaactgctgctgctgcagtggtagctaagctaactgcttcaacttcctcagccgagatgctctcctatgttctctcctccttagcctccgaaggcatcatcggaaacaacaacccacctgctgtaacagaaactctatcatccgtcgatttcccaccagagaaaagacctaagcttcaaaatcatgaccagtcgtatctctcaccgcaccatcagaacactgcaacaacatcatcctccacacccccacaaccgcttccaccaccaccaccattccagcttcaacctcagtttttgcagccgttacagcctcccgggccagtaaaccacacaccattcaactacaccatagcaacctctactgcaaccactcagcaacaacaacaagaacaaggtccttgggtacctgggctcactcaactttcaacaacctctgctccatcggagaattcataccagaagtttcagggacaagatggtttctatggcattaactcatctgtgcctattacacctgtcactcgccagtagtgtaaatctgttcgtaggggttcatatagcaaaaagttcacttttttttttggtttttttttgttaaatatagtttcaatgggcttttgataattaggattttatgttcttaaaatgtgctttgtatgctttctaattgtgcgtctaatccaaggtttcaactctgtaaacatatcataaaaatcctttgttttgctctgagattttactattgttggaagattctatagattttcaaattttcttgttcctctctttgaaatttacatggaagtcagatttggaccaaagtgatttgttgctcgtcttttaaagtcttctggtcaaaacgccgacaaggctttgcttttgactaataaagaaacatacttttccacaattttcttgtctttttatcttatttccttactcgtcagggattccctgtaacgcggcaatcctgacgaaagacatatcagaaactttgatagaatcacatagcagcaatctcttagctggattttaccagcttcactttgagattaggtcatttacccttttaagggtttctctcctactttcttgattctcttcattcccaagactcaaaacctagcaaacttggacatttggattgagtgtctctagtccgggtaagatttgtgtgttgtggtaactttatctgacggtttaggagcttaggttgcttagatgagttccaagtttttatttttcttttgcttattgttcttcttgttcctttggtccaagttcttgatttggacagtaactgaaaatttcctaattgattcctttaagtttgactgtgctcttattactagtcttctctaaatatttttgttctttgcttcgacaatttcattgatgctttgaatttgagaatctctctgtcctcttattattataggtctcatttgggtggattctttctggtgaaatctttcttgtgagagttttgtattgggagaaagagataatcaaatg

SEQ ID NO: 2700 - DNA, 3000 bp, Unknown
  misc_feature (1)..( 3000): cDNA_ID_2167701_gDNA_ID_1620577_Annot_ID_161010 3000 nt of promoter + ATG
atagagaagttaaccgtcttcgcctcacatcttaggttccggtggttgacggctactcgttccctcatcttactaaaagaatgaatgttgctggcagacacataacagcatatctcgttgatctactatctcgacgagggtgagaaactgattcatagactcacattcattttaatgatgttgagatgttttaaattagctaaactaaaagactgtttgttcaacagatatgcgatgaacaaaacagctgactttgagacggttagggaaattaaagagaagctctgctatataaggcatgcaaagacctcttctcagctttcctctaatatctgtgtagtaatgcattactagaataggaaataaacacaatttgttttgtctttttttgcagttatgattacaagagagaatctcagcttggccttgagacaactatccttgttaagaattatactgtaagtctctctcctggtatgaacctgtcaggtgtgtgaattttcaaggtttcgatggcaaatagaggcaagaaacagaaactagtgtacgttaagctaataggaatccaaactcatgatcagaactaaatagatagcagattcttggcgaacttgagcctgtagagaactttaaagattcgtgccatcattcctttgttctttttggtaatgaaagaatgatattatcatcttttcttttcatgacatcgtttctctgttcttgggcgctgtgtttgggatttttcatccgatagtcgataaagtttcatacttgtgccagttgcagcctctaaagctgatattatcaccaaattattttttttccagagtactaacccgttgtgtttttgaactgtgatcagcttccagatgggagggttatcaaagtaggcactgaaagattccaagcacctgaagcgctttttactccggtaaaccttcatcgcgtcctctgctaatttctcttttggaatagtttcaaccctccaagaatctcgaggctgatcacaaccaaatattttttcaggaactcattgatgttgaaggtgatggaatggcagacatggttttccgatgtattcaagaaatggatattgataaccgcatgatggttcgtgtgactcttacgcttgcttggtatttcaaaagaaagatccaacaaaactaatcatttatctgtcttaaaccctttgctcttttttcacagctctaccaacacatagttttaagcggaggtagcaccatgtacccaggattacctagccggttcgtatattttttcttcatcataacccagcaagaagttccattgttttatgtttcattgtcttttattctctgtttgtttcagtcttgagaaagaaatacaggatcggtatctcgacacagttctaaaaggaaacaaagatggcttgaaggtaaaaaagatgattctgataatgccatgatcactgtcagtcattagctcagtttttaacatttatcttcgtttttcttatcaatcagaaactcagattgcggatcgaagatccaccgagaaggaaacacatggtatacctcggaggtgctgttcttgcaggaatcatgaaggtaagagaaaagttcaatgctattctctcttttaacacgaaagcatgaaattttagtctgtgttatgatgttaagagaatttggattcgatgttgcaggacgcaccagagttctggatcaatagagaggactatatggaagaaggaattaattgtttgaataaaatgagccaagcttaataactttcaaacgcagaactcatacttgtacttgtaccccttttttttactaccgtcaggatgatttaattccgtttgtgaattcagtattttaggtttcaaagtttgagtacaattggttgcagttagggatccaaaattcgacatgtgattggtgggatatacagaaaaacgtgtattaactaataatgttgagactaatatattgtgtaataaccaaagccaaaaggtcgagaagagacgaaatgcatatatcttaattcttgagtaagcaaacagagtcaaaacagtgaaagattatttgtaattttgaaaaggaaccctatttcttgccacacaaggtagatccctattgttttctgttaaaacccaaaagattgccacaactctgaattgatggaaccagcttccttctactgcatgttctgcagctagtctaagtacagcagcttcaagctagatcaaagacaaaatgattacctaacctgccatgagtaaaaaaggatttgaaaacttttaaattaactagaaacaaaaaaaactgatttacaatcccaaaataaaaaactgtaaaaactttttgaggtcttaatatgggctttggcccaataacggcaacaccgtgtcagaaacgttggtgttggtgactgttaaactacctcaacgacatataaaacattatgagcgttggcccaataaagagatataggcccataaagttatagagaaatcacccggtggttcatccaaatctaaccacgacgaagattatttccaaactgctcaaacttctccggcgagttttggagacattatcggaaaacggcgccattttattaaccgtgattttcgttggctccttcactgctaattgttagcatcatcgcaacaatctccttcttctgattgattctctctgtaatttcctcttcgcgcttgttttttccgtatttgctttctactgaaattggtctctggttatctctcgtagattagggtttatacaagctttgatgtctaaagccactaactagttttgtttatgcacgtacttgtcctattgtctagttctcgcttcgtcttacgagttccttgtcagaaagcttgaccctttttgttttcttttccattgctttgattgatgactcttagggtttttgacttgtatcttctttgtttctctatagattttgtgaaggcacactggtttttgagctggtgttgaagcaatg

SEQ ID NO: 2701 - DNA, 3000 bp, Unknown
  misc_feature (1)..( 3000): cDNA_ID_1379427_gDNA_ID_1620578_Annot_ID_161050 3000 nt of promoter + ATG
taaagagcttttttactgttattaaatttaaagtgaagaaatgagctaatcattgtggtgaaattgagcagtgaagttgcttgattggggtgaagaaggtcatagatcagaagctgagattgtgtctttgagagctgattttgctcaggaggttgctgtttggcataaattggatcatcctaatgtcaccaaggttcatatttcacttctgtttactttttaccattgttatatattgaggatataaataagatttgggtcatcaatgaatgtatattttgcagtttataggagcaacaatgggtgcatcagggttacagttgcaaacagagagtggtccattagctatgccaaacaatatatgttgtgttgttgttgaatatcttccaggtggtgctttaaaatcttacctgatcaagaacagaagaagaaaactaacatttaaaattgttgttcagctcgctcttgatctcgctagagggtacattatattctcccttctttcgctgccttctcaagtcgtttatctgctctaatggttattgttatgttgcttttaggttgagttaccttcattcgcagaagattgttcaccgagatgtaaagacagagaatatgttgttagacaaaacccggactgttaaaatcgcagattttggagttgcgagagttgaagcatctaaccctaatgacatgacaggagagactggcacacttggctacatggcgcctgaggtactatagtgataatgcatcatcaagattggtaacaaaccaactttttataacaaataaactttggctgcaggttctcaatggaaacccgtataatcgaaaatgcgatgtatacagtttcgggatctgcttatgggagatatattgctgtgacatgccataccctgaccttactttctctgaggtcacttcagccgtcgtccgccaggtatggttgaatagattaagcaaagaaaagttaatttaattgaaatgtgcatattggttgtttcacaattatattttgttgtaaatcttgaggaatcactgaagtaaaaaatgtgatctagagtagtgtaaccatttcatcatttcactgaagtaaaaaatctatatgcaatatgctgctacatatgatcaatgcagaacctgagacccgatataccgaggtgttgcccgagcgcacttgcagctgtgatgaagcgatgttgggatgcaaatccggacaagagaccggagatggatgaggttgtaccaatgttggagagtattgacacaaccaagggaggagggatgattcctaacgaccagcaacagggttgcctatgcttccgaaggaaacgtggtccttaattcccaaagaccaatctaagatcattcaaaactcaagattcgtgtccttgcttcttttctttttctttttataatccagaaggaaaaaaaatgggaaggcttgttagggatctaatggttgctaaaatttacgtaaagagtatgatttggtttccatattcttcaacatttcttgttttgctctatttgtgagagttgcttattaaatatttatggtcacgtatatcatcatctctaatcatatatttgatatagctagtcaatggtacaactgttctttttgtctttatgggttaaccaactacactcgacaggaacatcctatttgatatatatagtccaatgttcagctatgataaacctcacttcccatagaaggaccattaggttggaatgcatagtcgagaaacaactttgttgaagatattattgctacttcagtattgtcttttggtttaatagagtagatctagtcaatagctactaatcttagcttagtccacatttctttgccccattatggtctaatcttagcttagtcaacatttctttgccccattatggtctttttgtaaccttaggttatcttctctctttgtataactatgggtctaacgcctcattaacaataacacaagttaacaataacgtattattgagactagaagcttgtgctaataatgtttcttagaagtctagtgtttagtgccaaattgtatagtgtgtttaagaacactgattataaataataatagcagttggcgacaccacaatgaaactatatctatatcattcattcattaccaaacaaataaataagtattgtcttcattgtcaaaaatttagtaataagaaaaaagcgttggggaactactaatgacaaatgaattaagagtaatgacaggtaagaggttgttttcgtggtgacgtcaatcggtgcacaaagtaacgctgatatagcgaaacgtagacaactgtcccctctgctccttcctcatcaagcctcttctcttcactgcttcttcttctagtttactctccaattttcttctgctgctgcttcttcacaaggtttctatttcttctaatctgtgtataatctctcctctctgctcttcttacttaaacagaatcatttttaaaactctgctcttgattttagctttaaaaacgaggtctttttgttgggtttttgttctgtttcgccttctttcttcatttacgagctttttgagcttaaagttcgtgacttttgctgctttcgtgatttgggtttcagtaactttgcggtttattgaagtttttttggtgtaaagttacaactgtgggtttagctcaaaacgaggtctttacctctgtttttatgttttctacttattgagctcaaatttcgtagcttttgattcttctgtgatttgggtttcagtcacttttcgggttagtgaagtttttggtgtagagttttggtttttattgtttttgcaactgtgggttagctcaaaacgaggtctttttcttgttttctgcttcttgagctcaaatttcgtgagttttgcttcttctgtgatttgggtttcagtcactttctcgttatgtgaagtttttggtttaaagttttgatttttatttttttgttgcagaggttgaagaatg

SEQ ID NO: 2702 - DNA, 3000 bp, Unknown
  misc_feature (1)..( 3000): cDNA_ID_3069268_gDNA_ID_1620578_Annot_ID_161066 3000 nt of promoter + ATG
attaaaagagaaacgaaaaaagtatgtacaattaacgaggatttgaacggcggaaaatttttgtcgctaatccctcgcttatatacaacagattttgaagatagacatatcatatcattgcagtcttatgtccgttgcaaaattgtgatgactaaaaattggtaaccaatgttatagtctcttttatttcttactgactccatcaaaatcttgcttgtaaactttggacactatttcgaaaagcaaaaacgtattaattttggaattattaaaacattaatagaatatttaatatgtataaatcaatagaatacattaaactaataaataaataatacaaaatatgaattttaaccatacaaaaaatctcaactataattttaaaacccctctaatagctaaaactgtaaaacatatactgagttggtctctgatattgctcataaccgaccgacctaacctaaccacacacgggatacgctcgatgttcccattctccacggtactccaacactggcatacaatacaaaacattgaaggagacagtaatgccacgtgcacggctctgcaccataaaatttaacgcctctgatttaaaacaccacacattgacaaattgacataaccaaagctacatagagaaaaaacaccaaaaatcaaaattccatcaaaggggcttttaaaattttggacaagaacaaaaaaaaaagaaaaatggcaacgagaggagctgttgctgctgctgcatccacaatatggaagcaccgaagaaacccttctcttcgatcattatctcgccatttcaatcccaatttcaatcatagaatcatcccaacaggtacaatttcattacaattctgttctaagatagatacatgaaacataagagttgtgtcaaaagttcatatcaatttagggtttaaagtcaattgtggtgtatatgatttttccttgtagggtttaaatatcaagttagggcgatacaaggaacaagtactgatcctgtcattacaccattaaagaacagagaggaaccaaagccacaaaactggaaaatcaaaatgctttatgatggagattgtcctctctgtatgcgtgaggtctaagttagacctctgtttcttgtttatgtttgttcataaagtgtttttgatactgaatttttgtctttttattggtgaatgaaggttaatatgcttatggaaaggaatgaaaaacatggaactataaagtttgtcgacataagttcaaatgattattccccggaagataatcaagggcttgattacaaaacagtaaatttactgtcttttaatttggttcaattttgtttcatcttctgtttgatgttcgaactttcggatttgatcgagatctttattaggtgatggggcagattcatgccattcagtctgatggtaacgttgttaagggtgtggaggtaagcttattagcatcattgttttacactaaccatttcatatttatcattttggtgtaacgttttcaggcatttaggagattgtatgaagaagttgggcttggatgggtttacactatcaccaaatttgaaccagtaagcttttctctctttatctcctagtgatctcttccattgtgttaagttccgtattcatggataacacgcgattacttgcagatagggaagttagcagatgttgtgtatgatgtatgggctaaataccgacttcaagtcacaggtatataaaatgacctgaaaaatgttgtacaagcttacttgattatttgtgcgtctcaaaaactagatctctttgttgattagggaggccatctatagaagctattcttgaagcaagaaagaaagataaggtagggaacaaaggttatcgattttctgtcgtagtaacctttgctcggtaaaaccaatcaatgatatgattgtgtttgcaggtagagacatgtggtgaaagcaagaactgcaagatatgaattttctttatactctttgaattgttacaaaataccaaaaccagtttggagttacaaattttctttatgtgagtgtgagaatttgtatatatatgatacacagccccattacattagccaaatcatcctgatgatacattatacacatgaataatttcagcaaattttgaaactgttaagagttttatatttggtaatgattttgtaaaggttagcttactaatgttattgaaatatttgtttgaataatgaaaatgaaattcaacattgtagatttgttcccagtcaccaaagaagaaaaaaggttgtatgtgaaaaaaaaactttaagaatcaatagaatatgagatcaatttgttcatttgttgaaaacaccaaaaaaatgcactgcgtctcacatattctctctctggggcatttaatcaaacaccttccatgcaccaaatcgcacacatttcttcggaggagatttcactacaaagccctctctaatgccaccgtaagcacaacagcttcatgtttcaaaactctcagttctagccaacaggaccaaatccatctctacgttgatacacttctccaatggaaccaggtctctctctatctctcgacccttttgctagataaacatgttggaactttggaattattcgtgggcattatttgtttgaaaagattcgtgaatttctaatcaaattgaaagctttagaatccaattttgggtttaatggttggtttaagcttgttgcccaccaagtatttgttataagtccttactgggtcaaagcatgataagtcgaatgcttttacctgcacaatgaaaaaaattcaatcttgttgtcccttttttggcgcacttcactttaacatctgagtgtttggtttgttatatattcctacctcaaactcaaactgatgttactcaattgaaatcactggtgaatgtctatgttaccagtgggtttaaagtatgtttttgcttgggaattctatgtgagtttgagtaggccttgtgatttatgtgcagaaa

SEQ ID NO: 2703 - DNA, 3000 bp, Unknown
  misc_feature (1)..( 3000): cDNA_ID_2167903_gDNA_ID_1620578_Annot_ID_161055 3000 nt of promoter + ATG
cttcctcgctaacttctcttcgccatcactgaaactaatatctctctgcttcctccttagaacttctatttgcttctcttgcattccacttttgtgagtttctattatcttcagttttcgagatagaacttataaactctgtaataatatgcattgtgcatatttttctaggttaagttatttgttttaaagtgttctgtttcttgctagcactaaatctattgctctcgtttattttgcagattcatttgaagtagtgagattgactccagagataaaacaagaaagagcaacaaagcaacagcatgcggtggtggttgtgtctttctgcttatgtttttcgtacagtagtagtcttctgtcgtgtgattctgtaaactgcgatcttacttcagacatagcttttttatgtaatggggtcgtcttttttcttcacattcccttactttgtccgccaaattatttaagacttcgtttggatactctgttttgggagaaggaatcagttggggagaaagtagttatggtttgtcaatcagcgggacagacaagatttcgtacactcaaacacgaacacggtatcacaggaaacattgtagttagagtcattgcatgctttcaacctctccaagattgccaggttattttcttgtttgatgagtttatgttattgcaatatatttagatttttaaaccaccagaacttttttttattgatttcgttttagctttgatgttgtgtattttgcaggctgaatatttccgtcaattgttgaagcccgtcacgtagagtagctcgatacttatcgttcttgtttcaagcctagtttcttctatccatttagttggtaagttccagtctttgcacacataatcttttgacctcccattcttgattataagtagctgatttgtttgagatgatgatgtcctctgttttggatagttgatttgtttagtgttggatgggacaagatcgtgggtttgggtttcctactcagcgcttgtgttccttgtcttccctagctctgtctcatctcgggaagcaagacttgaatttagtatctaaaacctgcggcgacaccaccgacatgttttctactcgtggatcttatcaagtttctacccaagtctctcaatcctattttgatgggtattgtggatgggttcatgggtcatcccacctacagcagcagttcttgcctcctcaaaaccaatgtatgaagcaagtacctcttcaagtagacggtgttatatctaaagctgaggaacaatgtagtcagaagaggttcctagtgtttgatcagtctggagatcagacgactttgctactcgcttccgatatacggaaatcttttgagaccctaaaacagcatgcctgtcctgatatgaaggaagagctccaaagaagcaacaaagatttgtttgtttgtcacggaatgcaaggaaatagcgaaccggatttgaaggaggattcggaagaactaaatgcattgctttactctgaagatgagagtggttattgctctgaagaagatgaggttacaagcgcagaccattccccaagcattgtagtatcaggccgtgaggaccaaaaaacatttcttggaagctatggacaaccattaaatgctaaaaagagaaagatactcgaaacctcgaatgagagtatgcgggacgctgaatcgagctgtggtagttgtgacaacacaaggattagttttctgaaacgttctaagctgtctagtaacaagataggagaagagaagatatttgagactgtaagcctcttgcgcagtgtagtccccggggaggaactggtggacccgatcttagtcatcgatagagccattgattaccttaaatcattgaagatggaagcgaaaaatcgagaagcatgaggttctttgtttgtaggatacctaagacatattagcattggcaagtggacttggtttctaaacaaagtagtagacatattggaccgtggtactcttgtcaagctacaaagggatcaggttgttgctagttggaagataaaccaaataatgtttcggagttgcaagagaaggaattgatattaaaatgcaaattgaatatttcatattagttgatgattaagatggattgcgaaattttaatttcagtcgtttagctgtttgttatatcatgtagttgcttcttctttttctataagattttgtcggtgtggttgttattgttcatctgtgagtcgtgtggccgagagaatcataaatgggaaagttgaataaccattttcaatgataggccaattataatggtaaacacacaattaatttaacttttttacaaatgattaaagatgtttgttttcgtgccaaacagacatgtgatttggtgggatatttggcagtcttttgtcaatatggtagcaatttttgcctattgtttcatgattaagactcttatcacttgtcatttcctgacttttgtgcatagaactagtgacatgtgatatactgtagtcccatccagtttataagttttgaatacatgtctctagccattcagaataaatcttgcagctaaatgttttagaaaccggaccagataccggttcatcccaatttcagccacatgaacgattcttggtctgcaggaccggaccggtccggtttttaaaacattacaaaaataattttatatgcgtaataaaaaaatgaaggaacaaaactgtaatgttcgtctcgggagacacaatccagaaacgaaacgccttttgtgagagagagaagagaagagaagagaagagaagagaagagaagagatcgcaccacacaaaaactacaattttgttttggaaattactctcacccacctgaattttgttgctagagagacaacacttaggttttgggcggagttctgatgtgaaatgaatcggcgtagaaaattttcaggatcctccaattcgtcagagagtgtagcgaggagtgtctgatccgttcgctgattcta

SEQ ID NO: 2704 - DNA, 3000 bp, Unknown
  misc_feature (1)..( 3000): cDNA_ID_3409493_gDNA_ID_1620578_Annot_ID_161051 3000 nt of promoter + ATG
agtaagaaaagtagtgaaagtatccaatgtgaagaagaagaaggtccaatcatttctcaaatactctcgtttgcaatggcttgaccgttcaaaccccaaatcatttctacttttactttttacctttttgcaccctccatttccatcttctttgggtttcacattatgttttgtcttcccattctggttggtctattttcatatggatctccaaaacactttcgtggaaaatgtatctattgcacttatagtgaaaaaacgatgaaatatgtgacgataaatataacaagaagaaaggaaaatcctacaagacaattgattgctcttcatcttttctttattataatctcttccaaaatatgtatatttttctatatatactaaagtgttaagaaaaaaaaacaagcttcattatcattataagacttccgttttcactatagaagtaggaacggtacaagtcatactcactgacttataaaaatacaaacaaataatgataacataagaacattattattgagatcataatttatgaccaatccacaataatttatattatgaaaatataaattcaatattagatactgtaagataagtttcgaaggacaaaaaaggagataatttctatacagaaacccaaatgaacaacctgcatcaccaaaaattaccaagttagccaaaaaaagtttttttagctagttagccaatgacttaatcgtatattatcaatcataaaacttgataccaaaattatctaaacctaattaatcccccagaagaaacagacacgttctctcttgtcagaaaatggcactgactagtaataattatacccaagatatttttcattgacaatcaaagacatctgaaactatattcaatagtgatagatgtagaagacccatgatttagtaacctgaaccaaatctttgatgtacagataagagagatctggttgctcacaatcatacaagcagagtaacatttaatattaccacgccaaatatttaagttatacaaaaaccattaggataatattactaatccgtatagtatataaattaggattaattaaaagtggatacacttaatccttactggctttaatggtgtcaggggcccaaaacaaaccctccaccgtttctctctttctgtgtgtctctaaagcaatcatcatatcctaggtccaccatttttatacacataaaataacactcttctcattttgcgtggttaaaaaaaatacacatatatgagatgtttttttttgataaagacacatatatgagatgttgatttgctatcttttatgttcttcaattcaacaaatgttctcgaaaaatatgacataataaactggctgaatatcaagatcatagtataatgtgctccaaaatgttggaccgagagtacttatataacatctatatagtttacatatattcacaaaacgcattaaaaatgctacatatcacgacttcaagtcttctagcatgaccgtgttttgtaatgggtttcagagaatattgaaatttaatttccttctgagtaaaggaaaacacgcatgggagatgagttcacattctttaattcttagataaagcaactaagtgggtttatagtataatttaactatttaagtacacggaattagagttatagttgaggaagagctgatcatgttaattatttttaaattttaaattaaaaagaaatttgtacaccttaaaggcgaaaataaaataaaattgaggagcttctaatggccactcccaaatttcaaaaggtattcatttcccatattttcggcatagaaattctagcttttgttttatatttgaccttttaatttgatttggttaatatgtaacgaacatgcgattatacaatacatttaaaataaaaaaaaaaagagaaaagaagaagagcaccattgtgtatatgctttatttgagagaatatatatatttaatattgatctcaagaagaatagtgaaggttttggtagggacaacagacaatgcatggagccatttggtacgtggatacgccaacaaaatcatccacgcttcgtgcaatttaaagcaaccaatacacttaaccaccactctaagttccattcctcaatcttcaaatcaattgattatcatatgtatcccatacgtgtaagcgtatgtgaaaatagatttggttcaatttataaaaaataaaaaagtcaagagacatgattggatccacttatcattatactctatatgctgacaatagaacaatattttacatagtataactcgggagttggtcgagttcatagcatcaaagcgtacttcaaacacacactgagttgtaacaagcatgtccaattgtttagacatgccacaaccgatatcttcatgtcaatatcaaatcaagatgagaaagatcggcttagttcttcctaatatcttttaacttcgtaacatcaatttatattagtagtttatccatagtatgtgaaaccaagttggaaagaccaaaatcagaagtatgataaactccacatacgacgtcaaaaatgtagatgtcgaaattcacatactaatatttttgtatttaggtttacgagggagctcaaatctttgatgggccgaacatccagagtaatgggccaaacttttgcactcactattctcgtcaataaaatggttggtaccaacacttattttgataataagtgatgattattgtttttggaaatacaaaacaaaaaagtatttattttatgaaaggaaaaaaagaaatgtaaatacagatacattagcgtcgaggcaagaccatgtgctcactcacatgcggtcttctcttctcttctcatcttccctttttatgattttcttttcccattttcctctgcgtttgattatctgagagagagagagaagaaacttgttgaaacaaaatcaacaacaacttatagaagaccaaaaaaagattcataggatcttttgcttgacaatg

SEQ ID NO: 2705 - DNA, 3000 bp, Unknown
  misc_feature (1)..( 3000): cDNA_ID_2105578_gDNA_ID_1620578_Annot_ID_161053 3000 nt of promoter + ATG
gcgacggcggttgtgtcttcttcatctttcttcttgttcttctctaaagtcaaagctctgcttaagtgtctctctagttgctcgtctaagctttttagatcaatctgatctgctcgaacaaacccatcctttccttctttcattgtcaagcaaaagatcctatgaatctttttttggtcttctataagttgttgttgattttgtttcaacaagtttcttctctctctctctcagataatcaaacgcagaggaaaatgggaaaagaaaatcataaaaagggaagatgagaagagaagagaagaccgcatgtgagtgagcacatggtcttgcctcgacgctaatgtatctgtatttacatttctttttttcctttcataaaataaatacttttttgttttgtatttccaaaaacaataatcatcacttattatcaaaataagtgttggtaccaaccattttattgacgagaatagtgagtgcaaaagtttggcccattactctggatgttcggcccatcaaagatttgagctccctcgtaaacctaaatacaaaaatattagtatgtgaatttcgacatctacatttttgacgtcgtatgtggagtttatcatacttctgattttggtctttccaacttggtttcacatactatggataaactactaatataaattgatgttacgaagttaaaagatattaggaagaactaagccgatctttctcatcttgatttgatattgacatgaagatatcggttgtggcatgtctaaacaattggacatgcttgttacaactcagtgtgtgtttgaagtacgctttgatgctatgaactcgaccaactcccgagttatactatgtaaaatattgttctattgtcagcatatagagtataatgataagtggatccaatcatgtctcttgacttttttattttttataaattgaaccaaatctattttcacatacgcttacacgtatgggatacatatgataatcaattgatttgaagattgaggaatggaacttagagtggtggttaagtgtattggttgctttaaattgcacgaagcgtggatgattttgttggcgtatccacgtaccaaatggctccatgcattgtctgttgtccctaccaaaaccttcactattcttcttgagatcaatattaaatatatatattctctcaaataaagcatatacacaatggtgctcttcttcttttctctttttttttttattttaaatgtattgtataatcgcatgttcgttacatattaaccaaatcaaattaaaaggtcaaatataaaacaaaagctagaatttctatgccgaaaatatgggaaatgaataccttttgaaatttgggagtggccattagaagctcctcaattttattttattttcgcctttaaggtgtacaaatttctttttaatttaaaatttaaaaataattaacatgatcagctcttcctcaactataactctaattccgtgtacttaaatagttaaattatactataaacccacttagttgctttatctaagaattaaagaatgtgaactcatctcccatgcgtgttttcctttactcagaaggaaattaaatttcaatattctctgaaacccattacaaaacacggtcatgctagaagacttgaagtcgtgatatgtagcatttttaatgcgttttgtgaatatatgtaaactatatagatgttatataagtactctcggtccaacattttggagcacattatactatgatcttgatattcagccagtttattatgtcatatttttcgagaacatttgttgaattgaagaacataaaagatagcaaatcaacatctcatatatgtgtctttatcaaaaaaaaacatctcatatatgtgtattttttttaaccacgcaaaatgagaagagtgttattttatgtgtataaaaatggtggacctaggatatgatgattgctttagagacacacagaaagagagaaacggtggagggtttgttttgggcccctgacaccattaaagccagtaaggattaagtgtatccacttttaattaatcctaatttatatactatacggattagtaatattatcctaatggtttttgtataacttaaatatttggcgtggtaatattaaatgttactctgcttgtatgattgtgagcaaccagatctctcttatctgtacatcaaagatttggttcaggttactaaatcatgggtcttctacatctatcactattgaatatagtttcagatgtctttgattgtcaatgaaaaatatcttgggtataattattactagtcagtgccattttctgacaagagagaacgtgtctgtttcttctgggggattaattaggtttagataattttggtatcaagttttatgattgataatatacgattaagtcattggctaactagctaaaaaaactttttttggctaacttggtaatttttggtgatgcaggttgttcatttgggtttctgtatagaaattatctccttttttgtccttcgaaacttatcttacagtatctaatattgaatttatattttcataatataaattattgtggattggtcataaattatgatctcaataataatgttcttatgttatcattatttgtttgtatttttataagtcagtgagtatgacttgtaccgttcctacttctatagtgaaaacggaagtcttataatgataatgaagcttgtttttttttcttaacactttagtatatatagaaaaatatacatattttggaagagattataataaagaaaagatgaagagcaatcaattgtcttgtaggattttcctttcttcttgttatatttatcgtcacatatttcatcgttttttcactataagtgcaatagatacattttccacgaaagtgttttggagatccatatgaaaatagaccaaccagaatgggaagacaaaacataatgtgaaacccaaagaagatggaa

SEQ ID NO: 2706 - DNA, 3000 bp, Unknown
  misc_feature (1)..( 3000): cDNA_ID_2168052_gDNA_ID_1620579_Annot_ID_161086 3000 nt of promoter + ATG
catgtttgaatgtttcaaaatatatgtagaagcaaaactctgatagagctttaatgccaccaccacaagcaaggtttgaatcaaattctaggaagaatttatatgtacagaggaatgagatgccatcatcctcgagaaacaacacttcaaacagaagaagtgagtcttcatataatgcaagggcttctgcggcgaattcatatagcagtcagagtagcaacttgagctccaattctgatgctcataaacccaaaaggaagagaaggcctaagaagaagaagcaacaggtcggtttacttacctacgagttaatttgtaggaaacaaatctttgaatagcatctcatcaaatatcttgcgagctgtgaccatagtgtttgattcttctctttgctgtttttgcagtgatcggatactcggcttctccaaacactacacactcttcatcagttccaattactctactgggatctaatgcagatatatgaaatttatatagatttttgttgtggtcatggaattcagagagatatgtgtttgttgtttttagcttttgaaatgaaactctaaagtttttgggtataaactcccatttgagtctttcatggagcttttttaccagcacaattgaccattgataatttttttcccttgaatcagttttttcagttaagatacttgtcttttttagattgtccgaattaaatagtttttgaggaaaacaaataagtgaagaaatgataatttttgcacccaaaaaagcaaagaatgaaaactttattctaaataaaaaatttacaattagtttttagaaatgagaagaaatgtttgactgcaaaaaataaattaagttgttagcaagttttggttttgccaatcaacgtttttaatacaatgtacataaacaatttcattctttctaatgcaactattttttaaccaaaattttctgagagaatgaaattgtttagcgttcttgcggtaaaacaataaatttagagaactgatatatgttatattgaactgatcataatctaaaatctaatttattaataattcaagagaaatgaacattaactacaacgaacaaaaataattcaataattaatggctgaaaaaacaaaaataaaataaaataaatgttaagaaaaacccaaagatttattgatttgttgaattgtgattgaaggacgaggcaccgagtgacgcagttgaaaaactcaagaatctcctcggacaagagcagagatccagagtgatgtctgagaagattcattcaacacattaacgaaactccccaaaatagcttttattgatggactcaaatttcaagtggcttttgtttgccatcttgatctctctgacattttcgggttttgttcttcaccatggagttctcgctgaaagtgttaagcctgatgaagctaaacagcttagagacgaggtaacattcctccacagatctggatttcgattttggtcatcgattggtttatcagttgtccccaaattgagtattagaacaatttagtcttctgggacacttaaagtcttgatctttggatgttgtaattactcattgatgttaattatgtcgtaaaggtaagtcctttagccgttagagaagaacatttagttgttttgcacacaataactagctgagatcacttggtttgatagtggagttgcagctttgacctttttgttcgataattaccttatttgatgatgggtttgatcacattgagtgtaggtacgtgggatgttttatcatgcctttgatggatatatgaacaatgcgtttccactcgatgaattgagaccgttatcttgccaaggagaagatactcttggaggctatgcgttgactctggtaagctttaatatataaccttctcttgtgtaaggctttgtcttatgtaaaacttgacaatggttttggtggcatttgtgtagattgactcgttggatacattagctttacttggtgaccgagagcgcttcacttcttctgttgaatggattggtaaaaatcttcagtttaatatagtgagtaatgattggttttggcttctctagcaagatcaagttataattgttattttctcaaatactccttttagaacttttgtatgatgtagcctggcagtgaagttgatgaaatgatacatgtctttttaactgcagaataaaacagtctctgtgtttgagacaactatccgagtccttggggggttactatctgctcatctgattgcaagtgattatgcaacggtacgtttttttctgcgtggctatatctttcgtcatgattttatcttatgtgagggtacttgtatattcttcagccagaagagataagtatttttttgcgctctataatgtgttaggctttatatgagcttattctgcaaactagtcttaggattcctaattgtcttatcgggcttccaaagtctaaaaatctccttattaaagtggttttggttgtttgtcatgtaagattgaatttgaatctaatctgatgacagggcatgagaattccatcttacaacaatgaattactagttttggctgagaatttggcacggagaatgcttcctgcatttgatacaccgactggtatgctcttttagttatacacgtgcatatatgaaagcgagaattgccttgtcatctccttcttcacttgttattttctacaggaatcccatttggatctgtgaatttgatgtacggtgttgacaaacatgaaagcaaggcaaaccatcttcttttaccttctcatagctttcacatcttattcttacttatttaatttgttcatctgtgctattggtgccgtgactggagtgcatattaatataaatgataccgaaatgcttggttttcctatctttgctaggtctcaacgagttaaagagagttgagattaaactgctcattttctgcttgctgatcttatcttttgattcctatattggaaactcatttattcatg

SEQ ID NO: 2707 - DNA, 3000 bp, Unknown
  misc_feature (1)..( 3000): cDNA_ID_3069312_gDNA_ID_1620579_Annot_ID_161102 3000 nt of promoter + ATG
gatttctataaaaaatacattccttaatagattaacttaagccatataattataggccggtggtttgcatatctaattatcaacttcctcgtaccagaaggaaccttgtagcttatagagatatcattgtattcgaattgatcatattaaactattttgatatttacttatttttctaaagaaactaatttttgctaaatttattcaatgactagtattatgttttgaataaactttgaactgtatattctaacctgaaaaataagtggaattctacagatcaattaccaaagttttgtctttgtttttgtgatatatcgaaggttttagagccaagttcgtaaaaaaaaaacaatgtcaaaagttaaaatagctcgaatgaattttgtttcatgtaggttttttttcttatgatcggacgtttcatgtagtctcatggagtatgttataaacaaaagaaaaaaaaaaatagtggaagaaaacaaaattaatgaggttgtagtagagtcacgaaatggggtctgcagaaagaaaagaaaagactgcaagttcgaattattccttcttccgtgtgtgtaattatcatttgcttttattattttaaaaaatataaaacatttactatgtattttcttacatgtaaaccatttactatttttctccacgaatatttcttatgtaaatttatataaatgtatgtataaatacatacactacgttagtggtactaaacggaccacaaagaaagtggccatcaagcttaagcagctgcaataagctgacacataaagaaatctgtctatacatatccaataaaatctaattcaataaatatgtacaaatggtcacaaaaatagtaaagggtgtaatcatgcaaagtcgtggtctagtcgttttctctattaattaagcccaatttcgaagtatacaattaggagcaattgggaaagtagtacattttaatgatgatgctaatttgcagttgtaacactttatcacaaactagacaatccacattcaccggcggaaactaacctagactagtttccaacatcaaaagtccaatttttgtttcgtttaaatagatggcgcaaacgtacaactaagattagatttaagtatttaactctacaactaggttgagccaaatgacgacaatgacaatgccgacgactgttgatatacacaactaacgtttatctgattagatgagttcgtgaacggctacacatccattagcttctatttaaaccatttgttatgaaacaatgtttgacaactcaaatgaaaaagatgaacaatatttctataccaagtaccaagtgaaactttttgtgtttacatcaggtatgtaatcattttccgtgttcctttgttaaaaaccgtccatccttgattcttctgataatggtaaaactatccgtttgttaaattgttttattgtatttttatctattgtaaaaaactaattaaattttaaatttgctatgcataaacaatactgtatatacattttttataataagattagagaattatagtaccatcttgtaacaatgatgtaataagagacgaaaaaaaaataactaactgatcattaccatccataaataaatagttgctgccataaaccaaacacattgtgcttatcaaaaagaagaaatttgtacttaatgaaacattcattattagcaaagtgtaaaaccaaagaaaaacaaactttatttctcattttattagtaaaagtgaagaagagtaaagaaaaagagagactgagatgaggctgagagcctgagtctgcgggtggagagagagagaaagaaagcctctttacacgtgatttttaaaagagaccaaaaccccaaaagcaaacctcttttgcatgcgtccttaaaagacataaatttctctcaaaattttctacatcacaaaatcaatctttttctcttcttcttcgtcttcatcatcatcatcatcatcttcctctttctcttcctactgagatattttctccacattgagaggaaagctatcttctctagcgtcactcttcttcttcattggtcggtgagtgttttattttttttactgtatttctttttaatatagcggacgggtcattttctctccgtagcaataaattcacttatataaaataaaattttcattcttcttggagatattgatatttccactgctcttttcgatgtttattccttcactttgttcacttgctcttagtttttatctttcactctctctctctcacaccaaagttcacagcaaaataaaattaaaataaaaaagcttcgatttttcgattaaaatctttgtaattatctgtttgggttttctccgggatctcattttccggtttcaaatagagacaaaagattaaagctttctccggttttgtcttctgggtattcccaatttcccccatttcacttaaagctttaatctctgttccttgtttttgtctgtgattcttcttaatgaaaacaaaaactgtaaaaataaaaaaaaaacttctggtgattggttccttttattcttggtctttacagtgttttcttctaatttcatggtttcttgtctctctcttttttatcgagaaaaaaactacatctatctctgtaacactgtatgtatatacttcagactctgttttaatctctgtttttttttacctctctggtttctgaaactttgtaatagaagaaactagaacaacaacattttttacttcactgtttcaaagttttgatttttattattaaatttaacccaaaacaccatcatcatggttttgttttctggattttctccatttaatgcaatctgacattttcttataattattttttgtttgtacttatttttctttcatcctcatgattttgcaggtagaataaggccaaggaagggatcagttttaagttttgtttcattctttttgtagtggagaaaaagagtttttgaaaatccaaacaacaaaaa

SEQ ID NO: 2708 - DNA, 3000 bp, Unknown
  misc_feature (1)..( 3000): cDNA_ID_3069296_gDNA_ID_1620579_Annot_ID_161107 3000 nt of promoter + ATG
taactaattcacgatcatctccttccaaataagccttcaaaaatgatacaacaagtccaccaacgaatctcctcattggtctcctctcttcaccattcttacacaaacaataagaactcttccctctaatcccttttgtatcatcatcaagcatgtccaaatgcccataatccttcgcaacgaaatgccatgctggaccttgacattcccgaaagaactctcggtgattcactccgggaggtgcacacggtgggaataatgggttccgagcggtttcaccaagccccgaaccgatcacaagtataggcgttttgtctaggtcaaatgagtttggaaggtaagccaacaccggaggaggggtttgtttccctttccctgttccatcgactggatctataccgatcaatgtcgagatctttagattcgaggagtacccaaatttctttaaggcgaccgcaaacgcggttttgccaccgcggctatggccggagagggcaaatttggataggtttggtgttacttgcgctggaagaaagtgattaagtcctactgataaccaatccataatctccgccgttgatttaatctcatccattgtgtctggtccggcgatactatataactgttataatatcacatagccaagaaatttgatttacaaccatataaaataaaatgttaacatttgatattagaaattcgagagactctagagacaaaaacaggataaacacatcaagtggacccattgatatgcatttttgttcttacttttcttcttgtctaaggttcttataagagccaaacaataataaaagaaaagtttcagaaaaataactaatttaaacgtggcataatgtgttccatgcatccagctgaattatagatacatcttggttaaatcctaaatcctaaatcctataagtcctaacaaatcaatgtatatgtatttattatgatttttttggattcaactagaatatcttaatacatggacctacatattcatgaacattcacactaaacctcaaaggaccaagtagtcagtcacatgcaatatttgcacaaaatggaatggaacgagattgtagcgaatttacatttttctaaactctacactaatactaaatccctaaacaaaaactatacactggatttaacaattccgatagtaccatttccataaaaataactcataacattttactaattaaacaaaaactatacactagtttgaccccccaaaaaataatttctatactaaattactaatacacataggaatctaaaactaaacaagaatttcagtggctaattagttcctgaactaatgtaatgattggaaattgaaattgaacctgaggagcgatgaggatgaagccatgagaagagacatgcaacataagctgagaatagaaggagttgtagagaaggtaaccatggaggagcatcaccaccggataatctccttcctccaccggcgtagccaccaacagctgctttggcggagacggtgaagctctagaagacggtgttattttgcagcaacgagatgatgagtccaaggttaagagatttgatttgtatttgccatcttcaaaggcgtttcttgatgaagaagaggacattttttttgttctttattagtttttcttttctttactttttttgtttggtgggttcatgagaatgaggtgagtagagatattattaaaagttataagaagtatggccgttgaaatcttggttaattttaaagagcacataaacaaaatcaaatagaaaaaaattacttatgttaaattacttatattattggggttggtgtaatgataaatcttccagatgtagatattggattaaacgtctgttgaaaagaatctattttctaaagaatataaatttaacttgtgtcccatctctaaaaaatataagacctttaaatttaaacttctaaatatttttttttaaaaaacaaatcaaatagaaagaaattacttatgtgtgcatggaatataacaactacaatcataaggccatatattcatagtctattttcagtattgaaacctgattttttctaattttgggtaataaattttatgaagtctttttattatagtctagttaaatttctctatatttaaacaaagtcagatcctatatatatgagattttttggaattttaaaaaatatttaaattcaaacaaaataattggagatttgaatttttgtaagaaagttactttgtgtttcagattaaatttaataataaatggtcaaaagatttatgactaagaagtattaaaaattaaaatatagaagagaaaaaaattgatatgatatgatatgctcttagcaaaaaaataaattgatatgctgttgctgggtacaaggaatgggctttgtacttcatactagactactttttctctagtccaatttaaaaaaaaaaaaaacattatataacattcgagactaatttaaagtgttaaacggcccaatttgtattacacggcccaagttaaagtgttaaacattacctcattacctatgtacgatttgtggaaaaaaaatatatatacctatgtacgattttggattacattttttttttctagttaaaactaatttcaagtttgaaatataaattatatatctgaatatagatcattctagttcaaatcagatggaaatatatgaacctcagaaaatacaatatcatacaaatgagccaatgttttggtcttattcattcatgatcattgtggctcgaaaacggttgtttttttcgtgcaaaagaaaaaataacgattttttattattagaatttcgaaaccagaattaataaaaattaggagaaaggaaaataatacgaattaaagtgatcgtacacgtggctatcatcgacggaggaaatagccatttatttatctgatcttcatcactctgatgagtctgaaatcaaaaaagcatttacacaacgaagatcattaatg

SEQ ID NO: 2709 - DNA, 3000 bp, Unknown
  misc_feature (1)..( 3000): cDNA_ID_2109199_gDNA_ID_1620579_Annot_ID_161097 3000 nt of promoter + ATG
atatgaaagtaattataagtacaatttaaagcaaacaattatgggagacatgaacagagattttgggaataagcgatggagaatttgctcattgattgttattttctttctaattgggtcatcagtcatgtgtggagatgcactatagtgaagaagatttgatgcatcattttcactaaaggtattcaaaaagaattatcagtctcacatctgcatagaaattattgttataaaaagaatagaaccaagataaaaaggtggtattataatgctagtttttttttacttattttattggagctgagaaaaggtgggattgtcttgttgtagggacaacttttgatgtgttccaaagagacctttacatgcttttctcaaattgaagttatccaaatcaaaccaaaataaaacaaacccaaccaaacctaaaattacacaatttcataaagatttcttgtcgaactgaatcagaaccttcaaatcaaattattatataaccaaactgaaatgaaaccagttcgaaacttcaacatttttttctaacacttactcaactaatcactaacttcaaaaaaaaattatactctctccgttcattataaacaccgtttaaattttaaaatctttttacgttaataaaaatagcaaaaatatattatatcctttttaacaaattatataatatttatctcttgtattagtagttttgatcctttattcataaaaataaaaaatatgaataaagttcttatttgaaggaggaaaatacaagaaaattgcacattgacgattattaaaaatgttccaatggatttgatatatatatacacaacaacaacaacaacccaaaaaaaaacaaatgggccgtcctcatgtgaaatctaataggtctcattactaacgcaattgggcctataatgtttaaatttgcaaacaaatttaatcttcttctcaattacaaaatctgagcaactagaaacttattagcttccacatatgacatctccaagcacaagcaagaatcatcgatgcttaaacctaatctcaaaatgcaaatccttacaaaacctcaaacaaatccatgcccaaatcatcacaatcggtctctctcaccacacatatcctctaagtaagctccttcacttatcctccaccgtctgcttatcctacgcactctctatcttacgccaaatccctaatccttccgtcttcctctacaacactctcatctcttccatcgtctccaatcacaattccactcaaacccatctcgcgttttctctctacgatcagattttgagctcaagatccaattttgtcagacccaatgaatttacgtatccttctctcttcaaagcctcaggctttgacgctcaatggcatcgccatgggagggctcttcatgcccacgtcttgaaatttctcgaaccggtgaatcatgatcggtttgtgcaagctgctttagttgggttttacgctaattgtggtaaattgagagaagctaggtctttgtttgagagaattagggaacctgatttggctacttggaacactcttcttgctgcttacgctaattccgaagaaattgatagcgatgaagaggttttgttgttgtttatgagaatgcaagtaagacctaacgagctttctcttgtagctttgattaaatcttgtgcgaatttaggtgaatttgtgagaggtgtttgggctcatgtgtatgtcttgaagaataatctgaccctgaaccagtttgtgggaacttctctgatcgatctttactcgaaatgcggatgtttgagtttcgcacgcaaagtgttcgatgaaatgtctcagagagacgtatcgtgttacaatgcaatgattcgtggtttagcagttcacgggtttggtcaagaaggtattgaattgtacaagagcttgatctctcaaggattagtcccggacagtgcaactttcgtggtgacgatatcagcatgttcgcactcgggtctagtcgacgaaggtctccaaatatttaactcaatgaaagcggtttacgggatcgagcctaaagttgagcattacggatgtttagttgatctactaggccgatccgggaggttagaagaagcggaagaatgcatcaagaagatgccggtgaagccgaatgcgacactatggagatcgtttctagggtcatctcaaacacatggtgactttgagaggggtgagattgcgctaaagcatttgttggggttagaattcgaaaacagcggaaattatgtgctcttgtcgaatatttatgccggagttaaccgttggactgacgtagagaagacccgggaacttatgaaagaccaccgtgtcaataaatctccggggattagtactcttaattaatttacaaatgtaattgaaatttaatctccaaaagtaggaccaaagaagctacaacaacttgttttgtttttctaataaaaaaattgtaaactaatcaactataccacaaaatcatgtgtgattttatttgcatagaagacaagtcatatgaaattcaaatataatcttccgaagaccaaagctacaagtacaacaacttgtttttattaaaaaaaacatgttaatctctaataactcgatacgtgtataccaaaaactattacaaaaatctttatattaatgtcgatgtgacaaaatatcccatttcttaaaaatattttcacaacaaatcctgtcgttacactgttacacagaataaagaaaaaacagttgttagattgttgtcctttataccatagattagtcaaataattgaattaggtgcttattgacacatcaattaagaatggtattagaccgatgtccattcattatccactaactgagtatttttaatgaatatgtagtcctaattaatcatctatccactaattatgtcttaattacaaaaaaaactgattaatcaatgttctcttaaagattaagagagccaaaacgaagcaaattaatctgccttcaatg

SEQ ID NO: 2710 - DNA, 3000 bp, Unknown
  misc_feature (1)..( 3000): cDNA_ID_2168072_gDNA_ID_1620579_Annot_ID_161091 3000 nt of promoter + ATG
gaaaattctatgtcagtttggatttataaaagaatggttaagatttaaatttacaatgaattcaatttagtggttttaatgaattaagctttttatatatttagggagattaattgttttaatttgtttaaatatattatatggtaatttttgattggctaattaagagggggtgaatgagagaggttcactcctaaatgtgaacccaagaattattttaaaataatagaccactaccactaaagacaattcttgggttcacccataggggtaaatctctcttatttaaccaatcaaaatacaacaaatatgacatgttatactgtatttaaaaataaaatttggcgaaaaaatttcagtttctaattacatgttttcattagctgataggtaatttggtctttcaataaaaaaatattttttaaaaaggccaacataaaacagtattgttggaaatgtgatatagaaaatagtatttttgcaaatcctccattattaatcaccaattttgtgcctcaatagatatcttaaaatgagtttgagtgcaaaaataatacaaatagcccattttgatccgcattttcaggacccagtttaacatcaccaatattattggtaaggcaaaatgattaatgttattatatgcaacatcacaattaaaatataaaacataaaacactcaacaaaatagttgacagcatttattttgtgcaacaaataattgacaacaaaatgcaaatatatgtgtttataaaactcggaatggataaaaggtttagctatgaccttttagtgaacatatgagctgcacaggtttctatatgatcattacaaaaaatgtatataatacgttaagtcaaagacttaaaacttatgtataaaatgtgtaaagaagacatgaaaatcaagttcagaaatattgtaatcttttcacacaagagcaaccaaaacaattcaaccataaaagtgaaagattatgccctccacatgtgagtccatttcaacattaagatagtcacatgccaaaaacaatggctaagaaaaaacaaaacaaatatgggttcttacaaaaggacgaaataatcaaaatggcctagaaatattactatattattctatttcttagttacaatttttattctttttggtcaagctaatattttatccacaaagaagtctaactagttgattctgaaatgtacaaattgttaaaatcaaaattatgtgataatatagaataatataaattcaaaacaagtatcacattttttttccagaaaaatacaacaaacttttaggaaaatcattacaaaggtctaaacaccttccaaaatcatgttacacttaaaaaactggtatttttgtaagacacaaaaaatattcgtatgtctgtatacatttcatacatatttacttttgtgtaagatcatatagttcctagcttttcaatggtcaaattagtatgcaaaatccacattctttatgtctttgtctctctgtggtaatgtgcacgatcaaaactcgtttttcgtttggtaatatgtaattatgtaagtaaaataatttactattttttgttcttttcatttcaaccactattctcagttttttttttttttttgtttctgatatttatttaaagttttaaactatataggttgtcttattaacaacacattgaaaatgatatttcgggagccaattacgtccgagttccatcttgtggatgaggttttaacgatagaaacaaaattaaaatacttgtttaattagtattcgttatattatatctcttccaaaatgtatataaaaacgagagaagtgagtggaagaagaaaaaatacaaaaaaagtaagtaaaagagagtgacgtaacaaaaattggaaagcgtgatagaattggcaatgataaccaaaaaaattgaggtttccattgagattcacattgtggtgtacccacgtgctttgtgttccacttcttcttcctcttcgatctcatctcataactcataagtcatacctaatttaaacaccaacaaaataatattgaagtcgaatagtatatattaaaattttgttagttagttactatgttggtttcaattttatgcagcacgttctctaaggattgttattattcgagttgtgaataagatactttgtgtggttttccataaataaattaaattatacgagtgtgtttgagtcaatgttaaaggctttctcgcagtccatctttgataattaaagtggtgaccaaaagtaacaattgaaaaacaatgacttgacttagcaaaaagattgtaaaatagtactactcacccatgtatacgaaaatccaaatgtttgtaggattttgcatttgctcgtaaaaaagacatgtttatatggtctagggctgtgcccaaaatcttctaatcataagaaaaaaaattagacgcaattttttgatgatcagaaaaataaagtcattaacaagtaaaatctctatattttaagtctagtttcttgtatatatatttgatatgacaaaaaaaaaagtatatatatttgataactatttcatattatacgtgaattggatatttgtgctgtctaactaagtgagcaacttaatgatccagagtgacatataaaggtttgtttgcattagtactgcttttgtgtgaccaaattaggaatctctacttcatttttttttttctacatctttggatgtataaggcccgatctatagtcagtatctattacgcagaataatgcgatttagtagaatcgaactccggtaaaaattaggagtcaaatgaacttaactacttaactaaaggcaatatggtccaaaacattgaagtcattaacaacaaaaattgataattgactctaattaaaatacacatttctttccctcgaaaaggaaaaaggtgcaaaatgtaaagatcagcctcatatatatatttaagcggagaaacaaagagagagcgaggagaagagataaatgatg

SEQ ID NO: 2711 - DNA, 3000 bp, Unknown
  misc_feature (1)..( 3000): cDNA_ID_1028034_gDNA_ID_1620580_Annot_ID_161121 3000 nt of promoter + ATG
gaaaaataacttagcttataagatttaacttttcaattattttcatttattaattttaacttatttaatattaatttgcatgatgtaaaattagcttacgagattacggcatatatagaaaatatattttcaacaatgtttggtttctaaatatttttgtggatttctattttttctattaatttttaagcctaggcgtttgggtattcggatcggatatttcgggttcgggttttcgggtttagaagtttaggacccgttcgggtaatttaagatttcgggtcgggttcagtttgggttcgggttcgggttcgagtttatttatatattgaaatatcaaattttgtgtgcaaatctattaaattatttgaaaatttcaaaaatttccaaaacaacacgagtagttttgcttgaatatatctaaaaatacacaaaaataactaatatatccaaaaatatcctaatattttctatatataagtataaatgtaactaatatatatttatatttgagatatgtttggatacctattcaggttctggttcgagttttttggattttgaagtttagacccgttcaagtatttaaaaatttcatgtacacccgcctaaataggcgggccttatctagtgtatatattaaaagaggggttttagttctgatgtggtaaacccacaattattcttagcatttttattttttatttatttaattctactattcaatttaccaaacatttaaattagaaactatatcatgataaaactaattgccaaacatatgccatacaaattcaacaccataattactaaacttaccataattaaatattttgaattaaactatataaaaaatattaaatgcatttgaacaccatacaaattctcctaaattataatattgctaaacatatggataaagtaaatggtatcttatgtgtaaaatataatccatttaatttagttaaaattgttaaaattcaaacaacattctcttatagttatatcatattctatggtcatccattcatttaaccaatataaattatctttcaaaataaataaaactaaaatagatacatttttggtaaaatgcttatagatatatatatatattcctctatctatttctttatatatatcatttatttatttatttatacaaaaatatgcttataaaaaatgtgtatatatataaatatttcattaagaagttattatactattgatctgcttttctttgtatttttaatcaaattactattgatctgctatggtaccaattcgattcggagatccagtgatatggaaaaaaccttcggtttgatgtttgaattgtggtgaaatacatattataaaatcatacacaatcactaattcactatataatggtgaatgcaaggttccccctaaatactagctgcaatacgttaaatttaatagaataacaacaaatgcaaagccaagaacacttgtttaataataagatgctcattcttgccagtgtcttctatcaaagaaaaactcacaaaacatggtgtgtatgtggtttgtttttaagttttaaccaagaaaaagatcgttggtcttacggtagacacatgaatacatatgagtgggatttggtacaagaacacttgtttaaaaataaacaagtttaagcatgttattattaaacaagtttcctagatttggtttgttttagcgaagacaaagatcgctggttctttttaggtgtattataaaaatcttgggggaaaaaacctgaaaaaactctcatttattttttatttggccgtttaatacctgcattatataatttgcccaaataatatttaggttaattatttttctctttaaaaaccttcatttttgtttaatttgataaaatcagacatccaacttaactgctgttaactttttaacagactttctaactgtagttaaagtttaacccatcgtatttacaaatatatatacaatctatttccaaaattttacaattaagttatcttagtcaaggcaaaatatgatattcaattcatgtttaacctgggtacgaatctcgcttacgtctttgtattcgttttttttttttgggacttcatcttcttcgccaaatctggattcgtttttttttgctttctcaaatttaggtttgaatcccccaatcaaattgaccacacaataacaaaagctaatcaaattaataaacctaaaagaaatcgtcatgttgaaatcgctgtttggatctgaattttttttacagaaccttcgaaaaaaattaaaagtagctttgtcgaagttaagccgagcttcatcaattcgtgttatttgtctctcttgagaagttaaaaacatcgtaccaataagaagaagatgaacttaattttgtctggatgaaatctttaaattccgagaaagaagaagaaggaaaaaaaaaagagactataaacgtcgtaagaaagtttcgaacccaggtatatcagaaaattaaatctgtgtttaaccgctagactaaggtaacatatttatagaatatagaaaatagattgtatatatatttgtaaatatcatgagttaaattttaactataaacatctgttaaaaagttaacatccgttaagttggatgtctgattttgccaaattaatacaaaatgaagatttttaaagagaaaataattaacctaagtattatttggacaaattatataatatagatattaaacaggcaaataaaaaataaactaagattttttcaggttttttccttacgtatttgttcctcagaatctttagtttgttatgaaagtgagtgaaaacgcaaacgtgggtttgtggggagcgtttgcgttctaaagtttcaagaatcgacgcaaaacgtgagatgtgtttttggtaagcgtcgtgtctctctctcttatcctctgttcacgccattcacaagcctgtgtgaccacaaaatacgacagaattagagagaaaagatagagagatg

SEQ ID NO: 2712 - DNA, 3000 bp, Unknown
  misc_feature (1)..( 3000): cDNA_ID_3069341_gDNA_ID_1620580_Annot_ID_161130 3000 nt of promoter + ATG
tgaaggtaaccttaagaaccaaacgcatgaattcatatagaaacaaggatagtatataatatgacagtttggtttcatcttcttgttcatttttctaatttgcagctgctacaaatgcaaaggctaatggagaaaactgtaagaaagcttgttgatatttttccttatgtcattttctatcttttaagtttttgtctgagatgttttgtcacaacagctgcaaagaatccatcaaccataagtactacagtgcagaaatcttctggcggatacaatggtaatataatcttcagattctcacaaacaaatattttcccaaaaagaaacaagatctcaatgtttatatgttctttatttttcagctggtttagaaggtcttctaaagcctgcaggttagctttaaagcttattcattcttgtgaatgtttttaaccgaagaaagtcacaagagtgctaatcttaattgtcttctctctgttattgtttcttgcagatggtgtatgtggttgtttcaacaaggataaagatggtcttcaggcagacactgattcttcgattaacatagcggagatactcgcagaagaatccaaattacaggtttgttttatagatctttcttgaatagacaatggaaggctctcacatctaaaccaatctcatttttgtttatatcttttgcttttgactttggtagggctcagggacctctcggctcaccacatcattgaacaatcttgttgatactcatagaaaagaaacgtcctcaaaggtaggctcagtccttggctcatcttcatcagttacttctaccacaagcgaatcagcggctacatcagagagcatagagagcttaaagcaaacactaaggaagctacgcggtctaagcgcacgtgatctcgtaaaccacccgaatttcgatgcgattatagcagccggtacacgttacgaggtactcagctcagcttctattggttacatctctttgctagccaaatacaaaaccgtcattaaagaaggactcgaggcttctcagagagtccagattgctcaaacccgagccaaactgctaaaagaaaccgcaatggagaagcagagaaccgtagactcggttttcgcagcagcaaagaccactgctcaaagaggagacgcgttgcacatcagaatcgtagcgatcaagaaactgttggcaaagctagaagcagagaaagtggacgttgattcaaagttcacctctttaacgacgagtctgtcagagcttctcaaggaggcgtcacaggcttacgaagagtatcacgaggcggtgcataaggcaaaggacgagcaagcggctgaggaatttgcggtggagacgacaaagagagcagaacatatttgggttgagtttcttagttcacttaattgaactaatgagattcttgattgtggttaaagcacatgttcaattagttgtggttcttgtgttttattttcttgtgttgttttgtttgagactttgtttgttgcttatatcaggggagagaggttgaaaaacctttgagagagatagataaatgagagatttgtgaaacacaaataatgttttagtcgtcttataataaaacctttttttttcttatatatgctcattgataatactgcaaaaaggtaaaatcatgtttttttttttttaatatgaatcatgatattcaggcatgttttttccaagattgacaattatataggccagaactagcaagaaataagagttaaagtgctaaaatcagaaatcgagtgtctttatttcttgcaattgcagtttattagtaaataaatcacataaaacagagattagttcatctaacattttcctgataaattgacaaaaaaaggacgttgtaactacttcaatatttattttttgtcggctactaattttatttttaaaattcaacaaatttaagtaatattacatttgacttgagtgaggaaaatgttctataatgttgtcatttttttataaatcaaatttaaattatatcatgagttaatattttaaagatgtcctagaaaaattcacacgtaaaaataaagaaaagagattatcccacacgagtcgctaacacgtgtgacccaaatcatactcggaaaaagcaaaacgatcattatttgaaattaataatgacgtcatcaaaacaacgataaataaagaaggaataattggaaggaaaaaaaatcaacaaataagaatgagccatctctcaccgctctctcctcgtgcacagctctctgactccgttaacttccgagtctccgagcattctctctctctttctctttctccatcgccgcgactcggctcagctctgagaacggcgcaagcttagattgccggagaaaactttatgcaatgtaatgtcttcttcttctttttttttcgtttctttctaattcgtcttcgtctgcttcttctgcaagctcgtgttgttactcatctctctgcatcgacgattttcttctagttttgttgactttaggttttctttagatcgtgaatttctcaacatttctccttaatctgattgcgttgcttttccagtttttttgtacttgggagcagcttcaacattggagcatcggcgatccaagtcggaagttcacttaccttcggataacgcgactctgacctatcggaaatagtaagatactcgctaagatcttgatcttcattgtgacattggtttttctctcgcggctttttattttccataaccgaccaactttctttatttcgtcaacgcgatttcaatttggaattcgaaatccttgtaactggagcagttagggagtacttgatgaacttggatcaatactgtttctatatatagctgatgattgatttctcttcctaaattgcagtttcattgacctcatatggagtgtgtctaattgctagtggttttgtggcttattgaagtcttgggaatagtatattgaggatgctattgtagtaaagaaagtatg

SEQ ID NO: 2713 - DNA, 3000 bp, Unknown
  misc_feature (1)..( 3000): cDNA_ID_2168015_gDNA_ID_1620580_Annot_ID_161131 3000 nt of promoter + ATG
tggatgctgctggaattggtataagattttgtttcaaaatatttttttctactctaattctcgtacacatgcatatatatataaatatattgtttttggtaattattttgacgtgtttttgagtcagctgatgaaagaaggcaacggctggaagatattgaacgaaaactgaaaggtaactttgcctatatatcatatatgcataaattgattgttcgatgaaatgttttttgttttgatcgtatttttattctaaattatttttatgttttgcttaaaattttcttaattattattaaatttttcttaatttattattaaattttaaaccatatttttgctctgaattgattgttcgatatatgaacgtcactttaaatctaaagagtttttctttttatatctttaccgttggattctagccgcggctgctacaaatattgttgtagaagatggaacctcaaagagaaagagtaaggtggaggaaacacaagaggtcgtcaaatttgaaagtgaatcaagtagtgcatcatcggaaagtcgtcgtcagtcgtctagctcttataacagttttaataaaggcactggtggctcggaaatgttgggatctctaggaatttcacagtcaggtttatctctcaattctaagctttaatgtggacaccatgtcatgtaaaattcaatattaaattttgaagtaccttttctatctggcaggttcgtggcgttgttataaccaggacaaaaatggtgttagtgaagaggaggatacttccatagttataccaaagtatgacatagattcgatcatcaaggaagaatccacttcccaggtttcttcttaaacttggacataatttttatgaaatatagacaatgaaacttgtttaacacgtctttgactttggtacgtagggctcctcgtcaaagacctctagtcttatagcatctctgactaaaattgttgagaagcataggaaagaaaagtggtcttctggtgtaagtgtaagtgtaaccaaaggagcttcttccacacaaacatcagagaccgtagagaagctaaaagtgacattgaaaaagtatcgtggtttaagtgcgcgtgagctcgtggctcgttcagatttcgaagagatactggcgactgctgcacgttatgaggagctgagctcggcctcagtaagccacatttcgaggctgtccatgtacagaagtgtgatcaaagaaggaatcaaggcctctcagcgagttcagcttgcgtatgctcgtactagattgctcaaagaaatggccgtggagaagcagaaaaatgtagacgctgagttagcattagtcaaggctttggctgagagaggagacatgttgtacgtgaaaatatttgcgatcaagaaactgatttcgaaacttgaggccgagaagtatgaggttgatatgactttcgaaaagacagttgcgaatctatcacgcgttatagaggaggcttctcaagcttacgaggagtatcatgtggtcgtgcgtaagtggaaagaggaacaagcatctgaggaattctcgcgtgaggccattgagagggtagagatggtttgggttgagtttctcagcactctctagagacaagtcttttgttttcttctcttttaattacatgctttctctcttgtttatgtcttattccttgtcatttccctttctaatataaagcttttatgtgagcgccttgtcaaattgctctttactttaatgatatcagcagattatataaatacttcgtaaagaataataattaatttaccaattaccattaaaaaaaaattatttggggtcgaaagacatgactcagctttcattatgtggcccaaagcagtaatgaaatatgacactagacattatttctatttataacagaactataagtttttttgtgtagttatttttcttacttcaaatcagttttgttttattaatagtatccctctatgtagcacgttttaggaatagatcgaagagcaacgaaatggatgatacatgggcagctaggtcgcgttacttccggataaacaatgtcaatgtgtcccctctcaatattatattctctaatcggatcggatcgaatcgaatcgaatctgactcgtctatcgtcaagctgtcgtctactaattatctatagagacgttaaaatatcaatatttagagagagacttcaggtttattattttacaagattttttcatatttttagtattaggaaaaagtggattggttaaaaagtaaactagaaaattaagtcaagctaaaaggtttgatattgaatttactgccgaacgaaaatttaattatagccgatcattgagttttagggtcgtgacacatgtggttgtcagttctgtacaagtacaatcatatatatgtatttaattttctcatgtagcacgctaatattatcttatagtataaataaataccaagtctaacagatacgatttggtagtagtgtagtgaacatcgcattatttatttatatcagcaaagtagttcacaatacgtggactatggcctatgaggataattaattatactctaatgattatacttctatttcataatattgtagtaagttaaactgattaatagttggatttaccagcattagtggattccattatagatatatttcaataataaacttttcgttttttcacttttttaaaaatatcatttttcttagtctttcttttggcaagattaagagtgggataatcataatttataggcgtttcacatacacagaaactaatgaagacaagaataaaattaaaaatagcgttgaattctttgtaattaggaacgtggaatatatataaaaataaaagccacgtgaattctattattaaattaaaaagccacgttgagttattttactttggttttatttaaagtcttgtttttcctcaagcttcacaacacagtgtattttgatctttgtgataacaatcttccaccatg

SEQ ID NO: 2714 - DNA, 1320 bp, Unknown
  misc_feature (1)..( 1320): cDNA_ID_2168019_gDNA_ID_1620580_Annot_ID_161132 3000 nt of promoter + ATG
caagttgtatactctatttaattatataaaaaagttcttagtttcaatatttcattatttctccacatatatttctctcatgtttgttgttttgtttgtttattcattgtataatgatttatttacactaatatgtcttcgtcacaaaaaattcagagattttgttagacatatattatagactatcatttttttcttatgcttgttaccttaaaattcaaagcagactatgtacgtacaccatatgtattagggtttcaattttcagagtgatgtttatatgatgtacatctaaataatatatctctagacaaaattattttaggtgtcaacataaattaaagagtgattcaagggaggcccaaaaactaataataacctaacattaaaatcaaaccattacataaaactttccataatcacctaaatatttatcaaacatagtggataatactaaattatactatataattgcatgcggatcaacaatacaatagaacaaattaaatagatagttgattttatatatatttatcactattttttatattgactatagattgaccagcggtataatgtaggttgatatttttcgtttataaattaattttttttattttaattaatattctttatatgaataacatatttaaaaagtacactacgggcctatgttattataatcatattagtcctttttattgtttgactctaaactattattcaatttttttaagcaatattggatcttgtacatttaattattttcttcattgattgatatatgtctatttttaaaatttttgaattatatatacatgaaaaaaatctaatcctttattaactatatgtattttatatatgataaaaataaattagatataagaaaaataagtgaaaaaagaatcatatatatatatatatatagttatatatatttaatgtatatagatagattttaaaaaaatagcaattaattgcatgtagttaaatagtataatatttaattaaggatataaatctagcataatattttttgagatagattttatagagagtaaaaactaaatactatttattttagagatttttggaccaaaatctttaccataaaagtatatgtagatatattaatatttatatatttatgtttcttgatgtaattatgtattatttcttttttagttttcttattttaaaacagacattcggtctatttaaagacatcatgttctgcttcaaacatcaaacaaactcaattttaaagattaaggaagcagtgtgtataattttttctttgtaatgacaaactctgctatg

SEQ ID NO: 2715 - DNA, 3000 bp, Unknown
  misc_feature (1)..( 3000): cDNA_ID_3069346_gDNA_ID_1620580_Annot_ID_161126 3000 nt of promoter + ATG
taactgtgtggatcatatgaagcatgttggggctgttctcaatgtttaggcttggctctgagttccagaagcttttttggttattgaagagacatctcaggctcctgcagaggatcagaacttaattgcttagaaccgatcagagagggcgactgctgcaggtgatgctcagtttgtacatgtgagtgtcaagcacatttccaaaacaaggccacttcgcgaaaccagtttatgctttctatggggttggtccgcaaggtggttacctgactgtgctcttccagttctttgttcctgggtgtcccgacaatcggacaaatctgttagccacactgtaggcatcccttactatataactgaaccatgagctgtatcttatccactgcattagcaacaacttttactttgacaatctatggttctgttcacatctcacggttctctataatcgtgaactgtgtacctttagcttcagaagcaataacctcaagagtcacagctaaattctttacgaaaaattatcttacccagcctcgaacaataattcggaagtatcaggcaagtatgctgcaaatgtcgactcttgggctaattcttctagtttcatgtaaatctcttcagattgaagatgtgatttgtctccagcaacaaattcatgagcaaaaccgtttacctcaattaaactaaagcctggtgtcttcttaattgcaacgtccacgatctttcttctcacttctcgcaaatccttccatcttttgcaacctgcatatatattgcataacaaagcataaacagccccattatcaggttctaactcaaggattttcttagccgccaattcagccattggttcatcattatgaagtctagaagccccaagtagagctccccacacaatcgagtttggattcattggcattttccttagtatctcatatgcttccttaactagcccagctcgaccaagcatgtcaaccatacatccgtaatgtactaaacttggctcaattctatggtcgcttctcatcttggcaaaaaatttccttgcttggtctaccataccactatggttacaagcagagaggacgccaaggtaagtaatgtcatctggttgtattgacatgtcttgcatttgaaagaaaactttaatggcctcttgaccttgtccattgttggcaagaccaacaaccatggctgtccatgtgaatttgtctctctgatccatgtcatggaaaaccttctgtgctttctcagaacacccacatttgaaatacatatcgatcaaagcattccccacaacaacatcgttcttgatcttgtttttgtctatgtatgtcttaatccattcacctatctccaaggaacccagatgagcacaagctgtgagaacactaaccatggtgaattcatcgggtatcatacctgcactttgcatctctcggaatatttccagagattcattgaagcaaccagctcgtaggtaaccgtcaatcataatagtccacgaaattctgtctctcactggcatctgatcaaaatatgtccttgccaacttcagattccctctctcaacataccctttcacgatagatgtccaagaaatcacatccctagctttcatactcctgaaaatcctcaccgctatatccatttccccgcacgcagcatatgcattgaccagagcattttccaatctcaaactgggttcagtcttacactcactaacatactcatgaacccttttacagagatccttatctttcaccttagaacaagccgagagaacaagaagtaaggtaacagaagttggagaaaccaagttcctctccatctccactaaaagctcaatgctttcttcatactctttcatcctgttgtacccagagatcatcaagttccacgagaacacatcctctttgcatctcctgtcgaaaaccccacgagccatatccattagtccacataaagagtacattttcacaagagcattctgcacataaagattagaacctaatccaaatttcacaacatggcaatgcagcttcttaccacaagccaaagctcctccatcacgcttaagaccgttcaacaagaaaggaaacgtgtggctatccggagtcacaccttccttcaacatattcaaatacaatctaactccttcaccatcacaatccacctttgaccaacctttgatcatattgttccacacaaccacgtctggttcaggtattttcacaaacagcttgtatgcataactcacatggccacctaaacgactacaccagaagacaaagagcttcttttggaatgttgggtttggtgctacacctctcgtaatgctttgtgaatgtaattgcttgaattggtccgtcgttttgcaaactccaaggatagagatgaaacgagagtaatcattggatatagattctgtgatcgttgacatgagcagtgccttgaagatcgatagttcagagttaaaaggagattttagtgggtttcgcagaatcatctccaaaaacacataaaaatctacaataatcaaaagcgagctcggacagtgacgggaggactcggccgttatgtttattgttctgtcgtctcctcataatcggtcgaaccgaaccgggtcgcattaccggatgttcaacaaccaagtcactcaaccggaaccaaaaaaaaaaaagagctcagacggcacttgctatcgtcacagttggtcaggacgactgtgacggcttccgtcacataatttgttctatcttcaccgctcttaaagtcgatcgaactcgtgtcgcacaaattgattaatacgcaaaccactagacgagagcgacttgttgtgaaattactacttatcaaattacataaactaaactgagaaagcaaaacggagcgttttgactcggttgctccaagaacacagagagagcaaattttgtttgtttgatagagagagatcgagaaaggagaagaaggaatcaagagagtagaaaggaaatg

SEQ ID NO: 2716 - DNA, 3000 bp, Unknown
  misc_feature (1)..( 3000): cDNA_ID_3069406_gDNA_ID_1620581_Annot_ID_161139 3000 nt of promoter + ATG
tccataacaatatgcttcatcacgccgcgtatagagccccagcctcaaggcttaatctcattcctggtgcagctcttcagatgcaaagggaactacaatggtttaaggtgatacatagttgtatatatgatcttgctacacaagaaattaggcaataactgtttctgtgaaaaggaacctaggattataactctgtattatttccaggaagtggagaagttagtgcaaccgaagcatcgaaaaatggttaacttgaagcagaagaaaactccaaaggctctgtttacagaccaacacaaggatctcgtggagcaaggagagaaatggatgaaagaaacagcaacttcttgcacagtcgttgccgctctaatcaccacaatgatgttttcctccgcctttactgtccccggaggttaccgttcagacggcatgccactctacatccaccagcacagatttaagatattcctcatctccgacgctatctctcttttcacctcatgtatgtctctcctcatgttcctcggcattctcaagtctcgctaccgtgaagaggattttcttcgatcacttccgacaaaactgatcgtgggtcttttggctttgtttctttcgatggcgacgatgattgtgacttttgtcgtgacgctcatgactctggttggagagaaaatctcgtgggtttcggctcaatttatgtttcttgcggtgattccgctggggatgttcgttgtccttcagtttccggtgttacttgagatcttccgcgccacttattgtcctaacgtttttgataaacctcggcgagtgtttaagctttgatcgagactcgagaggaataatgttggtgatcaaactaatgatggtcttccacttcacttgtaattcttcctacaaacatatgaaaaagccttatgagtagtaggttcgagccttcaaaatcagagtttaattgtgttctagcattaatatatacttctgatttttgtttttagtaaataatgatgattatacattatttaccagtttccttttataattctctcttccatatgcaaccactatataatagatttttttaataaaaaaaaattatctactagagcaattcccatacgtacttgtttacgaaaaaggtactaactggctcactaaaattaacgttgatatttcgatgaaccattttttttcgattcaaaaacatatattgctatattcgtgcatgtgtttttaaatatctagacttaaactacaattgttagaactttgatctaagttattggtttgcaaactactactgtaaggatactttgaactttttagtgttagtttgatattgtttctatgtaacaaaatttcttcacctattatatatgtatatgtttattttgttggagtttcataagtctaaagtaaaatattcaggggaaaaaaaaaactatttggtgaaagtgtttgtccttggaaaggaaagatgtacaagatacgaaaatacctttgcttcgctttgcttccaatacactgccatttgtcaacaacatgctcaatcgaaaattcgaacgtacgtaaatgtgtatgtgggtgaagattattacggcccgaacataactcatgttcagtattgggatttttatttctagactaatactaaatatttcgaataataattgtgatcaataatatattttgaatcatacgtagcgatggttgcaagggtcttatcagaagcaaagttggtctctagagtccccaccttctcctatgtgcaatttagctactccttcagtcctctgattgacacatgttcccacctgtctttgtttttccaagtcttaatgaagcttagaagttaattaattaaatcattttaaccttgcaccatctctcggatcttattaattatgcatattattattccttcatctaaaccatataatatttcctcacatatacgagtttcttttactttattagattctgaattattatcaaaattaagaaaattaagtaaaataaaaaatgtgaacatttaatattttgttgaattttgtaatctggatcatatgctcaaatgtacataacccattttctttataaaaaaaagtcaaaaactaatatttcgaataatcaataaataaatacaaattcaaaacacaagtttggtggaagcagttcttgaaaagacctccgaactttgcaaattgcaagcgaagtttgaatcaatgtattgagcttacctgtatttttccaaaaaaaagaggcttacctgtcttgctatgttaccttatcttcaccttactttgccaccaaggttttaaacgttgtacattagtattgtcaattgttaatagtaacggttgctttgttactaagatactttcatctttgatgaatactattcatgaagaagtatattattgttaactaatcatagttattcatggatgcatgcgtacatcattttacctttctccagctgtacaatatgtacatgcaataaaacatagtaatatatttctttccactatatatatatattgaattcaatgacttaaaacctttcaaaaaaatatttttgcttatataatcaagtgagttattggtaaagtgtatctttattttgaaaaaaaaactcattattttgaaaataaattatggttctctttacaaagaaatgatcaaagtttggtggacatatatatgtcaatcataagagagtcacaaactgagaatggagtttaaactaaagagctacaatattatccacaatttaaaacattttattaaaatcacgataacttcaaaaagagaaaatcaaaaattaactttgttaaaaaggtgggtatgaaaaatacaattttcttatttcctaacaaaaacaaaaatagaaacaaaggaaatgtgatataagaagattaaaagagacgttatgtctcacctatatttgctctctcctcttccttgtccaattctactgtcccaatccatcagttttatatg

SEQ ID NO: 2717 - DNA, 3000 bp, Unknown
  misc_feature (1)..( 3000): cDNA_ID_2049150_gDNA_ID_1620581_Annot_ID_161151 3000 nt of promoter + ATG
ttataatcattacaaagctttcatttgttgtcaactaatatgaaagctttctacaatttcttatttcattttccaaatcaaatttaagaactctcagacaaaaataatatatatagcaacacgatgtcgttttcactaaaaaaaacttaacaacacgtcgccgtttggtaatgacccaatcggcgaaatctgagaagactaaaaccctaaggtaaacctgagagaacaagccagagctaatctcttgtcggaaggaagaaggatcaaaaatgccgctctacgactgtatgcttctgttcaagcctataatcaggaaggagggcctcatcgacctcgttgcgcgcattggtaaacacgtttacagcagaaatggcgtcctcaccgagatcaaatcctttggcaaggtcgaattgggttacggtattagaaagctcgacggaagacactatcaggtattcaatttcgttagttttcttactgaatcgatggtttatgagtccgtagagtttgtttgatcaggattttctccaggccgattcaatggtattagcattttagtttaggtttgtgttagctttgtctttttcatctttctgatcgattcttatggttagatagctagattttgggaatttatacagtcattttactcaaatgcttgctacgaccatggactgatacttctttcgcccagattacttacgcttagtttaactttcagttggattcttgaagcaaaatcatcatattgttactagtaaaggttgtttttgcgtgattttgtctacccgatttataaaatcctgatgaggataacagaacagtaggattctagaatggttcctatcttagtcaattgttcaaagagcttgattttgctttggatcttcagtgtggagtttgattattagtttgatgctataaccgtagatagataagcaatcttattattagcattatgttttaggttggcctttcgaaaaagctttgtgtcttgtaactttctgattgattcttatggttaaatagctggacttgggggaaattatgcggtcttgtacacaaatactggctacgatcctgaagtgatacttgttttgtgatttcttactagtcacaaacgttgcgtttagtctatggtattttgtagattttcatttcctcgacagtgtttcctttcgaacttaagattccagaaaatcctgatgagggtaatacaacagctaggattctagataagttcttatctactgaattgtccaaagaatttgattgtgctttggatcttcagtttgaaatttgattacttgtaagataacctggtacaaataatcgcagctttcgcttatacattttcttcaaactgtttctgttattagacaatttggctatataggaacagaaggagaatatataattcatacatacctaggaagtaacgggatacatttgtttcgatcaactatagatgtaggattatcatatgttttgagagtatcagtacaaaagctttaaacatcaatctcctatgtatttttgatagaatctgcagagagtgaaaattgaacatccacttttattagctttcctctcttactaatctgcagagtcatgcgtttgctaagtgttttctgccttcatatcgggtgaatgttttgcagggacaattgatgcagataacaatgatgacaactccaaacatgaacaaggagcttcactacctgaacaaggaagacaaactgctgcgctggctcttagttaaacaccgtgacatcaagattggacagtcggaaaaggaagatagtctgactgtgcctaacagactcactagtgggagcttatatgatggatcctcctcggacgaagatgacaacaacattttagggttatcacgatgaggaaatcaatttctttgaaatgtttactcagacaatttcttcatgggagtccccttcaatggttatgaatgtttttggttacatgaagtggtggtatgcgttttgcgtagacaatgaaataaattaattttatgtaataataatttttaggtaaattgaactaaatttcatgtgttttattgttttcgctattttcctagtggatattcaacgtcatcaattgggttgacaaccccgaattaaatgccacgtgtattgacacgtcatatttgcatggggagagcgtttctctgtttttaggacttggaaaaattatcatttctaaaaattaatattgggaaaaaagaaggaaattaaaatagaggtggtggttcgtaaatgagctaagaacaaacacttgttataatttcccgtgtcgctgcatcttcttcttcatccatcgatttctctcaattagggttctgatttttcttcccattgttgttctccttctccgtttcgtctcaattacagaacaaagcttcgtttctccaggtataatcgaaacgtcagaatcttattaatacaaatttacgcgattctgttgccttataccgtttttttttttgagagagaaaatcttttaatcgtgtgttttctatgttcatatgaatgtatgcattgatgtgaatgtatatgaatgtatactcatgtatgcattttttttttctcctctcaaaattatgaaatagttcatgtcaattgtttatacctgtgtcgaatgtggatattttgacagaatataatctgagaagaagagtattggattgttttttataaaaattatgtcacgatcctaaattttgacgagctttactttaattttgtttttgttctgttttgtctttgttgttgatatgagctggatagtaatcgaaggttaaaaagtttcacaaaaaattggatttagagttgaattagcgtgtgagtatcttgttgtccttgaaattctttttatttcaaggtgttgcacccaaaagaatctaaagggtttctatgatcgttctgtgtttttatggatttgttttctgttgtcaacttttgcaaggtttaagaaagaatg

SEQ ID NO: 2718 - DNA, 3000 bp, Unknown
  misc_feature (1)..( 3000): cDNA_ID_2031499_gDNA_ID_1620581_Annot_ID_161161 3000 nt of promoter + ATG
acttaccatttgtttcataaatcccgaaattgatttatacacaatcctaaccagttagaaccagttagctgccggtgtgcaactatgaagtccattcctgatcgatatttatatggttataggcttatagcctaagcttattcacctaaaaacaaatcaatggttagctctatagtcaagttttttattcatgtaataattgactaactttaataattcagttatgtcatccattatgtaaaagtgcatcaatcctcaaaatagaaaagttatatcggttattattttaattttcaatatataagatagttaaattttgtgttaaaaatagaatagaaaatggaaatttagtagagtgatattccatattactttattgaacggatgtcagtattgtttgtgctactgctatatatcgtctctaaagtttgtacggatcgaccagtattaatgtactatgtagtctagtatttgtgttagagttgttactgtatcaactatcaagtatcatcgctcatattcaaattcgtataatacatgttgatagaaaggaaaaaaaatatagatgattacttaatgtcacatgtatttcgaccaaatgttcttttatttataaacttaaacgttaaaagagttttcaaaacacattctacctacaatttttcttctttcacgttgttcttaactacagaagatttgatctctacattaaaaaatatatatataacgaaactctggaaacatcattgttcgattggtttctattgcaagttgcatgtagggtttaaaccgattttaatttatatggcacaaatccattattccaaaaaagaaatagaactttatgggtggattgtggtgtaccactactagtaaagttgagaggaaaaaagctagatctctgggatcaagcaaactattaattacataccaaatcaagaaaactaaccttaattgacttttctccaacaaaagatatgaacgtggcctgccatttatatgaaaactttataatataaaaaacatgaacgtggtctggcctgctttgcataaaccaacccatataataaatagtgagaaaattaaatgtaatgataatagtagcaatgtataaatcaagaagtagtttcgtaatgatggacacaacgttttcgtaggtgccagcttcatcaccttcccacattctctctctttctcacctggtacgatcgtaaccggcacgtgcgattcacgtggctcgcaaaaaagttgactttttagctttgatttaatctcaacaaacattaaaaagtttatgatgatgaatgattagtttgctttttcttttgtataacatgagaggttacatgttattgctcatatctttcacttacatagcgcatcgcacgatgatgatttgatctgatatacggtctgatggtcatatgttcagtttttaagctaactagatgagttcaaatacataaaatcataatatatgcgtatagttaaatatatttcaccatagaatagctagctaactaatacatggatcgatgccaaaagtcccaaaactatataagtgacgaggacaccaacaaactattcgtcacgtcgacaaaatttagaacgaacttaattatgatctcaaatacattgatacatatctcatctagatctaggttatcattatgtaagaaagttttgacgaatatggcacgacaaaatggctagactcgatgtaattggtatctcaactcaacattatacttataccaaacattagttagacaaaatttaaacaactattttttatgtatgcaagagtcagcatatgtataattgattcagaatcgttttgacgagttcggatgtagtagtagccattatttaatgtacatactaatcgtgaatagtgaatatgatgaaacattgtatcttattgtataaatatccataaacacatcatgaaagacactttctttcacggtctgaattaattatgatacaattctaatagaaaacgaattaaattacgttgaattgtatgaaatctaattgaacaagccaaccacgacgacgactaacgttgcctggattgactcggtttaagttaaccactaaaaaaacggagctgtcatgtaacacgcggatcgagcaggtcacagtcatgaagccatcaaagcaaaagaactaatccaagggctgagatgattaattagtttaaaaattagttaacacgagggaaaaggctgtctgacagccaggtcacgttatctttacctgtggtcgaaatgattcgtgtctgtcgattttaattatttttttgaaaggccgaaaataaagttgtaagagataaacccgcctatataaattcatatattttcctctccgctttgaattgtctcgttgtcctcctcactttcatcagccgttttgaatctccggcgacttgacagagaagaacaaggaagaagactaagagagaaagtaagagataatccaggagattcattctccgttttgaatcttcctcaatctcatcttcttccgctctttctttccaaggtaataggaactttctggatctactttatttgctggatctcgatcttgttttctcaatttccttgagatctggaattcgtttaatttggatctgtgaacctccactaaatcttttggttttactagaatcgatctaagttgaccgatcagttagctcgattatagctaccagaatttggcttgaccttgatggagagatccatgttcatgttacctgggaaatgatttgtatatgtgaattgaaatctgaactgttgaagttagattgaatctgaacactgtcaatgttagattgaatctgaacactgtttaaggttagatgaagtttgtgtatagattcttcgaaactttaggatttgtagtgtcgtacgttgaacagaaagctatttctgattcaatcagggtttatttgactgtattgaactctttttgtgtgtttgcagctcataaaaa

SEQ ID NO: 2719 - DNA, 465 bp, Unknown
  misc_feature (1)..( 465): cDNA_ID_2049105_gDNA_ID_1620581_Annot_ID_161168 3000 nt of promoter + ATG
caagtcgacaacaacagtcaacattcaacaagctcacatggagtcatggacaacaagtatcctttcgtaattacctttaggccctccaatttattattattatttgtggtcgtcctttttgttggtagagtataattcaataatacatagttaattacatattaaactgaaatttatgtatcattagttgccgtttgttctactgataaaatgtttttgttttgtctctaaacgaaacgtgcaaatgttctttaaccaagaacaaaaaacaaatgtaatgataccgatattttaggacagttttcccatactctcggacgattttgcccttgtctcattggactctgaatacacacacgtctgttctatataagacacacagctccttaccacaagttgttgttagtctactcattaatcctcacaactctctatctctctctcgccccattctctatcataatg

SEQ ID NO: 2720 - DNA, 3000 bp, Unknown
  misc_feature (1)..( 3000): cDNA_ID_3069377_gDNA_ID_1620581_Annot_ID_161166 3000 nt of promoter + ATG
cattagatcacaagattctaacagaggaaccattaatgtgatgaatatatttaaccatatgattacggacccaatcgaccaaactgtcttccatttcaccagtgagatcaacaggtctgcgtccggtaactagctcaagaagcatcactccaaaggagaaaacatctgatcggtctgtcagtttcccgcttgacgcatactctggagccaagtacctgtcgtttgattcacaatttgagattctttagagaaacagattttcggatgagattataaaacaagaatgtttttgatatagaagtaagagctaatgaaatttgcaggaacatttttcatcagctggtttcgcagtctttagtacccgaaagttcccatgatacgagtggagacatgcgtaacattgtcttgagatagcttcgctaacccgaagtctgcaacctgtagatttgagccagtccagttagagaaaaaataataccaacgaatctgaaaacattatgagtttaaaaattataagaacgtaccttagcctcaaaggattcatcaagaagaatgtttgaagctttaatgtctctatgaatgattctcggatgacctaagtcaacaaagtcaagaaaacaaattttgatcacaacctaatcaaaccactcaaaaagattgaattaataatttagatttttgttttgactcacagtcttcatgtaagtaagcaagtcctttagctgatcccaaagcaatcttgagtcttgtaggccagtcaagaaccttgccacttttaccatggagatggaactcaagtgtgtcattaggtaagaactcataaaccaacatcctctgtcctcctgcaatacaatatccaacaagagacacaagaaaccgatgatgaactcggctaatgatgtcaacctcagcctgaaactcgcgctctccttgcccgcttcccgctttcagactcttcaccgcaatctctttcccattgggaagtattcccttgtgaacatatccgaacccgccttgacctaacaatcttgattgggagaagccttgagttgcagcggctagctcgtcgtaggtgaatgtgctcttgttgaaacctagagccactgaagggtgaggtggtggtaccgacggaccatgtggtcctgagtagtttgagctaaagtcgctactgtttccattcataccgcctgagactggcggtggtggtggaggcggcgatggttgccagcttcctggtggtggtggaggcggtgaattcatccagttattattcccgttggatccaggatactgctgagacagattcattacgtgatcgctctggttattgtattgctgctgttggtattgatcacctaagataaaacagagaattgttttcaccttgtatcttggataacaagaaaatgaaagaaaatcatgataatgtttcttgggtaacaatattttggaatattatgaaactcaaaaactgtcatggtttttcaatcatatctcaaatggattgtggaatgtgattagaagtaaggttcttaagaaaatgctagtttattgattagcttggtgcacaagaaaatgttctaaagtagaaactaggttaggcaacggctaggtttgatgggttttgtatttacctttgccggtggcgtagccgtttcctgcataatagggcatttgatgcttcttttttttcttacgacagcaacagacgcagaacaatatcataacaagaaacaacaatccagcaccagccacaattcctacgatagcagccgtgtttggttcattgttgccggaggagttggaaccaccaccgcttgatctaggaggagccagcgctcttggtggggaaggagagttacggtcagagtttctggaaggaggcggaggtgaacgattgttgcttcctccgccattgttttggttgttgttgtcattgttattcccattgttgttattgccattgttgtcatttccattgttgttattaccattgttgttattgccattgttgttgttgtctttgttattcccattgttgttgtcgttgttgttattaccattgttgttgttgttgttgtcattgttgttattaccattgttgccatcattgttattgtttccttgcggagatggtggtgattgtgagtctgaagaaggcggttgaggtgaaccatttgaggaatcatcgggcggaggaggagctggtggtgaaggagaggaggaatcagaaggcggaggagaggattgttgttgattgtcggatgatgacggagatggtggtgtaggggacggcggtgaattctccggggattgcccctccgccataatctctctttcggtgttttctttttgtatatgattttatttgtaaagctctctcctttttttgttttttacgagaaagagatagagagagagatgaacagagagaaaacacaaaaacctctttgtgtgtgttcaaatcctatttttaaaagagatgctttcaaatctttgttgttgctgttgtttctgtattggtattgtcttctttttgtagggtctatatttgggtattaatacagccatgcaaattatgtaccttcaactaaatttgtaaaacaagaaaaagaaaaattacagtctagaatttgattacttggttttaccaaaataaaaataaaaataagcatgctctcgttgagagttgaactcaagacctcccgcttactaaacgggtgctctaaccaactgagctacgagagctgcttgctgatcaaaaccaatgtacatataagtttggtaaagtatagtttaattattagaggaatgattcacttttagtaagaagacaaaataatagtcacaaaagaaattagaagacagatcaggaacagctagaagactcttcagggcacagagaaaacacccaccacatcaccgtcttcttcaacaaaatttaccaccagagatcgcagatatttcttcattctatctctctcttttagatccgattcg

SEQ ID NO: 2721 - DNA, 3000 bp, Unknown
  misc_feature (1)..( 3000): cDNA_ID_2049142_gDNA_ID_1620581_Annot_ID_161153 3000 nt of promoter + ATG
ctttactgatattggaatgatatctcaagatctaaaccagaaacttgtctgcctgcatatatgtgagctttgtattatatagtttttaattcatattttttgctaaaaaagcaacaatataaaaaggaggaaacaaaacagattaaagagaaaaaggaaaaaagaagaaggagaaaacgaaacagatgtaatctgctcaatatcgtctactccacaaacgttatcgtctggattttaagttttgtctttttggtggacatgatcttcccaaaccttaatggtcccgtacgtgtttactagcttttaatcaactgttttcgtttcatgttttttttattctttcttttatgtagttataaaaaccgaaacccaattctccagcagcctgagccctgagggtcgtcctcggctcactaatttacttgcagtgcttgttaagatgttacaaaaaaactttaacattgataattaagcatatactacataccattatatatattcctcttacttaacagtaacacatcaaattttgagtaaatattcataacttttaaattagaaaggggctttagtgtataaatagctttataatttgtgtatttatatgttgatttaattctagatagagacttggagagatatggttgaatttgtggttgtggacatggattagaccaccgccaaaaatgaaaaatcacaagtgggatattttgctttttaaccctacttttctatcattttttaattcttttttgcctcttttaattaatttaatgagcaattgatgagaaacttatgagatatataggattcatcatttatctctctagtacttggtgcatcatgggaaatattttgcatgtcaggtagtctaatgataagttattgaatttaaatattgaaatctcgtagtgatttacccattaccaaaaaaaaagaatttatttacaagaaagttcaatatgatactagtttccacgtcgaaattaatagtcatagttttaaacatccttaatttagaatacattcccaaagggtgaaacaaatacatgcagcatataatatgtttagaaagatttttcttgcttcataaaatcgatagtatagtatagccttagagttgatattttgtttttaatggatggaaagagaaacatgtgtacaacatctattatttggatccttagtgttgatgtgtttgaaaaatattttatgtttgaaacatcactttggctcaatggaggattatgttttaaagtgatctttctattaagattaatcatccaactctaacatctattattgtgttctggtttcgaagaagtgcgttatagagccaaagactaccaattagcaaacatacaaaatttcgtttgaaattgtatatgggctcaaattcaaattcatattagcgcccaattcaattgggcttatttttggcccaactaaaacctatttgtggctcatttttatatgatcgatccaacacaagcacatatgaaaatgtaatagacgcagatattaatgttacaaaaattgtttaaagtatctgttttttagtttgcatgtcgtacttattcaatgtgtgtgaagttctcacgtcatcatgtctgttaaaaactaatgaaatctgttttaaaaatttgtgttgtaaattcaaattatattgaagttcatgagggtttaagcacagaaaaaaattatgggtatgtatgggataaaacaacttagttcaagaagaaaataaacagttttcccaaagttaaacaaaagcaaatatagagaaaattatcaaagattttaggatgatttaatttaaaatttacaaagattaacattttacatacacaattgaatagataattttaaaaattgataaatctaacttttaatcaaattttaatcagtcttttttttttttttttttttttttttttttttttaataaaactttatccgtttttgctttacatagtcatcttttcatgatttgctgttatctcatatcttagacttatgatttttttcttattaatttttttttttcattgcgtatctacatttttataactaaaaaaaaaaagttgtatatcagaaaaatcatatttttttatattatcacatcttatgatgcatatccaataaacaaaataaataatttgcatcaatttcttttgttcagttgcaacaaatctttcctcaaaaaaaacatttagctaattttaattgcagaagccaaagagtaaaaaatttataacattcggtcacataaataaataaactgaaactatatattccaaacttcccttacctacgaaggacctagtttatgggacccactaacaaaattaaaaaatatatatataataattttcgaaaaaaaactaaaataaaaaaattgaaagtatttaagtgtgtatcgaacgagtcacgaagaagatatcaaatcgtctctggaaaaataaagaattttagaatgaacgaattagtattacttatctgataatgacgataactaacttgcttgatttccagatattcctcatggttttgattcaatttcgtctcccatagttttgaactcgcaacactaactttttgtaatcgaaagttttgtcctttttttttaacaatcgtcgtttagggttctttcaattttgccgataaaatcttatataaaaaaaaaacagtgaagaataagttcgaagaagaagaagaagacttaaaaagcagcgacacaagtcggtggtgactcggtaaggtactgatgtttactttttcatgagttcgtgagttttgtattctacttgctctgttctgggttgagtttttcttttttgtttctactctctgatttttgtttcttagatcatcgagaactatatttatgattctgggtttttactggagattatgatcggtttgatcaaatgtggaattagtagggttactgattttgaactattctcaattgattggtttctcagaaaaagaaagatg

SEQ ID NO: 2722 - DNA, 3000 bp, Unknown
  misc_feature (1)..( 3000): cDNA_ID_2049183_gDNA_ID_1620581_Annot_ID_161140 3000 nt of promoter + ATG
actctctctcctttgattgctttggcgatgttcccaggttccgaaagattgaataccacaactgcaaattgacacagaactaaataagcattcttgttgtattttagatgatcatgtatgcatgtggtcaaggtttgagagagtgttatagaaaacaagcctgggatgttattttcttggcacaaagtgatagcagtcatatccattacagagaggtcctttgaggtgacctcttggtaagttagtgagtcaagcagacgagcgtttgggtttcttttaggatcatcgtcgaacacgccatcaacatttgttgctttcagcactacttctgcattaactgtgtccaatgcgaaaagtttttttttagtgttgcgaataatcattggagaaaacttaaacggaaaccacctctttacttactttcagcacatcgaagagccgctgcagtatcggtggtgaaaaatggattgcctgttccagctgcaaatattacaacccttcctttttctagatgtctgattgctcgtcttcttatgtaaggctctgcgacttccgacatgcggaaagcagtttgaacacgggttgggatgccaatactctccattgtcgcttgaagaaatattgcattcatcacagttgccagcatcctatccaatttcagataaaccaatgagaccaaaaacctccagtagaggaaaattctggatcttctccgagtaagaagaagaagatcctttgacacaaaggcgtatgattacccgatataatcagcagaggagcgatcaaggccactgcacccagcccaggtagatccacgaaagatatttcctcctccaacaactatagcaacctattgtaaaggcgtaagaagatcagacagagcacacacaacattgcaatgattcttaatgacccagacacatgatctgttgccgtatagtatgtttaaatcataacaaatttctaactttaagttgtgtaatgccatatatctccaccccttaacttaagctcccgtttcttgtaagtttgagctaattgatttccagcatatttggttacatctacacaggcaattatcaaatacttcgggtattatacttatgtataggaagaactcaaagctgaatacatatccactaaaaaattttgaatccaattatcacaatgacaactagaacaagaatgtttgaatgaagcgtttagagaataacctcaatgccaagtcgagtcactgctgcaacttcccttgcaatcgccatagtaacctaattaacgggaaactggatgagacttctgaagtaaggaaacagagaacaaagaaagcaaaacaaggagggttcttttggtatcacaataaacctttgggtcgatattttgctcctcgtctccagcaagagcttctccactgactttgagtaaaacccttctccatttaagcggtggtttggatgttccatcaaaggaaggcagtcgtgggaaagatgattgcccgtttaagctactgaaaattacagatgatcgcaacagagtattaacaaaatcagccaaagttccaaacattataaatgggttaagttttacttcaaccaaaacaataaaatcagatttgcaatatattttaataaactcttaaaccctaaacccagaagtatcttcattgacaaattttcacaaacatctggtgggcgtaaagattaaaacttgaagattaataatacctcccgttcccgttcccgtttccgttcatggagtctggagatgaaccattgtctgaggacaaagaagaagagcagctgataagtacacgcctactgtaattctggttggagaagaaagtacgattgcgaagtgtaagagggacgaaggaggttcgggaaatagacgaagaagttgagattggggagcaagaggtaagaggcaacggaattgccattgccggagagatctaagaagagattatttactgaaatattcagtagagaagtgtcgccggcaaagacgggttttaagtctgagaagataaggtctggtttcaatgtaatttactaattaatcaaatgaattgttgtgatatttaatgtgtatatatatatatatatatatatatatatatttgaattatatccccaataattcactatatttaatcttatcttatcatacaaaaacgaataactttcattaaattctgaatatatttagaaaattttgatatatgtcaaaatgtcttttagagttttaacatacgttatacatatacttctataaaaaatgtaatttttaatcaaatttaattgaacaccaattttagtgcactacatataacaaatagctacaaatagatagatattttcttatatctaaataattcacactattttatgtgtacttattattgaccaatggttttttttctttttttataacaattgattaataggtttgaaataactacatttgcatcctacaagagaagtgaagaaccacaaagcattcttattttcgtttcaatgacttgaaaaatatgagttttcttaccaagttcaagttttaaaagtttactaattgcaaatttacaagtaacattgtttttgaagagtgaaactaaattctttgctttgcaacgacgtaaatttttgtaacactaaagctcgatcttttaaatattcccgggaaaagtaaaagtaacaaacacatataagaagaaaaaaacactgataatgatcttgaaatctttcatggtatgaatagtcaaggattattcgtattacagtttattataatgtttaattacttgaatccttgtctcttttctttgtccttgaaaccttgcttcaaagataagccaccacaactcttttaacactttactcatgtgcctctgttcgaataacggaaagatatgttttcttttacagaaaaattataaaagaacaattttacacttaaacaaacacataccaccacgtttcttgcgggagaagcaaccgacaaatg

SEQ ID NO: 2723 - DNA, 3000 bp, Unknown
  misc_feature (1)..( 3000): cDNA_ID_1010815_gDNA_ID_1620581_Annot_ID_161150 3000 nt of promoter + ATG
atgtgtgtataaattcacgtaaatgtatatgcgatgtgtttgaatatagcagaagaaagtcacagaaaaaatattttaagtgattgaaaatgcaaaatgtgctataattatccactatcatgagaagtactgattcaaagtacattgtattatttattcagaagccatagtgcagtaattcgtgaacttagtcgaaagggacaaccaacaagcagttaagtactttatagcacattcacatttgctctgcttcaagtgttctttccattttaagaaaaaaatgagtttcatcgccgtcatattgttcaatggaattatcagttctctcaaggaaaattaataagtagatttactaggactgaatcacaaacataaccaaataatagctcaaatgcgcagtttgataaagattacttataattggatctacctgtacccctcttcatatgcctgaagtgctcctgtccattccccaatacagtccaaaccattaccaatattaatcttcgctagtgcttgaccctacaagagaccaccataagtgaatattagaatcaggaaagaagaatagctataatattgacaaatccaagaaaaggtataatcagttttccacagaaaatgttcagtagaggcctaatgaattatttctggttttgtgaatcaaattctgatgacagtagtgaacataggtttttataattaatcgtgcaagcaaacaaatctcacctccagattaccaattgcttcatgtccctcataacttcttatgaaccacttcagggactttctgaaatttctgagattttggtaagattctccaacaatcatgaaggcatcactcagcttttccttgtcacagagttcatctgatattttcttcttcctttttgaatattgaagatgctaagacattcaaagaagaaatagcaaccctttagttgcatgcaaacttcaaatggcagcctcctacttaactttcaaaactatatcacaagtcattgaaacagtgatgcagagacttggatcactcagtatccgtatgatacagaataatcatcgttttgccacataataactttactttgcaagttcagaacaaagatattatcccagcattcaaaagataggttttcttgagagaacaagaatcatgtaattctttgataatatagtcttcctgactgatctgaaaagacagtgtcaatagcagaagttcacaaaacttaaatcaaatctaagaaaatagcatatttttcctactccatactacctgatgaaatctcacaatgcttattcatcattaaaaacccctacgatggacaactttaacttctggaaacttttcaaataaatgcgaacatggggtggagtgataggactaaaaaggaaggagtgtttaagttataaaactcaccttcagccatgcgaataccatgctagatttatcaataagacttccaagacaagcatttacttggagcatagactttcgttcctccgaagtgcctttggcatcagtcatttctgcagacaacttcttaagcataagctcttcttctctcaattcttccataactttcatggatttcttgactatcttggtattatgctctatctgttcaaccaatgcactctcgtcttgcatagatttcgctagactagaagctttaccataacataaaagagcatcaatgtacttttgggtcttgttgtgtaattcagcgagattgatataccccttcgcttctccttggacatgattaatcttatgacagatattaatatccatctcaatgtgtttctttgcttcatcccaacttctcagcgccataaaaacgtttccaaggttatgatgaagcctactccgagcagcatcatactctctcacctcctcttcatcgcaaatctgcagccctttcttaagaatagtacgggctgcttcaggattatcaagatcaaggtcaagcataccgatgttgttatgtgcgttaatatactcctcaaggaatccgctagattctccaggaggtggtttctccttgagaatctgtgcaagttccatggctttcttaaagtactttttagcactctgaatggcttcacaatcatcctcagacttcaagaacatttcatggtaagtacgtccaagttgagtacatgctctttgcttctccacagtgtcattagcttcttcagctagctgtaaatgcttcttctgcaaccaccagaaaaaaacacaaattcaaaatgaaaaactcaaacaccaaaattattcacggaaaattcaggaagccaacaataaccaagtaggaaaaagcaattgattcaagagggcttacctgataaatcaaggcttcttcgaaattttcgaggcggagatagatctcgccaagagactgacaagtaggtaacaaatctttcccaggtaaatacttgacggagatatcgtaatcaatcctaaaccacttgagagcatcaacgtactctccatgattcttaaggatatcgccgacattgttagcccacctcgcctgttctctccggtcacccacttcttctgctttccggtacgctctcttcgccgcagctacatctaatcgacccatcggatgatgatttctccgttcttcaattgaaaggtttttgttttcttccttccgattttcagatttctcgaaatttctttctcagtgattttgattttctcattttctccagtcgccaaatttttggtcccatcccaaactatcccgccaaaattcaagggtaaattagaaattttcataccctaaatcctgaagttataggccttttagtttgggccttgggtcgagtttattttgggcttcttatatcctcctgtctcctgacaagaaaacaaaaaaaccctaagggttctaaggcactcgctatataaactatcattttgcgccgcccgaacccgaagaagaactctctcttgtaaacctgcgatctgaatcttcccggcggtgaaaa

SEQ ID NO: 2724 - DNA, 3000 bp, Unknown
  misc_feature (1)..( 3000): cDNA_ID_2168375_gDNA_ID_1620582_Annot_ID_161189 3000 nt of promoter + ATG
cgtttcaccttcttccaccttattttgattgcagatagaacacctctaaaccacataaaacatatacacacaaagactcgacacataatcgaaattttatataacgaaaaaaaatgtagagctttaatttattattgaatttcaagttatcgtatgtctcacgtaattcgacatataattccatggggagaaataagtttatcacgtctctttgaaagttcaatggtcgtatcgtttatctttttgtcccaataagctatctaactaatctaagtgaattaagtctacttaagacaactcctacttagttctccccaatttcttcaattaattaattttcctaatcacatttccaacaatttatgcatgcgtataaaatacaattatatattaatatgtactaatacaaaattttatgatctagaacatgtataagttttcttttttttttagaatatctaaaagtttaaacccaaaaactcaaaaactttacgttttttagagacagaatctatactaaattaaatttatttctctaatagacgtcgaactcattatctctatatttgaaagatttaccactgaatcaacatcatattagtatttgtacaattatatagaacgatatacatttttgccaacttttgaaattatactaaatgtctaacctttaaaccagtttactgtacaaatacctatgtaaaaagaattctgtgtgatatataattgtaaatataatacgcaaagagatcgtcaattttgaaaaacactttaaatagtaaatattatatagaaatttatctccttaaattagatgtctatatgttcagaaaaaatattggtatattttaaaaattacaacatggcatctgacctgctcagaattaaaatattaactgtagaagatattttgatacaacataatcatatattattccactacctccaatagtccaaatatatagcaataattttctaaagatacgtatcaagaatggtttaatatgatatcattgttacatgcatatgcgtaatttttttcatagttaatatattctttgtaatatggagccgactgatgaatattggtgagttctagtgtgtgacaaagatgccattgttgactagcaaattctaaatctgaggagaataaaataattctagaaattgaacttttgtttttaacaccaaaatcaaaaccaatgggcccaattctttgctgacttggccaaatgagagccgtccatatgtcagtcgacaactgccaaacaatcttgacggtttgttagtttggctcaaaagccaccagtaatcactgatcagtttgggacttgagtaaatgacttatttacccttagttcaataatacggttttgtgtgatttaatttgctagttaagttaaaccatatttaaggatggtttaattacatttcaggtggaaaaaattgatgagagaatctagctagaaaaagatggacacgtatggaccgttgaaagtaggaatacaaattatttaaggaatacaatatttaatttcaacaccaagtgtcgaatagatacaacaataataatgatgaacaccaagatttattttatattctctattttgaatattgattactccaactttttcatgatttgtttttcagcacttgagattggaatagacacactgtgatatcgaccataaaatattttcttaggaatatatcgttgtgtataaagtataaagttaagtgtaatgctttaaacaagaaaaataaaagagttgagattgtaatcatagcaaaaggctattttatagaccttttagcggatggaaaaaaaaaaaaaaaaacaccttttagctacatgatgtagcctacatcatatataaaaaagataatagaattatttaagaaatgtaatgtgttataaattaataaccaacacatacacaataagattcatataagtttatgaaatcaaggttgtgatattgttgttattgagatccaaaacttaaaatccaaaatatcagaacttttggagcattggattatataaaatatatttttctcaatcaaatctttttttagttaacaactttaaattaatcgcaatagaattattcatgaaaaatgttatttacatataacccaatccaatgatttcaaaagagatattatagaattttgtaaagcattaaagatttaactacattttgttacatagacccataatcataaaacctttgattcatagtttcattcttataatggtctcttaagtatgaaggtgttgtagcggagactagaaatatatatgagggtaatgtttgtctgttgagacacatttttacaagctattaaaaaaaatgattccaacaatatttattgaaagtaaatgtattttattaggagattttaaaattaatgtcatattctaaaatgtacaatatatacattattttttgaagattttacaataaatttcaaagtgaaactgaaatgattttattaaatttatatacataactctttgtgtttttttgacagtcatatatataactcttaaacacaagcttttacagaacatctacagttattttaggtgaataaacactccaatttcaaacaatttaaataaataaatgataattatctgtcaacccataaactttacattgtaagaccattttattttatttattttgactatttatggatatgtgatattattgagaaaaaaaacactattactaattgacagaaaaaatacacttaatattttctcctaaattttctcaacgaattaattacaaaataatgtgtataccaagtaaaaagattctacttctcagtgacagcagaactaatttattcaagggtagtttcggaataataaaaaagcaataaatctctttttcctataaaagcaaagagacactcaccaaacaactcgtccctgaaacctctcttcagaaaactcaggcaccattttctccttccgccgccgcc

SEQ ID NO: 2725 - DNA, 3000 bp, Unknown
  misc_feature (1)..( 3000): cDNA_ID_2168401_gDNA_ID_1620582_Annot_ID_161195 3000 nt of promoter + ATG
tctcaatgtttgtgtcatattctagttaatctatactcgaataattatagtattcccgatcgttttatagaaatatataaccaaaaaccaaggtcaaacgtgcaatatgataatgactttgaaccaaaaaaaaaacttaaaacaaattgcaacctcatgggtcctaattaagtaattatacaccaacaatatagttaacaatttaattattcttatgtaaagtaagaataacttttgatttgaattataagcttatagagccaaatataattaagtataggccaggtccattgaaaattcagacatattaattattacaaatgaagtcgagtaatgtagagtttaagggtacggttttttggtagtgaccaagctcgacaatgcaaatctatttttaattctatatagctatatttataaatgaaataatgagtgttttgggatcactaaatacaaactttcatgagttttgatgattgtaatacccaaacttttttcttggatccggtgcaacgatagaacttaatttcataaaattagccaagtgatgaaaaaatgattaagcgctactagggacatgcatgcatgcgtttgcaaattctaggtcaaaactaataaatttaattaacaactatactatcttaatgatttgatttccaaaacaatgctaaatgcaaataatatatcaaacagaaaagacccagattacacaaacaataaatattcaaatgatctggactctggagataatacgtgtttagttttgaaaaagcagtttaagaaattatagtagcatgtccaattgtttactaaattaaaaccacaaattcgaaatgtttatgttattatgatatttgaactgctatatatgggagtttggactcttttatttctgtttctgtttttgtactagactttaagtttctgagttcaatatatatataatcagcatattaacaatcattatcatgtacgtgaagtttcattccaaagatttatttttttgacttaaatatctgttttcttaatttcgtacgaccattcaattcttgcaatgtctaagagagtggccataggaattcaaaatttgatacatgatgacactttacaaataaatccaaactagtacaaacccaaaagcctcatgaggccataatatgcaaggcctagtttacatcttttagaggttcgtttattatagtttactttccaggaaggcccttttatttacacttaagaaaataaagcgaagggaatatgttgacacacaaaataagaacaaaagataggtgaaaatgtttttcttttttttgaaaatctacattgcactatttttgttttatgataaattagattttagacatgaaatatctcctcatatatcaaacacttcacaaaaaggattcacaaatattttcacgtagtattctttatataccaatgttttgtctataatacatttaatgtgaatttatacaggactaatgtaaattctataaaatcttatcataaaattcattaaggagattcagaaatattttccaagagacattgttcttgtactacacatttcaaaacactaataaaagtagcttaaacattatttttacgtaaaaacaaaaaccaattcctaaaactgtattcttgtaaagacatgtaggaaatatttataaatattctctctaactcgtcaaataatatatgagatcatttttacacatgtagcatcagtttaggaaaaatataaattaaacagtatatctcgcataatacagaaatttggtatggtccaatatgaaattcaatgtatatacatgaaattgtttagaaagatttggaattttgacaagtatattacatgcggatatttttcttgaaattgaacaaacatagaaagaaatttacagtgtatttagagattttaagtcagaaatacgcatttaatttaattttacttacatagtaagaaatctaaaatttcatttgttaaatacgtaattgctgacgtcaaaaagatgtaaattttatagaagaatttaaaaattttgaacacgtaaactacatgtagatatttttctcgaaattgaacaaaacgtacatagaaatttacaaaatatttaaagattttaagtcaaaggataagcatttaattaaattttaaatagtaaaaaatctaaattttcatttgttaaatacgtaattggtgacgtaagaaaatgttgtaaatgttttagtaagattgaaagtttttgacacgtagatatttttcccgatattgaacaaaacctacatagaaatttacaaaaatctttagagatgttaagtaagaaatactcatttaattctatactacttaaatagttaaaaaatctaaatttttatttgttaaatacgtaattgcttacgtaagaaaaaatgtaatttccttataaattagtaacggccaaaacataatgattataagttaacaaaaagaaaactaaagagcctgaaaaataaatataaaaatatatatacaatgtagaccttttatgaacaaatttgtaactctatatttgaaaaactttgcaataaattgttaaatataaattaaacctaatgcatcactcatgtaatcattggcataaaaactataatatattttctttgtgagccaccgaagtttagctttctgtcactttgaccctctctaattattcatagttttaaaaccaaccctctctaaaaatacttaaaagcaaactcttccaaaatcaaaacctcttcttacacagattttttttttctctgagagagacagagagagcgaaacttgagagaccaaaatccaatcttttcaacaatcgattctctctgagaaaaccaacaataaagctagacacttttttttgtgggtttgtcttcttcttcgttcatgcaccatgttgtgttacgtgaacgaagaagctatataatcaataaatcttatcgatttgttgagtttgggaatcggagagaaag

SEQ ID NO: 2726 - DNA, 3000 bp, Unknown
  misc_feature (1)..( 3000): cDNA_ID_2168409_gDNA_ID_1620582_Annot_ID_161197 3000 nt of promoter + ATG
gaagttagtgaatgtgtcctaatttatacaaaataacacaacagattactccatttattctaaagaaaaataatattaaattaaactaatataaaaactaacacaatatttattaatatatacaatattaatttttgatattttttaatactcgacacgttattttaattaattaagcgctgttagtgatgttaatgatgggttaaaacccactgagtacccgaaacccatctaaaatttcaaaccaattgatctactttttgtataaaataaaacgtgggttttaaacgggcaggtcctatttcgttaaagtcttacacgggttttaccctactgggttatggatacccgtaagttttaacttattattttagtatattaaaggcacaatagcccaattgccaattctattgagaaaccctaaattccttttcttccccaaaattctgccaccaccacaacagtctctctctcttctctcctcttctctccgtcggagtcaccgtgagagtcaccgccggagtcaccgccgtctacaccgccggagtcaccgccggagtcaccgccgtaagtctctcgtcatctccttgaaaaatcaaactctagtttcacttgatattagatgtcctttctctcctttgattttgtgtttttctcctagctttagaatatgacgaatctcatgaataatctaatttttagacttggtgataagtgtatctttcattctttttttaaacgaaacaattcggtgaaaaaacattcacgagagacacatagtagtgctatacacttctagaaaaggagagaatttaaataaacattatcaagtaacgtcatgagagtttttctatagaggtcatgatcttgtgttttctttgaaaatctgaaacccatttgggaatttccaacattgctttttttaagtatttaaatacgttacttgctcttaatcagaatttgttacttatatgatttaattattgttcattgatggtcaagtttattctctaattaaagttcatgaggtttttttgtagaatggattcacaaactagagaaacattggcacatttggaggctgagaatgagtatttggcaatgaatgaggaggctgaaactcaaggagaagcaactcaaagtgcaacacaatctactcaagcggctacaacggtatataactctaacaaacgcttaaagtctgatgtttggaaagagtttagacccatcttagaattagaagaagatgggaaacagagaggtcgttgcattcattatgataagaagttaatcattgaaaatagtcagggaacatccgctttgaaacgtcatttacagatttgtcaaaagagacctcaagtgcttagtgaaaaaattgtgtatgatcacaaagtagatcgtgagatggttagtgagattattgtgtaccacgatttgccatttcggtatgttgagtatgaaaaagttagagctagagataaatacttgaatccgaattgtcagcccatctgtagacaaactgctggaaatgatgtgtttaagaggtatgaattggaaaaaggaaagctgaaaaagttttttgaacaattcagaggaagagtttgttgtactgcggatttgtggacagctcgtggcattgtcacagggtatatctgtttgaccgcccattatgttgatgatgagtggaggttgaataataagattctagcgttttgtgatatgaaacctccacatactggtgaagaattagctaataagattcttagttgtttgaaggaatggggtttagaaaaaaagatattctctttgactttggataatgctaggaataatgatagtatgcaaagtatccttaagcatcgccttcagatgattagcggtaatggattgttgtgtgatgggaagttttttcatgttagatgctgtgctcatgtgttgaatcttattgtgcaagaaggattatcaatagctactgagcttttggaaaatattagagagagtgtcagatttgtcaaagcatctgagtctaggaaagatgcatttgcagcatgtgttgagagtgtagggattaggagtggtgctggattgtctttagacgtccctacacgttggaattcgacttatgacatgcttgctagagccttaaagtttcgtaaagcatttgctagcttgaaagagtgtgacagaaactacaagtcattgacttctgagaatgagtgggatcgtggagagaggatttgtgaccttctaaagccgtttagtactatcactacttacttttcaggtgtcaagtatcctactgctaacgtgtattttctgcaagtgtggaaaattgagcgtcttttgaaagactatgcagtttgtggtgatcttagagtggataagacagaaatcaaattgggtacccacgggtagtttacatgatatatttacataccagcttagtttataagcaaaatatagatataaaatatatataatagtatagtatattagtagttaaacataaacactaaacaaaaaagacagaaatcaagttggatacccacgaatagtatcagaacaatcgggtttttttcgtgctttatccactaatcaaaaacccatttaggttttctaaagttgggtttttggtggacgggtttattttgaattcaggtcaggctgggattttttatccaccacaacatctttaagcgctgttaaaataatgaagagtagagattaaaaaaaatcactatgtcagtacacttaatcttatcttatcttatcttatccacaataaacgcctaaaaaaatgaagcgtgagatttggttatataagtttaacgactaaagccacgtcatcactactgtccctatcactacccgccaacgtcttttcggtacagcagcaatataccacattaatcatttttttattctctcttttggatcgcttccgttcaatgtaaccggcgaaacagagcaatctgaaattatcttagggctatagttatg

SEQ ID NO: 2727 - DNA, 3000 bp, Unknown
  misc_feature (1)..( 3000): cDNA_ID_3069423_gDNA_ID_1620582_Annot_ID_161200 3000 nt of promoter + ATG
ttttatacaatgacgtgattttttttatgtataatgtaaaattaaaataagtaaaacttctataaattaacagtcgctcatcaataactagagtcttgtttcttaaagacgatgacgacctattaagttatcttaatgagaatgtggacgatattgagcccgagtggtttattcttgacatttccaccattcgtagtgctatgattggagcagcgggttggccttcgtccatccccaactacaatcccaaacatatcattgagaatttggggtgtagattgttaggacttcaattaaagcagctacatcattaatacataatttgaacggatcaattgaggagaaagctgaaggatgtggttacacaatttctagagttttcacacaggatgaggatacaattcatataactaaactctgcaaaacaatacaaaaaaaattgatgtagtaaaataatataattgaactctgcgtaaaaaaccaaacaatactaaaatcatattttactaaattttcttacatatattgatattaataagtttatacaattcttagtttatgatactaatgaaaccatatatttctataggatttttgaataaattattactttatttattttatcaaataatgttaaatattatattcacttgactagaaaccaaatttttttattaatttatagtgattactaatttatcgaatattaatcaatagatgttttttgtacaatttattcacatgttaaatttaaaattacaattgtgctcacttcatttctttacttagtctacattatctggatatcgtataattattaaatcgtgttcatcatcactgtaaatatactattttagatttaactttagtgaaatatgcatataaacattaacatgttttaagttgattttcatatttaaatttatcttattgtaatgttgattttttttttggcaaattgacaaatttattttgattgttcgagcataagaaaataactggttactattataaggtacatgttaaactattaatgatgtcacagaatcttaattaacaaatgtatttgtcgctaaagacttcagacttctagttgtctttttggtttgtaaaatattttgaaagaaaatcatgtttccaaaaataatttgatacaaaatcaggtttcatttgtgctcggaaattttgtaaaaagattcgttgttgtgatcatttttaatacacggatgaaagaaatatcaattaaacaaaaacaaatattagaaaacgtcaaaccctatttgttaattcactttagctaactacgacgtctatatacatctcccaaaatataaaatattattatatatttgtgaaattaattattgtttttctgtaaccatttttggagaattattattgtttggctatactcttatagacaaatgggaccgacccacttattcgttggatagtctttcttttactccactcagcgcataacctctatcacacacagctcaatcatcccacgtcttcttttctaaatcccctattttacccttgaacctatcaccgattcgatttcgactcttacttacaacaagggcatatcaggtataatttaacataatgagagatgcttatcttaaaaattaaatatcaaaccagggtggtgcaatgtgtttttcaataagagtttaggtgtgggataatcaaaatcaatgagcaattaataagattggatgctatgccaataaggatgtcatgtcttttctataatcactttatttttattttattttctcttatttttttagtttatttattgattccttgctaaaaagtccacaaaatcacgtttctaaaccaataaaaatcatttatgttgaaatgtttttagtttattggttggttaaatgatgattgttgaactatgttgtaattcatgtgtgttttgtaatgattgtagtcagtagattgtaaattttgatatatgtatatattttttttgtatggagtgtatatataaacaaaatataacagatgtattttgactaattggacagaaatactatagttaaagccaaatttaaattggagtttggaaataatagtttgatatcttgtccctttgtgcttgcataatgattgtctgattatattcaatatagttcacaattcacacttaatcatatatataaagaagttttgcataattgcaggaaaaaaagcttgccccacactagcctgaaagctattataatattacgattagaaaccaaattgttgtagtttagtgagtttgttatatatcctgatgttggtgaagacttaatagattataaattacattttacctctcaaaattcaaatgatttatgtggtatagtgacgctagtttcatcttagaaactttggtttacgagtaaaggataagattaaccggagtatatgtatgtattaactaatattatgcattgaatacaaatgttttagggtttgatgtaatcgattgaaaaccaaattatggtgtgatctaatgataaaaagatttacgccaaggttggaggatcaaaacacgaagttatcttctacgatttcaatcattattgaccatgctataaaactaataagaacacttaattttttccttagaaaacttatccgaatttcacacactttgaaaataagcataatcttactttcgactataaaagaaaaaaaaatgtagttaaaaagggtaacatttactggtatgttataattggagtttgctaatcaaaatagttcaacaatcattgaaagacaacaacaacaagtatgctatttcttgttttattaaccaaaccattaaaccaacctataattgataaataaaaatagtagtaagtctataaaaattaatatccagtaaacataattcatttgtggagcactataattatagacggtgtcaagtaacggcgttagcaccgacgaggaaggcgatggtataaaaggcacaccccaacataaatg

SEQ ID NO: 2728 - DNA, 3000 bp, Unknown
  misc_feature (1)..( 3000): cDNA_ID_2168405_gDNA_ID_1620582_Annot_ID_161196 3000 nt of promoter + ATG
tgaccctctctaattattcatagttttaaaaccaaccctctctaaaaatacttaaaagcaaactcttccaaaatcaaaacctcttcttacacagattttttttttctctgagagagacagagagagcgaaacttgagagaccaaaatccaatcttttcaacaatcgattctctctgagaaaaccaacaataaagctagacacttttttttgtgggtttgtcttcttcttcgttcatgcaccatgttgtgttacgtgaacgaagaagctatataatcaataaatcttatcgatttgttgagtttgggaatcggagagaaagatgttaacaaaggtgcttagtaaggaggttaagccatgccttgcttgtccaatctgcactaatccgtttaaggatgccaccacaatctccgagtgtctccacacctgtaagtgtaacccttcgattgttttttcctttatctttgtgatttagattctgattttttgtttgtgactatctctctgtttattggttatattaattagtgtagactagagattatatcagattgattctgaaacttggaagttgaaaccgatgttttgtttagctttttggtgttgttgtgtgtgtttcaacatgtatctgtgtaaatattaaggtaagcagataaggactgtttttttttgtaagtggatgattcagtgtctgtttatgtctttgtgatttcaaagttgctgtttctttagcttgttatgtttctagtcctggctttaagtattggtatatcttgtgtctttatatgaattgggacttgtggaatttgtggtaacagtttgcaggagctgcattcgtaacaagttcataaatgagagagtgaacgcttgtccagtctgcaacgttaacctcggtgtttttcctctagagaaacttcggtatgaacttgtttgattcttagcatttgcatctatctttatgcttttatgtgatttgaggtatctatataagtgcaggtcggattgcacttggcaggatttgaagctgaaaatctaccgagcaatgatggaaagcttaaagaaggcaggacctaaaactgttgcagcgtctgtgaaatcttcgaaaaagaagagaaaatctcgaacttcactgcgggtctcttcatctagagtatcatcctcacctgatactccattggaaccagccaatgtggttgtggaaccacctaatgtggttgtggaggagaaacatagggagaccgttctagctcttcaaagcactagaaaaccgataatcacgttccagaaacgtgggagaaaagcttcactcccgaagaagattgattcgaaaccagaacccgaactgcctcctaaggagcctaaaattaagaatctatttgacctgaacaacgaacctgaagacaatggattggtaagtatgtatatgagtctttgtataactattgttctcctttgttaactatctgtttgcaactaatgtgtttatgcatcttaggacgaagctgaaggatcaacttttcaggaagtcgtaccaaaggagaaagatctttgtaaacctattttctctctctctgtcactctaaacatcaacgatactcctcctgatatcgttgagcctgagataagttcggatgacgacacagaggaatctgttgaacctattcagaacaagtgtgttgtgaatagagaaacaaaggaagttcctgttcaagtgaatcaaaacagtctccttattagctctgatagggatagagaggacaactctggtcagaaactgaagaccaatggtgctgctacctccagatcaaggaagaagaaaggtaagaaaccggtggaaaagagctattctttgagaccccgaataggcaggaggacggttaatccagcagctggtactactacaccagaagctccggtttccgtggaagaggagatgaaagttgaagaaggacgtaacaacaatccagtttggttttcactaaagccttccaagactcagtaaaactttttttctatcttcttttttcatgtctttaacttatgattctgtttatatttgaaggactcggtttcttcggttttcaggaacattgaaatgctacttccaccgatcaccgcttgctgcataagagtaaagtaagtactaattaaatttcaactataatctctgttgttgttgtagaatgtgtgatattgattctttgatttgtttttatgttcacagagatagcaacatgactgtctcatatctcaagaagtatctaatggtgaagctcggtctcgaaagcgaagaccaagtaaactaactcttctctctatctatgtctcactctctcttgtcttttaactctaatattttttgatgttcttttgcaggtggagatatggttaagggatgagccagtgtgttcgtcactgacactacataacttggtggattggtgggtccaaacaactccattgcctgagcgacaaagcgcgatggtcggaagctccgctgctgaattcatcatggatctctattacagcttcaaatctgacgcctctgactctggctctgcctctgaataattcttctcagaacttcaaactttactcttcttctaaactcatttcttgcagaataagtttcttttgaaagacttctagttttagcatctttctttatttaataattgctgagacctaaatatggaaaactctttatttatttgatttgcttgctttttgaggactcaaacggtatcgttttgtactaattaaatagaagctcattttagctagcttgagttatatttgataagatgcgccggttttgtgctctgtttggtttaaggtagggttaacgaaagatctgtatccaaacagtcttcttttttgcccgccatggataaacacagagccaggagcttagtgacgaactaaaggtgaaatttttattgaaagtttcaatttttatatggattggattacagaaacatttctatgtgaataaaccaaca

SEQ ID NO: 2729 - DNA, 3000 bp, Unknown
  misc_feature (1)..( 3000): cDNA_ID_2168390_gDNA_ID_1620582_Annot_ID_161192 3000 nt of promoter + ATG
attggcccggtccctacgttgcctttggaacagcttatgttatgattaatgcttcgacgaaaagacagtgaaacatatccagctaattagggttgctcttgtttggatcgtttaagccccacgaaatatgtactaaagcaaaaaaataaactcaaattcttgtgtggagatcctgaataatcggtgatttcgtgaatctaaacgagtcatgtcattatttcaaaccctagcgtttatattcgaattttggatctgagaaaggggattttggattcactcaaccttttaaggtttttgttttgtttgcgataaataactttgaaaacaacattttatcttctggacggttgatttgaagacatgatgattgaaacaaggctaaataagtaaaagtgagatgttacattaatagttaataaaaatcaatatatatatatatatatatatatatatatatatatgaaaaataaaaagagagaaaatggagataagatgatagggatgagtcgaaaaaggaacacacaaactttaataatttaaagagccaacttttttgagctacacacgaatgtgatttgcaaaagacacgactctttggagtgtagcttgtgtatgcatcacaagacaagttgtgtgtttcgacatatcattcctcttcctcatctttaacttactcgttttctttcaaacgtagcattatattattatttccatcatctttataataacatgttttttttttgttttgggtgcctatatgtgttttgaattcgttagaacattcaaattagtttaatgttttggaacgaaactatagtcatgtcaaacatactaaactacgttttacagatattaaattaaaattctcaaaaatattttaatgttttggtatgaaactataatcaagtaaaacatactatatttaaatttcaaaattgttcatatatgacatactttttttttttgaataaacgagaaattaaagtagaaaataattaacatttttaccatgataattaaaacacggttaatatttctaaccaaaaaaaattaagaatctattagctagttcatatagttattcacgtacctcttcaagatatgtacgttaaaattgtcatcagaatctgtagtccttgtagagtaaaaaatatcaaatattaacataaaagaacaaacaactgttgattcagtacataaattaatacattaaattgaccacagagaccaaaataatctaaaaatgatttatgtatttggcttaagttcaatattgttttttaggcaaaacttaatgttcaatatatattcatggaattaactccataataaacagtaactgaattctcttgtactttcttaaatggttttcagtaaaaaggtttagtttaaccaacaaataactttagcaatcatctatataagcataaagcatcacatagatctagtagttatgtttctataatacattttcactaagactaaaacatgcatgaacacacaaacaggaaaaaactattctcaagaagtttgtttcccaccatgttaagtgattctagaaatctgtaaatggttaacctttagtattcattcgtgcaatatttaacagacaaatggtattcattcgtgcatctctcagtttgtgagaaaatacattgcatgagttcgttattaactggaaataatacataaaactctgacaatcagaacctctaaattatttacttataagaagagaggcaacgtatcttgcatcgcttttacttatctaatcttttggtgatggaaggggcaagaacatagaaggaatctttatcttaaaagaagagaaaacaaataatatccaaaattggtaaatccattgaataaagcctaacgttaacatcaaatcgcatgcggattagaagctaaatgcacatagttaagcgtaatctatggggagaaattaattaccactttttggttcattcttttaagttttatgattcaatgaatacatagcacgtggaacctctctcccccacaacccattttgaagggaaatgaataattaaaagagacatacacataagaaagcacatggctttaccattcctctatcaattaccaacacatttgacccttatccacatgggtcttcgtctcctattataaaatcaaaatctacacacaaaatgttataacattttccaactcacaatatacaaaatgccacgcataaatatgtcttcgcaagacaaatatgtaacgtttaatattcgatattatctgagatttaaccataaaactaatatttctttattaatcaaattacatctacgagcaaaaatgataaaattcaacttatgcacattcaatagttcgtaacacataagagtacttggaaactctaaataatcttcattttggaatcaggattcaataaaatagtactttatttgacataagtgtccttttaaccattttttacaccatacgttttttcttctgaatcgaaatttttacatcatactttcaaaacatctattaatcttttaagttaaaaattaataaatcaatagaagtaaactaaaaataataatcaactttcacatcaaattttaagacaacacattatatttaaatatatattaagaatatctattatgcaacaaatggattaacaatcattagcacttgatattttctttataacctgcactatacactttcaaaaagagaagaagaaacctttaagaaacagtaaataaatgttattataatacacctctttagtctttactttatttatattttctctgtttgcttttattccgggtcggccgatagaattctcatcatttcattcatttttatattctttcgttataattattatacatcctttgaaagaaaaagaagaggcaatagagatggacggctaagatgttaacgtaaacaaagttggcggagggaaaagaggagcgtggaataattaaacaaaagagtcgtgtccacatg

SEQ ID NO: 2730 - DNA, 3000 bp, Unknown
  misc_feature (1)..( 3000): cDNA_ID_2168397_gDNA_ID_1620582_Annot_ID_161194 3000 nt of promoter + ATG
tcaagtagctaaaaattagacatacggaatattaaaaaatggttttggctcaatttttgtacaatgctcttagatttttcatggatttatggtcaagttttgtatgagtgataacaaaaagtcagatctaatgtagtgtataataatttttgctctataaaattgattataaattgaaattaatggtaagtcttgaaatagaatatttgaaagaaaccgacaagtctacgttaaatatcaaagttttgggggtgcaataattaagagcgttttggtgcagtctgttcgtaatcgtagtgacggttgggaactatgatattaatatggtgtctattttttgtttagttaatttagatttcaaatcaaacacttgattaatagaatgtcaagaactcataacactctaatcactaaaggcaaatatagctaaaaacatgtcaatcttgccggttgaaccggataaaaaatcagtggtgggctttcaattcataggattacggccactcgtgaaagaatatgacactaattcacgaaaagatgtttcgtctaattttatggtggttagaagaattccagatgttttcaataatgaggctttttcccataatcattgttttccccccaaatgacatataactcttttgtataaaaaatacgtaattttatgaaaggtacaattatctccttcgttagcaaaatccaagtttctacaatatgtgtatgtgcacgtgtaactacagtttgagttcataaaaccacgtcccacttactgtaaaacgttagcgactacactgctaattagtaggattagacaaattatatgttccctgtgttttaattttgatattcgtttcggttcgtttagcaaaatagaactaatcataaatatttaagtttcaaaagcctcgattcttaagaaaactacataatttcacatattttcactcgattggttgcgcatcaaatgtatatataaaacggatcacaatttttttttttgatcaaaacggatcacaaaattaagtgtaaaaatacaggaactttcctcagtctcgtcagccatgatgcaatggcccttgatttcatctgtaaaaattacaagtcttttcacattacaaagaagcattaagttcattttttatgttgggaagaagaaaatcgatgtcagtcttcactcagtgtcctcactaagaacatgtacctagaccaattaatagattctctgtttatataccacaaatgtctatgcttattaatgagtagtactattcttttatttttaattttttagtaagacacatttaataaccaagatgatacagagaaaacgggagaccgtaaacaattaaaataatatacgtgacttgtatagttgtattgcttgacacaaactaattagaatgttgaccaaatttggttaacggaatttcaccgcccaattccacttgctttatatgcgatgaacagttgaccagaggagacaaagtgtaacaaataggctattaacaaaacatagaagtaattaatacattcatagtttatatatagacatgttgtgagaacttattcttttcttctttaacaaacaatctgaattcgtttcatactatataagtattatatactacctagttatatgctagctttgtattgactcatagagtcatagtacaaatgctaaaatactaaagctacacagagtggtagaaccagctgaaatatgtttaaaactacatgacctaacccaaccattacaaatttataaacaaactacatcctgaaactccagaatagacgatgtagctcactatgaactataatgtatgtttaatgtcagaaccaaataaatttaaaaaaaatgtcagaaccgtacgagaagaacaaacaaaactttttgtagtttgtttgtatatatttctaagtaaaaatgctgaacacaattatacaaccaatatatgtgatctaatgtgctatttaggaaaatttgtcgatgataagtactacgtcagagtcaaaagacccatattggtttagtccgactattagatacgaaaagtcaagcaaacattacatgtaaattttggtaagatgtgagagatatatatgtctttttttttattttttgataacaaagatgatgctaaaatacttttagatccaaacaccaattatgagattcggaaaaactaatgttagaattcgaaccatgatggccaatattacatgaactcaagtggcaaattttttcactcttttactattggagcaagatgacttggttatgtaagagatatgttgctctcaatattctcatagatcatctctttcttcaaattggtaagatatgagaaatatgtcccatctttttattatcataccaaagtcttttataaaatatatcatatatgtatatatatatattgtcaagaataacttgacttcatacatactatttgaattcggatagtatcacaaaacatcactaccacgtaactgttggaacttcaattttacaaagtatttccggctaacttttcggcgagtttttcagtgaagtttgtcacaaaaataagaatgatcatatttttggaatctttgtaatcgttttcaaagttttctctccggattttcgcggttctacaataattacattacatatcatgatcaatatgtgacctgatcctcgtagttaattaaaacataatttcccggtcaccattcaaaactttctagatggaagattaacaaaacaaaattatcttagcttaattttgtagtaacagagaagaaatgattaactaacatctaatcaagcccacgtgtcataaaccccaccaatgaagaaaaaagagcaaaagacatgcacatgcaattacacgaatacatacaccccaccaccatcctccctccttatattattattgccccttcctctcctttcttcttcccctcttaccttttcagagagagaaacaatatttctaatctattacaagtaac

SEQ ID NO: 2731 - DNA, 3000 bp, Unknown
  misc_feature (1)..( 3000): cDNA_ID_3069456_gDNA_ID_1620583_Annot_ID_161211 3000 nt of promoter + ATG
aacaataattagatatgaaatcggatagtaaacaaaatacactatatatctcattgcagaataaattggggatttaaatcaaccaactttgaaaattggacatctaataggtattttttcccatgacttttgaaaaaacaacattttgaatagtcctaacgattttataaatttgagcttgtagttcaagtcacttgtgaaagccaacttagaggctgaaaaatgggcactagcggataacatgcctagctttgaggagtatatagaggttactggggtggggatcacagcaatgacgactttaatgggtgctatgatgtgtatgggaaagatagttccgaaggaagattataagtggctcaaatccagaccaaaaattatccaagctttagctatcaaaggtcgtctaatgaatgatatgaaaggttacaaggtacgaattcgcttaaatcatttcttcacatccggtttttgtctactatatttttgtccctataccttacaaacttacactgttacttacacatacatttatcaggaagatatgagtagaggatatgcggcgaatgcggtcacctgttatatgaaacaatatagagttacggaacaagaagctttaaaggagtttgaaaaaatggttgcggttgcaaataagacagtaaatgaagagtttttgacgacaatgggagtgtcacgcttggttcttaagctagcaatgggcgttggactcatgatctctatcacgtacagtgaagacgaaggatacacccatcccgaaggaaaaatcaaggagaagatgactacactgttcgttgatcagatccctctttgaagtcttgaaaaaatgttttggcaaccccatatatgttcaagcctttgttcttggtttcttttacaacaccatgtttttgctttctacggtctaattaattagatcagaccaccttaaattcacaagaagctgtgtatgttttctaattaatgtgggttagatcagaccaccttaaattaagatcctataatatttggtcaaaaacaagaagttaaaaagctatacacatgaaatcggttcaaatccttgcaatttaaatggtcttgtttctccctatatttctacgttttccctttattttggtttaactaccggcataaccttggtgatttataaagttttcaaaaataaaaagtagtttaggtaagattctttagaaaattaataactttatttttattacaatattcgttatttcataataaaaaagtgtacatgatttcatggataatatagaaaaatgggtttctgcgaaaagtggatttcatggataatgtggtctacaacaacagtccaatatcaggtttttattaatagataacctagaggcttgatagtaccggggagagattaaagacaaggaaatccgctatcttcttacatatttattctatgtacggaggtgcttattgcgaatattcgaaaagctgaacaacgaaaattgattactggtatgaaagtagatacggcaagctcctctgtaactcatttgttatttgcagatgatagtttattcttttgcaaagctagcaaagagcagtgtggagtaatcttggaaattttaaagcaatacgaagcggtttcaggacaacaaataaatttttcaaagtcctcgatacagtttggtcataaggtagatgattcacttaaggcagaaataaaatcaacagggaatcactaatcttggtggtatgggctcctgtcttggtttaccagaaagtctaggtggatctaaaacaaaaatgttctcttttgttagagatagattacaaaataggataaatggatggtcagctaagtttttatcgaaaggaggaaaagaggtgatgattaaattggtagctacggcattaccaacttatgttatgtcttgctttacactaccgaaaacaatcacatcgaagctcacgagtgcaatcccaaaattctggtggagttcaaatggtgaatctagaggtatgcattggatggcatgggataaggtgtgttatagtaaatcggaagggggtttgggttttcgtagtgtagacaattttaattcggctcttctagctaaacaattatggcgtttaatcacggttccaaattcactctttgcgcgggtttttaaaggacgttattttcggaaatccaaccctttgaataatataattcatactctccatcctatagatggagaaatatttgttcaggtagatctctagttaataaaggacttattaaaagagtaggttctggagaaagttatgtctagatctagttgttaacgatcccacaagtcacatatacaagtaacgagtaatatgacaaatatcaaaatgaggcaaataacgaagcaactatcaaaaatattatgatacttgacttggacttgcaagtaataaaattaaccgacttgttattcgacttgcctataacggatacttgaattttcaaggctagttattgtcaaaatctaaacagacattggttttactcgatttacaatctaaaccgaacaacaaaccacataagttctatatgaaaccaaattaaaacccgacttgacccactcgtaataatacgacccatagatgatcttccttgatatattaatcttcgtcttcacccaattcttccagcaaaagaaaaaaaaactttttgttgaaatttgatatcaaaattaccaaagcttatttctgctgcttcgctccctcgttcaataattttttcctaacaattctattttctggctaattaattgtctataaattctattaaatatttcaaataagctctacaaaattcgggttcagtttaaatccggttcggtttaattcagatttggttccgatttccgacatttcgatataacttcaaatccggtccggttttattgccagtgtcgtttgtagataagatacattcacaaagacaaaatcactcactcgctcaagagctcctccatg

SEQ ID NO: 2732 - DNA, 3000 bp, Unknown
  misc_feature (1)..( 3000): cDNA_ID_2168208_gDNA_ID_1620583_Annot_ID_161228 3000 nt of promoter + ATG
ttgtttaaacatgacctaccaaatttaaaaattgtttccgcaatataacatatctcatgttattttaaactgtttataaatattaatcatatcttaaacttttgattgattttaaatatatatatatatatatatatattatattatttaatcatttttaaaaattgaaacttaatatatccgataaaaattaaacttaatatagaacttttaaatttggatacttaataagtcaaaattctttttcattcatatttggattcattttaacttatttataatataattttgagtaattttttaaatattttagacgatatgagacattgaacacactttttatttaattgattgaaaattattgggtcatttctagggataaatcctattattcactttttcttaatctaactaaccagaatttgccacctaataaaaagagtatttttgcaaacttaattagaaaagtagtacatatactatttataatatgtaatatagtcatgatacgtttttttcgtgagagagagagatgtaagggagacagaaaaaacgtgcgagagagagaaagagtaggtcatagtttttttttgtttttgtttttctttcttattacatttcattccttaagattttaagaactaaaatacttgtttgtaaattttatttttttaaaattgatcatataaataaaaatctatgtttttttctctatcaattgatatgcattttgtttaataatttttaaattttattttactgtaattgtgaaactagagatataaatacaatctttacagcttaatctgtacagcgcaatcagtacgaagcaatctatgcggttgtatctatacagtgctgaaacaacccgacccattttttagaaaaaaaaatataattaaatattcccataaatatctaattaaaccgcaagtcaaaaatactattttatgaataaataaataattcgtccaacaaaaccaagaataactaacaatcctaaccgggttccaataatcaaaaacaccaaaaataaaacaaacgagttcctagatcatcctctcttccttgccatgattccacgatcacactttatctttacctgcatcaacaaaacaatgagatgcgtaagtattatcataaatatttagtgaggcgatcctcccatctacgagctatacacacaagcaaataaaaaggtataatcacgaatacaatacaaacaaaccagtcattgaacaattcacccaaaacacattcaccacacctacatatcatcacacaaaacaaatcacacaaccttatcgctcagataagttcatggtcacgcactcaccttaacaaaatgattctaatagcaattaaacccaggagagactctccttgcgtctgagacagtccagaaacgtcctgcaacaagtccacaaccaaaagcaaccttgaagcaaactggacaggaaaaaccagaaacaaaccgtctcaaagatgaaaccctaaaatacaacctaaccgttaactattcaatcgttccggtgaaatcctagctgcagacgtcacaaagctgcccaccaaatctcgtatcgatcggaaaacagacgagaccacgatctcagtttcaatctccgctggtcctaattcgcgtctgagaaaacgtatttcacgaaactgcgaataactcaaccaattttaatccaaatccaattctgtaaactggaggataacgataaaggacttgggaataattataccaaaattcgttacctttaaccacgatttgatatgacgaaactgatttctcccaaaccctaacgattctgctccttctccttttctctctttttctcctttataaaacgaaaagtggctaaccaaagccctaatttcgagtttccttcttttataggcacactctagggttttcaattaacccaaccaattaaaccggatgatttaaaaaacaaaccctaaccgattttccggttcacgggcgttacaagtgctatctgtacagcgttgtctgtacaaagctatatgtacagcgcaatcgtaaagaaaaacaaattttttagagagaaaacaaattaaataaaaacacataaccaataatacttggataatacataaaaagagttatacattcatcagtaatacttgtcactttgaaagaagtttaggtaatctgtacaatgctaatgtaaaatactaattcatataacaattaacacaatactataaatattagaattatatgtcggtttgagtttataaataaaactaatggttagctatatgaattatcaccaatcgcataactaaataatttaacaaagaaagttcatgtctgaccatatcaaccaaaacaaataatcatattgattcgagtagttgatggatctagggttactttctattaagaattcttcttggacatctttcacttaatgaattgtagttagattcgtgatatagctgctgatctaaatgggtaggagtggtattcgtgcaaacctattttcggaactaaggttacatatcagccttgcgtcataacgagcacacaccacttagttatagagctttgcaaacagaccaaattcgctttagttgttggtcgagatgcgatgttacatgcgttagttaagtaacgtatcatgcatgactttaaacattcagttttacgattacatgtgcacttgcagcttaactttgtgtaaatataaaggtgaaggactctcgacatcgatgaagtttctacaaaaatatatatatatatatatatatatatatatataagagaaattaagaaaacgtaagatagaaaaaaggaaaaaataaaaagaaagagacggtttgacagtcacggtaaaacattcaaagaagggttcaaaccggtctagaaaaatggttgacatctaaatctaaccacaagaaaaacagtgtgtcctagtcgtatccgtgcagatccaatctacatagtgaccaacttcggaagtgttggat

SEQ ID NO: 2733 - DNA, 3000 bp, Unknown
  misc_feature (1)..( 3000): cDNA_ID_2168212_gDNA_ID_1620583_Annot_ID_161229 3000 nt of promoter + ATG
ccagcaagtaaagatctcttaaccaaaaagttcattcgtctataatattgtcaaaatcttaaatgatgttatcaaataaatattattgtattttgatttattaaaagatgatatgtatatttttttagacataagagaatatcatgtttgttttaaaatagcattaaaaacgtggtacagtagattgcaaaattgaaatgatgaatcaatataattaaggtatgatatcatatattacattaaaaaatgaaaataaataaattcatgtatacttttagcaactaaattaatttgaaataaatataagcataataatagaaaacggtcacacaatcttgaaatttttaaatctacactagcaatttttataaatttattgaaggtttttttcattagaattttttagttgagaggtttttctattaaaaaataagttgaggattttaaaatggatcagtcaaaactttttgtcattaaaatcccaattaattgatgttctttatataccataggatcaaaacacaaatatactcctactgactatcattatttctagaaattttcaaaatttttataatcttttaaagaattgtatacaagagtgcctagcattaaatgatattggtcaaaactagctaaaagcaatcacgatatccacatttctatcagttaactgtaagtacgacacatgcccaacccagacgcactttagacatcaaatatatctataaaataatttagagatattattttccagactttctttctctcctaaagcatttatagtattttttttttatgaaaatattatttttttctataaatttggaagttcaacttcgaaaatttttatatctgtaagaagtaagatttatatcgggttaaattcatcttttgaaaaaaagatttccttcggtcaaactcaataattttattttataaaaaatatttagttgtaagttttatgatgggataagtattttttttttttgctttgggccggccttacgacaagtcgatcattgacgtatcactttttttttgttaaagtacattgacatatcactttcggaagagtttgccatatataagcagtgtcgaaattattagatgttttcatgacttggtagttgcctctagcgtgacaactgcctctagcgttgcctcaagcgtgacaactgccgtgacagtgacctcaacaattgctgacagtttctcaattctcgtagttatttcagttcgtgtttgaatattattattgaaatacgtaaacatagatggatccgtggaaggcatgcacatagatggatccgtggaaggcatgcaaatgtaatattgtaggctgcttacaataacgtagttcattatagtatcaataatatttacttgtatataaatatacagcagattagatagcaatatcgtaactatatgtctatataacaggtgagtattaaacgtgacaagtgttgttaaacttgttttcgacatgaaagtaaagtaaattttagaaacttgtgatttctttataatagagtaaccaaacatagctagtaaaatgatcgataccctaaaatgtatataatattgaaaaccattgaaacgaattaatgggcgaggtacactccatacatgagagataaacaaggccgtgaaaagaactaattactatagcttaagaaacccaaagttagtgtttcttattgtttgaacaattgtagaggaaggcttgcaagcattgcaaaatgataaagatgaaatagtttttaaatcaaatggcaagcaaagagaacttaacaccatcaaaagccgatggagatctcgctaaggaagaactaggtcattgccactcctatatcccggcactagcggacagaatctgttaactatatatagcatcgttagttataagccatgcgaaacttttacttaaccttatatttaaaggttttcaatcaaaataatcttgaaaaatacttgggtttatccctatgggtaaactcttatattcacttcttttattttaagcaattaaaatctgacacctaataataataaaaagaatttaatttaattataaaacctaataatttgccattaaaacgaaaatatgtatcggtttgtgtttattagaaaaggttagggttaaaattttatgattaaacgaggttaaatatcggtttgggtttagaaagtacgattagggtttagattttataattaaacgaattaaatattggtttaggtttataaacagatttagatttgacaattaaacgaggttaaatgtcggtttggatttagaaaatacgattagagtttagttttttttacgattaaatgagtttagatggtggtttgggtttacaaaagagaattagggtttagattttataattaaacgagattatatatcggtttggatttataattatagctttaatttattatgtaatttaaataggatttaacatgacatgtttttattggttaatgcaaaaggaggtgaataaaaggattcacccctaggagtgaacccaagtttcgttcaataacctttaaaatcgtcattttctacaattttacctttcatatctaaaagtaaaaattaattttatgaagtaaaaaaataataatacgtaatctaattgtttaaatatttttataagtttttaacgattatatacgttatactttcaaaattctaaaggtagatttaaactcttcattgtttattgtgaaagttttgttttgatataccaaaagtttcaaacgatcatgagtactatttatcaaacttttgcaaacttactgtgatgataacatgttatattgcatattattttgattttgtctcattgatttgtattttttagcagaaattgacaagttggcttttttttggcagaaaaccctatacttaatgatcatattattattttcatgcttttgtgctcttgtcgacaacagtatggttagctggagtttgattcgacaatg

SEQ ID NO: 2734 - DNA, 3000 bp, Unknown
  misc_feature (1)..( 3000): cDNA_ID_3069452_gDNA_ID_1620583_Annot_ID_161213 3000 nt of promoter + ATG
catctttgtgtatgattaagtcctaagtgctaacaagcaagagatcatccttaaggatccgctcaactcttttgatccttgaggatgatcacgaccgaatgctttgaggagaagagtggtttatttttgttgtattgacaaaaacttctacaataactttgttttgctttgacatttctcacaatttttatctgtctagattccaaaagcgatttttaagtgtccttgcacccactcaaattctgatgattttctatccacctaatgtggatttcactttaattctctttttctaattaaaataagctactgtattttttttccttagcttgaggacatttttaaagttttttattttgaaatcgtcactttctaaaatttatgatttgtagtttcaactaaaagcggatgacaaaagaaaattgtagttattttcccaatttttttgaatccatagttagttaattatttgggtaatattacaaaataatcaaaatttgaatcaaaataaagtaaataactattgtcagttttttatcggtaaatgaacatatgacgtcacaataaaagacaaaaatgtcccaacaagtcgaaccaaaaacaaacacttcagagaaaaaaacatagatgtgaaagattttaacaaaagtaacattttataacgtactttttgaaaattagcatgttatattaaaaataccatttcactttaaaaaaagtacaatgtgaaataaaataataacatgatatgtattataatagcgtgtcaaataaaaaacaaagctgattaatattaaaaagtaacatgaaatcttaagaaactattcattttcaaccgtcgattagtattgtaattaaaaagtgtgtaagactcaaagaatactattggatcaaatggttatgggcttcgtttacgagagagacgtgatgggttgagtcctttgttttagcaaagaaataagaaaaatttctaaaaatagcactaaaacaagttttatggacaataatagcacacattccatagacctctaaaaatagcattatttgacttactatgaagtttttgttctaaaagtattatcactaatttattttttcaataatatcacaatttttatataaaacctattaaaccaaaataaattagaaataaatttaaaatattatatttgggttctgtatttccaatttatggtatatatttcaaccatttaaaagaaattttgatcattttaatattactttatggcattatatttgggttccctatttctaatttaggatatatattttcactgtttaaaagagatttttcattttaatattagtttgtggtattatatttgagttctctatttccaatttagggtatatatttccactattttaaaaaaatgtgattcaatttaatattagtgtttgctctcatttttatttgggagattgacacaaatgacacttaaaaactttattatttaattaatttttagaagattaaaaactttatgtgctatttttgaaagtttaaaaaaaaagtgtcatttttggaataataaaatttttaatgtcatttgtgtcaatttcacaaaaattaaaaacttttataccaacatacaaacgaagtcattttgagtagacacctcatcatgcatgtgttagctgactcaacaacctattaattacacaaaatttcaaatcgaaaactatactatacagattgtatgagcataaaaatattaattcaagacgaagtcattaaaatatcgaaaactatactatacagattgtatgagcataaaaatattatatttttatcagaaagaattatctacagtaaaaacgtatatataatagtttttataatcatatatatgaaagttgaccaactctctccatatgattgatatatcatcactttaacatttgccatgtgtccactgaataattaatgtaagctcttcaacttttaatttctagattaatgatgtatttattatttaattttactaatacataatttattttgttattatatgttcttcaataaaattattttattggttttctcatattcgaagaattttttctgtaatcttaactcaaattatgagtgtatagtagtcatggattagttaatagtttgaatagtttgcatattgttatatatctatatagtaaatcgccaagggtgaagagtatgtaagaagtttaatcatcaaattcttaggtttcgagaatttcaatattaccttctatttaattagtttaagacgaacattgtttaggaattgtgtgtataatgcattgttgaaaatgttgttaggaaaaaatattttaatactaaaaataattacttattacataagtaaatgattatataattaaaaattatatttaaattaaacgatacaaaaaatttgaaaatatcccagcgtagcgcgggtgattacctagtttgtaataaataataattcaagacgttagaaaaagagaggataattcactgctcttctatacactatttgttcatatttaaattctttattcttttcatatcattggtagtttatatatatattatgtagttatttaatccttgtttgattgtttctatgtatcgaccaaaaaaatatacaaagttgaatcttaaaatattgttttcatattaatattctaaactttggtaaagttgtaagttataaaacaacttgaacataaaaataatgattgaaattaatgagagaacacaaaatagaaaaaaaaaggtcatgagaacagaacagaaacacttttgtggctttcgtgggctaaagacgtgcacgcagacacaaccctacacatctctccctctctcaccaactctttctctttacccactgcacctacccccaaacaatcccttttaacatctctcattcctctgctcatgattctttgtctcttcctctgatttctcaatcctctgttttctccgtctcctctgtttttttcacatcaatg

SEQ ID NO: 2735 - DNA, 3000 bp, Unknown
  misc_feature (1)..( 3000): cDNA_ID_2168193_gDNA_ID_1620583_Annot_ID_161223 3000 nt of promoter + ATG
tcatggtttttaaccgtgatataagcatttgtttgtagaatcttttctctcttttgtatcttttcgagtctttgtaggttcaggtacgctattggcggactttcgagtatttggagcattgtagctatgaagagcacctctggacgtatcagaggtgattttttctatcgacacccttgtggtgtcgttcgacacgcattgcgaacacaagtctcccacgtgttataacaagtcttgaagagttgtatatttgtcccaataaatctactatttgcattaaaaagtctccggaagtattttagactatatttaggatttttatggttattgtttagagctatgcattattttggagaaagattttgtacaaaacttggagagatgaatgagactttatcacagaagatccttaactcctttactctatctttgaatctcttgatgcaatttattcagattctgattcgtgtttcattgattatgtctgagtaatctacttgttaggtttatgaattttccaaggttttgaatgaatggttaaactgaacaacctgttatcttcaccaagatttgatttaattatttgttctagattgatcatccagaatattgcctatatgataattagttgatacgagagtgtaattgattcttcaaataatcttaggtaagaaaaataactaatcgcaaagagatatggtttaggaattttttgaacaatcaaacttgattgttaatgcttgtctagctaatctattaaattttcaaagaaatttggaattctagtttaggcataaattatttctgcaacgaaaattgattaattttacaatttaagtgtatggtctattaggtatattgttgcacatcggaagttgaataggatcttaagtggtatatataagatatgggcatctccacctatcgccaattgattttaggttggaagccaacaatctaatatgatatcagagcccgatccgcacatactcaacctaatccacatcggtcaggctcaatattaggcccgctgatccatgcccgaacatatcgagatcaatggctagaagaaccatcatctcgaaggggcgtattagagatattgtctcacatcggaagttgaataggatcttaagtagtatatataaatatgagcctctccacctatcgtcaatttgttttaggtttttagaaatgttgctctgataccatatagaggctgaatatttcttatatttgatagagtgtgaaactacacatatatatacagaagcgatgaagtaattagggtattagtaaaataattacatttaaaacccttatatatctaagtacagtataacctccataaattaatactcgataaattaataacctctataaattaataaattcttccggtcccgagttgggaccagtgtaaaaattgatacaaatcgataaattaataagataataactttttcgaaaatcttatataaatatatggtcccatcaatattataaattaataattatgtaaatttaccaatatatacatatatatatatatattaatattatatgtaaaatatttattgaaatatgattctagtattattttttcttcaatttctattaattatttgtagagtttaattctaatatttttattacgtcgaaaaaactttttattatttttgaaacttaataattgttttttccttgtaattagttttagaaaaaatgattaattataaagaaaaactacttttatatcaaagttttgtaaaaaaaatacaaaatttataaaatctctttataaattaataattattaatttatcgataaattaatacctctctaaattaataaattttttcggtcccaacattattaatttatagaggttttactgtattaacgtatacctttatatggtccttaattaaaacctatctgttgttttatttgcaactctgatttactgaaagaatttccttaagtctagcgccttcttccacagaaccaatttaattactttattattgtaattttaatattggaaatttttgtttagttttattcgaaagccaataatttgttgtatgaactatgtaaaatttgattcctaaatattacattcgatcttttttgattcctaaatattacattcgatcttttattcgagagaatatttcatagggataattaaaacccatatcatacatatagcgtcgtgacaactaccgtgacagtgacctcgacaattggtaacagtttgattctcataattagggtcaatgactatcaacccaattattattcttcaaacacgtaagcttagctggagccgtggaaggcacgcacaaaagatattgtagatgttgacaagaacgtatcagtacaaatcgtgccaagttttgttgaatttgttttcgacatgaaagtattgaaatttgagaaacttttgatataattctttcttttttaaccaaaaaagaaaaattttgatttcttttaaatagagtaaccaaatgtagctagtaaaatgatcgataaaattatgtaattttgtaaccaataaggaagaagcagatcatggccactcgcatatcccgtcaatagcggacataatatgttgacttgactatatagcatcgttaaacccatgtgaaacttctacttaaactatttatgcatttatacgatcatatttgtgggctcttgttttatagtaaaactatatattatagatgctgacaagtgacaacaatatataaggtttgctggacaaggatatggagtttaattattaagagcgtgaggaacgttgaattatatttaaatggtaaatgccaaaactcttggttatatttaacattatatatcctttgcaatccctcaagaaggatacattcaatttttggtggtcttttcaaaagtggaaatacaacaaaacaatgtcgggacttaggcaagtgtttcatctcttacaacttcattttttgtttggctatg

SEQ ID NO: 2736 - DNA, 3000 bp, Unknown
  misc_feature (1)..( 3000): cDNA_ID_3069492_gDNA_ID_1620584_Annot_ID_161253 3000 nt of promoter + ATG
caataggagtaagttgttgtttgatcacatctgagataaatgaaaaccctctttatgcagtttgctcttgaggaaactggtgacaattgggaaggaaaatgcatagcagagaaacaaactgagcgtcttgaactcaaattatcaaatgcggaagctaatcagattgatgagaaaaagaaaaaaaaaggtggtatattgagttcaatcacttgatctactatattctacctgtggtttttggcttgatgagtactataccagtctacctcttactagctaggcattatttttcaatcttttgtgtgtttcacacaggtagaatataagacagaattcctgtagatgtctatttggtagactctgcatcgagaaagagacgttatggctggtgattctgaaagggaacttgtctttgaagaagacaggaactaaagaatcattctagtatcattccctgctgctactgtatggatctcttttttatatacatttatttgcacagctttaagctaaacaacaatcaaagagtgaacataatatgtgtttagcatagctgtggttataagtaaattgtagagcttgtttagtcgcttctttatgcttgaagttttagacataacacttgttctctagacatatactgtaccagacatgttttgatcataaaacttaaaaagaaaaccgtgtttaaacgggcggcctaacgtggcactgaatgtaatgtaagattgtgctgaatgtatttatgacaattcaagagtacatgatgttttcttgtttaaattttacaggccaggcggcctatatatatatatatatatatcccatcggagaaaaccctaactggaaaaggaaacttgtagaaaaggtaaactgcaagcaagatttatgtttcacaaatgagattgtatttgttgctgtaagaacaaagggaactccgttgttgggaatgctcctcgtgtatagtcccactttaccattgaataatttgatcacatttccaagcttttggatcagccacatctaaggcttcaccttcacaaatagctaagatcaaacaaattgtaatcccctgaatttggaatgtaagtgtttctttacatgtagttttgaaaattatatagatattttttatgaggaaaacacttgcttttgtgtggtcacaaaggattgtttgtaccacttatatttaaatcagtaaggccaagttatatgtaatgtatgtctcctcgatcaataacacctccaaattgacattttttctttctttcttaaggtctttttaaaacaaggccataaatcatgatgattcgtactatttggtgtttggtattggacagattaaaaaaaactagaatcgacatttaataaatgcattcagcgtgatggtttggaaaattagaaagggatttgatgtgaagctcactggttttgacggaaggacctcctcattaaataaaacgaacaagacgtccataattatagggcggtgcaaaatgactcttctttacctgttatccaattcgtattcattcaataactgatttttttttgtttggtaagaaacattcaataaatgtctgaagttatttatggattttgatcattttgagtccgataacgaatactatcatactagatgacgtcaatagaaaaacgaatatgaatacatatattatataacaaaaacaaaaaccaacaattccaatgaaacctaatccttcaaaccaagttttcgtttttttaaattacgtcttggatatgaagtatctggattttagaatttaattttctcaacctcttttttttttttgatcagcatatctcaaccatttaattaatttcagaaatttggatacaaatatttgaaaattttgggaaattgacatatgcaccatttaaagggttcggatacgaataattaattatttgatctaactacgcaagtaaaattgagcaacatttaatttcaatctgaaaaagctagaggatattcattcaattaggtctcatactctcatctttgaataataagctcactactatactatataagtaaggtaaggaaacatatttagaaaattcgttatcatatatggaataatcagaagaagaacctaaattaaaaaaaaaattacaagaagaaaaagagaaatcattgacgaagaagactgtaaccaggataaaaacaaatgtgccgatcagatctccaatcatcacgcgtctgttaataatctgaatagtcaacgctaaaagatgtcttgagtctgtctgaccagtgaagtaaactactactacttgtcaataagaggcggcaagcacatcggacggtccttgttttccctgttaattataaacggtcaccatctctttagacataatatatactactagtagtggagtgtttttgttaattaaagtgattaaacaccaattctaggtgttaaccaaaagataaaacgatacagtaaatatattcttgtgaattctatagtatcataatattattccttttttatttcacttttgataactataaaatctttggcaaactaaaatatcattagattattcctttttaaatagctaaggtataatttctgatttagctttgctatcacaatgttcaatttgtctaaagatccgttacctctctatgcgagagaagctgtgagagagtttccgacaagtaactaggagatcgtaattcttgtctgaaaaacaactttttttattcgaaacttctctcacagatttttctcagtttttccagaaattttgttcttcttcgtccactcaccgtggatctctctagtttgttgaagaaatcaaattgtggaataaataaaaaaacagagaaataaatactgcaaggaaagtttcttacttcgtcactttgacccagaaagctttcagattttcccggaaaagaaatctgctggagaaatttcattgactgacttatggatttgtgaagaagcttgaaggcgaatcgaagag

SEQ ID NO: 2737 - DNA, 3000 bp, Unknown
  misc_feature (1)..( 3000): cDNA_ID_2168290_gDNA_ID_1620584_Annot_ID_161256 3000 nt of promoter + ATG
aaggcactaattaaccaagacattaaccaatgagaaccaaatacaaaaccaaaggaatcgaataatacgcttcagcaaatcatccaccattaaactcaccgtggagcgaaataggacgatgatcctttccccaaccgacgccgcgagtggaatcgagatactgctgaacaagatgacgacatttctgatagtgattgactccttcgacgcggtaacaccatttgaccttctcacgcaagatcttagccttctcgatttggatccatttctctcgaacgatgtgctctctcatttcaaccatcgccaccggatccttgtatggattttccggatcaaagccatccggcgccgactcttcgaactccggtaatcccttctttctccccattgcttcttcttcttcttcactcgtcgtcttcgtgattatctgagttaggggacctttctcttcatgttaacaaataattgtgggcctattctctggatctaatgtatgggcctaaatctagcataacgtactcgtactctgtggcctttttatgagtgagtgatttttgagtttttttttaattcttactcacagttttattgttacattcagacaattttagacatctaattttattgttatggacgagttcattatattagctatctagctagctaacactaacaaatttttgacaaaagtaaggatttttcatgatatttataaaaactgtagatgagatatgttcattttggttgaaaatataattacattacatatattatttgaattttatatttaatagaataaataaaaaaatgtcttagcaaatcgtaagtttaaatattttcactaataaatgttatttgcttgtttttcttgtctacgtacgtaaaaagactatttatttacgtagataatgacaaaacatttgacctagcacacaaactttcaaggattacggaaaatctacattagaaaagaaaaatctaacgtgtagacaaatttgtagattatgtggactccaatcttacgattttatatcaattataaggtgatatttcctggtgtcacttcaactcgattatcatattttaattttttaatgtttattaagttagtgtaaataatataccagttgcaggttatgactgattcaagtagctattatataattgcatatataacactgattcaaataaaactgataatttcaaccatttaactgaaaaacttgacaaatgaaacaaaagaaagtacattgttaattagaatcttgaaactcataagctacacagtaaaaaaaaaaaagtaattattcaatccattatccatattgatttttggtaggaaattctctattagtgcattcatataaaaaaaaatattaacatgtggtgtgattctagaaagcctagaaacaaggacgagaaaagtatggagatgaattgaattaattgttaaagttttctaatggtaggattgacaatctagttacatgcatatatgacgacccaacatatccatgtataaaaattctcccaataactctgcctgctactgaacatatataatacacacattccattaggttggtgggatttattaaccactcttccagagtaattattttaaccttgtatatatgaagaattaaaatgactaagactcatttaggctgttttattcaaccagaaaatccaatgtgaacaaatttgagcttctagaattggttaaaacttaaaaacacaatcttaaggaaaacatatactagactaaactttttctccgtcctaagcatcccatctttttggtgttctctacaactattagaaattgagtttatttggggaaaaagcttttgaaggtagacaatttaccgagagggccaaatacagtatgtgattttcgttgattattttctgtgatagaaaaatatatgatttgtgtcattttatttatctacgtatcaagaaataactgggtccaccaaatcaatatattggttcacacccgataatcgaggaaacatttgcacgaaacattttaacgtagaatatgagttatacaattcgagttacgtataagagtcgcaacgcaatctgatctcagaaaacccaattcgagcgtataattataatataaacatattttcgttttgaacattgcatgtgttttttttttgtatggatgtatatggtagtgagataagcccaaaagacaagtgtcaatagagtaagatggatgcaaatatgcaatatgtgtcaatagagcaagagggatattatgcaataataaaacgattcctttataatcgcagatagatatataacagttatgaatttggacgactagtcaagattatagaattttgatataatttaaaaaaaaacaagaaaaaaagaagaagctgaaatgaccattgagaagccatgcatgcatgttcacattacattggacattagggtttcatggtgggtagaatttggtgaagttggttggacaaatctcacataaatccatattatgtttctataattatatttatgcagatattaagacggacgctagttttataaacatagtaatgtaatctaaaaggaacattaatatatacgccgacaaatattttattacacactaccgataatataaggtcatatttacatacacatatgttttataaaagaaaaaaatagggtacgtatgcgtagagaaataccttgaatcgtcaaaatgttagctgtaattatcaacagttgaaaaagactacccgtggccgcttctacctcaagatcggtatttggtacacaaatcattatttattttaatatatagtttagttatataagtgaatatataaaccccatctatgtcacattaattattgaaaagcttttaagcagttaatctccttcgtcctcttcaagagagagagagagcgaggagaaacccttcttcttcttcttttgttgtcttgaatttagatttgtaagagacaacaaaaaatg

SEQ ID NO: 2738 - DNA, 3000 bp, Unknown
  misc_feature (1)..( 3000): cDNA_ID_2168302_gDNA_ID_1620584_Annot_ID_161261 3000 nt of promoter + ATG
tttggagaatttcctcgaacatctggcgtgcgttttcgggacgacccatttcgcctaacagcctcgccattaagaacttccactctgtttcttctggttgtgcagctactagtctctctaatagcttaagagcttcttcatcttctcccttctctagcttctgctgcaggagtgatctcagcgtctcgacggcctcaggagtggaatccaaaagctcagataatggcgtgatctcagacagtttctcttctttcacttcctcgtaggtcttttcgatagtcgtaaccggagactcggctttaaccggtaaagttgaaaactttccggtcattgaaacagcagcaccgatgagaatcgctgatttggcaaaagatttaaacttttctggaaaacaataaccagaactattctgattcgagctagctctgatacgaatagaaagaagatcgcgacggggaatcagaggtccggtgaccggagtcgctttaacggcgacgaaagaagaaaccaatgaagaagaagctgagagagacgaaatcatgtcttcctcagagcttcagagagagtatcaaaggttgcagaagcacaatcaaaatcaaaagagatgatgaacaaacaaagcactaagccatggcgatatatcagacacgcgtagcttgtgtgaagtatatttgggcttggtttttatattatgggcctttaaataattgggtctttggccttttagttttcttaaggcagatctccggcgaaactttagactgagatacggaagaatcagatcaacgcatgcgaccaagtaaatcaaaatcgggttgaagaagaaagagataagctttcacatcagtaagttgataaattcatgttttggttttgaaatcagtatcatcttctctgaatcaactgtttatccgtattaatcattaaatttcctgagttagggatttcatcgataattaaatgggttgtgatgattcatcagatttttgaaggcgcgaaatggggaatacttcatcgatgctgactcagtacgacatcgaagaagttcagagtcattgtcatgatctatgtgagattttccgacaacttgtctctgtctttttttctatctgtttcaaattttaatgcttttgttttgtgtgtgttttgtttcagttgagcagcaggagattttatctctgtatcaacggttttgccagttagatcgaaacgcaaaaggatttatatctgctgatgagtttctctctgtgcctgagtttgcgatgaatccactctctcaggttttttacaatttctttaatcttaaatctatgcaatcttgttgaattgaattagctttgtattgattgtttgctggatattgataacagaggctgcttaagatggttgatggtttgaactttaaggattttgttgctttcttgtctgcgtttagtgccaaggctagtctaagacagaaagttcaatgtaagtaaatgagtttcctttaaatcgattttttagtggcaaatgttcactttcactttattgtatggaatgatgatcagacttctttgtttctcagtgatctttaaagtctatgattcggactgcaacgggaaggtctcttttaaagatatcatggaagtgttgcgtgacttatcgggatcattcatgtctgatgagcaaagagaggtatgatttatagaaagttggtgacttttaagtttttgaaaagtgattatggacatgttaacaactaactaaataatgaaacatcattaaactactaaaaccaacatatcggtgtgtaatgattgttgtgtgaaaattctattcaactaaaatgtttctgatattcgatcatctaactgttttggtgtgccattactcatctgacacattgttcaaactttgagataaatgctagagtttttccttttgttcttcccatgtgctccactcttatcatattggatgaaatctttgctttaacctctatggttatgatcatgagaagtgtataaagtcggtaaacaaatgaattcaccatgtgtcttgtgttttacttttgtggtatagcaagtactgagccaggttttgaaggaatcgggctacacgagtgactcattcttaactctggaggatttcataaaggtacaatttgtgcttattgtaattgttatcatcaaaattgcagtatttaacttgtcacattcctagaatctgaaactgcatctcctttcttgtttcttcaatctcacagatctttgggagtagtagaccggagatggacgttgaaattcctgtggattagactttatgatcatatatcatcaaacacaacactcaaatctcatcttgtattttgtccacactgtttctagaataatccttgttaattgatcacatcattgcaggctttttcagcacttgttaagtatttgtcaattgaaacttgttctactaaaggaaattacaattgtttcctctgcttagctttttgcattaccaataatggcatatgatagactttaaatcctaatctcaaaaagaattttttttttttctgtgaagaaaaagaaaaagaaaaagtggaatggaatgaataatcacgaaatctccgttttttaatttaaagttgattgtatttaatgaattgtcaaagaagagtcttaattacttgcatattattaaactatgggttaaagaaacaaaaatactaattatggtaattagattgacaaatggtatgtagacaagaagcttattaatgtgacgtaacgtaattaaagtaaagtaagcattcaattctacttaatattgtccacacaagtcattatataaaataaaaaaggaattaaaacgtcgtcattttgcttcataatagaccactttattcacctaactaaggtccaccaccacttcataacagtttcgtttcgcgtcagtcaaataaaaaatatcttcaccattcttttttcaaacaaagcttaattctctttgagaatccgtctagta

SEQ ID NO: 2739 - DNA, 3000 bp, Unknown
  misc_feature (1)..( 3000): cDNA_ID_2168328_gDNA_ID_1620584_Annot_ID_161269 3000 nt of promoter + ATG
ctgagtccgacgtagtagaaagtgtcgatctttttgttacgtagaagcggcgccgtcgcgtctccgccaccgagttggaccgagttgaaatcaagacttgaggactttcccgagtcacggtcaacgaggcagtaagaaaacgacgtcgctttcatttgattggttatcgataaaacaccaccgcctaaaccgagtaaaccggctgctccggtaaagagaccttcgttgtcgtgaccacaacccaaagcgacgttgtttattttaccagagttaccaaacgtcaccgtatcggtagcgagttcaccgacggtgaaagatccgtctccgtaactaacttggtagagacatttgtttgaccgacaagcggaggtttcgagaagagagcactgtggagcagagcaagtgagagatttgtatgtggaagacgaagtcgggttaaaaaccgggtcggactgttggtaacagtcggcgcaaggttcacactggatccaatttacgtcgcttccggtgtcgagaaccaagtacatctctttcgccggagttccgacaccgattcttgagaaatactcgccgcttccttgagaggctccggagacgacaggtgtcgttagatcctcggtttggtatcgtgtatcttcgttgtaaacgggtttgagatcggatctatcgactccttcgacggcgaaacggatcttcgcgacgattccggcgactcgggatgagtcgcgctcgagtcgactgagtgttaagcttttgtagtctttgtgctgtgacgcgacgaaagtgtctcgagagtgaagctctagagatagtggtgaagatgaattgaagaaaaccgggtcggatagggattcgggtttggtggtggtgagtgaggaacgagtcgggtcgagtgagaggatagtttgtgtttgctggagagatgaaacgacgtcgagtacgttcgttttaggtggagtggatagagagcgagaggaagcatcagtggtggtgaggaaaagagagagagtgacgacggcgaggagagaaagaaatcgcgggaaagccattatttccggcgaaggttgatatgagttaagtggaagagagaaagagtaagtaatgtttttaatttatagagagaaaaataaatgctgcggagagagtcacgccagaattgctgcggttataaaagccacatcaattatttatcatcctgttaaaatatttggattcacattatcatcgatcggtaaaaaaactttatggttggatattatattttatatatacaaaaataaattaaataagaagtcttaatctggatttatcatatgattcccaacatagcgttacatttataccgaatcaaataaaaatttagacaaatgtaatttgagaattgtgtttatttgttattggcaccgaaagaagaatttgtactttgtagaattcaacacaaaactatagcatagtgtctgtagtctgtacggacgagagtagaaactgtagaagatagggatttgacctactaaatattttaatacaagtctacaagcgattatccaatattaagctcctagagatgtgtgactacagagtacttaagtgtttatttattgcaatgacctttggatacaaagtactcctatattgttaaccaattcacttttaattttttttacgtgaccaaagctaagatcttatctagaaaactaaaagctttctgtccttttgttatattcgggcttcaaaactttgtaccttcttcttaccatcgctgtcgagagaaaagtcagcagaagttttggaaactattagttatagggatcgaattatcttaatcatctacgatcatgtcattttgtgttggatatttgttaatgcttgtacatttctaaaaaaacatgtgttgtatattagctaatgtcaatatgtggtgcatatttgctaagttgccgtggaaataacaaaaacttaaaattttgctaagtactgtacttttttttttttgtgattgcaatttgcttaaggtgattgatgaacgaaggctatatgtaaaaactggaaaggagtgaatcaatgtgagaagtgggtgagttgttacttcgttagaagagagatttgggtttatttcgctttccctgaattaatggtaacgcacccttttggctttggttgttgcgtgtcatttatttctcttttgtttttaatcttgttatatccattttcttatacctactttactttttttccataaaatgagattatgcaattcaatcagtaatgttttaaatcgcatacacttttatatttaacaatatgccttcactaatttgtatttcaagattagttagtgatattttatagtaaagtttaaagaacattataatgtagacgcaatcatagagtttttctttgtcaaaggcaatattgcaacaaaaaaaaaggtagaaacgaagacatttttttttttgtgtgtgtaatcagtaatcgccttacacaaaaagacatatacttttttgtgtaaggttttttttttttgagctactatcactaaatttgaaatcaaataattgatactccaataaaagtagaaataatatcatagtatatgaaaaaacaaaaaaaaattacaaggacgatgaaagaaaaaacaaaatctcataactcaaaatcaaatatcatctccaagttcttaacatgataaaactagactaaaataaaaactgacatcctactaaaattagaaacaaaatgacataaattgaaatcaaactcacaaaaaaaaacaatagacattaaaacaaaaaatccgaataacaaaaaacaggatctcagctaaacaaggcctggtgtagtatactagtattggcccatggcccatggtttggtatttttttttctctgaccaaaggaagaaaaaaaaaaagatatttatccgtatggcgccaagaggtttgtgtggttttcgatttcatccaaatttctgaatttcgtctctaacatccacaaaatcga

SEQ ID NO: 2740 - DNA, 3000 bp, Unknown
  misc_feature (1)..( 3000): cDNA_ID_2168317_gDNA_ID_1620584_Annot_ID_161265 3000 nt of promoter + ATG
tcggctgactacctggtcgacccatatatatatagtattaatttcccggctagatttttgcaacacaaaacgtttgcttcttcgtttggtctttaagttttttgttataacgaatagctcttatcgttttttttgtgaaagttatggatgaaggttaggtttatataaactaaggtttgaattagtttaaactttcttgagatgctctacttttcttcgcatagttatttccatcttgtatataattaactaaattcatttgtatagttactactttgaaacactattccccaaaaattgtttggctgtcaccgttcttaaaaaaaaaacaaaaacaattgcgtatattgtaatcaaaatagttgaaatccgatatcataagtgattataatggaaattaaagtgtatatacacagattcagatgatcgattactgaatgtgggcataaccaaaaatatgattaatatacatatagtgactgcaaaatatgtgtgaatgagtgtgtacaacttaaacttcaaaacctttttgatatcacaaaacttgaaatggattaaatctttatatcatgtaaaatttgttttgggatattactggcttctatattgcttatatttgtggttaaccagctggtggtatttctaaatatatattctatatgtggaaacaaaaaataaaactgcaactaagttttgaaaattattgatgtaatgataaatgataatggtaaacatgatttatgcactaatgggtattgtttaatttgcttggtcaaaactcagaactcgaatgaccttgacttgtgcaattagttgacgtttttaggtacagattatttttgtaccaaagccagacaccaaatatatcgaataagggaaaaaataagccctcttggatgaaaaaatacgatcttccaattcttttattttcacatatcaaaataaacaatattgataaaatctgaaaaagaatttaaaataatatgctagctcaatataaaactacacttaaaagtgctgttttcgtgaaccacttatttaattcaaatcatattgcaaatcagaaatcttcttaatcaacccatcatctgctgactcataggaggagccatcgtccgttgcatatttccactccaccctatcacataaaaataataaagttacatcaaataattaatcaaacgtatgaaagacactaattatttcaatagaaagtgagtccacaaaacaatgcaatttaccaatagaggggtcaagaccacgggttttgagttcacggtgttcttggcaaagagcacaacattcacaaaagaagtgagtgacgcaatccgaagttggagactccggtaacccgaatttgcttcggatcttggtccggtaagtgcatgagaacaagcaaggtaagccgaccacacaacatattagcccgtaaaataccccacatctcccacaacctacgtacattatatatacgacgttacgtgaattcacacacacacacattgtttagatatgacatatgtgaatgtatggcttaccggtccttccttcgtcggaaatgtccgcgatccgtccgaaagtgacgcatgggcagaaacatgtgaggcaagcttatccagcacaaaccaaaaggaacaaatcattatacaatcctgacaatagatctatatatgtataaagattaaaggacaacttgattaaatttatatagaatttctaccagtttcactgtcttccatgcagctgaaaagaccagaagtccattgcttttccattgtaaagtagcttcaaccaaatcttgcgtcaggttttaaccagttttgtgttgatcgatcttttgataagcgagatcgtaaatcaattaattagggttttgaagatagatttttgttgttagatgctttaagaatggagggtgggtgggtatatatatggttgatggtggatcgcttcgagagatctacaaatgtttaatttttagtacattgcactttgggaaaaatcataaaagttgtaaaaaagagtaaaagacttttaaaactagtacgttgcactttttgttaaaaggaggaaggttttttgaaaattgatttttgtttaaggaaggtgagagattttactgattgtgagagattttaagctacttaaaagtaatatgtaaacgcgtttttgggattggtttaatccacacatatatacaagatacaaagaatttaatttaatgactaagaaaattaaagaaattatgaataaaaaagaaatatacatcctaaaaatgcgaaagtaaaataaaacaggctatgctaaattttaaaatattaaattcaacatttttctattcataaaatttctattaaaattatttgtagataagagataatatgttcaaacattattcctctatataaggaatcaaacttgcaaactttaaaataaaattttgaaaaatatatctaatgtaatattctggttttattagtaaagtaatattacttaatactaacaaattacaaagaaaagaactgaaggaaaaaaaataaacttttaaaattttctaaccagtgaaataaattagaatttaaacttaaaattttattaattaataatagtcataacaaaatttgacaaatgttttcaacttagatgtgcaataaacatgaatttattctactaaatcaatactgggcctatgaatggcgcaaggaatagcccattggttattctatatcttttggaccttacgtttttgaagcctgtttaggatcacactcataacaaaaaaataaataagaattacgcttctaccaccattaaactctaatgtatctgaactcagaagatccgatcggagtagtaaaaattcaacaaaacaacaataagaaaactcattaattcattcgtcggattcgaagaagaaatcacttcccagaaactttcttcgtatcgaagtattgcttgtgttcttcggagaaacgagatcgggatccgaatacgagtaca

SEQ ID NO: 2741 - DNA, 3000 bp, Unknown
  misc_feature (1)..( 3000): cDNA_ID_3069488_gDNA_ID_1620584_Annot_ID_161255 3000 nt of promoter + ATG
ctaggctgatcagtcatttacagaagcaaaatagttcttttgacctcaagtgttatctagtctcctcagcacagtgagatatttttcagattaataattggttaatttctcatccccacaaatgttgtaaagctaaatgactcgaggtaagattcctaacttgtaaacttaagccttgaaaagaataaatccacatgattcgagcatgtttgttcaaaagagtaaaaaaccggtgaccatcaacagatgatgaataaaccggactaaaccataaatattccatcatacatgaaggatcaagtaacatggcatgatacagctttagatgactaattcattgtgtgagagtacaatgcatatgatcccaagttaacctctactagtaactgtgaaaaatggctgttacaaacggggatagaaattacatggcctaggctgaaccagcgggaacagtagctgcattggagctaggctgaaccaaagtggctggagtggcactcaggctcggatcttttgactcgggtgcaacaatgggaactgtagctccgggtagtgacagaggggtttttgcagccgcatctagagcgggtatctgatgctgatttgagttagccaaatcgtttacggcgttgtgaagttgttgtagcctgtaatctgtctcgggccgccgacaaatcttcctcaagggaacgatttcctgctgggataacggaaaagaaatccaaaataggtgagtgaggagggttttgctttatggtctaaaccatgaaatggagctgacgggtaaataaaaccgcaagggatagagagagagagagagagatgatcgtccaacctcggactggtcgtggctgtaacgcaccaagaacctacaacgacaacctctgacatcatgtcttcttctctgtgcgtcaagaacaatggcgtcaaagtaaagagcttgatcttttccttcctgaagatgttataacatagttctagtcagggataaactaacatgacacctatcactaaatgcttagagagcgaagttctaaacctggaaacaaaggacgagatctccagcaagaactgcaacacattctgatgcttcacatgggagagaccgttgtcttacatgctttttgacatttatccattcatcttcttcaacttcgaaacccgcaaatcgaacctgcacttcctgaaatacccaacagaaagattgttgttagcaaaacaaaaaaggggaacaaataagtcaacaagaggttggttaggaattaccggatcaccaatctccaagtttctatgagctaggaaagcttgcacatcatacctgtaagtaagcaagagagttacatatcagagaaaaccagtggaatgtaatgatattgttacaaagtatcataagtcagcaaaaaaaatactgaagattgaatgcaagggaatcaccatgcaccatccctggcagatttggcttcaaattccaagtaagagttgtctgaaccactcctcatgacaccgggaactatgaggaaaagcagtaaacagttacgaaaatggcatctgtgcaatatcagccatactgatctagacttatggagaaaaaactaaaactgaaaaaaccaatgaaacctattccaataaataaccttctcaacctattttactgagagtagaataaataaagcacctaaactaccagaaggggcaggcgtcatgccgggtaaatttccagtcatatgagtggttttaggaactgataatggttgaatcacacttctcatctgatttggtaaatccatacgcggcatggaagatacatttagcttcccaggagctttgtttccccttgctcgtaaagcatatcgcctattttgaaaccagttccagatctgtgatgcattaaaacaacattcccattaacttttaaaagcaaacccaacagactctgtctgataaaacttaagaatcaagaaggaaaaagccagtacttgcttgaactgcacaacaactttccccttccgctcaggtgattcactgagacaacagataacaaaaagtaaccacattttagatgataaagacacaaaatcactttcaggccaaggaattgagcaacaacaagtaaaatacctaaacttatcagcaagagcttcaagaatatgtcgacctggcattgctgtattatgctgtagcaaaattgcttccatctccgttaccttcataacaattgaagattagctataacaaacaagataaaacctcttcaaaagaagtcacaaaaccatagaacaacagatagatagaaaaacttatgtattatcaaatctaaactcttaaacattacttaataaagtaaagccaatggatttcagaacatacatcgaattgtcttcaagtttctactagctaattacaaaaattcaattggacttcaggatctaaaccctatcatgaacccaaaaagaagacctaaatcctaaggaacaaaaccgacacaaaaatcagatttttcagctctgggagctcaaaatccgtgaaagcaacacattacaaagaatcgagataaacctcaggcaggataaatcgaaacgccggaccgccattactgggaggtcgacccatggtatcttcttcgtctcaccgaagaaaaaacaaaaattggcggcagaaagtgaaatcaatcggagcttctctcacttaatattcgaattcacggtgaatctctctagtacggccggtgacccaacgacaacgaaaccggttttactcagacccgactccgtcgcttatataacttttcacctgtgtaatttttttaaacttaacatgtagtaatgggcttttaaaacccattaaaggcccattttcctaaaaccgatacaaaaatcttatccgtatggtcgagtaaatccagcttatccgcctgaaacttatttctcagtatccaaaacgatggcgaagaagacacttcgctgaagcttttttttccaaaaaaatttcttagtgtcgtca

SEQ ID NO: 2742 - DNA, 3000 bp, Unknown
  misc_feature (1)..( 3000): cDNA_ID_2168447_gDNA_ID_1620585_Annot_ID_161282 3000 nt of promoter + ATG
gtggactatgttctgacatttgggttgtactaaagtagagtggataataaactaatcaaacagaaattaactgaaaacaagtgtacagtatatgacatattattggaaataaagaacaaaattactgtaattttttttataatatgcccatcataattgaattattttggctgactttagtgaaacaaaaacaaaactggaaagaacattaaaatattaaaaaatattaggtaaacgaatttgcgtgtagaagttgttttgattgataataaatagaaatctctatcattatatttataagttacaacaaagagatctaaaccaaactctaaactagtttttttggagcttaccaaaaaaaaaaaactagtttttttggacataaaagaactaggtatttttgctatttaaagcattcacaactaccaccaataatgattaatctcattgtaggaacactcgaatctttaattttcacgataaatcttttaaccattgaatctctatgaatttgttaagaaaataatataattaagactttgagaggactcgatctaaatctaagagtaaacctagaaacttgtataaaaatggatattcttaccatttaaatgttaaagcatccttagtgacagtgtccagctatgatttaaattgtaatgaagaaacttagaaaccttaatccctcaagtatcatggtaaacaaaacattttaataaactaaaccttttattttgttattattgcagtatttttaacctaaagaaatgggattataatgaagaaagattccccactcgcgtttcacgtcacaagccgatcgtgtagcaattgtcgttattggatctgagcttctcgattaaaaattgacgcagtaattggatctaataagagcatgaggttaaaatatgaattatttgagatatgaggaaatgaacaaattatacccacttgtgttcttttatgttgaacaatcttctggtttgtcaactacctgttgaaccatttctaaaaaaacattgtttctgttcgatttaaatgtgggggaaaaaaaataaaatacatgaaatataatcttagaatctaaggaaacttattattgggcaataaataagaatttgctgaaaagttttaggggcatcttttggaactctcaagtttcaaacaatggtgagtctaattttaaataattgtttggtgtgtttagtaaaaaaataaaataaaattaatacacatgaccaatttacgtatttgttattagggaaattttttaaaggtttatacaattttggaatgtttagttatttttaaaaacttaaaagatttttttttattgattttggtaaatgacaaaaactttcactaaaaatttgaaaacagaatgtttgacggatgctaacaagcttttagaaagtattatttcgaccataaaattggatgaacactggatgtaaatggaattgataacaaaagaaatcgagatataaaatatctattgttatgtcttcattcagcttataagatttatcatctattggcaatccgaaaagatgcaaaactctttgtgatatggtatgcgctaatgttcatttaatgcctcaagtttcacccattagaacacaagaagaaacttccgaagatgctgcatgatgacgaaaacatacgcttaggacgatgttttccaaaccgcataaataaaacagaaaattatagtttggtggcacgcatatgggattgtccttctaacaaaaatgtgcattcacaatagttcttacttagaattgctaaactgaaaaactcgtgtgaaaacttaagctaaatatgtaaaatccataaatttatgcatagaggtaaacatcaattttttttatcatcaagtaaaaggcacatgacagattcatgagaatagatgaaagataagaatgttgaattttaataatttaaattgatgtgtttaataatttaaagaatcaaaaaggaatttttttggtaaatatatataaaaatttctatagacaattatttagaaaatcaaaatataaagtaaacatgtaggaaatatacaataacatgtatcaataaaaatttggttgccctaaaaagcctaaaattattaacagctcgcgagagcattcttgatgtaaacatatgtcttccattttggagaaaacaaaaaaaaatacattgaaataattgaaattccctcaaaataaaaaaaataaaaaaaagtattcaactttttatttgaccctctctctcctcttccctcttttcatggtagacccaattctctctctctcttaacaacactctctcctctctctccctctctctatctatccccatttccatggaagcaagcagatgtgttcttacatctctttctctctctacagccttacatgaacagtgactgttctctctctttccctctccttccttttttcttctacttctccttccctttgcttcgaaaagggtatctcgtgatctttatcgctcaaaaatcttcactttcaggtaacgatttattgggtctctctctctctctctctctctctctaaagctctgttctttttatttcttctttttctgggttttattctctgattcttgctagatccaaaagttctttattttgcctcttcttcttctttactttaacgagatctgtttttacccttaaagactcaaaataaaaatccaaactttttgcatgaagagctttaattgatttgtcacttagatttgatatttcaatttgggtaaaattttgtgcatctacttaaactttcatctgtagtaagatccgtgattgttgtttctgagtcttctcaatccagctttaaactgatgctattgttttgttttgatgactatagatcaggccactcgttgatggaatctgtgacagtattgattactagagagtaaagacaagttctttaaatctcagggaagaaggaattggtgtttaagattgctctgtgttaatgatg

SEQ ID NO: 2743 - DNA, 3000 bp, Unknown
  misc_feature (1)..( 3000): cDNA_ID_3069522_gDNA_ID_1620585_Annot_ID_161284 3000 nt of promoter + ATG
atgtatgtagctggtcccgataattaagaagttaagacgtatcgaaatctaatatgcttgaaacatgccatggtcatgtcaattacgtttgctagtgatatttgaagactgaattgggtcattggttcagctatatttcaacaattcagatttcgttaaaaataaactaacaagtagaataaaaaggttatctatctacttactaaaaccagcatttaggtttagtggctttcttgttcaattatctgcgtattccatattcaacttaaatttttcgttgccaattcatcaccatattgaagtactgtatcatgctattaagtttaaacaatattttgtagaccgacttttaaaatacaacaaaattgaattaaaaatggattagaaagtcctaactaattatataagatagtccagatggaagaactcaattcgatctgagttttagtaaagtaatttaatgaatcgtaaatcttaaaaatcatgaaaaatcacttgcaagaaagtgagaaacaacctatggaccacaataacaagaatttgtcgtaaaacaaagaaaaggttttaagttttgttggaaacttacttggtcaattctactcgtggtaatgtggtggacaagccttaaatcgcgattacaagcttagagaatgttgtaaagaaatactccaagaagatggcatatttataggacgagaagaacaaaaataaaaaaatttggatatccatcgcagttattacagattctttatttctataaatagattcctaaatcgttgcgttttgattctatattctatttttgtaaattaaaagtccatgcatggttagatattgcactgtcgtctaggttcatttttacgtttctattgccagctctaacgattttgactgtgattcatctttaattagataattaagatctattgccagctagctctattgccatattaattacataattatctctaagactaaaagatcatgttctgatgaaacttgtcaacttgacatgtctctaactgccaaaacttatgaatttaatgtacgtagaactttttaatattgactccgatgacttatttgatgtttgaaatcatgtgtaacaacttttggctcgataggcctaatatatttattagcttttcacaaccagattcttgaatgagacttttctagccgtcatgtgaaaatgatgtagctaataaatggtcttctttttttatgaataacaccgactcaaaggtaatttcaatgagaaaaatatgagcattttaggtatgtcctcaaacaaattaaaactgtattcaaataattgatcatcttgctacattatataatagaggtggtgatcaaacatcatagcatagtcatattgttaagatgtctcaaacatcgtcgcattaggtctgaatcggcagggccggtccatatactaataagtaataaccaaatgttatgaactacgcgagtgtaaataacataagatgttaaaatggttggtgaacgtgcattaaattgttctactgaacgcgttattggttttaagcatgtcgatatttgtagagattgtaatatgttgtacgtattagagattaatataaacgcgttattgatatgtatattacatttgatatcatgcgtttgcggacaaataaatatctttattatatacatcatatcgtcacatgtaatgtgtcactatatataatagaaaagaaatcaacttaaatgattgtagtccaatccccctatatagtcgtatatatctcatcggtcaagacacatatgacataaccaatttttagtttgagtgttctacatgcacgcatgtattcaacgaatgggttaaacgttaactcgttctcgtaagattatttttacataaaacagtgaatctttttattggtaaatatacataaaactgataatagtaataatctaatttagcaactagtttatcctcagaatcattagatacgttactgatctattatgattgcttagtgattagatagagccgatatcaactcagtttgtacgcacaagacagaagactaatgaataatgacaatatatattctcgacccatttcacacaatgctagtacaagataaggtgctttcgtgtcatagagattttgacaaattgattataacttccgttgactgatgggagcgaaattgacaaaaccattaacagattatgagcaagttctcaagattttttagttttctttctctctcggtcccaaaagaaaagatgacaatagctagcatcaacttgttagaaaaagacgatgaacaagtttgagaattggaccactgaaaatccaatttccacccaaccaattattctactattagtggaaaaacgtggtcaaccatctttgtcaacttcgccaatatgcttttcaacttcttaattaatgcctcaaatctcggaactacattttgtcacaacgctaaagataaaagagaactaaaagtagaaaaacaagagtttgtgaaagtttacaagttttttttgtagagagaattttaaccgtgttaatgttttgttccaaatgtttttgtttgttttggaaaaacaaaaatttggttgtttttatttcacaagttcaagagcacgcttgtaccaacaagatcgatgatcgtgttgtttcgattcgtgtcgaagttgacaccgtttcgttgtcttgtttattgatcgagacatatttgtttttggttgtggaacaaaattttaaagtatattgcgtgttcacactagtttgaaagttgtgtgcgtatgaataaacatatcgaataatcaataacaaggcaccatatagttattgggctcaatttgttttaaattgggccgataattatttaggcaaaagcccaataatagacaccagtcaaatatacctttgtgtactccaacaatcatcatcttctacttcttctcttaaaccctggccgcgcgagaaaaccctaattcaaacctgtagccatg

SEQ ID NO: 2744 - DNA, 3000 bp, Unknown
  misc_feature (1)..( 3000): cDNA_ID_1664939_gDNA_ID_1620585_Annot_ID_161286 3000 nt of promoter + ATG
atgtacaatgtcattattgtgatcacaaaattggtagttagttaatgtcatatatatatatatatatatatgtgtgtgttttaattttgttaggtacagaggcactcttgtaaataaaaactaccactaaaatctgaatgttttgtgcattaaaaaagaaagaaagataaaacctcgtaccgatctgaataattttttatcaatgaagtcacaattttgtacgttgatgaagtcaacacgtggcaaattacaaactcgacaatttcctcaagagaaacaaaaaaaatccctgaaaaattcctcaaaattttcttaattttcgagataaattgatttaaaataaaataaaacagaaagatacgcaatgaaactgcgttttcaagcaaactgctaaatttctatctttttttctctctctctctctctctataagggctctgcttcttgtacaacagccgaaacaattataccatgacattaaaatccagatttttttcagtcattttcgtattatttgtttaaaagtaaagtttttcttccatcaaaatggaaaatgtgatctggtttttttcttagaagatattaaaacaatcggagagaggattgcaaattttttatttttgttaatttgctgtgtgatgggtctggttgattctttgttaggaaaagatgcaagaaaatttctcaaaaggaaagatagtgatgctgcagaagcaggtacgtcattattataacaacaattcatgaatctgcctccatattcttcatttgatttgcctcatcataattcagatttctcatgatcaaaaatgatgctttatttattcccacgttgtctctgttcttcaccgtttaagttaaatggttttgatcggatctttaatggttttgatcggacctttaggcttttttgatctgtttgtgaatttgtaggacgagctttggaagaactcagaagttctttgtacaatgagcttaaaacatcagaaggagctaaaaggcaacaacagagattttgtggccctgttgttgcaatgtcctttaatttcgttgttgctgttggaatcatccttgccaataaattagtaatttggtttcttcaatctcaaattcttctttctcttttttttatttaccatgtgaatgtaattgtaaggttgaattgtgcaggtgatgggaagagttggattcaatttcccaatctttctaacattgattcattataccgtggcttggattcttttagctttcttcaagtctctctctttgcttccaatgtctcctccatcaaagacaacacctttctcatctcttttctctcttggagctgtcatggcctttgcttctggactcgctaataccagtctcaaacacaataggttcatagctcaatcgctaaagtttgaatcaagattcatagcttaagcttgaaagcttttgttcttctttgtttccagcgttggattctatcaaatggctaagatcgcagttacaccaacgattgttcttgccgagtttgttctcttcaagaaaaccatttcttccacaaaggtttcgcttatatcttttatgacatgtcaacaaaacaatcaagaattcattacatgtttttggtgcttactctgtttttgcaatttgtcctcttacaggtcatggcattagctgtagtatctctaggtgtggcaatcgcgacagtgacggatctagaatttaatttgtttggtgcattagttgctgttgcttggattattccaagtgccattaacaaaatactctggtctaatcttcagcaacaagctaattggactgccctagcgtaagaaataagaatctctctcttttacttttacttgaggtgtaagcaatacaagtctcttaaaataaaggctttattgaatgtagattgatgtggaagacaacaccgtttactgtcttcttcttgttggctctcatgccatggcttgacccacctggagttttgcttttcaaatgggatttaactaactcttccgcaatcctcatctcggctcttctcggctttcttctccaatggtctggtgcactcgctctcgggttagtctttttgttctcttgctttggttggaagttcagtcttgaggttataaaatgctaactaaatttgttgtttcttacagggcaacatcagcaacatctcatgtagtattagggcaattcaagacatgtgtgatcttgcttggaggttacgttatcttcggctctgaccctggtttcatcagcatctgcggcgctatcgcagctcttggaggcatgtctgtctacacgtggctcaatcttccggggaaatccatcgatcacatgtcaaacaagcagctgccaaagcaaaacgtcaccgtttcaaaacctaaagccgaggctgacgacggaggaggagagaccggagtaaccgtagtttctgttgacccacttctctccaagacgataactgcaaatatcgtatagttttacaatttgattagattgccaaagagaaaaaaaatgagttttactttttcttcttcaggttttagtttgtaaaattggttcagttttgatatcaaattagtgtagtaaagtatactaataaaaatattttgatatcataatgtgacaagagggcttggtgggtttatttgtacgataatgaaatagatggtgtagtttagaagtaatgtaaaacttgatgtgtatttttttttttgtcgtcacttgatgtgtattatgaggtgcaattagtaaatataataaacctttttgactttttctataatttcaaaaactttaatgtagtaaagtgaaaacttgtggggaatagggttttcggtgataaaatcgggctgacccgaacccggtttagtgcgagattccactgtccgtcgttaacaaaggagctaaatctcagaacgatttctcgatttgcttttgcgacattataattttcctttcaattgactcagtgagtcgccgatcgagttagaaatg

SEQ ID NO: 2745 - DNA, 3000 bp, Unknown
  misc_feature (1)..( 3000): cDNA_ID_2168459_gDNA_ID_1620585_Annot_ID_161285 3000 nt of promoter + ATG
acaaagatggttgaccacgtttttccactaatagtagaataattggttgggtggaaattggattttcagtggtccaattctcaaacttgttcatcgtctttttctaacaagttgatgctagctattgtcatcttttcttttgggaccgagagagaaagaaaactaaaaaatcttgagaacttgctcataatctgttaatggttttgtcaatttcgctcccatcagtcaacggaagttataatcaatttgtcaaaatctctatgacacgaaagcaccttatcttgtactagcattgtgtgaaatgggtcgagaatatatattgtcattattcattagtcttctgtcttgtgcgtacaaactgagttgatatcggctctatctaatcactaagcaatcataatagatcagtaacgtatctaatgattctgaggataaactagttgctaaattagattattactattatcagttttatgtatatttaccaataaaaagattcactgttttatgtaaaaataatcttacgagaacgagttaacgtttaacccattcgttgaatacatgcgtgcatgtagaacactcaaactaaaaattggttatgtcatatgtgtcttgaccgatgagatatatacgactatatagggggattggactacaatcatttaagttgatttcttttctattatatatagtgacacattacatgtgacgatatgatgtatataataaagatatttatttgtccgcaaacgcatgatatcaaatgtaatatacatatcaataacgcgtttatattaatctctaatacgtacaacatattacaatctctacaaatatcgacatgcttaaaaccaataacgcgttcagtagaacaatttaatgcacgttcaccaaccattttaacatcttatgttatttacactcgcgtagttcataacatttggttattacttattagtatatggaccggccctgccgattcagacctaatgcgacgatgtttgagacatcttaacaatatgactatgctatgatgtttgatcaccacctctattatataatgtagcaagatgatcaattatttgaatacagttttaatttgtttgaggacatacctaaaatgctcatatttttctcattgaaattacctttgagtcggtgttattcataaaaaaagaagaccatttattagctacatcattttcacatgacggctagaaaagtctcattcaagaatctggttgtgaaaagctaataaatatattaggcctatcgagccaaaagttgttacacatgatttcaaacatcaaataagtcatcggagtcaatattaaaaagttctacgtacattaaattcataagttttggcagttagagacatgtcaagttgacaagtttcatcagaacatgatcttttagtcttagagataattatgtaattaatatggcaatagagctagctggcaatagatcttaattatctaattaaagatgaatcacagtcaaaatcgttagagctggcaatagaaacgtaaaaatgaacctagacgacagtgcaatatctaaccatgcatggacttttaatttacaaaaatagaatatagaatcaaaacgcaacgatttaggaatctatttatagaaataaagaatctgtaataactgcgatggatatccaaatttttttatttttgttcttctcgtcctataaatatgccatcttcttggagtatttctttacaacattctctaagcttgtaatcgcgatttaaggcttgtccaccacattaccacgagtagaattgaccaagtaagtttccaacaaaacttaaaaccttttctttgttttacgacaaattcttgttattgtggtccataggttgtttctcactttcttgcaagtgatttttcatgatttttaagatttacgattcattaaattactttactaaaactcagatcgaattgagttcttccatctggactatcttatataattagttaggactttctaatccatttttaattcaattttgttgtattttaaaagtcggtctacaaaatattgtttaaacttaatagcatgatacagtacttcaatatggtgatgaattggcaacgaaaaatttaagttgaatatggaatacgcagataattgaacaagaaagccactaaacctaaatgctggttttagtaagtagatagataacctttttattctacttgttagtttatttttaacgaaatctgaattgttgaaatatagctgaaccaatgacccaattcagtcttcaaatatcactagcaaacgtaattgacatgaccatggcatgtttcaagcatattagatttcgatacgtcttaacttcttaattatcgggaccagctacatacatttttagtatatgtcatcattatctttacttcttttttgtatcatcacaattatttccattttatttttttgttcttcttcatgtgcaaaagaagaggtactttgataagattccagtctataggattcaattaagatactaattaaatacagtatatacagaatcttgagttgtccgctttcaagattccaatacagtttacaaaattctgaattagttattcttgttgagtcaatacttttgaaagaatgttgaccaaaaaaaaaaaaaccaaagaaaacggatccttatttaacggtctccttaaccttaataatagtaaaacggtaaaaaccaaaattcatgtggtgtaaattgtctaaagtctgtatttttttttattgacatccattttttttgtgtcgaaagtctatatatgaagtcaaattcatgaacaaatgcttctaggctaaaaacgttatcgtaatctttaatcttcaggcttcttttctaaaattccgactggttaccgagggctagaaaatccggtcaccgtcgccggagacaacctcggtttctaaacgaaaccatcgtgaaggacggaaaaaaggagcttgaagacaaaaca

SEQ ID NO: 2746 - DNA, 3000 bp, Unknown
  misc_feature (1)..( 3000): cDNA_ID_2168478_gDNA_ID_1620586_Annot_ID_161297 3000 nt of promoter + ATG
accaactttttgatttttgatttttctaaacttcatcatataaacaactttactaaagaggacaagaaaaaaaagaagaagcaaacagtcaaatggaagaaaccaacattagagttgttctctactccattttctctctcatcttcttgataatctctttcaagttcttaaaaccaaagaaacagaatcttccaccgtctccgccgggatggttgccaataataggccatctccgccttctgaagccacccatccaccgcaccctccgctccttctccgagaccctcgaccacaacgatggtggcggcgtgatgtccctccgacttggatcccgtctagtctacgtggtgtcgtcacataaggttgcggcagaggagtgctttggcaagaacgacgtcgttctagctaaccggccacaggtgatcatcggaaaacatgttggttataacaatacaaacatgatcgctgcaccttacggtgatcactggcgtaacctccgtcgcctctgcactatcgagatcttttcaacacaccgccttaactgctttctttatgtccgtaccgacgaagtacgtcgccttataagccgcctctctcgtctcgcaggtatatatgtattaatgtatatgctacaagtgctttcatcattcgttgacttttcatttatgtttgtcttatcttagtgttatagtgaccacaaaaaattgaaatatgattatatgaaataatgatgatacgaaaataaggatgagatagcttgtggtggccgtaattgatgaatagaatgagtttcttttgcaaagtcgaaatactaaaatgtacgtattacgaaaataaagtttttattaaaaatttaaaatatgttacatagtaatgactaatgagaaaagttttgtcacatgtgtttttttcatcgtcgtgaagtttgttgataaagactagtcaacttttcaattttttttggtgttatttaagtgctaattatattgaccactgagtctttgtgggcgtcaatcgtaccatgaagatttcttaaaactcttttacttttagaacgttttacgtcaatatttttagaatagagatttctaaaaacattttacaaagtaatgaagaaaagctcgactactctatttttggttctcgtttggttctcgattttcctttttcttttaataattgcaggaaccaaaaaaactgttgtggaattgaaaccaatgcttatggacttgacattcaacaacataatgagaatgatgaccggaaaacgatactacggtgaagaaacaaccgatgaggaagaagcaaagcgtgtccgtaagttggtagcagatgttggggctaacacgagttcaggcaacgccgttgactacgtccccatcctcagactgttttcaagttatgaaaatagggttaaaaagttaggagaggagacagataagtttttacaaggtctcattgacgataaacgtgggcaacaagaaaccggtactacaatgatcgatcatttgcttgtcctccaaaaatctgatattgagtattacactgatcaaatcatcaaaggcatcatactggtttatttcttcttcctttattttttctattaattattagatcttttgttaactttgattataagtaagataaattgtctgatgttattatgttaatgcagataatggtaatagcagggactaacacatcagcagtcactctagaatgggcactttccaatttgcttaaccatcctgacgtaatatctaaagcgagagacgaaatcgataaccgggttggtttagaccggcttatcgaagaagcagatcttagcgagctaccatatctaaagaacattgtccttgagacccttaggctacacccagctacaccattgctagtcccacacatggcatcagaagattgcaagataggatcctacgatatgccacgtggtacaacgttgttggtgaatgcatgggccatacatagggatccaaacacgtgggatgatccggatagctttaaaccagagcggtttgagaaagaagaggaagcacaaaagcttctggcgtttggattaggtagaagagcgtgtcctggatcgggtctggcccaacgaatcgtgggactagctctcgggtcattgatacaatgctttgaatgggagagagttgggaatgtggaagtggatatgaaggaaggagttgggaatactgtacccaaagcgattcctttgaaagctatttgcaaagctcgtccatttctacataagattatttcctaaaattgttgaaactacgaataaaagatgtgtgacatgttaatgcaaatcaatgattctctctacatgtaaaatcttgatggattattatggctatcttaattatttttaataagtgttactagcagatttatagaaaagcaatcgagtattataagaaaagtaaacggcttctagagggactatgaccgtttaggccaaggaagtttgaggcaataacaggtctgtgatgtccttaaatgttctgagtcacacgcgcgctacactaatgtattcaacgagttcacactttggccgacagacccgggtaacttttgaaatttcatcgtaatgaggatagatcattgtaattgttggtttccaacgaggaattcttagtaagcgcgagtcatcagctcgtgttgactacgtccatgccctttgtacaaacagtccgttgctcctaccgattgaatgatctggtgaagtgttcggatcgcggccacttggatgacccaaaaaaacatataattcaaaaacctatagcgaaaacaagcaaagagtggatgagtaaataaatggcattgttgttgttgacctcactcaatcacctagtctcattctcactcactcgcttgccttcttcttccgctcacaatctcttcctttctcgttccttctcttcttcgatcagacgattcaatcgcttctcactcaaaccacttcgctccttcgcatccatg

SEQ ID NO: 2747 - DNA, 3000 bp, Unknown
  misc_feature (1)..( 3000): cDNA_ID_2168497_gDNA_ID_1620586_Annot_ID_161303 3000 nt of promoter + ATG
aataatttttgagggtgcaataaagcaatagtactctttagcctaattgattatttgattgttcacttggtttgttgggttacttagcttttattagatttgaaaagtttcagttattttttagaacgttttgcttcgagacaaaattacaatatgtattcaggtaaaagacaataggagatttgtcgaagaaaaaagaaaaacagacgttacatacagattggggtttcgaaatagttactataaaacaagtttttcttctgtcttgcgcgtgaaatatgttcacgtgatttcatgggtgagagaagaaacgtgttgacgggcatttaatgctcgacaaatgaatgatgctcatacagcaagaaagattgagttgacttagtaacggtgaaacttaacattaattattgttttctcaaatttgagaaatttttaacacacttccgacatatactacacgattttaacatttgtacacatataaacacatataaaaagcattaaactatatatatatatatgtatatacacatatagataacattattaagatttgtatacatgtaactacacatagagggttattaacatttgtatgtatataaacagatatgtagaaagttattacatttggatatatataatatatgtaaatatattgagcgttattagcatttgtatatatgtaatgtaaacatgtatatagcactttattatgtaaacatgtatatagaacgttatcaacatttgtatatttgtatgcatgctacaaatcaaacataaattacaaccactatatctcaaaccgtcgaatagagctagtgaacaatgcattgcagtgagaaattgaaatatcattatcataaggttcgtcaaattttcgatggatttttactaattttgtcgagttgtgattagtttttgttgagttgtcaccagaaattaataaatttgaaaatatgattttgtgcaaaaaaataaaaacctttaaagttgcctatttttgcaattttactctccacattcaaaaaatgcaaaattatcctatgaagtataaaataatacgcaatataacccatatttgcaactttacatatattataatcgttttcacgatcacatacatttgtttttgaaaattctaaaaatataattgaagtcatcatttcatagaaaaatcgttagtttacattaaaaatttgagcgtgcaatgaagcaatggtattctttagcggtattctttagcctaattgtttatttaattgttcttttggttttgttgggttacttagcttttattagattcgaagagttttagttattttttggaacgttttgcttagaaacaaaattaggatatgtattcaggtaaaagacaataggagatttgtcgaaaaagaaagaaaaataaacgttacatacagacttgggtttcaaaatagttactataaaacaagcttttgcttctgtcttacgcgtgaaatatgttcatgtgacttctttggtgaaaaaagaaacgtgtataaaacaagattttgcttctatcttgcccgtgaaatatgttcatgtgatttctttggtgagagaagaaacgtgttgacgggcatttaatgttcgacagatgaatggcgtacatgcagtgagaaagaacgagttgactagtaacggcgagacttaacattaattattgttttctcaaatttgagaaattttaaaacacttccggcatatattatacgattttaacatttgtacacatgtaaacacatatatgaagcactaaaaataattatagtgttaaattattggatctaaatacacatatagataatgttattaatatttgtatacatgtaaacacatatatcgttattaatatttgtatgcatgtaaacacatatatagaacgttattaacatatatatatatatatatatatatatatgtgtaaacatgtatattttgtatatatgtaaacatgtatagaacattattaacatttgtatatcggtatgcacgctacaaatcaaacataaattacaaccaccatatctcaaaccgtcgaataaagcaagtgaatagtgtattgcagttagaaattgaaatataactatcataagtttcgtcaaatttttgataaatctttttctagttttcgtcgagttgtcaccggtttttgttgagttatcaccggaagttcattatatttgaagatatttagagtttagtgtttttttgggaagtcccgttctcatctcatctcgtctcgtcctgctttcataagtgtagtatgttatacgttataaaccaccatattgataatgttgttataaatcataaaatattttcttctacaatacaatttataatttagtgaattctgaacaaatcttctcaacgaaacgtaagatcatcatatcagtaattcaaacttgtaaatgatgtttcttatttgcattggtttgatttataatcgaggtttcttaagttttttgttacaagattagatattatcgtatatcaatgaagtaaaaagatattattaccaaaaaatttagtcctcaaatcgaaaccaaatatatatgaacttcacagaaatattccattcttcatacaactttaaaataaaaaaagaaacacaatcagacaaagttcccatgcactatactacttatgttcttaaaagattaatcttttggagtttcacaaaaattaagaaaacagttaatataatgtaatattttcctacaccaaaaaaatgataattatgaacaaacagtaattcataaatttaaatatccgcaatcagtattttcaaatctaatgaaatatatgcacattaattaataaaaattgcaattaaaaacataaaaataaattatcacaaccctaacactcatcttagcaccgtattcgaaacttcagaaccaaatcattcgaaaccttgacatgattaagctacccaatccgatttctagggtttgtgatcccttaatcatg

SEQ ID NO: 2748 - DNA, 3000 bp, Unknown
  misc_feature (1)..( 3000): cDNA_ID_2168501_gDNA_ID_1620586_Annot_ID_161304 3000 nt of promoter + ATG
cttatgaaagcaggacgagacgagatgagatgagaacgggacttcccaaaaaaacactaaactctaaatatcttcaaatataatgaacttccggtgataactcaacaaaaaccggtgacaactcgacgaaaactagaaaaagatttatcaaaaatttgacgaaacttatgatagttatatttcaatttctaactgcaatacactattcacttgctttattcgacggtttgagatatggtggttgtaatttatgtttgatttgtagcgtgcataccgatatacaaatgttaataatgttctatacatgtttacatatatacaaaatatacatgtttacacatatatatatatatatatatatatatatgttaataacgttctatatatgtgtttacatgcatacaaatattaataacgatatatgtgtttacatgtatacaaatattaataacattatctatatgtgtatttagatccaataatttaacactataattatttttagtgcttcatatatgtgtttacatgtgtacaaatgttaaaatcgtataatatatgccggaagtgttttaaaatttctcaaatttgagaaaacaataattaatgttaagtctcgccgttactagtcaactcgttctttctcactgcatgtacgccattcatctgtcgaacattaaatgcccgtcaacacgtttcttctctcaccaaagaaatcacatgaacatatttcacgggcaagatagaagcaaaatcttgttttatacacgtttcttttttcaccaaagaagtcacatgaacatatttcacgcgtaagacagaagcaaaagcttgttttatagtaactattttgaaacccaagtctgtatgtaacgtttatttttctttctttttcgacaaatctcctattgtcttttacctgaatacatatcctaattttgtttctaagcaaaacgttccaaaaaataactaaaactcttcgaatctaataaaagctaagtaacccaacaaaaccaaaagaacaattaaataaacaattaggctaaagaataccgctaaagaataccattgcttcattgcacgctcaaatttttaatgtaaactaacgatttttctatgaaatgatgacttcaattatatttttagaattttcaaaaacaaatgtatgtgatcgtgaaaacgattataatatatgtaaagttgcaaatatgggttatattgcgtattattttatacttcataggataattttgcattttttgaatgtggagagtaaaattgcaaaaataggcaactttaaaggtttttatttttttgcacaaaatcatattttcaaatttattaatttctggtgacaactcaacaaaaactaatcacaactcgacaaaattagtaaaaatccatcgaaaatttgacgaaccttatgataatgatatttcaatttctcactgcaatgcattgttcactagctctattcgacggtttgagatatagtggttgtaatttatgtttgatttgtagcatgcatacaaatatacaaatgttgataacgttctatatacatgtttacataataaagtgctatatacatgtttacattacatatatacaaatgctaataacgctcaatatatttacatatattatatatatccaaatgtaataactttctacatatctgtttatatacatacaaatgttaataaccctctatgtgtagttacatgtatacaaatcttaataatgttatctatatgtgtatatacatatatatatatatagtttaatgctttttatatgtgtttatatgtgtacaaatgttaaaatcgtgtagtatatgtcggaagtgtgttaaaaatttctcaaatttgagaaaacaataattaatgttaagtttcaccgttactaagtcaactcaatctttcttgctgtatgagcatcattcatttgtcgagcattaaatgcccgtcaacacgtttcttctctcacccatgaaatcacgtgaacatatttcacgcgcaagacagaagaaaaacttgttttatagtaactatttcgaaaccccaatctgtatgtaacgtctgtttttcttttttcttcgacaaatctcctattgtcttttacctgaatacatattgtaattttgtctcgaagcaaaacgttctaaaaaataactgaaacttttcaaatctaataaaagctaagtaacccaacaaaccaagtgaacaatcaaataatcaattaggctaaagagtactattgctttattgcaccctcaaaaattattaggatgatgagaatgtaatatatcctatatatgctaaatcaccaagtgcatgtttaagtttattaaacataatctactaatataaacttctattaagaataaaatatttagttgatcaaataataagtatctccatacaaattccagctgtaaaaaataaaattaggaaaacgaaatactaaaataataaagtttggagatatatagaagaaaaagaaaacagagcgccattatcggtgaaagctgtggttgttccttgaaatccgattctgattccttccttttggatccgattctatctccaccttcaagcacaatattcgactcggtactctctctttcttcttcttattgcaaaaagattctctttttatctgttttgtggatatagagattctggataaaaacaatcatcttttttctctcaaaaatctctgcttaagaactgggattcttcaaaagctcttctcttgtctgatttcttctgaatttcccctctaagtctctccaattcttctccattagctataaagtcgattcctttatcaccgttctgaagaatttggtcgaaagttttggcctttagtacccaattttcaatcctggcgataactgaattgaaaagggttccaaaagttacatcacctgaaaacaacagtgcttttgattgtgttggtggtttggagtgcttgataagtttaatcagggcccttgat

SEQ ID NO: 2749 - DNA, 3000 bp, Unknown
  misc_feature (1)..( 3000): cDNA_ID_2168505_gDNA_ID_1620586_Annot_ID_161305 3000 nt of promoter + ATG
ttaagaaacaattattgtttaattatttgccaatcatttttttaataagtttgaaccaatagtagtataaaacagttaaccattacatcttgaaatctataatttatcaataaaaaatttaaaaaataaaataaaaacctaaaaaatcaatctttgtggaacaaactcaaaacactaaaacatcaaatctaatatgacataatgttcggctgtttttcaaaaaaataatcattgattaatggttaatgcttctctgtgaaagtcaccagttcacgggtttgagacttgggagcagcttagacaagttttcttttattttaattacaaagaacagtcattcaaaaaataatagttatgcagcctatttttttcttcttgcttgtagccttgtcaaattcagggacggcttgatgtctcaactaatttgcaacatgtcttcaatcattaacatggcccgtttacaagccggtagccctagttgtccccatcaagatatagaccaatcccaataacacctttgaatcccaacataccatgctatcagcagatatgtcttattgccttattgcatgatatctaatctagttatactaaatcaacagtcacttttcccaaaactgcaagtctctccttttgccacgtatgattaagtttaaaattttggtctttcacattcgtaaaacaattcactgctttctactattatttttcaacacaattttttttgacaaaaaataaataaaagtctgaccacttttttagcaactgctccttccacgatcttaagattcttcactttctctcccatctttcaatccctttgccagttaaattacgatctaaatggcaaccgtataagcctcttttacaaaaataaaaacaggttcatgttcttcttcttctctcctttcttataactttagatcgtccattctttcttcaaaatttgtataacagagaaacaaaaagatgacataaacaatgaaagttgagacttttgtgatgcctaatgtgatggacgatgttaactccccacgacacgttgagtttggtccacctaatcgctgatatgaatatcattaaaactttggctatttgttgcgatttacttggtcttatctttttacattttctatgcaccctgctcgacaaaatgaccacatgagtttgcgagaatcgtatagaaacaaaatggatgcaaatgttttgggggtttcaattcaaaagaagaaaaccaatttgagagatgggtggcatgatttgacatcttcttccacgatgtagtctgcaaaatgattttaatgtgaaaccttcttatatgttcaagttttaaaagcgttttgattcgaaggttattcatttctccatcattattattgttaagcttttggagaagaaaaaatagctccgtatatcttttgttttcttcatctactctttctctttttttttctatgcctgagacagttagtgtatttatgtaagatactttgttgtttctaatgaaagtttctttgattttgacacacacatacatatatatatatatatcacgatttgggtgaagttgagaaggacttctattgagagttacagagcaatgtgtaatacatccaatcaatgtatttcgataaaataaaactaaacaaattgtattttgtgaggctgtgacattcatcattagtgtaatagttgtagatttcaaagaaacaaaatactatactatggatattgttattttcccgtgcaaagcacgggctgcctactagtattctatagatcccaatggcaagtgtccgaataagactccatcattcgttctatctaactcgggagatgatctcatacctcctatatcatcaaacgagacccaaattgtcctctacatagaaagaatatggatttcgtcgaatatttacagatttatcattagtgttactcacacatatttcactcaattaattatataaaaaattacaattaaaatatgcaatttcatatataatctttgttatttattgtaggaaacatagttttcttcttctaaacatcacatgttcaagtctaaaaccaaaaaaatcataacattataattattaattttgtttatattaaatttgtttaatacatattttgaagaaaaaaaaaattaacactcaagcatttgtagtctagtagtaggggaagttttagtaaatggtgaaattcctaaaccaaattcgattatctttggaaacaaaaacacatttgtttcagaagtctgtcatttgtgatttgatttaattagtttatatggtagttagaatgcaggcggtctaactactccttgaaataacttgaaaaacactctaaacttgggacatacagtgtggtgggctttcaggaagatgtttactgtgaagcacttcggtgcgtctctatcgaagtttaccggatcaaccgatagtttttatataaaacaaaaaaaaaaacaaaaaaaaattaacaactaaataaagctatttgcaagctaataaatatcaatttatctaaaagtaatatttaccactataaagtcataaaatatcttgttggattccaatattattgatttatagaaattttactgtagtttaaaagttaattttgttattacctctttttcctattggtcaaataatgaataaacaattaaaaaataccaacaaaagacaaaaaaaacaaaaaacaaaacaaaaaagctaaaaaatcaccgttgaaaacgcgtcgctttctcttgcgtttccctctcttctcgttcccatgtctccctctcttcctctgttgctttctttggtttatctttcaaactcaattctcatcatcagaaatacataaaactcttttttaaaattccaaatgaatttcaattcaattcgattcaccatttcaaacaaatctcaattttgattttcccggagatttggatcggagagataatataatttcttgacagtgaagacattgatggtgacgacgatg

SEQ ID NO: 2750 - DNA, 3000 bp, Unknown
  misc_feature (1)..( 3000): cDNA_ID_3069542_gDNA_ID_1620586_Annot_ID_161310 3000 nt of promoter + ATG
ttgttaaattgcttaaaaaatactcgattgatttagttttcatgtaaatgcaaattaaacaaattctaaccaaatttgtttttttccctgattttattagttcctattctttttttttgtgcaaaaatttgattggttcctttgtggctatgtgtggtgcgtggcatttcgttaataggctcagaatcgagagcttaatacttacaataaaacgacatcgtttaataacaaaatcatcaccatcgatctgaccagagctccttctttgagcaaggtttttctgggtgcttttctacagcaatggcggcgagaggtgctctgcttaaatatctcattgtcaatgtcacaccttctcttcaaatctcaagccgtatcacttcccctcctttgtatgttcttcttcggcgtttctctaaagaagttagagcattcctctacacatctgaagtcacatatcgctttctctctatcgtcaaaaacttccaaaaatttgagccttctaaagtattttcagattcttacctctgatttggtgaattcagttatgatagatagacatttgatttgattatagaagctagagttatgttgtttcttgaacattgatatacctcgattttcactcattttaactatgatttaggtatagtttttagagttcttttgttatttttagagtcttgtatagtttattcaggtctttacatgtttgggatgcatttggagaatatagagtattctggagaaaaacataaaacttatgctacaaaagcaatccgaagaccaaacttcacgtaggtgtcaatcgacaccacccttggtgtcgctcgacaccaatatccgacgccaattcaattgcgcaacttattgaagttttgaagatttccaaattcgcttcagaacttttccttattttcaaagaagtccctacacaattttaggaatttatacaatagaaactctataaattaataatgttgggaccatgaattttattaatttatagtgatattaatttatcctataaattaataaatattaatttatcctattaattaataaatattaatttatagaaatattatacataaaatataatattatattcttcttaaaatgtttcttaatttaattttccatatattttgttgtttagatatataattatgttaggttttttatttttctttgacttctttaatttatttttctgtaagatattgtgtttgtatatctaagatattaacgtgaagtaaagtaaacatgaattttaatccaattttttttacataaatcttagcaataccttctcaaatacaaaattaactatgacggatcaaatactcaaaaagttatgtgagtacaatagagatcataccagttgtattttaaaaagagttgtaattatagtttgaacaaaattttcatataaatattagtcttaaaatgtatacttaagatctatgattattaatttataatattattgggactataaatttatatagggatttcaaaaaaaatattatcttattatcttatcgattttagttaatttttacattggcctgacttgggaccggcaaaatatattaatatatcgtgtttattaatttatcgagtattaatttatagagtttctactgtacaaagattttaaggtcattgtttagatctaacttttgataacttttctttaccctttatttcactttgttctctagagccaaaaccctctagagccaaaaccatatgaagctctctctagagaagatctttctaaactatattctcttcttgtttcttacattgatttctaccttaaacatgttttggtctttgataatcatgtatgaatagttctcttgttgggtttagggactctcaatagggatttagatgaattagtataccgaaaatcctgttaggataatatatttagaattcttcatctttgattgttcttagtgctagttctagaattactagaacttgattttaggttaataggtagtactcaaaaagacttctattactagaactatcttagatgagcctagtatttagatgcggactagcgtcgatttagatacttaggtgaacttatcaaacatgattataatgcttgcttagttctagggatttacaaaagagttagaatcaatactactaagcatagtgagtaatgcggcgaaccatcggttactctataatagtgattagagttctagaatggttcgatcgtaattctaatttattgctagatctactattctgatatttcctgagaatttccctaaacccaacgttttaatcatctgaatctacaaccaattttaattgattttctgtcttttattcttataatattttcagtttagcttcatttgaaactgttagtctattgtgtaatctgagaactttgtggaattcgatccctaagtgctataacaacctctttatttgagagagtaatcaatacggtaatttgactcatatcaatttggcgtcgttgccaagttctcttcgattcaccattagattaggtgtagaatttagtcttaatttttattttactttgttactcacgcgttctttttcttgtgacaagagctaataggaatttgaacgcaacaaccggaaagttagcaatcagtggatatgttgagattgattatcagacctgatgctgctggagtcttacgagacagagatggtcaggcatacaacgaagagggccagaaacttgatgaagagggaaacgtgataccagaaatcgcagaggatgtcgatcggcaccagctggttgttgatcgacataagaagaaatcagagcagatggtcgtaggatgactcttgatgactacaacagacaagatctcttctattccaatcagtctgcaatccgaccacctacatttgaaagaagagatttcgagataaaacatgcatactttactcttgtgagtatgcacccttttcatggtctaacacccgatg

SEQ ID NO: 2751 - DNA, 3000 bp, Unknown
  misc_feature (1)..( 3000): cDNA_ID_2785775_gDNA_ID_1620586_Annot_ID_161302 3000 nt of promoter + ATG
cttaaggtccatccgcctcagagaatgattgacttaagaccaataagtctttgttctgttctttataagattgtggcaaagattctagtgaataggctaaagaagcatttgtctctgattgtgtctcctactcaagccgcttttgtctcagacagaatgatatctgataatgttttgatagcgcatgaagctatacacagtctgaaatctcatcctgttttttctaactcatcgatggttgttaaaactgacatgtcaaaggcctacgacagagttgaatggtcttttctcagagaaatgctacaactactagggttcaataatatatggatttcttggataatgggatgtgtgacatctgttacatactcaatcttgattaatggccaaccttttggttttatcagacctgaaagaggtattcgccaaggagatcctctctcccctttcttgtttgtgttatgcacagaagctttgattcatctgtttgatcaatctactagagcaggctccttatctggaattcagtttcatccttcagggccagtaattaacaatctgctgtttgctgatgacagcctctttatgtgtaatgctgataaagatcagagtttggagatgttgaactgtttagataagtatgagaaaatctctggtcaaaaaatcaacaaatcgaaatcagcaatcactttcggattaaaaattgatgaggctacaaagaagtggattaaagatacaactgagattcaaacagaaggaggaacagggaaatatctaggattcccagagtgttttagtggatctaagcaggaacttttggattatattaaagtcagattgaaggatagactaacaggatggtttgcaaaaaatctatctcaaggaggtaaagaagtccttattaaatccgtggctatggctctccctgtgtatgcaatgagctgtttcaaattaccaaagacttctatcaagaacttaacaagtgcaattatggagttctggtggagcaattcaaaggatcacaaaaaaattcactggttggggactgaaaaaatgactttacctaaaacacttggtggctttggatttaaagatctggaaattttcaatcaggctcttttggcaaagcaagcttggaggctattacatgagcccaattgtcttttttcaagattcttcaagagcaggtactttgtgaattctccatttatagatgcgtctgttggaagtaaaacatcctatgcgtggagaagtattttgtctggtagggatcttttaattaaaggactgaaaagaatcattgggaatggaaaagagacattggtatggattgataagtggatccatgatggaataaacaggagacccacaggaattcaatccctccaaaacattagacttcgagttgatgctctgattaatatggaaacgggatgttggaatacgaatctgttgagagctttatttcatcatactgatgttaggattattcaagcatcaaagccagtagttgggagatcagatttcttttgctggacagaaactaggaatgatatctattcgattagatcaggatatgatttagcttacaaatttcatcatttagatcagattacagaagctacaaatcgcccttcaaggaccacaattgtagaggcctgctggaagattcccactgttccaaaaattcaggtgtttctatggaaactactaagaggtgcactggctgttacagaacgtttgaagacaaaaggaattcagagttatgatggttgttggttttgtgatgcagatttggaaacaattaatcatatgttgtttctatgtccatatgcaagacaagtttgggctttgtctaatattccatcaccacagacaggtttttgcaagtcagattatgagaatttccattatttgatgagtttgcaatcacaacaaaaggatattgcagaaatttcaaaggtttttccttgggttttatggcgcttgtggaaaaataggaatcagctattgtttgaaggatctttttttccgccaaatgaattgattataaaagcaagggaggatgctactgaatggtttacagctcaagaagctcgagaatcacctatgagaaagcctaacctcagccatgatttccggaaacctccagttcagggagaatttaaatgcaacattggatattcttggtccaagttgcataggcttgcgggtgtatcttgggtacttagagattctctgagtaatgtagttctccacagtcgtcgatcttattctcaagttgtgtccttgtttgaagctaagatcaagagctaggaatgggcagttgagagtatgaagagtttacatgttcaaaaagtgatttttggagccactacaatggagataatcaaagccctgcataaacctaaggattggccatcaataataagtcacattctcccaatgctagttatggctgatggaatgactgattggttcattttatttgaacctaatgggtgcaacaaaggagcctataaaatagccaagagtgttacctctgacataagagtgaactcttatgtagctcaaagctatcctagatggatgaaagatttcttcattaaggagaaatgtattgtcgatagtattaggtcctaagttttttttagttttaagttaggagttgtaattatagagtgtattttattaggttctaggtccttctttttatttattccagtaattttctagttagatagatttttaaagagattacttcgcaatgatagaaaaaaaacaaaaagatttagtccttctagacttaagcggtggattaatgtttatagtcttttctggggtttgaatctttgactttagctttcttacaattaaggtttctccttctcgtaattgatcctagagtatataaattaggaagtctgctttctcttagtcctgtatctttaagctttcataattaggaaaaaaaaaaaaaaaaagagagaaggggtagcg

SEQ ID NO: 2752 - DNA, 3000 bp, Unknown
  misc_feature (1)..( 3000): cDNA_ID_2106220_gDNA_ID_1620586_Annot_ID_161298 3000 nt of promoter + ATG
tgttccagaatgaggttgatttacttacagtgttgatgcgtgttttatttcacctcaagcttttacctgaaagaccacacgactactgcaaatgcacagtatataggagtagtactttaggattgaatccacaaggagagaagtagttcagagaaatccttaagaagagagtgaagctaggaccaaataaaaagagagggggttgttgtatgcaataaaccaaaataaaagacaagtaactaaactaaacgataagcaataagagagaagcgttaggctttcgagggtttctccggatgtcatggttcaaacaataggatatagatctcaatctaggtgataacatggttaggtttgtttacttccaaattctcggacatacgaaactctatcaagaccagctaaccctaacggctggtaggtgaaagccggctattctcacctatatcttgtgtactcagttgccctaacggctagtaggtgcttacatggtttcaaaatacaagatcaaagcattaagttaaaattcgattctactccataagtccctatcactcggcgggcgtgcaacggttatagttttttattcagttgagctatttcaggcaattatacaagattctgtcaagtataaaatatctaagatcatgtactaggtggtgttctggacatacatgcattaagattaaactcaactagaaagaatagtgtaaacgatcaaacaaagccatagaaaccgccaacctagactttcgatctaaaagtccccatgaattcccctttgaaaccccctcaaacccaactagagatctactcgctcatggcaaaggagctaatcaaaagttggattgagtaaaccataacaaaaagatgaataaaacttagaaagggtttagagattacttctttgaatgtagaatacaagaggcaaagttccatataaagagtcttacacaaaacgagaaagagagagatggtgatcttcaagcttcaagaggtgcagctgcgagttggcagctctcggcgacggctagggttcgtttgtgatgaaggcacacctagagttagggcttagaacaagtatttatacttgagggccaggaattaggtttaggggtaagaacgtcattcccccgggtaagtaagtgatcgggccgaatagtgggcttcaggaaaggagcctaatgacggtggcgcaaagagggaaggacttgggcgtgaactagtgttcggtggtgagtttctcggagctgcccaggttcaagtctccttggccagatgctttttggacttattatttctaaacggccggttcttgacatgtcttcactctttgtgtcatatcttccaaacggctttatagattgttttgattcgacttctacgttaatcttgactcttctatcattccatacataccaaaatatctcgtttccgtgatagggaagacctcagacagatgctaaacttctgaagtactggaatgatcaccttttgatacttttaggttcaaaactcttaaaaaccttcttggcacctagaatacgtgtttctcctcttattggttctagaatggcatcaaatgctctctgaaatataagaaaacaatagctaaaacgggataaaaagtcgtgttatcaagtgcagagaagggaacccttacttttcaataattggtttgttgcaactcatatatgggagcctgctcctgcctttaattttgtgactaccatagacctttgggtgcagatgaggggcattcctattctgtatgtttgtgaggagactgctttggagattgctcaagaacttggagagatcatcactttggactttcatgatgccaccacgactcaaattgcttatattcgagtccgagtgaggtttggaatcactgacagacttaggtttttccaacgcatcatttttgattctggggaaactgctctcatcaggtttcaatatgagcggctaaggaggatatgcagtagttgttttagagttacacatcacatgaactattgtccatatcgacaacgcttacctaactatggaagggaaagacctgtcttccatgatgaaaggttcagatcgagtatgaattctcagtctcaaatgaatgataattcctttccagttcctatgaccccacctccaaggattgctacaccacagttgaatcatggaaagtttgttgcagcgcatccgtattttcctactacaagagaaggacttaaccaccatggtagaggcactagtcaacatggtctctgtcaaggacaacaagtctcaatagattctaatatcactccatcagtgggaacaacaatcacagctggaactcaacgtgtttatgaaattggccaatcttcaagaaggtttgaaacaagggaatcaaggaaacgtcaagaggagaaaggaccttacaatgaccaagatcaagcgcacatgaagagagggattctgaaacctccaaagaaaagataagcactctactaattctgtcaactctttttggtttaggacagcattggtttcaacaagtgcatatccaagctctgaaataatgcgtcgaaggggtatggccttcataacactttttgggttaaagagtactatatggctgcagttagtgtttttacgttcgctctgtaactttttgagtatacaacatggttaaccttgttggtttctgatgccatggttgttagtttacttgttttatgtgtatgtcttcaagctgtaagtggtagatctactattgtacaattatgatctaaaagaagacaacacttagtgaaaaaaaaaaaaagttcatacatcttatttagtctcatcccgtcacgatccttatttttaattattaaatcctaattaccaaacgtgtcgaaattcgaataatataaccaactttttgatttttgatttttctaaacttcatcatataaacaactttactaaagaggacaagaaaaaaaagaagaagcaaacagtcaaatg

SEQ ID NO: 2753 - DNA, 3000 bp, Unknown
  misc_feature (1)..( 3000): cDNA_ID_2170845_gDNA_ID_1620587_Annot_ID_161324 3000 nt of promoter + ATG
tcataagctgtcgaaagtctctgtttaggtaattgggattaagaaagtaatgaaacctggccaaggactattctgtgtttagcttttatgatggttcctgcatattgagctttgagtattgcagcacgaagagctttctcaggaggtaccggcggcagagcaggaaaagccgttttcaactctgtagcaattataaaatggtattaagaaaccaaactatacaaaaaagaggaattctacagattcgattaaactcataagagaggaataataacaacttaccattacccaacagatcactgtttgaaggtttatcaagctgagacttgagactaccatttctctccttctttgaagtgtcagacccttcattgatatagaatttaaaagtaaactgttagaaagaagtgataatagaataacaagtgcgaatgaaactatgaaagatagctttagatttcttaccattagattgaggatctaactcgctcgcttgtgcacctgaaatgttctttaattgacaatcctgtttgacaagagcattgaaacataaatccctattgttagtgacaagactaaaaggaaattaaatttgacagagatcaagaaagaatctgtatataccgttaacgaacaaacgtcacttccaaatgagctacaggacttgaggcatatgcaaattatcctaccacatttacaggttgctaatgctttaggcgtcacagcaggagtattctttttgctctgcactttcactggcttggacgaaagagaacccttttcggagttctctttagctggtttcgtcaatcccaccccagaggaagctgatgttccagtgctgctccgtctagaacaatcacgttcaactggctgtctcttataaccttctctaacttcattccaggataacctcaaaacctttttcttcatgagtgattcccatctaacctcaaaaatctcattaatctcctttgcaatcgtgtgaacctcattccacagaggattataatgcatcgcattggcaaaagttaaccgaacatccgctgcaaactcatcagcattactgtagacattcttcaaaagtttcgatttgacagtgcctaaatccattggcttttgtatgacattgaagtaatcaggaatctccattttaacaggatcaacaggctccttaaagagccatccaccacggtgctccatcaaaaaacgtaacaatgccaaacattgactagaccaatcacaatccagcctctgcttcttcttaggttgaacttcatctagctctttaggcccaccacgcttctttgatttctccgaggattgagataaatcttcagtcactacatgctcaattttcttcgaactatcagacaacgtttggaatgttctgacagaaccttgaggaccaaactttatcttaatattgggtatcgcaaccattcttacaagaacaaataaaaacctgtaagcaaacataaaaagcgactgaaattagggtttatctacgcgacatcacaagactcgaaattagggtttatacgtcaaaacgaacaaatcgacaaaacaatcagatacccaacaaaattccgactaaataccgactaatttcgttacaaatttctaacgatggaagaagatgaagaaggagtgaattagggtttatcaatttcgcgatcgattaacaaaaaaacttgaaaaaggtactttgagaaacgaattcaatgaaatatatagcgaaaagagtattattttacagagataaaagcttaccagaggaagaatcaatggaacagtatgagagattttggagtatcgagtgtgagagtcagagtgaggaggaggaggaagccaaagcggcgatagaagtttcttttttcttattgagggtttgtgtgttaaaaatacttgagataaaacgcgtattttgtggttaaaaacacttatatatttcactattttgaaaatactacttaaaattatctcaaacgatgtcaaaattaaaatatgacaacaaaatctgttgaataaaaagtgatttaataaaaaaaagctttctttaataaattatttcctatttttttttaataatatatacacggatttttttctctttttttctttacaagtagcggtatttctcgtactacttttttaccgttaattttttctcgtatcatattttttatactcactaaatcttaaaactttgcgaacctcatacttgaatttctttttcttctctttttcttataaacctgttttttacgtaccataaaccattgatggtttctaaacatcgacaattttaccttcaaccaatttttttttagatcgttaagatctcttttaatttaccaaaaatgcggattgagaatgaatggtggtcaaaaaaacaactcttttataaaatatcagcaaacaacaactcaatgataggataagcctaagaatactatttataataacatctcgaaaccctaaatttttttaataatatagattatttaattaaaagataattacataagatatttggataatttcgaaatatcatatttttaggttgccaaaataagacctactctttatattagattaggtctaccatcaaattctttttgcaaatagaaacaggaaaattctaacaacttaatattttctttaaaaacttatctcaagccaaaatccaacgatatctatcgatatggtattatcaatcaaaagattaatattgcataaatgttttgataattttgttaacaatagaataagtgtgaaattatgaaattaactggattctaattctatcccttgtaacttgggaagggtgttaagtgttaacacactcggtaaatcactcatggactttgaattttatatttgggcccataatggatcaatcgtaaacccatcaaagaagctcaaaacatctaattttattccatttttggcacctcaaaatatataaacatttatattattgcgaaatttccgatc

SEQ ID NO: 2754 - DNA, 3000 bp, Unknown
  misc_feature (1)..( 3000): cDNA_ID_3069556_gDNA_ID_1620587_Annot_ID_161329 3000 nt of promoter + ATG
attctcactctaccaaaataataaggtaacactttcatagaacgagaacctatgttaccgtcaactcaagtaactattttgagctttttgccacttggatttctcaattacgaacaaaatcaaaccaacaaaaatgattttacagattaatacataataacgcttcagtatcttttttctttgacaacatgcattatctgagtttaaatttggttagtactacatcgataatttacaagtacctatgctaatagtcaaaattcaaattaaaaatctaatatccgaataaatggaaatcacgtatatataaccaattacaaatagtttataaaaattcaacctttcgtgaatgattttgctatgtatagactaaaaccgtgtcaaaccaaatatattagttggcctactgttccaccaatatggatgtcgggacataccataccatccctttctacatttggtatgttttcacatttcttttcatgggaagactaagaactggattacattttatttttaatataaattagatattttatgacctctaagtaatagttgaaacctggattctatcgaggatgatcgatctttcttttctattatattttttgttacaatttttggttttacttcttaaaagaaatgacttacaaaaacagagcatcaaactttcgggtttggcaactctggtttttagcaattaaaacaacaaaattaccgagtgaaagagtctcaaaaccacgaaaagaaatgtctcgcagagtaattgttgcgtattactcggtcaacttgtttcaacaaataacacagaagattcggttcttacgttcttgccattaggtgtaactataacagcttgggttgcaataagacgaaggatggattattggttatcatgtcgaggagactcgaggcaagttgagagtcccatgatgtggcatctcaatcatgatgtgcaccatcgtcacaattaagtcatagctattgggacaacgttgaaacaatttgtctcttgttttcacatatattttacaaagagggaaagtgttatcttatctccaacaattcccaaagagcataaacgggagaggaggggtaatcgattcaaacaggcgattcacatggtgaaagcatgttttgggactgaatccgagaaccatacttgatgataccaagggatcggacttccagaagtggctgcatgttgtttgtgagacatggattaatgtcaagtagcagaggaaaacctcaacattgtggatttaagcaccagaaaactgccaaccctcttcattagtagcgttagctaaacactagtcaatgttagaagctgtccataaggaataccagaaaaagcatatattaccgtctttaagcttgaaataaaaggaaccataaaccatttctccttaggtttaggagttgttgccacatggagagctccctaggctcttcttcattagtggccaaaaacatctccatttctttttttctttttttaagttaactatgaaattttaagattatgtgacgtatcattcgagaagtcatatggtttatgttgactgcattagctaataaaactctacttaagattcatgttagtgatgtggaaattgagtcatcgtgtataaaggcatcccttttccgaatgctatgaaaaaacctaaattgatccaactaaatgggaaaccatgaactgcaactttatattatcgggatattttaggcgaaataataaactaaactcgagaatatgaagttactatgtaattccaaaattgttaaagaagaaactttatatctcaagcatatgacaactaacttctatataagtggctctttggtcgttcttaaagacatgaacatataaacaaattagaaaatgttaaaaatatgttttggtccgattaaagcagccgcgggtccactagcttgttccgactcaaatagttttcgttatcactttcttctctccatttttttcatacgacataaaagtgatatagttacactaaaaagttgttttgtcctacgcatagtgacgtgtaacaatattttaaaactcaatatcacagtaatatatgactgggaaagttacaacttgaggtgtaaaagttgcacacattaacatatctataggctatagcattggtacattttaaaaaactatagcattttttttacaaaagattacattgaattattagtaaatatataatatacataaaaactgattatgttgtaaatcacataataattgtatgattgaagattgaaatgataagcctattatcgaaaataaaattagtcaaggagaaaactttgaaagatatatgaatgagttgttaattgcttgtgcataagtgtgaacatgtaaataaacttttgaatctaggtaggtccatttactttggaattgttacatagaacacttcagacaagttatgtcttaatcactttatcggtcacccataattttgtaaaaaataaaagccacattctaacaaacttttataattccattttacatttatatacaaatcaatattctaccaactttgtgctataaatattcatcacaccacaaccattcaacactctaccaacctcttctaatttctacaatcactctcttaactctttgctaagcacttcttgttaggaaaaatcattccttaatcactctcgaagctttcacaccaatattacttccttactacatctcttcattttaaagatttgttagttactttttttttttgttattgtacgaaataatttgttttctttcagacaatgttcttgtcacacaaagaatacaatcgacttgacttgcaattttttctaaacaacaaatccagcatcgagaaaagtttctatttttggattttccaaatattaacagttatagcttcgtgacttcaagaaatatccatttcaagattatttaacctttttttgtctagcaagtcatcgtattctactttgttgttgcaa

SEQ ID NO: 2755 - DNA, 3000 bp, Unknown
  misc_feature (1)..( 3000): cDNA_ID_2170848_gDNA_ID_1620587_Annot_ID_161326 3000 nt of promoter + ATG
agagatataatctctcgtaagattatatgattttggtagtaatctctctttcaagagatcataaaaaaatatcttgtaaacactaaaccaaagagatataatctctagtaagttaatatgattttggtagtaatctctctttcaagagatcataaaaaaagatcttttacaagatacattccgcatcgaacaacattttctatacgtggtttcacgcacaaaggtcgctcactagctggagtaatgtggtttggcaaaattatgtcagtgagcaacttcaccaggagaccatataactgcattaccatttcctcaaagcccctatcccaaaaatagctgtaaattaacacggtggagtaaatatgttgggacaaatattgcatgaaaccaaaaaaattcataatttaccataaaaattcttttaaaaaaaatctgagaccttaattttttcgacaatccaaacacaacagagacagaagtaatgttttagtatgggcatttttgttgttagcaacgctttgtcatgtaaacttttgctacaatgatcttcatggatgtgtgaaacagaggctgatttggtaaacctttttcaggtatcccacgcctcttcaatgagccaaatttatgttttcacacaatggtgagtcttagttttccattcctaatgagtataactctcttatgttcattgatctgatactttttctattatgatgtattgatgttcaaagataatcccacaatgtcttcattaccaaagctgatatttctttggacgtgagaaataaaagatcgccgacatttctactgaacacgcttcttgcagatcttattcagtaccggtaaattctgttgtgtagttctctagagaatagtaattttcttgaccatgcatctaatgagaataaggagtttaggttaatactaatatcattgtgtatatacttgtctcttctattggggaagcaggtgagaccttacattttagatcttggcagcaccaacaaggcctacattagtgagagtgttgaattgcatctcttcttaattgttttgttttcgtggtttagataaaacgtacgttagtagtgacctttgtttttcttttttcagaaaatacatattgaaccacaacgctactatgaactttttgagaaacaggattataattaagataaaagaattaaaaaagtgtgaaggaattaaaattttaatttcaatgaaaataaggggccaagttgaaatatatagaatatacaaaaaagaaattgtacaactattttccttttgtatgaaaataaattagttttttcttttagcaaaaaattagttcatgtatttgcattgcatcaactaaaatagttatattaaaaaaaggatttttgtgtagctgtgatatttggaatagaaaatccagaataataatatcgaaaattgtttgctttatccccctttcttttgtagaaattctcatatgattagtggatgattcggtccaagtactatcatttaaggatctgtgtagtattaaaatctcgaaatctctattcgttattaactttgtcggtgaaggggttgatatataataaaccgaagactttttgtgtgaaaagaatcatgtaataacggtacttattcattttgtacttatactaaaataaataccgattatgttggtggtagacttctaaattttaattagctttttaaaaagacccttaatttttaataaaattgatggaaagaggaatagttactttctatcttcggtaaaattcaggacccaagaaggtcgaggcacgtgccccatgatagacttgtcatgtgatgtgacctattttctttgtccaacaattttttaaaacaaattgtcataggctagaagtcgtcaaaagttaataagcaaaaaacgcaatatttcaaaaataaaaaatttaacaagaatgaatgacacaaacctaatcgtcttgacattttatctcatatatcaataatgctcaatcgagtgtaaatactttttttacatagtaaaaggcgaataagagagcagatcatgtagcaattattttcactattattgttattgtgttgttgactttgatttttagtttttaatagcagggtacaaatttgtaccttcaattatgtcaccaacgagtgtttgagataagattagacaatagtaaacacaaaattgatgtaagctatttaacatgtttattgaactgtaaataattatatctgttttaatatattttttaactattttttttcttaattgatattttattgtattaacactccttcttattaactttgcaaaataaactgtcatcttgtaaattattaccaaatcttaacactattattattgactttagaatctaagatatacctaaataatttcttaaggccaaaaaaaaaattatcatctttttatttaagttaatctaagatataaacattaagagaaagttgcaaaattaaagaaaaaatatctatctttacctggatacaaaacttatacttttggataattcatatgaaagtctctcttctaatgtagtaaaaacttctacatttcacagctaaaaactgaaacccaaatttaaaatttcgtgtatagtaccgaggaaaaaaagtatttgcaagcaaaatctagagcagaaaaatttaaagatcttttgcttcacatgactctattgtttttttcttacctctattttttcaagtctgcagctttttgaagctatatttttcagatctttcactctctctctagctacttctttttgtctttaagttttcaaattttattaaatttttatattctactgcctcctcagcttctctcacaaagcacaaatccaagccccaaatcaaatcccaccattgttttattacctcaatccaagaacactagacacaacaaaaatctctgtttcttatccaaatttctgatctttgtggagaacaatattttgattggatgtgagacaa

SEQ ID NO: 2756 - DNA, 3000 bp, Unknown
  misc_feature (1)..( 3000): cDNA_ID_2171070_gDNA_ID_1620588_Annot_ID_161338 3000 nt of promoter + ATG
attgtaaacgctgtcacaaaaaaaaaaaatgtaaatcaaaatatatcatatcatgccatttctttccatcttaccctttgtgttttttctaaaatgtttcaggattaactgaataaaatatacaacgagctgcacacttataattaattaacatttttattcacacctactaagttgaccaatctggtgagagagagactctgacagccgtaacagatgttacgtagtggttcaaagaatcattaatgttaacgtgaaacgttattcacgtagtggtttaatcatgcacatgataacgtgtttcacgttgcctatatattcatcggtcaaaacaaaatatgaggaaattttcttccaaaaatgataaaaaattgttaacaaaatttagaaatcgtgggcccagaaaatcttgaagtataattttgtttctccaagttaaccagtcataagttgtagtatatatagtttcgttttttgaaaaagggtttactaaactactgatttctttactacctaaaatcatatatttgatcatgcaaatggtctcgtaaaaacaactggatattaaatacataataaaaatagcacgatttatttttattaattttaaaatgaatgttaatttcaaaattatgaatatggagaattttaattttgaaataaatttctgcaaagaaaaaaatgaatgttaatttcatttagttaataaggggtgattgggtttgtaaataatttataaaatgtttagccagctcaaaggtctattacttttggattggaaccaacacttataaatgtttttttcttagaaagaaataacggtagaaaaatagcttatgagtgtatatggtaaattaaaagttcatgtgataatttagagctccatatgtaatatattagaatcttctgtaataataaaaattaatgtatataataaattggatgtctacatcacaagatatttgcaacgagaataaattacttctctcgtaatagttaaatgaagttatatgcataatcagattaaaacatgataagattttcttaaatgaagttaaatgcaaaatcagattatttactgacaatacgtcacatctaccactttcttgattttaagttatcatttcttatagtttactcaatacaacgagctgcacacatacaaatttttaattcattaacattttaatccacacaaactcagttgaccaatttggaaaacaaaattcttgataatattttaattgatatatacaaaaataacattaaataataatgtaattatctcagacaagatcacaagtttacagaataatgagttcatactctattttagactaaacatattttctagtacatgaacaaactaacaaaatcgggaaaattcatatgatgataatgtttcaattttaaatgattaaagttcattttcaatctttgttttcatgatactgttggttagaacatcttcatcctttagatactcaaaaggaatattttaccagccataaaatattattattttaatatatttcaaataaataattaaattttaatattaaaatcatattaaggtaattctttgtaagtataagaagtttctaaagaggaaccaattctaacttctcttttcttgtttttttttttctactattttaatacaaagaatctaaattagatactaataggggcaggggcagctactaagagcatcctcaatagaggactcttaattttttttctaaatacctctatattattattttaatataatatatttagatgattaattttttttttttttaaatgaaatcaatataaaagagacatgtgtctcattagactcttatataaatcttcaagtctcttagataagagtttttttctctctcttcctaatctacttttatatacataagaactatttaaaaaccctccattgaaaatgctctaagaactaagaagttctcttcttgatgtccatatatataaagaaattaattcacctaatctaagtgtcgtgaaattcttcaccattttcattgaacgtcattgccacagtcactgagcattgtcaccaatcgattctgccagatttaattagtttgttccaattgtatcatctacaacatcaatagaaaataaattagtaaaacggtgagggccaatgtacgaatttacctgattttattataatttctctatgtgtcttcgacaaagatgatttcttaaactataaaattagcatggtgattcattttggataggaattgtcaaactgaacatttcaggattgttagagtaaaagattttgtagatccctaaaacaatataataagtcatttaaatagttatctagggtcctaagtcaaaatgttttttttttgttatttagagtcctaaataataaatacagtataaagtatatattaatatgccataaatgaaagtttttttttagtgaattcgacgcctaatgataaaataacaaattacataaatgaatcatgcatgttgcaatattaagttacaagaatagaaacaataaatacttgttttctttcattttggttattttgacaagaaaattacattaatagttattaatttccacagtccacgtattgcaaaataattttgactttttttttgttggtatcgcaaatactctcacgtacaataatactttttttttcttaattaacattaataaatttgggaaggtgagaaaaaacaatgaaataaattttaatcatggaaaatcccacactcacactctctcacacagtcacacacatgccatttgttgcaaaatgaatgatgattagatttatgatggtctatatatatggttctagatagatctaataatcacacttcatcttgcaaaaatataattcacacaaggtctttgttttttttcggcatcacttttgtgtttgatttagtatataatctaatcaagtcaaattattatgtattatagggactttaaacatg

SEQ ID NO: 2757 - DNA, 3000 bp, Unknown
  misc_feature (1)..( 3000): cDNA_ID_3069566_gDNA_ID_1620588_Annot_ID_161352 3000 nt of promoter + ATG
aattctcttcttgtatatttgatatattttgatgattatcatttatcagagcagccgtttgaatatgaattctcctgttcgttataaattattgtaacaaagacttaaagagtgatccagcttcatctctttatccaccacaaatgctatttccgtcacataaaaataccaaaaaaagaaaaaaaaaaagagtgaaaatctaagtgaaaacagatcacgatcgagttagataagaatagagagatgcaaaaataaaaatagaatgatatttgcgagacgacacgtaaacaataaaaagttacggtaaaaagttacggtaagatccacctcgctaatgtctatgtataaccagaactagaatctctattgggagtttctagaggagagactctctattaaaacaaaataaaaaatttagaaaaaggaggagagagaacagagacgtttttcaacgtgagaaactttaagaaactcatttctacttttattttgttctgattggttcaaataataattaaaaaattaaacaataaaaataataataaaatttatattattttataaaattgaatttctcagtgatggagatggtcttaataaccacgattctacgttcccctcgaggaaagttgtcacctaaaaaataatttattatgttaatttatactttatataacttaaattctaaggttgatttaaactgttttatatcttctgttctcatttctttatgccgactcgttcataattatttcttacttaaaggctaaaaaaaaagattatgttggtatgagcccacatcactctatatctatctagaattggctctgatatcattgtaaaatcatgactatcaaattgtatcatcatatatctgttggctcccaagcccatggaaattgaaccccactctcgtttgacgggcattgagcaaatttaggagtgtcgaaagacttctttactaacttaatttgcaaatcatcataaatttttcctttgatgctagttcatgttttcaccttacatacacacaattagaatagctgcaaacgcacgtgcatgaaattagctgaaccttttaaggtatcgcgatcccgcagaatatgtagctaagcaatgaattcagaaattaaaatctagctcagaagaaaacaaaatggctgttttttttttttggtttttatctaaaggattaaacaatcaaatatgagttttgatgtttttattggattctaaaactcgagacatttttttataaaggatatactttagcatgaagcatcaattatatatctctaagatcacttctcgtaagccttgctcaatttctaccatgcttgacattgacttatacaacaccagggctcgctaaacctagttacctgattacctgaaccacttgaatcatgttatcttctaataacctggtttaaccatggctcaacccatcttgtcatgtccgaccatttctttaattttgcttgatatccttgattgtttttgcccatctgtccttaggtagtttagaacatttattgtccttgagactaagtcttcatttcgaccacttttctcgtcaattattaaatcataaaagatcatgtttttattttatttttttgtcaaacaaatttgtattcacttaaagcctcataagaggaaagttcatacaaactaaaactgaaataatacaatggcaataaagataacgataaaggctccatgagttttctaaagagatgctcaacttagagaagcttgcaatgtttgaaaagtcttttgaaaccatagcggattcgaccatggagatgaactccgcgaaatcctcgaccaactggtggtcataaacagctcgcgctaataacgcatacgagcttttggtacaatgctctacggaggaggctgcgagataagaaatattgaagaagcttcggtaaccatcactccttggaggtatggttataatgccgatcttcttcaagcttgtagatgcttggtaattacccctgaaactgagaatgtgcacttgagagagcttggtaatcagaagaggcttagacaaaatgtttgagaagtttcggtaaccatcgctccttggagacgggatcataatgccgatcttcttcaaacattcgggaaactttagcttttgagttgtctcaataatcgtgtccgagagagtttcgattactatgcatagtatactacattaaaagatcatgctttaaacagctaattaatgacgccgcatgttatcacgttttcagtttgttttttaagtttcatggtgtccaaccaagtttcgtaatatgttgcttgtttgatccacatataacgaaaaatacctaaaacatagtatataaataaatataacagttaattgatattttaataaaataatagaactaattttccaaattcttatatcaatctttcatttacagttatttttatttttctaattcttgaatcaatgtacttaattataatattttcttacggaatcagatttaaatttgaataccaactattgtaaattttgcgtccaaaacatcaaaaatatcctaaaattaaattccagaatatctaatctctttttgccgcaatgccagatcgtagacgtgaaagcttcgatgtctctaacctataaattaacaaatattattttcaatatcattgaacaaacgaaatttttgagctaaaataattaaacaattgttacccatgtgagcaatgagggatgctcctacattttttattttatcttttggtttggtcaacttctgtgttactatcagttatattttttaaaactcccgataacaattaaaatttatttaaattcttcagcaaatacacactattaattgtcttactgaatgcttagctgtgtccaacctttaaaaaatgcaatttgttttcaactctttctttatatataaacagaaactaacgttgtaagagatttataagttcacaagtcataaatacgaagcaatg

SEQ ID NO: 2758 - DNA, 3000 bp, Unknown
  misc_feature (1)..( 3000): cDNA_ID_3069588_gDNA_ID_1620588_Annot_ID_161339 3000 nt of promoter + ATG
caactttttcagccttcatcaatgttatgcatccctttatgacctttaaaatcccattcttggatttaaaccagcatcccttgttctcaagtgtccctaaggatatgagattctttgacatgcccggaatatacatgacgttagtcaacaagactgttgttccatcgtcattcaagatcctcacacttccaatccctttaacctgtaaagtagtgtcatttgccattgacacatttccagattcagaaaataccaagtcctcaaaccattcttttcttgagctcatatgagaagtacaacctgtgtcacaaatccattcttcagagcttcctttacttgctcgagcagcagcttctgaaaccatgaacacagacccaccagaaacaatactttgcgctgatgattcttcatatctaactgacttcttccttgacttgttctttttctcttggaagcactctgtcttgacatgtcccttttgtccacatctccaacatggacctttcttttctcttgcctcagatctgaccttctcttttcccttagcttgttcttctctgtaatctgacctttctctttcccttaaagacaaacgcttctcttcttcctctgtttgtctttctatttgagcaacctcaagctctttcttgtatattgcagtcattactctacccaaagttaagggttcctcgcaataatctaaagagtacttaagctgttcaagctttctagggagagacaaaagcaacatgaatgctttgtcttcatcagacacataaacatctaacttttctagatcttcaactatcctgaagaaatcttctatattctcttctacagccttgttttcactcatcttaaactcaaagagcttccttttaagagatatacgacttgatagtggatcagacaagtagagtttatctagaacacttatcatacctgcagcagtctcctctgttctgattcttcttaggatattgtctgcaacactaagtatgataacagatctggccttgttctccttctcttctcgtgaatggtctttcttgtgttcttctcttcttctttctgagcttgaagacacgaccttcaccctttctgtctcaacagcttccttcttttcttctttctcctttagagcatctgagatacccataacttcaagctgagcaagaagctttcttttccacagtgtgtaatctcctctcccgtcgaatctttcgaatctaggttcttgagaggtttcctccttaacctggagctctgataccattttgtggagattttgggtgttaaagtagcgacctttatcaccataaacccctctctttctctccattacactcgtgtgaagaaacttagaaagaaagacttgaagcagagtagaaactgagaaattgcagagaaagtaaagtgcaagagagagttttacgtgttcgggtctcagtgtgaaaccctactcacgccgggaaacttattgtcccggaatccactagaatcagtccttatatacagttggctcttactagagcttgtacatacacaactcattaactacattcaaccaaacacgccattccatctcatctactctctgcatctttgattctttgtcccctgtttttcatgttttgttcgaacacttctacaaagaacaaaacgacacagaccttttaaaggaaacaatgctgcaggcgtgcttcctcttcaacgacttgtacgagatgggcttcttgcgtatgggcctgaagttttctaactttgaatcaaaccttctgattctttgagagtcttctcttgccttctcttctcattcatgaaactcgaagacaaactctcacagtctatattcgttgtttatgttttaagttttaactaaaaatgttaaaagcgttcagtcaaggtttaggtttggtttgggcctagtcttaagatttttgtttcatgaatataaaagaaagaataaaccaaaagtaaaacctacattcaaaaaaaaaaaacgatgaaaagtccatacttgtcgtgtacgattaaacccaatgacgtgttcgtattaaaattttaaactgaaccaccaattttaaaccttacttgcgctgcatcaattttatcaacacatcaatatttcttaacattaggaaattaacttattaaacagaaattattttctatataattcatgtatgactaatcccaagatgctcactctttggtctttagtcttttacatgctttaatctttccatctttgtctctatctcgtggatatggaagaagacaaaattcttacggagacccttctatctgcggcggaagaaccacctgctcttcctttctcatccgtggaagatattcctccgatcaccaccgttggtggcttcgtcaaggagttcaacgtggaggtcaaaaagctatggtacttggcagggccagccattttcatgtctataacccaatattctctcggcgctgctactcaggtcttcgccggacacatcagcaccatcgctctcgcagcggtctccgttgaaaactcggtcatcgctggattctcatttggtgtcatggtaaattaatatccccttgttgacctttttggtttgcgtttatcattcaaatgtgctgaatttaatactattagtttgggagatatacctctaaatcattcaaaatgttttttttttttaaaccattcaaaatgttttgagctagttctaaaatatcattttcaataatataaatcaaaatgttgcaaaaaaagatatttaaaagatcaaaaataaatatgatagtaaatgtataacacaaacaaaaaaaatgtaagcacaaacgccaaaaaaaaagaacgaaatcttgtgcgatttttcaatttgtagtaagattataatagtttttattaccatataaaccatatttataagtaagatattctaagaaactttttttttttgagttgtaataataattgtgaatgtgaccattaattagcttggaatg

SEQ ID NO: 2759 - DNA, 3000 bp, Unknown
  misc_feature (1)..( 3000): cDNA_ID_2171107_gDNA_ID_1620588_Annot_ID_161350 3000 nt of promoter + ATG
cgcaacacacacatatttacaagtgcttttgtttcctttgacaattgaagttactcaattactgaaagaaaaatggaaaatggcttgctgtatcaccaacatttacggtatcaccaacatattagctttcagtttttttttctttttcttttagtttttgtgaatgatttcatattgtttaatgtttctaaaatggttatattgagttttacttacatgtttttgttttgttctaaatgtaaatcgagaaatttttgcatctttttttttttttttgtagtagtaggcatcaaatgcactttaaaccataaatggatatgaaagaggaagcaaaacgggcaagagtctcaaccttatcaatttgtaagtttttgtaaatgattctacattgtttaaagtttctaaaatggttatattgagtcttacttatatatttttgttagttgttttttttggtaggcatcaaatacactttaaaccattttttggatatgaaaaaaaagctagcatactatggatagtagaatcaattgcaagagaaagcaagaatcaaagttttgatcattcataaaatacaaaaattgaggcaagtgttttagttagtctcaaaaattgataataacatgtatgaccacaataattatagaactatttatttgtctttccaaattaaatattttgaattaccccttaaaataactagaatatttattatctttgttaattaaattaaattcaaattatatataccttttatttatattttaaaaattttaaatcaaaattatcattcatttacccaatatcgctataaatagttaccaaattttgttgacttatatgctctgtaaaacaaaacttatttttttttctgatttttagtataaggaagctcaattcttagtttctgaagaaaacatgatcaacattagttcacacatattaggaaattgtttaattgtttttttatcattacttacatttaatgacctttccaatcattgttgttaaacctataattggtttctaaattcttttatatgagtgacatattaaattttaattttttttatataagagtatttgagaagtcatcatgtacagtcttttatctatatagacactatatccttaattatatttaaaatttaggttgtttaattttttctatcatttatttaatgaccttttcaataattgttttaaaacctataagtcaaaattattgaaaggccctataatacaaattacaataatctatgttatatacacattaaaaaacaatttaggaccaaataatacattataaaagactttattatattgatgcaaaaaaattagattctttaatatgagtcacaaattgaaatgatttaatatttatgttttccaagtttatcttttcttaaattttaagattttttatatgagagtatatgagaagccatcatgtgcggtcttttatctatatacattgtatccttaattatattttaaatttaggtttaattatatattttatcaagattaaataaaatgtatctttttacaaaatatgagacaaacattttttctatatttttctctagattgggagtgtagttacagttacttttgggtaaacggttaatgtatagtggtgtgcttgacatgctaaaaatgtgtagaaatttcttcagtatatattatttattttgaaagtaaaaatgtgatgatctcatattgacatgctaattgaaatttaattttatatttattaataattattatttacaccacataattcatataaattagaacaaaagaaaaaaaaatgtagtgagttcaaaatcaacaaaacaacacttatttcaagctagccatattccataatgaaattgaaatttatatttaaaataaaattaatttgctctctttaattgaaagtaattccaaatatttttttgagagctttacaaattattcattataaacaacaaatttatgtaatatgatatacacaataatgatttttttaaaagaactaaacttattttaatatatataaattcaaaaaaattatttaaacaaaataacaatgtaaggttcataatctaaaattaaagtttagaattaagcttttacaataatatttttaaactcataacaacaacaaagaaaaaaacttaaaagtaaacaaaacaatatgaaatatgagaatggaaataaattgtgggagttaatttttaatttattgtgtgttgaataaagtagagtggaaaaatataattgatacatatttttatgatttcagttttatattaaactgtgtgttcaatttttattatttattaagaattttaaaaaaaaaacttatattgccaagtggaccaataaggaaagagtgaaaccttacttttatatatacatgattcctaattttttggtttcattttttaaaggttacctaaagtatagctattattgtggtcattacatcacatataaataataacaattgttatataatcttaaattaattatatataaaaattatggtttcaatttatcaaagcttataacatttaacttagagatatattttccctacatcgcatttggctaaacaaatttgcatgttttggtggatcaactacacaaatattgcagtcgtaaaacatcaactctatctttctcggctaccgagtaaaattttattctatctgaagccatgactaatacaattaatatcgttaatttaaacaattatagtatttattactaatataaaataaaattcgtataatgagattatcttaatagaattataaaataaactccttctataagaataatcctttttcttttagaatatattaacaaattggattaggttaacatacaatacagatatccagagacttatatatataggcaatagggtttaacaatggagcaaacccacattataaagttttcttgcgcatctttagcatccaataaattattgaagaagccatg

SEQ ID NO: 2760 - DNA, 3000 bp, Unknown
  misc_feature (1)..( 3000): cDNA_ID_1537188_gDNA_ID_1620589_Annot_ID_161363 3000 nt of promoter + ATG
tgcatcttgtattttaattaattaatactatttttaaaaaatcaatcaaagcatgaatactcatggaaaaaaatctatgatcaagtccttagttgagtgattttcacaatttaagggtcggaaaaatattttataacgtctatatcaatatgtgatctgcttttatacaaaaaaaatatataatggattagttaaaacatggtggagtcaattatattaaaacattactgataaatatgctttttaactcaaacatagcaaatcaaaaatagtaaaccttcacatacaaatatttatacatttataaacgcatgaatatacatttttataaatattaaaaggtttctgagtttaattcatgattaattataactaaagatactaaaattcataagtagattgaagtagctcaattgaacaaatctcagcaaaatacatagtatatatgagatgtaaattcgattgttcaaatgtcttttcattaggacctgtgtaaaaagttttcgagagaagaattatagcgaggtttgtttcaagtttcaacaagaaaaaacagaaaagaatcatgtatataaatcaatcaagtactgataatatagaagtattattggaaacaaacaagaagagaagtaaattcaaagacaaaatgatttagaattcttggagaaggaaaaagaagaagacagcgtggagaaagagcccagaatgttgaacgtcgtgtgggcttcactctgcaccaccaccccaaaaccctagttcataccctatcctataatttatactcaaaattttctcatttcttctattatttatcaccattcatatggaagtatatatttaatgaagaattttcggatctatagatcattatatgtaaaatcagtttttgataaaacatgtgacagtttcacaaaaatagttcatctttcacaaaaatagtactcgaatccggtagcattttagtatcctactatttagtttttccactccttttcattatatatataatgatataagtctttttacctctttttcataagtctttttaactctttttttctttaaaaatgattatatgcacatctacttgataaactggcggatggtaaacttgagttaggtttgagaattttcactaattattttaggatttgaatcttctttagtatgagacaattaagctaacacactcgaagatatattcagatcataatcaaaatttatccgttggatatgtatgaatagattaaataaaagagagaatctcttcggtgcacttgagacaaatctataacatagaaaatcttgattagattaaaaactagattaaagaaggaaagaaaaacaagaaagtgggtttggctatacgaaacgagtgggattattaatgattaaaagtaaaagtctttttggtctctggtcggtcgacaatccgtgtgtcctgtggtcagtgtttgttttttattcttttggttaattttcgagtattattatgctttccactgaaaaaacaaaaacattaagcagccaaatgaaattcttttaacgcgttgtttcagaacctgatgaaaaaacaataatcatgacctctttcttcttcccctttaaatgcatgtcaaattgtgtaggagtgtttgattatataaattaaatctactttagtcttctcttctttgtagaattgtagagtcgtggtataaactcgaaaatttcttattatacttatagaaattaggcagacgaaatgctcttgatttgcttacaatcttagattaggtttaacccaagataaaaaaaaactttgttttgatgaagaaaaacaccttagttacaattttggacatcatcttttattttcacagttagcatctgagacttttttttcttttcttaaatagagttcttagacaatatcttttgggtccctgatcatgtcaaatgccaaaaaaataaataagtatacatgattgtgtctatttgaccattctaacttctaaaagtttcaaatgaaataactttgtcaactattatttttgcctatgaattaggtgctgaccagaatcatcttgctaaaatcatgattttctactattgcatattattcttgatcgcatttcacagatcttaatatatacgaaaataactgtatatattatcaactgttacgattaatatataaccatgcatatcgaaatattttgaattagtattttttttgctaaataatattttgatatagtggtggcgtggtattcctcatttacaaatcgcatgaactttatcctaaatacgattaacttaagtagaaaaggcacaaaaatcttctattcattaacatgaaatcaattcttaagaacataaataaataataatattcataggaagccaaatccatcagagaaatccacaagatgatgacagctccccatttagaagtcgtaaaagaaaagcaaagaagatgtgcagcacttgcagtttcatttgttttgttagatataccagaaaaaaaaaaagagtggtcccataaaaacctgtaatatataacattttaatcaaagaaaatgatagatttttttattaaacaggaaaaaccactaacttttaattaaaaaatttggaatacagcaatacatcaaaaatccattaacggtacattatagttgaaaataaattcaggttacataatattttttgcgtaatcactatactattctgccattttatatggaactaagttcatacgttatttctcacaattctccttgatgtgatcaaagataatggcggtctgattgtataacccggtgaaaaaggttttttggaaagaattctttaatattaaaatatcaaataaattttgtttaaaaattaaggacacattatatagcactatatatacacatgtgtatgcattatcaaatgggatgtttgtgaccttttgtctcttcttctctaaaattctctttctcccaaaaactaaaaaaccaaaaaaaccaaaaa

SEQ ID NO: 2761 - DNA, 3000 bp, Unknown
  misc_feature (1)..( 3000): cDNA_ID_3069616_gDNA_ID_1620589_Annot_ID_161381 3000 nt of promoter + ATG
ccagagttcatgagaaaaatagtctgtcagataatattgatccaataaaaccatgcacatgtcagttttcccaaaatatttacatgtgtagtaacaacttttgtaattaaaaacgtcaccaaatgaaacgttaataatgacgaatactttaccacatatttgttctcgatggagaggagataactatggtcccatgaagaaggttgatagttgcccgagcgtcgacggaggtcaagaggattagcatccggcatcgtttttgtcatggatttggatatgaaacgacgaggacgttgaagacgaaaattatggatacatgcattttggtaaataggagctgaacctatacacaaagtagccattgaattagtataagattctcttctttctggctgaatatattggagaacacatacgtttataactttatatagacagagtcagaatgatgacttagaacactatttcggtacatgattttgtttctgttttttttttttttcaataggttgtccaatttggtttaacttgaagtttatttttgtgtatgtgccaactacaatatcttatttaccaaatttatttctattttcaccatataaaattataaatcatagtcaattatttaaagatatctattattatatctttatttacaagattaccagataaatagttatttttcaagtatattcaattaaatagtgtgacaaactttacccaattttgctgcatgtcaatactcttttcgcaatgtctaatatccactttttgtaactgaaatttatctaattaaaatcttctacatgattaaatatagaagttataaaaactgcgtacaaagattaagtgatggagacagttcaagtttgattacaagacagttcaatctgatggctatgagttttgttggcagacatgccaaaaaaaattaggttgtcgtcgatttcatttgttctttaggagaaaaacattgataatcgaagaaaaaaagtttgtaactccgttttaatgattcaaataacttatatgtgtagaggattttgaaaaaacaatttccatattattttaatacgaatttacgtgttggtttttaaatgttgtagagagatataattaaataatatagaagtaaacttatttgattcaacttaataaaaaaagttagtttgaaaaaaaggttatgtgattctcttgttttgtgatcgtaatgtacacaaaacggtttaagtatttttgcaaacaatatctatgattgatgagatatatcagtgattaactaataaaagtgagaaaaagaacaatatttggattcacagttcacacataatggtttaattcttttattaattttttttttttttctaaacaaccagaatcatacttcaatcaattcaaaaactcttttcaatttactcatttcagaactatgttatcctattgtaaaaaatatagttctaatgtatactcaataagccgtatgaaggaaaattataggctttattctcaaaatcacgctattgtatttttaaatttgataaaattcatcaaaaaaaatttaacaatatagtctacgctactgtgttttatatttgataaaattcatcaaaaattttagcaaaaatgaaaagcaaacaaataaaaactaactaacttactttcatcccaatgtagtagaaattcatgacatatgaagaatcattaaagaccttttagatccctttgaatttggcaggaattcgaagccacatcgtacatttgatatctccaatatatcacgaatcgtctagtttttttgtggattagtttggatatgtcttgttaggatatgtattatcttttcctttttcaataaaccctactgaatctagggttatgattccacaaaaagatctataagttttttctactccaaagacaattggttttggctcatgggattcttcccattagagagtatcatatgtattctgaagtgagtaaacaactttagaagatggcaaacaattttaatgtattgaaaaacaatatttaatcgctttaaccattttttgtttctccaaacgagtttttatttttgcgctaactaataaaaacttatttagatgaacaatgaatcttaatattgctatattaaaaaccattaaaagaatacatacgtataaaagaaatatctcttatattataagcatgtgatatttttgtacagaccataacaacataaataattatatagaatcccaagaaattggattacacgtatacacattacatacaacagaaatttaaatgtatctcgatacatttttatttttttaaaaggtataatttcttcaataatttacatatagagaaataagtcagttctctttgtatttggttctttcttgattgaatgaatacaagtattttgcacacaaaaaaaaaagagaaataacgtagaagaaataaattatgttttggtccacacttaaattatatgataagatattctaatgagattagaaaactatctacatgaataaatcatacgttccacaataattaaatgaaaataaataataaaattaaccaaaatagttgaaattgaatcttgcctacatgattcaatgttcttttaattttgaatttatttatttatttaactaagcctctagatataaagcaaagttatataaccatgattttggggttgttaaaagaagttgacgaaaattgaggaatgtcgaataataatgatgaaaaagatatttggcttagcacccataataatgatgtgactatccaatttcagtgtctcaccgaaacggcgttttataaggccgtgggccaatggcctgtttaaagccaactgtaatgtgtaattcgattcaattaaaacgacgtcgttgctttcaaatttagataaccaatacgctgccgttttagcaagtctctctcagataaataaaaaaaattctccgactaaacggtggataatgcagtgaagggacgacgatg

SEQ ID NO: 2762 - DNA, 3000 bp, Unknown
  misc_feature (1)..( 3000): cDNA_ID_2171213_gDNA_ID_1620589_Annot_ID_161383 3000 nt of promoter + ATG
ttccttgtcacatttccagcaatttcttcccattttaagatgaagatctgtcaaagtatcatttatttctatctcaaaatgatacgaaaccccaagtttttgcagatcatcgatgagctctaattgctcgagacggctcttcttctcatcatcaagcatgctcttcacttttttcttcaacacatctctagttattacttctgtttcactctgtatatacatacatatgtttaaacatgcacgtagtaacaacttgttaataaaagaattcataaataaaagtgaaacttaggtgcaacaataaaaaattatgaaaatatagtacaaaactttaccgcatatttattctcgatggagaggagataacaatggttccacggtgaaggttgatagtttccggagcgtcgactgagttcaacaagagtagtatccggcgtcgttttggtcatggacttgcatacgaaacggtgaggacgtcgaagacgaaaatggtgggtgagggtattttggtaaataagagctgaacttatacgtaaagttgccattgatttagtagactattctcttattcgtggctgaatacatgcactagacaacacatatggttatatagacaaacggtagaagaaaatattttatataattaggagatcaaaagatctaagggtgtaaaatatttttcaattaatagctaaaaaagcttttataatatattgaccgcaaaaatgcttaatctatatctgttacaatattttcaacttttatacattataatcatttcaacttttaaattattaaataatggtacaaccgtacaactaatctaactaaatctaaatgaaaaaaatatcatttaactcatcaattattatttttttgatgatttaaaacatgaactttggatctgataattgtacacatttgtataattgtcatttaaatcacacacttctttttctccaaaagctccttgtgtaattatacccacgaggccactatatgtatgtaaatttgatatcatagcttatttgattagataatgtccaagcctaaatgatttgtgtacctcgtgattctcgtgttatatttggtgacgttattatgtacaaaaaaattatactaatggccccttcaggtagaacagccattcgcacaaaaagtgaagtcaaacaaaatgtatcttctccaaattctaaatgttatgtgtatctcgtgatcgtcgtgttatgttggcaaacaaacatggcccttttaggtagagttagtcgtatggaaataaattctccattcgaagcttggagaaagtataaaataaagtatataatgttcacttggcttaacaatcgccactcgttcactgcacattatcttaatttatatcaaattactattgaaagataatagaagataacgtgcgtgtatctccaatatataagacgtcacaactcatcacttgctctgtcttattagaaggaagacaagaagagttctttgtgtcgtttgtttatgcatcaaattttgcagcagaaagaaaggatttgtggagtgatattaaatatcatcatgattcccctttgttctataacaaagcttggttaatatgtggagactttaatgagatattagaaggagaggaccattcactctatgaatcatctccattcgttctccaagggatgagagattttcaagacttaatcagacattgtgaattaacagatatgagctaccaaggccagagatacacatggtgtaacaagagaaaggaaggagtaatatgtaagaagctggatagggtactgattagcaagcaatggatgcaatagtatgaacagtcctacagcgtctttgaatcaggcggttgttcagatcacctaagatgtcgattctatattatggagcaggaacaacgagtcaagaggccttttaaatttataaatgctttaatttcgtattcggatttcagaagtgagacagaagagctttggaagacaactcagcctctctttcattctacctcagccatgcaccgcttatcaaaaaaattaaaaggtctgaagccacatttcagaaagatggggaagcagttacttggtgatatctcaaaaaaagcaaaagaagcctataaaactttatgtgaaaagcaagcagaaactatgacaaggccatcttcacaggcagtggtagctgaagcggacgcatatgagaagtggttaaggctgtcgggtattgaggaaagctaccttaggcaaaaagcaaaactgcattggatgaagataggagaccaaaataataaaactttctacaatgctgcaaagattcgggaggttcgtaacaatgttagagagattaagtgtgatgatggacatattgcatcaaatcagcagcaaataaaagcagaggcagttcgatacttcagagactttttaacgctcaaaccgccagactacgtggattggtcgcgggaggaactggaaactctactggattatagatgtgatgagaatgacaagacaagctcacactagaagtcactgcagaggaggtgcggaaagttctcttctcaatgccttcaaataaatccccaggccctgacggatatacttgtgagttctttaacgagacatggtcgatagtaggaaacgattttgtggtagccatccaatctttttttaagacaggcttcctacccaaaggagtaaactccactattttggccttgatacccaagagaaaagaagctgtgatgatgaaggactatagaccgatatcatgctgtaatgttctctataaggtgatatcgaagattcttgcaaacagactcaaaatcattcttcccaagttcatctcttcaaatcaatctgcctttgtgaaagatagactattaatgaaaaatctcctcctagcaacagagattataaaggattaccacaaggaaacagtttctcctcgatgtgccatgaaaattgacatatcaaaagcttttgactcagtccaatg

SEQ ID NO: 2763 - DNA, 3000 bp, Unknown
  misc_feature (1)..( 3000): cDNA_ID_2171209_gDNA_ID_1620589_Annot_ID_161382 3000 nt of promoter + ATG
ctcaggaactatgaatacgaatttttgaaggtattatcactcacaggagcgtaagggagaagaaagagccatagtatatacacagcttcactagtccatagaagataccgaacaattctccttatagaatcatcttcaacctctaccgtcgccgtctccggtttccggcgagcacagcataagaaggaactgtctcgtgttcgtaatttgaaacgattcgtagactgccatggattgtagcagcgatcgactgtggagatttctctactccgaagaaaatggcggcgaatttgtggcgatttgatttgggaactgtggagacggtgacggagatatgtcaacgtcggtgaggttatcagaatcatcgtcgtcccttcactgcattatccaccgtttagtcggagaattttttttatttatctgagagagacttgctaaaacggcagcgtattggttatctaaatttgaaagcaacgacgtcgttttaattgaatcgaattacacattacagttggctttaaacaggccattggcccacggccttataaaacgccgtttcggtgagacactgaaattggatagtcacatcattattatgggtgctaagccaaatatctttttcatcattattattcgacattcctcaattttcgtcaacttcttttaacaaccccaaaatcatggttatataactttgctttatatctagaggcttagttaaataaataaataaattcaaaattaaaagaacattgaatcatgtaggcaagattcaatttcaactattttggttaattttattatttattttcatttaattattgtggaacgtatgatttattcatgtagatagttttctaatctcattagaatatcttatcatataatttaagtgtggaccaaaacataatttatttcttctacgttatttctcttttttttttgtgtgcaaaatacttgtattcattcaatcaagaaagaaccaaatacaaagagaactgacttatttctctatatgtaaattattgaagaaattataccttttaaaaaaataaaaatgtatcgagatacatttaaatttctgttgtatgtaatgtgtatacgtgtaatccaatttcttgggattctatataattatttatgttgttatggtctgtacaaaaatatcacatgcttataatataagagatatttcttttatacgtatgtattcttttaatggtttttaatatagcaatattaagattcattgttcatctaaataagtttttattagttagcgcaaaaataaaaactcgtttggagaaacaaaaaatggttaaagcgattaaatattgtttttcaatacattaaaattgtttgccatcttctaaagttgtttactcacttcagaatacatatgatactctctaatgggaagaatcccatgagccaaaaccaattgtctttggagtagaaaaaacttatagatctttttgtggaatcataaccctagattcagtagggtttattgaaaaaggaaaagataatacatatcctaacaagacatatccaaactaatccacaaaaaaactagacgattcgtgatatattggagatatcaaatgtacgatgtggcttcgaattcctgccaaattcaaagggatctaaaaggtctttaatgattcttcatatgtcatgaatttctactacattgggatgaaagtaagttagttagtttttatttgtttgcttttcatttttgctaaaatttttgatgaattttatcaaatataaaacacagtagcgtagactatattgttaaattttttttgatgaattttatcaaatttaaaaatacaatagcgtgattttgagaataaagcctataattttccttcatacggcttattgagtatacattagaactatattttttacaataggataacatagttctgaaatgagtaaattgaaaagagtttttgaattgattgaagtatgattctggttgtttagaaaaaaaaaaaaaattaataaaagaattaaaccattatgtgtgaactgtgaatccaaatattgttctttttctcacttttattagttaatcactgatatatctcatcaatcatagatattgtttgcaaaaatacttaaaccgttttgtgtacattacgatcacaaaacaagagaatcacataacctttttttcaaactaactttttttattaagttgaatcaaataagtttacttctatattatttaattatatctctctacaacatttaaaaaccaacacgtaaattcgtattaaaataatatggaaattgttttttcaaaatcctctacacatataagttatttgaatcattaaaacggagttacaaactttttttcttcgattatcaatgtttttctcctaaagaacaaatgaaatcgacgacaacctaattttttttggcatgtctgccaacaaaactcatagccatcagattgaactgtcttgtaatcaaacttgaactgtctccatcacttaatctttgtacgcagtttttataacttctatatttaatcatgtagaagattttaattagataaatttcagttacaaaaagtggatattagacattgcgaaaagagtattgacatgcagcaaaattgggtaaagtttgtcacactatttaattgaatatacttgaaaaataactatttatctggtaatcttgtaaataaagatataataatagatatctttaaataattgactatgatttataattttatatggtgaaaatagaaataaatttggtaaataagatattgtagttggcacatacacaaaaataaacttcaagttaaaccaaattggacaacctattgaaaaaaaaaaaaaacagaaacaaaatcatgtaccgaaatagtgttctaagtcatcattctgactctgtctatataaagttataaacgtatgtgttctccaatatattcagccagaaagaagagaatcttatactaattca

SEQ ID NO: 2764 - DNA, 3000 bp, Unknown
  misc_feature (1)..( 3000): cDNA_ID_3069612_gDNA_ID_1620589_Annot_ID_161385 3000 nt of promoter + ATG
ttccaacaagggcaggaaatctgaggaggtcattcttcttgttagcagcgggagccctaagtagcgaactggaagagagccatactcgaaagggaattgttgtaggatctcatctctctggtgctcttgtaaaccagccatatataaggtggacttttgaagacttatctttagccccgagtgaatagcaaagtcttcaaacacttctaaagtattctcaatggattttttgtttccctcaataaacaccattaaatcatcagcaaaacagaggtgagttaagtttaacgtcttacaattcgggtggtagtctattcttttatcacttgcagccttgtctattttcttggacaaaacattcatgcatatgacgaacaatagggactaagagagcagccctgtctgaatcctctctcactaccaaaatagcctgcgagttcaccgttcacttgtaccgagaaagacgctgtagagatgcatacctttatccaattaatgtagactccggaaaatctagagcttgtagagttgtggtgagaaacccccattggactgagtcaaaagcttttgatatgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatca

SEQ ID NO: 2765 - DNA, 3000 bp, Unknown
  misc_feature (1)..( 3000): cDNA_ID_2991451_gDNA_ID_1620589_Annot_ID_161380 3000 nt of promoter + ATG
cttgattgaatgaatacaagtattttgcacacaaaaaaaaaagagaaataacgtagaagaaataaattatgttttggtccacacttaaattatatgataagatattctaatgagattagaaaactatctacatgaataaatcatacgttccacaataattaaatgaaaataaataataaaattaaccaaaatagttgaaattgaatcttgcctacatgattcaatgttcttttaattttgaatttatttatttatttaactaagcctctagatataaagcaaagttatataaccatgattttggggttgttaaaagaagttgacgaaaattgaggaatgtcgaataataatgatgaaaaagatatttggcttagcacccataataatgatgtgactatccaatttcagtgtctcaccgaaacggcgttttataaggccgtgggccaatggcctgtttaaagccaactgtaatgtgtaattcgattcaattaaaacgacgtcgttgctttcaaatttagataaccaatacgctgccgttttagcaagtctctctcagataaataaaaaaaattctccgactaaacggtggataatgcagtgaagggacgacgatgattctgataacctcaccgacgttgacatatctccgtcaccgtctccacagttcccaaatcaaatcgccacaaattcgccgccattttcttcggagtagagaaatctccacagtcgatcgctgctacaatccatggcagtctacgaatcgtttcaaattacgaacacgagacagttccttcttatgctgtgctcgccggaaaccggagacggcgacggtagaggttgaagatgattctataaggagaattgttcggtatcttctatggactagtgaagctgtgtatatactatggctctttcttctcccttacgctcctgtgagtgataataccttcaaaaattcgtattcatagttcctgagattgagacattgatatatctgtgtgaatgtttctaaggtttatgtagaatcaccacattgattaatcttgaaagtatttaggataattttaggaattgagaaccatttcaatttctctgcttgaatgttttgagaatctagtaggtttgttctttttgaatcatactcatagttcctgatatagccatagttctatgtggctactaatttatctatggattatgtgaatgtttggaaggtttatgtagcatcacattgatgaatcttcaaaagtaatttggattttggatgattttaggaatgagaactttttcaatttctctgcttgaatgctttgagaatcgaatagttttgttgttatcttcaacttattactgagatttgctcttctctctatagattatcatgatatgtgcttgtggttagcattatcttagattgtgtaatcttgtatggttgcttaattagaaaataatctctatgatcaacagggagatccagtttgggcaattagttcagagacagtgaattctcttttgggactttctctgaatttcttctttgtcttgcctcttacaaacgccggtatgttcagccttaagatatatcgatttcgtttacctgtttgatctttgatgaaagtttcttgcttatggactttgtgacagaacagctggtattcacttcttacaagctcctgttcttcacccggtttgtacctttgagctgaacaggtttttgtgtattagtgaaagtaaatcgttctgaaattgtttttttttttttaaattcaacagatggctgaagggttattcaactttgtaatagcttggacactcatgtttgctccattgctatacacagaccgaaagagaaatcgatacaaaagctctcttgacgtcttatggagtctcatgatgttccttacaaacagtaaatacaactttagtttttatttaagaagttcagtttctctggaaagcaaccctctaaactagattattggttctgttgatctcatgttgcaaacagcgtttctaatcccatacatggctttacggctcaatgacgctgacccagatgataaaccaagcaaaaggtctcaacttggtgaagtgatgaccaaaggtgcaccaatagttggtctgaccggagctacggtgtgtctgatatcagcattgtggtctctctacggtcgagcagatggtgatttcggtggaatcatggacagatggcagtatctgattggttatttgggatcggagagactagcttacgcgtttatatgggatatatgtctgtacacaatctttcagccatggttgattggagagaacctgcaaaatgtgaagaagaacaagattgaattggtgaagtatctaaggtttgttcctgtttttggtttacttgcatatcatttgtttctcaatctcgaagatgaatcaatttaatttgttagtatacacacatattgtcgttgtacttataacaaatgtaattatattatggaaattttgttatgtcatttttagaaaattctatcatttgtatcggtaatgttttttccacatttgaatttatatttcacgaaggaatagtgaaaactctataaaattggtaaattgcaagaaatgaatcgcaaaagtaaagtcctgaccgaaacagcataaacgtcgtgggccaaaaggcccgttaaagcccatttaagaagggtatggttccaattaaataaagacgtcgtcgtttgctctcaataaagaaaagagacatttcgccattagatcctcttttttttcttcgtaggtcgaacgaaattttgtgtttcgttgaggagaaaattgagccgtgtttgtgttgaggtaagacccaatttccgatttgattgttggtctgtttatcttttgatagaaatggtaatttagattcgcctaattgatcatctcctgagaattgggctctggaaattgattttacgatctcgttataattatgctgtaattttgttgttggtgttgttgaagatg

SEQ ID NO: 2766 - DNA, 3000 bp, Unknown
  misc_feature (1)..( 3000): cDNA_ID_2171164_gDNA_ID_1620589_Annot_ID_161369 3000 nt of promoter + ATG
aacagcatacctttaacggagacgttattattacctaacggtaacggaaaatgtttctccgcttggtgttttggtataactaaacggtttagtttcccgacgtcacttggcgttaccgttttctcaaacagtaactccgccgttttaaaccccgtcataaccaccatcgaagccaaagcaaacgccgtcgtctcttttccgttaccgtcacggttacgtttcctttggtctaactcttctttgtaagtgtgttttctcaacatatctacgatctctgatttcgaatgcgcgtttaagaactcaacctcttcttcgaacgtcgtgtctttgaaattagtaacggcatcgcggccacggaaacggtgagccgcgacgtcgtaagcacgagctgcttcgtcttcctcgttgaaagtaccaagccacacgcgttgatgtttctcgtaaatctgagctccccatcttccatttggttgaggaacaacacctttgaatcttgaagaaggaagctttcttgattcggcttcgacttcgacttcgacaccgttctctgaatcaagtaccacgcttgttccgcttcccattctatatagtaaactcgccggagacgatgactttctcgccggaatggaatctgtagttgtagagctctcgtctacgctactcatggcatccatgttatgaaacgaaataagaaactgagagaaaatcacaagaaaattgtgaaatcttgagagattagtaatgtgaatgtatatgtgtgaacgtgtgtgaatgaatgtgtgtatatatagagagacaaggggaaataagaaacatcaagtgtgcatgtatgttattaaaaaaaaaagttccgtcctttttattacttgtagtgtgttttaaggagatggtataatatatgggtaggtgtatcggaataatatgggtttgtgtgtgtatatgttgtgggtcaacttaaatacaaaggaaggttcatgcaaaagataaagaatacttaaaaaaagaaggttaaattcgcatttccatattaggtttatgtttcaattaaacaaataattatatataaaataaattaactcaatcaatatatatctacgatgcatatattaaaactatagctaaaagtacccccaaaaaatcatgaatctaaatttattttatattttatggttattacttattaatcagcaaaacttgtttgatcttaagtttctttaatttttattttttattttatgattgctctatatataccattcctttcactgtttgataccgattatcaccaaactttttttatgatattcacgacgaaaaaaggtgatatgaatatgttgtgggctgcatggggaagtggggtcggcaagtggaccataagatataaaagagattcacatgataaatagaatattatttagttaagttcattccccctgatgttatatacaatttgttaatttacaagcatggtgattaaaataatataatgattagcaaattgttgtaaaagaaaataaataaaaaagttggagctgaaggaattcgatctattttcttactatagagatgcaaattaactgttacgatattattcctttctcactaaaaattaatatgtttttctccaaatctcaatgaattttgttccgtgaggatctttttgcaagcatgaatccttcatgtatatacaaatgcaatggttcaatgctcgagatcataccttttcgttattctatcttttttgtatacatagcatcagatccgtgcttacataaagagaaaataaatcatcgtctatattcaactttttggtctatatatatatatatatatatacacacacataaatttatgtatataacaattacatatattataatgagcacaaattttagtattaaaacatatttttaaattttaggcaacactattcatctctatttttagagcaaaatataaggaaaaagccaaaaaaatcccccttttttatttggatgtttaataacattatttttgattgaaaaaaatatatataattacattgtgcgatttaatactcaaaaaataaaatgttgttactttcatacacatgatttcataaccaaaaacaatattctaattttagctttagagttgaattaactattaatttgtaaataaaatagcaatcactgtttaaaaataaaatttaatttttattataaattgttttactacaataattttattttataaatttcagaaaataaattagagaaaatatgaaaaagatattttcttagtgaataaaaatatgaagtatatattaatatgattttttttccccaaattttctttaattttttattttattttctacttatcaggattttttaaacttttaatataaaatataccgctttaatagttaccgattataaaagcgaatatcaaaaaatttatttaaaaagttacttttaactttttttgtatagtattaccttatttagtaaaagtttactgatgaattaaaaaaataaaaacttagtatagcttcgtatcatcgatcaaaaacgtgataggtggaaaataaattttataagctttgcttacgtcatcttactttccatatttaggtcggtcgcttgtatggccaaatcccatataacaataattttaatactattacaggtaataacgatcatatgtcaacactcaacagtaccaccctttgtttttctttttctcaagtgtacttttataaaacaagctattatcaccttttttttttctttatcaacagctaatatcactttttgaaactagttttaacaaatacggaatataactctatgaaacaaagaaatgagaaatgtcatgtttccttatgaaattgggttccatttaagagtacaaacagaaacataatctgaagacaaattaagaaaaagaaaaaacttccaagatgatggggaatggtggattaatagaagtaggaacaggaacccaattattcaaatg

SEQ ID NO: 2767 - DNA, 3000 bp, Unknown
  misc_feature (1)..( 3000): cDNA_ID_3069624_gDNA_ID_1620589_Annot_ID_161373 3000 nt of
gtctgatttacctgaagaactcctagatttaattgcaaaccgttattcctccaacattgacgtcctacgtatccgtagcacctgtaaatcctggcgttctgcggttgcgatgtctaaagagcgtcttcagtttcgctttgaacgctaccttcctacctccaacaagaagataaaggctcatctctctcccaccactttcttccgtataactctcccttcttcatgtcctaacaaaggatggctagtaagaactagacaagcctccaaaatgtatcgtaagattactctcttgtgtcctctctctggcgagcgcatcacccgttcccaccaaaccctagaccttttgaaggttggcgtttcagagattcgccaatcttacgagattcaaatattcgatggattgaaggacgaaaagataccattagattcagagatattctctaattatatcaagaatagtgacaaaataccatcaggtgtattctttagagttgctttcctagacaatattttttttgcagtcaattaccacgataataaaatatggtgttgtaagactagagaaggaagtagaagttggacaaaaattaaaaaccaagtcgaagatttctcggacattatacttcacatgggacgtatctatgccgtggacttaaaaggagcaatttggtggattagtttatcacagcttaccattgttcaacagacatcttcaactccgttggactactataaatatgatagttgccaagacacgaggctcgtggaatattgtggagatctatgcattgttcatgaacttagcataactcgaaatcatatccagaggaccgttggttttaaggtttataagatggacgaggatttggcaaaatgggttgaggttagttgcttgggagacaacacactcattgttgcttgcaacagttgttttactgtcgtagcctctgagtaccatggatgtttgaagaattctatttacttctcttattatgatgtcaagaaggccgaaaatataaaagtgttcaagcttgatgatggtagtatcacccagaggactgatatttcttctcagagttgttttcacatgttctctcttcccttcctcaactattaattacctttaatttaaaaatcttgattattaaattaaagatttttttatttaatttaagtatatttcaaatatgaatttaatgcatatctatgttacttataattaacagaaaatttaattaaataaaaactaattaaattaataaattaaatttaaaatcatgaaaataatattgtattttttttctcaggaataatactataatttaacttttcacaaaatgttttttgaaacgatcatatttcgaaattttgaatgtggcaatgaggtttagaatggaaggaaaagtaaatacatggtaaagtaaataacaatgtatgtgactgcatttataaaattataatctaataaataaaatttaaagtgaaacattagttcctaagaataatacattagagagagttgttatttattattaaatttttacataaatgaaaataaaataataccaaactcaacaatgtaattatccatcttctaaaaacgtaaataatcaagaatcattattttcatgagttataaaacaaaatatataaaaagtgatatgtaagctgttagaaaaaattctatgtaatttatgtagcacaactctttaacatgatcaaaatgaagaaaaagtttgagatttcattacttgaatcaaatgttgaatcaaaggctgactttaaacaaaatatttaaaataagtttttttttctttgagaaaaatgatagtccttatgtttttagttgatatttgaggataaatttttggaaattcacatgtctttggaatcataagatcatatgagcaagaagatttagatttcgaacctatttgaaattcccttttcaaaagtatgatttgatatgcagcggtgagaaaaaaacagagaagtagaacaaaaattctattttgttgaatagatttgagaattaattataacggttaatttacttagagaattaggaattcaaaagaaattgagccgttttataattaagttaccactaaaatccgctaatttatttacaaatatttgcttaaacacacacatgcactcgaggaaacgataatcgttttgaaatcaaatgacggggtttcagccaataatacggcgtcgtttaaccgtggagaggttggaaatttacacggtggcgtttaaaggttagttaacttagcgaaaggatttagacgatgttgttttggagttttatatgttttcttgtgtgtcaagctttgctccttaagtctgatttttttgtctaaattctcgagtttcttccatacctgtaaaaattcgttatcctaatagttttagaagaactaaatttctacagcttttctttgtgaattcgatttagtacagaataacatacataataaaagattttaaaaaaaaatcatgtctaacagagaggcatgttcatctaacaaaactattatcttttattatacacatacatatataagatgccaaatattttattttcatctaagagatgtctatctaattaaataatgtgggacaaatatgtagttagaataacgaattcaaagcttcacaagtcgcacgtttttcatttttctttctgtagtttagggaccggccaaaagtacatcaacttagacccaagctaagacccaaaaatttggaccattttctaacaacttgccgtccatggaaaccgaatcaaaaatagcatcattcgttggtgacccatttttgggatatttagcattatcccattcaccatttatcagccatcaatcattcatccaatatatatacacatagacatttcgtaaaactcaaatcactcaccacataaaaccaaagtcccatctcttaaaaaactaatcatttcaaagttttgtctctagtctttctttttattgagca

SEQ ID NO: 2768 - DNA, 3000 bp, Unknown
  misc_feature (1)..( 3000): cDNA_ID_3069608_gDNA_ID_1620589_Annot_ID_161375 3000 nt of promoter + ATG
catcctacctgatataaaaatcagtgttctatcctttaagttgttcatgtattttcattccaagagcagccaatgttgagacagattctcttgctaagcttgccttatccgtttatgctgaaaacattgttagttaatccaagtattggcgtttcaaaaaagaagtgattttggtgcaaatatcttttcacagaatataaaataatttttaatcaattttacatacatgtatccgggacaaaaatatagttagattcattacatttagaaggttttttattttatttttgtagtttagggaccggccaaaagtatttcaacttaaatccaagacccaatgcttagatcacgttccgaccatggaaaccaaatccaaattcctcccaaagcatctttttagtttgagacccacttttggtaatttacgcacgtgctacttcatcaatcatccccattcatcactcatccaacatgtctatctataaatagacggagatatttcgtagaactcaaatcactcaccacataaagtaaaagtctcatctcttcataaaatagctttaaaccaatcaagtagagtttcttctcaagtctttttattttatttttatcaatggcttcttcagcagtgtctctccaatccatctctatgacaactctcaacaatctttcatgtaatcaacaatttcatcgaagctctcttcttggttcctctaaatccttccaaaatcttggtatctcatctaacggttcagatttctcctatccatcaagtttcactgccaagaagaacctcactgcttctcgagctctctcccaaaacgggaatatcgaaaaccctagaccaagtaagttaattgatccttttttgtcttccaaacttgattaaatatatgattacagagactcaaaatcaagaacacaattcacaaactgagtttgttttttcaggcaaagttcaagaactgagtgtgtacgaaatcaacgaattagatcgacacagccccaagattcttaaaaacgcattcagcttaatgttcggtctcggagatctcgtaccattcacaaacaaactctacacaggcgatctcaagaaacgcgtgggcatcacggcaggtctctgcgtcgtcatcgaacacgtcccagagaagaaaggtgaaagattcgaagctacttatagcttctacttcggagactatggccacttgtccgttcaaggaccatacttgacttacgaggattcgttcctcgccatcactggtggtgctggaatctttgaaggtgcctacggacaggtcaagcttcaacagcttgtgtatccgacaaaactgttctacactttttaccttaaagggttggctaatgatttgccgttggagctcaccggaacaccggtaccgccgtctaaggacatagagccggcgccggaagctaaggcactggagcctagcggagttataagtaactataccaactaattcatgaaattaaaatgtttctcgtatcgctgtgtaatgatataaagatttgtagttttgtgctcttatctgtaataaaatcattgaggaataatatctcgagtatgttttaagtcgtttggacgttggtacacgaatatatgaaaagtctttgtaatcttttggtcactctcaatgattttgaattaaaaatagttttagttatagaaatgattttatgtattgcacaagaaaatcaaataaaaagaactattaaataatgaaaatatatatcttaaataaaagagtataacaattgaattcttaaaaatcatacagtatctcaacaaatccaagaaacaacgaaacgaaaaattgatgtatcatttggtcgagttaagatacaaaatgaaaaattacatttttttttgtagccatcatcgacaaaaaaaaatgtcttagtcgcagattaaatgaaataaggacaaatgatggctacaaaaaaatatgtaatttaaaaccgtccctaaaggtaaatctgactcatcttaagagattgtttgatttttgatatataagtcataagtggttgactaatgtcaaataagtgacgccttttgatgacatggagaagtatgcagatgacattgattgatacggatggaatggagaagttaatgatctacatgtcacactcctcatttcaaaaatagttaacggtgattatgagtcttcatcgaatactcattttaaaggagttgctgataaaaaaaaaaagagtggatgttatgggcatgtatttaagggcatgtatttaaacaagaagttaccaatcgtagcctatgactaggattatggcatgcatgattaccatgatgtggatcaggatatagagtagagaatgttaacgcaagagacattgctagatcaagaattaactcatacaaaaatgatgaccggagattgatgatatcaaattaaattaagtaacatagactcacaaacgcatggtggtaatttgaagcctatgcattcaaagaatgttggagtcatggatccgaatagaattgttgatactagtgggaccagtccttccttgagaaaaaggatgcatgaaccatctcgtgattgtagtgctattatgtgtgtacacggcaaattgacacaaccgaaccgaccaagttatatatatgtcactaaaacagtctgaccaacaagagtttgaagacctgcaggctacgtttatatcttttgactattatagtatgttcccattactttgagatctcgtagtactcaataaatattacacggttttaagtcgataaataataaatacataaaattctctagctaacgcttttagacaattcgaaaccgagtggaaactacacaaagcatcttttgacatatacgcacgtgttacttcatcatcgtccaatataaatagactcattactaaactcaacaaccattaaaaccaaagatcaatctcttcttaatagtcaatcatatatcaaaaaatttaaactcttcttgatca

SEQ ID NO: 2769 - DNA, 3000 bp, Unknown
  misc_feature (1)..( 3000): cDNA_ID_2171183_gDNA_ID_1620589_Annot_ID_161374 3000 nt of promoter + ATG
gcttcttctacaatctctctccaatctatctccatgacaactctcaacaatctctcatatagtaaacaatttcatcgaagctctcttcttggtttctctaaatccttccaaaattttggtatctcatctaacggtccaggttcctcctctccgacaagtttcacgcccaagaagaaactcactcctactcgagctctctctcagaacttgggaaataccgaaaaccccagaccaagtaagtttattttcttcttgatcttttcgcttaagtttcgaaaaatcatataaacagagctttttccaaaaaaaatgaaatacttttttttttttttgctaaactgcaaatatcatataaatgaagggaaaggtttacatgagttagaacctaaacaaaaaaatgaaatacttacaaaacattttctaaatacattatctttatattaaaatcagtttttcatttcataatttttctaactccattaaatttatatgattccagagccttaaaaccaaaaatttgcaaacttgataatttaaacataatatcagatctcaaaatcaagaacgtataattaattcacaaattgagtttttaatttttcaggcaaagttcaagaactgagcgtgtacgaaatcaatgatttagatcgacacagcccaaaaattcttaaaaacgcattcagctttaggtttggtctcggagatctcgtcccattcacaaacaaactctacaccggcgatctcaagaaacgcgtgggaatcacggctggtctctgcgttgtgatcgaacacgtccctgagaagaacggtgatagattcgaagctacgtacagcttctacttcggagactatggccacttgtccgtacaaggaccatacttgacttacgaggattcgttccttgccatcactggtggcgctggaatctttgaaggtgcctacggacaggttaagcttcaacagcttgtgtatccgacaaaactgttctacactttttatcttaaaggattggctaatgatttgccactggagctcataggaactccggtaccaccgtctaaggacgtggagccagcaccggaagctaaggcgcttaagcccagtggagttgtaagcaactttacaaattagtgaataaaattagtcttatctttctcgtgtcctgtatatataataatctttttcatagagaattttatattcttatacttgtaatcaaataatttgtatggatcttagtatccttgtgaatgcagtatgtttgagttgaaaaatacttgtaatcgaatctttagttttgagttgtccccttttggggagtaaaatatcttcttcttatttttattgggttgaaaataggtttttgcatagttttttttatcgacctttcaaatacgtcacaattacatttataggagttagggttggtgttgtaatccatatacattaccactatgaaactttcagcgaatacaagcatatactatcaaactccaagcgaaataaatactcacaaaaggctcaccatggtcgtaaagtgaggattgaagaaaaatgatcatgttgatggatcaaataaatcttccatcgcctgatttcatcatgatgtacactcatctcaagaacaagaaaatgatactaagaagaaaaaagataagctggattaggcacgaaggtttggaagaaacccaaactctaacccaaatattgtggataaataaaaaacaatcaactttcgagttccttctccagccaacttatgggttgcaaagatacttttacatataaaagggatgctgacctagtgcgaatatcaagaaattgtgtgtgttttatgtgctccgggttcaatctctatttggtatacaaatgactgttttttaaatccggatatctaaagtctaactttgagtactaggaagattataaggcaaagatctagaactcttatagcttaaataaaaaatgattttacatgtaaaagacagaaattacctaatattagttaagagatgatatattttcaagaaataatgattctagttgtataaaatacctagttttttttttgtatttttttttgaatatttagaagtgcaagtccgaaggccatacatttcctagagatatgatccacaccaggttaaattcatttcttttggagaagagatccctcccaacagacttcgaacccaacacctctacctgcgagattttttttttgttattcgtattagatgtgattttggtgcaccacgctagcgttggagatgaaactcccacattttcgcactgaatcgactattaaagcttggtctaagctatcaatttattacagtctatgccagaaatttatggcatcctacctgatataaaaagctttatggcatcctacctgatataaaaatcagtgttctatcctttaagttgttcatgtattttcattccaagagcagccaatgttgagacagattctcttgctaagcttgccttatccgtttatgctgaaaacattgttagttaatccaagtattggcgtttcaaaaaagaagtgattttggtgcaaatatcttttcacagaatataaaataatttttaatcaattttacatacatgtatccgggacaaaaatatagttagattcattacatttagaaggttttttattttatttttgtagtttagggaccggccaaaagtatttcaacttaaatccaagacccaatgcttagatcacgttccgaccatggaaaccaaatccaaattcctcccaaagcatctttttagtttgagacccacttttggtaatttacgcacgtgctacttcatcaatcatccccattcatcactcatccaacatgtctatctataaatagacggagatatttcgtagaactcaaatcactcaccacataaagtaaaagtctcatctcttcataaaatagctttaaaccaatcaagtagagtttcttctcaagtctttttattttatttttatca

SEQ ID NO: 2770 - DNA, 3000 bp, Unknown
  misc_feature (1)..( 3000): cDNA_ID_2171160_gDNA_ID_1620589_Annot_ID_161368 3000 nt of promoter + ATG
ccaagggttttgagatgtcttatgaaatgattttggcagaagaggatgtaaaaaatttcgaataaaaagtagtcagcaaaacatatgttttttttgaaaatttttagataattaaatcagagaatagggttggacatatgagtaacccattcgagttcggatagaacccgttcgggtttgagattaatggtatatgatttactacccaatagaataattctaaacatatgttttgttgatattatctatattgtttagtgtttaacattatacacttgtagtttgattgttaatttaagagtttcacatgtagtataccatcttgtattaatatcgatctaaacccgtcaattctaggattttccagcttgtattaaaaattgaatcacatctaatatgttattaactattgtagtatataagattataaattttcaatataatatgtatgaaattgaatataaatatttcaaatttatgtcccgttactcagtagaaagttttcttaaatctatttttcacccgttataatattatttcatgtattgaacaatttatattcgtttttaaaaattcaaattatggcatatgcggaaaaactctaattatttttttataatgatgatattattattccgtaaaaatagaatcatataaagatgagaagtgaactataataattaataaaaaattaagatgataatttagataccaaatataatttgttgattttaattagatacttttttggaaattaataatgtatttcgtttttctaattaaattaaattaattaaaatttagatatcaaaccttatatgttgattttgattggctattatttttggaaattaataatgtatttcgttttttaattaatttaattaattaaattagtatttgatttttaatccttaaagagataaattaatttactctttaaaattttatttttaatggcatatctatgtaattatttataaaaattaagattatatttaaaatgtatttcccaaataatatagtagaataataattaaaaacaaaattaattggctcgtgaacaaaacgataagaactaacaagaaaacattattattgttgacaaataaaaacaagaaacattattatattaacacctaacgctgccacaccttttataagatatatgttttcttttacaactatctgaatctctaatgtaataaaaatatatgaatgatgtcactggtagtttggtaccaattccatgcacaacattgtaaaccattttcattttagtgttctttgaaccttttgtaaataaaaacaatattaaaccaatggaactcattgtatagttaattaataactttcgaatcccaaaaaagttccgagtaacgttttttctcgtctctatattggattgtaaaaacaagtaaaatatatatccgggtcagttcttctaatcaaaataatcaagaatgctcattagattagactggaatattttgataaacatccataattagaattgaaagttcttaatttaaaaaacaacaactaaatataaagtaacgaatacaggaaaattatattttctattctaataatatatgttgattgttgcatattgtctttttggtttaataataatcgttatctaaagtctagaaaaaagttaattataggtatatctttttagtaattcttatccaaatacttcaaagacacgacatacaaaggacaataaaaagtacatatctataacgagatcgacctttgatcttagaaaaataaaatgagttaagaatacgaatatacgatcgatccccaagaaaatagatgtgtaatttgggagtatatattactttttttttttcgtcaggagtatatattacatttttacatttatctataaaagaaatatattgtgttaatacactaaaatcagataaagaattaaataatttagcatattacgcggctgccgacaatagatgtggagtatgacttcacgtagacatattaagtcatctagtgtcaatatattaaattgattgttgggttataattgatcttaaagtgagcaagttttatgtcgcaccaaaaataaactattgagtgttatgtgcctaacacttaagaagttaagataatctcgagcgcttttaatttaatctaaacaagactaatgtgactaatgtgcataaacattcgctttgctttttttcatcacatcctatcgatggcataatcatattctctggatacgttatacttttgggtcggcaattcacgtttttattcggctatatattgagttttcttatttaaaagaatattgaaataatacatctaatcaaaaaataacaaaacatgtagcatagtgatttatactaatatttttgttgtggatcatcatcattcagactaaatatgtattgttattgattgaaaaaaagatagttaagtttctctaaacttgtgaaactaatctatttgaaaagcatcttgagatttcataaatatttttaatgaaatataaattcggggtctattgggatagttggattggtttaatctggttaactccggttaactagatttcggtttaagtttaatgtgcatagtatataaacttgagaatgtaattaattcagtttaaaaaagctttgtaacaacattttatcagataataaagttcgttatatctctcttcttcttctccgattagacttccgatcatcggatttattatggtatcagagccatacaatcgattctcccgcttactctttcgtcggagatgagcttgttcttagcttcattgtgtttttcgatttgcgatctttcactttgaagatttgcaatttcgttctttggttcgccggaatcttgcttttccgttctgttttctttttatttctcttcattttgacctcctgtgttgacgattctagctttctttacacaaattcatcacacatttctttgtaatttcttgttcttacactgaga

SEQ ID NO: 2771 - DNA, 3000 bp, Unknown
  misc_feature (1)..( 3000): cDNA_ID_2171259_gDNA_ID_1620590_Annot_ID_161396 3000 nt of promoter + ATG
ttttgctatacgatcaaatacaaaaaatgtattggtcccacattaagaggccgacttgataactgaagcccaggtttagcccagtgagttgtgtcttcaattgctgttacatatatagccggaaggtacgaaaagagttgtagaagctttgacctaacttggagatgagagattcaacaatggcgatgtccgatcttccccgagatttggaagaggaagtgctctctagggtcccgttagcatctcttagagcagtgcgaactaattaatcgaatatggttgcctcgctcttgacataataatggtttgatcattaatttgtatgtcagaccattattattcacttagtatgtaatctctcgttggctcttccaatatttttttgaaacagccgaatacatcttagacacttttttccttagaagctctctttagcattgctatttagatgaaaataaagaagttctgtattgtccatgatacaattgttgttctctttgcatatgaaaaacaaaaaaatgactttataacatgtttgtgtaacacatgagcttgaaagcaaaggaaatagatgctttttaccagctaccagaattgatatgtccactctctttaaatcaacatatcgggtccgattggtgacctataaatgaatacaaggaatgaagaagaacatgactaaaaaagaacaaacaggaaaagaaaaaatgataaaataggaatgaaaaggaatggatataaaggaaaaatagaacaaatgttactgtaaatgataaccaaaacatagaataaatagtaacaaaaattaaaaaataaataaattatttttcaaattaaatattaaatataaaacgaacataaatttaatttttatttaataaatatttaattttttttcctgtttgttcctcatcaaatttgggaaggaaaaattttcttctaccattcctcaaaaaataaagaatgattaggaatattgtggggtctacatattacaatttggaaaaaaaatactaatgatggtgaaaaaaagaggaacaacatgttgttcctgtgcattcattttctaaataatggtcactaataggacccatcgtatgatcaattaatgagattcgctaaaaaaagtccactattgaaaatcatatgtcaaattatttaaattaaaaaagcaattcaaggaaattcaagatatcaaacataataaaatctatatcttaagttaactcagaaaatataaattttctgttgcataccaccgggtgtgccctagctaggcagagaaaagaaaagagttttattttttttgtttcactgctaaaggtaacttgatttgtagtatgacatataacatattcaacaatggcgatttcagatcttcctagggatttggtagaggaggtgctctctagagttccggtgacatctctgagaacagtgcgatctacttgcaaaaaatggaacattatatccaaagacgagagctttacaaagaagcacgttggtcaagcaaacgcagcagcaagggaaagtgagtttcaggtggtaataatgacggaatacaaagtttatctaatgagcgtcaatctccatggcattcaaaacaatgttgatccatctatagagtttaaatgtaaacttatcagcctagatgattcagatcgaataggtatatctcaagtccatatctgtcacggtttatttttatgcatcaccaacgaaaaaaattataagcttgtggtttggaacccttatcgtgggcaaacaaagtgtatcgaacataggatttcttacaagagatggaacagctacgctctcgggtacgagatgaagaacaactcttgtctttcgacacaaaatcttgaaaattgtggtgacatcattagtcgattttcacccagtttatgagactgaaatttacaactttcactctgattcatggaagaatattgttgattccactcctgaaggggatatgcaatattttaaacaaggcgtgtctcttaagggaaatacttactggtttgctagaaagtatgtgatctatgaaggaggacaagaagcatgggttagtttcttgatttgttttgattttacaacagagagatttggaccgcgacttactctgccttttgactattctacaaaggagagtgtgagtctcttgagtgctagagaagagcagcttgtgctgttatatcacccctggtttacaatgatgatggagatatgggttagtaataagattgagctcaatgcggtgtcatggataaagttcttagaggttaacatgataacattccctcattatcggtttagttttcaccatgtgagtttcttcattgacaagaagaataaggttgtagtggttttggataaagacaaagagacgcgttctcgcaacttaggatatttcattggagatgatggatatttcaaagaagtggaactgggaggatctagagacagaaatggttatccatttgtgttctcttatgttccaagttcagtgcaattttagcaacttgcaagagacaacaaaccatatttgattaattagtccatttacaatgcctaatctatatgtatttactcttttcttttgtcatctttggttattaatttgtatacatgtcgaccattgttggtctttgactattgggtgcaaatagagattcttcatcagaatggattttgcttcacaagaatcaacaacattatgaaatacaaatcagagatggttaaattaaccaatgaaatttccacaagttaaaccggaaaaaaacagagcggactaatccagttgtgccaatggcaaagatgtaatttcaaagaaaaaagccttaattttggtaattggtacttggtgtccaaattccgccaaacaaaactgtatcgccgtctctcttcttcctcaaaaaccctagaaactgtaaaacccttgcctatctcttacacacaccaccatcacagttcaacttttgtttgtcaacaacaatg

SEQ ID NO: 2772 - DNA, 3000 bp, Unknown
  misc_feature (1)..( 3000): cDNA_ID_3095815_gDNA_ID_1620590_Annot_ID_161403 3000 nt of promoter + ATG
cagatacttccaatgcaaaatatgaaaatttgtcttcatcacatgcaatcgattctgaaatattcacattcgagaattttggataaaatggtccttcgtatatgagcatatcaagttatacttttgttttaacgcatttgtatgttttggatctaagtattttgattatccaatttgctgagtgcattttccatcaagaacttcaacaagttttcagtagcttactcacttaatgttaatataacgctccataggtgtgcaaatgttagtcatattaaagttgttggttctgcataaaaagctgaaacatttgtgttctacaaaaccttttttggtgacatggacctatagttggtacttgaaatataaataaaataggaggatctgtaattcatgtctgtctaagcacaataaagtgaaaaatataaattaaaaactcaaaaagctcatcgtaagagtaaaaactttttacagagaatatacggtttcagcgggttactttcttgggaccttctctatattatagcttttggcgcagttaaatttatgttatattaatcatcaattttttgtttttacgttttatatcgtatgtaaggaaaagtaaagaaagctattagaaaaaaaagctactaaacatgaaattatgagtatatctttcttaaactcaaattcaagctctcgtggtaataagtggctattgacgataacaattacaagttggaatgttgaatagtttcgttttttttatttctattaatgtttttaaaatgattgttgaaatagggaaaatttaacaaatgaagacaacgatagatggagaggtcgatgcaaatggttcgagtgatcttatccatttcatgtggacacgtgtcgcaatagggaaagcttctcagcaacgtgatttatttgtttttttcttatcattaaatgttttcattttattcttcgaaatatacacatgtacagtatttccaaaagaaaatacactatagttgatagttcataaaaattaaagaaatacttaattgatttaatattcgtattgttgagttttccttctaaatactacaagtagtgaattttacttgataacattgattaatgtaagaaattaggtatcgatgcacatatgaaacaagtcgtatgtcacacttaaaactatcgttaatttgaaaaagataagacatgtcggcggtgctaaacaactatttaagcaaagtatacactgaacttggataacttagatatagtttacattgaagttgacaaatttacacatttataaataagttactggtttgtatgtgtttataaatatgtcgtagagcaatcgaatagtcaaatatgatttgttatcctatacattattaaaaatatactttcgggggaatagggcgattggtgggtagcatatgatgttactaatcattcagatgaaccatttgcattatttctttgtttatttagtatccaacgttttaagagaagaagcgcacatgtttttttttgcaccatatactgactactgttgttgtaaacttgtaattatacatacatatatatatatatatatatatatatatatgttttcaacaatcaaacgtacaatttttttctattttccatttaatacaatttatttcctagaactacaagttgtttttgattaaaacatgaaaagtatactatataagttatattcttactaatcatagttacacacgacttgaaataaatacatactaaaaaatttggaaggttatatgtttaatttgcaccaaaaaaggcatcgagtaatcttatgttatgtatacatcatatatctggtttttttttgttgataaaagtatatgtactatatcttagctaaagatgtaggtgatgatgggaaatgcttaggtgtattttggtaccttaatcatatgcttgaatgtgcgtagacgtattattttgtttaatttaatgatatgattatatttttattttgccgtttaatttaatacatgtaggtccaatagacaggaggcattgtttctcaattacataaattcaaagggtagtttagtaaataaattataggcatatcaaaactaagaattttttatatatatatgcagctgctcttttgtttaaggcaaattcctattcgaaattggtagaaaatggaaattaaaacaaaaaattaggaaactaacaacaataatactaatgaaaatctattaaggtttgagtttgcaaactttacatatgacgagttaattaattttttcatgcatgagctggatccacgaatcaagggtctttggtcccactttcttcccaattatataaatttccttaccctatatttctttcattgatgattcaacccctatatttcactacttcacaaaataacccagaatttgagctcaaagcaacatccaaaatgttcttctaaatagaaaaataaaacagaatatagaacaatagtacatataatatacaaaactaacttgtaagaaattgagaataaaaaagagagtggatctaaatgaaatttaataaaaccaatagtctaaatgtagagagaatgatgaaaataaaggacatgtcagcttctacatatatgtaaataaaaaatatatatgactgagtatataaaaaccacattttttttttcttctgcatctaaatgttacaaaaattgaataggaaaaattaagagagctttactctgtgaataaataaaaaaacagagaaaaagagctctaaggtgagacaagccttgtcttcttcaactccctaagtctcatctcaccatctctctcttcttcttttttttggttacccagaagagattcacttctatctccaacaatttcgtattctctcataatattcaattttaaatcgaataaaactcgcgtcaatttcccctctttctttctgggtatatattcttttctgcttttctttttttgtttcttgggttcgagctacatagagagaggtatg

SEQ ID NO: 2773 - DNA, 3000 bp, Unknown
  misc_feature (1)..( 3000): cDNA_ID_3069638_gDNA_ID_1620590_Annot_ID_161399 3000 nt of promoter + ATG
tcccttttgtggttgcggtggagaccccactccttagttttcacactttgacatttacgtgattctttctcaactctttttttttttggttttattcgtcgtgatcaccgaaatacatcctactatattatttaaaaaatacattttgaatgtaaccttatttttttgtaagtaattacatagatatgccattaaaaataaaattttaaagagtaaattaatttatctctttaaagattaaaaagtcaaatactaatttaattaattaaatttaattaaaaaatgaaatacattattaatttccaaaaataataaccaatcaaaatcaacatataagatttgatatctaaattttaattaatttaatttaattagaaaaacaaaatacattattaatttccaaaaaagtaaccaattaaaatcaacaaattatatttgatatctaaattattatattaattttttattaattattatagttcacttctcatctttatatgattctatttttgcgaaaaaataatatcatcattataaaaaaataattagagttttttcccatatgccataatttgaatttttaaaaacaaatataaattgttcaatacataaaaaaatattataacggataaaaaatagatttaagaaaactttctactgagtaacgggtcataattagaaatatttatattcaatttcatacattttatattgaaaatttataatcttatatactacaataattaataacatattagatgtgattcaatttttaatacaagttggaaatcctataattgaatgtttagatcgatattaatacaagatggtatactacaggtgaaactcttaaattaacaatcaaactacaagtgtataatcttaaacattaaacaatatagataatatcaacaaaacatatacaactcacagtttactatacatttaaaatcaaataaaataatatcaaatatttttaaatcatgtttacaataaaattttttagtttaactaaaatatataccgcaggttaatatctagattatagggcttattggatctaaagacggatcatcaaagacttcttaaactgaagcaaaatatattgaatattcaaatatctatatgttaccaaattataaacaaataagtcaatttaatattttatatacgaaatcaattaaatcttaatcacataaaaattagcacaaaaaagtattcatcaattaaaaaattatcagatctctgtgttatataagttttgatactatattcaaataaagtgtaatataccttttcaatttgtattctttaactaatttaagctaactaatatatttgctaatcttatacctatcaaaaccgactatcgtttcttatctctatagtatttttgcaagacttttttggtggatttggataaaagtgcattcgggtcatatggtatattctcctattaaataaatatggtgcactcatatgttattatctaaaatgtttagattctaattcagagtcatatcattaataaaattaatattaataaaattaatattaataaaattaatattaacaaaataaatagctttttggcaaaacggatttggagggacgggtttttgaatcaacattaataaaaaagtaaaatataattaatccaccgtttcaatacgggttaaatctttaatttattatttttaagaccactaatattaaacatatcaaatcatcctaatttagaaaagattatataaaaccaaaaatgttatgtggtatgtataatgttactatatatataattaaactatagatataaatgtgttagagaatgatacaatttgcaaaacttttatatataaaaaattattcttaaattttaagaattactattttttttaaaaatcacgggacggtaaaaaaattacagaacgagttctattttggaattgggttatatggtggatgtatttgaatcaatatttataaaattttaaaatattattaatatgctgttttaataggggttaaaacttcagttttttaacaattatctcatggattcgtggtataccgttacttaataacaattataaactgtaaaatataaatattttataaaaataaaatttgcaagttttaatatatattacttttaaaaaataaatcgtcccgcgatatacgcgggttaaaatctagtttactataaatctataatataatacttggcctatataaaatgttacttgctcatgttgaaaacacatactagccatgcgagaagaatctatgattctttttcacgagccataaattacggtcagccccacgctaattactgtgtttgtttgtttttttttttttttttttttatgtttgtttctatcgaatgtactgagagtcaaacgagttcaactgcttttttaattagcactaatcaataatcaatgctcccaattgcatgctaatgtgctattcagtcgtcactttagcaataatgacagctaaaagcttgcaataatatcgatgtataaataatttactcaaattcattatgcaggcaaaaaaatataaagctagaatataataacagaaaacgtctaaactagaaaagattgaaaaatcaaaataatattgcgattttgcggatagaaagctaatgggcttcacaagaaaaggcccaaattagtatcagttatcaacgtcactttgacgtgttcatcttctaaaatctaaacccctaaatcctaaccttccacgtaactcgtgtcggtacgaggcaaatcactcggtctgtattaattcagattaaccggatcaaaaccgtaaccggtttaattatactacatggtttcgttctgatttagggtttatgcaagttttcaacttctcttgagatattccatctctcagccaacaacgactcgagtcgaggagatagattctcaaagcttccattaaacgttgtgggtatttttttagctcaaatcaacagctaacatg

SEQ ID NO: 2774 - DNA, 3000 bp, Unknown
  misc_feature (1)..( 3000): cDNA_ID_3069642_gDNA_ID_1620590_Annot_ID_161398 3000 nt of promoter + ATG
tctcgtacccgagagcgtagctgttccatctcttgtaagaaatcctatgttcgatacactttgtttgcccacgataagggttccaaaccacaagcttataatttttttcgttggtgatgcataaaaataaaccgtgacagatatggacttgagatatacctattcgatctgaatcatctaggctgataagtttacatttaaactctatagatggatcaacattgttttgaatgccatggagattgacgctcattagataaactttgtattccgtcattattaccacctgaaactcactttcccttgctgctgcgtttgcttgaccaacgtgcttctttgtaaagctctcgtctttggatataatgttccattttttgcaagtagatcgcactgttctcagagatgtcaccggaactctagagagcacctcctctaccaaatccctaggaagatctgaaatcgccattgttgaatatgttatatgtcatactacaaatcaagttacctttagcagtgaaacaaaaaaaataaaactcttttcttttctctgcctagctagggcacacccggtggtatgcaacagaaaatttatattttctgagttaacttaagatatagattttattatgtttgatatcttgaatttccttgaattgcttttttaatttaaataatttgacatatgattttcaatagtggactttttttagcgaatctcattaattgatcatacgatgggtcctattagtgaccattatttagaaaatgaatgcacaggaacaacatgttgttcctctttttttcaccatcattagtattttttttccaaattgtaatatgtagaccccacaatattcctaatcattctttattttttgaggaatggtagaagaaaatttttccttcccaaatttgatgaggaacaaacaggaaaaaaaattaaatatttattaaataaaaattaaatttatgttcgttttatatttaatatttaatttgaaaaataatttatttattttttaatttttgttactatttattctatgttttggttatcatttacagtaacatttgttctatttttcctttatatccattccttttcattcctattttatcattttttcttttcctgtttgttcttttttagtcatgttcttcttcattccttgtattcatttataggtcaccaatcggacccgatatgttgatttaaagagagtggacatatcaattctggtagctggtaaaaagcatctatttcctttgctttcaagctcatgtgttacacaaacatgttataaagtcatttttttgtttttcatatgcaaagagaacaacaattgtatcatggacaatacagaacttctttattttcatctaaatagcaatgctaaagagagcttctaaggaaaaaagtgtctaagatgtattcggctgtttcaaaaaaatattggaagagccaacgagagattacatactaagtgaataataatggtctgacatacaaattaatgatcaaaccattattatgtcaagagcgaggcaaccatattcgattaattagttcgcactgctctaagagatgctaacgggaccctagagagcacttcctcttccaaatctcggggaagatcggacatcgccattgttgaatctctcatctccaagttaggtcaaagcttctacaactcttttcgtaccttccggctatatatgtaacagcaattgaagacacaactcactgggctaaacctgggcttcagttatcaagtcggcctcttaatgtgggaccaatacattttttgtatttgatcgtatagcaaaaacaaatgattagcaccatgtggaaacattagagagtttgtgtaattaaatttcaagtttcttttctgtcttgttatatacataaaaatggttacagtaaccttgttttttctagttatcctcatatgctccaaaaacataggagaaaacataatcatgaactttttgaccaatagtattgttaggacttgaattctcttagatttgttaattgatgatgaattctcttagatgtttataacactatgaaaatcattacttaaaaaaaaaaaaactaagatgatccatcagtcacactttaaatgttttttaaaatatgttcatatgttttgtttatggcattgcgtacataatttaattagactaattataatatcgatcaaacaaagaattattggctggatttggtcgcagccattagcagtcgctctcaactaatattattacgagaatctctagctgagcaagtatctcgtatttctcacgctctgacgaaaacttctacgagatagacgcagatatcgagaccacgtcattccccctaacaaggcaacaacatgtggcggacgccagtaaaactctgctcaattcacttcaattccatttttcgaatccgcgtgacgtaacccacctaagggtttataatccactactttgcacccccacctaaaaatgcatcacaagcgcgacaagtgtcaatacaattcagatacggagaatactctgagatcccacatctgctttcggtgggctcacccgcatcagataaaaaccctaagctaagggatcagaccaaacagtttaaccaaacgaggttatcaacttatacgacaacgaaagcacttatcaatgataagttagttaacttatcaaactacagtctgtgtgacaaaacgcatcgaagaaagtggagaacaagtcgtacttttttctttatctttttccttttttattaaatgaaaaaatataaatagaaattttgtagcatctctggggtcagctttttcttaatgttcgctttgcgacgcgaggaaatgcaaccttgaaaccctagaaaactcattctcaactacgactaaatcgatttcgcaaactttgacctacccttctttcacgataaacccagatcgcttaaattccttgaatttcttcttctgagagttttaggaaaaa

SEQ ID NO: 2775 - DNA, 3000 bp, Unknown
  misc_feature (1)..( 3000): cDNA_ID_3069693_gDNA_ID_1620592_Annot_ID_161452 3000 nt of promoter + ATG
ctttgtaaactctacaagaactcagtaatgctctccacgtcactggatggtcttgaaaaccagagctcaaaatcagattctcagcatctgataatcttcccgtgcgacctaaaagatcgacgaggcaagtgaaatgtttctcgtttgggttaatcctgtaatcgttcttcatgcattggaaatactttagtccttgtgtgactaatcctccgtggcaacaagctattagaacaccgagaaaggcttgctggttcggtttaattccgtgggttttcatcgattcaaagatgtttaaggcttcgttagcagaaccgtgttgagcaaggcttgagatcatagccgagtatgttgcaacgtctgggttttggacctcgataaatacttgattagcaagcggcatgttacctgactttgcatacatagaaatgcttgacgtcttaacactggtgaaagcatcaattccactctttatggcataaccctgaatctgctctcctgagcttaatgcagcaaaatcagcacaagcactcatcataagggaaactgtatactcttctggtcttatatgggatgaaaaaagttgtcggaacagatcaaatgcgctttcaagctgctcgttttggacatggcaatctatcatcgatgtccatgaggcgatatcttgctttgatgttgaagcaaagcattgcattccatcttcagttgaacccattaacgcatacagctcgattagagcgctcccaataaactcatcagactgaaaattgttcttacagatgagagcgtgaatctgccttccatattccaaggttttcgctgcactacaagctttgagcacaactgaaaatgtcgatggcgagggttccaaaccccgtctttgcatatccatgaagagcttaaaggcttcactagaagcttcatcggttatttcatccatttggagaaacccagatatcattgcgttatacgtaaccacattcttcgaaggcatcaaactgaaaagctttatcgcctctttcaaacttccgtttttggcatacatgtcaagcaatgcagtacggacaactatatcaaactccattcctagttttgctgtataacagtgaattgccatacctttttctataaatccttcgttcaggttaatacaacaagcctttagcacactccccagagcatacgtagtcagatttaggccgtctctatgcattttagccaacagatttagcggttcttccgctgcgccaacccgaacataaccggaaatcaaagaattccatgaaacttgatccctttcatcgcatctatcaaataaagacatagcttggtcaagctttccacacttactatacatgtcaatcaacacattgatcaaaaacacttgctgagatagaccattcacaacaaccaacccgtgcaacaattcccctaaatcaagatcacacctttctccacaaaagcccaatgcaccggcatacgtgaacttatcgagcttcaaattagcttctctagcttcaagaaacaattccatggcctgttcataaaatcccatctgagtgtacccagaaatcaaagaattaaaagaaataatgtttcgttcaggcattctgtcgaacaactggcgtgcaaaacccaattcccggcacttgcaatacatgttcagaagattgttgagcaagtacagacacgggttcaaggaggacttgatcatgtgtccatgagcgagctttcccagtaccacggagcctgattttgcagctgtctgaaaaagtatcttgtaaccttcggaatctaaagccgtgttctttggttggcataacgaagacaaaaacctgtaacccaatccaactcgtttggtgataagagtaaccagagaatcttgagcaatgttgttgaaaaaagtctttgctcggaactgtaacaacatgttctcccatcacataacgaaactaacggcttttgtctgtaacacaacggtctctctggagatcataaacgctttgctccgttctttttccaaactgggcctctatatagcctttagttaatagttttgggccccgtgtatattttgtatcgtatttgcgatgtgttggtatatacatttgacgttgaaaccacctatatatatatgcatagttgaccatcttttgatttaagaaaattcttcacaaaagatttgtttattgagtctaatttgtcttaggaaaatcttggtattataacatgaatttcgtgttaatttaaatcaaagctcatataagcaagcaaaccaaagatctttaaattgtggtcaacgggaattgaatcggacggtggaaagtccacgtgttagtaaatcggagccgatcacaccgtccaaactttagtaaaggagaagaggacggcgaggtggatcccaactaaaaattgggcttttctgtagggcccactatagtattgtccagccaattgccctccatggaaatttttcctacatgggacccataatgactttatcgtctaccaatgcaatgagtatatcataatttccttcgttaaagataataatattactgaacattagtattttttcttcttttatttaaatcaatgtgtattcatatctgaaaattatctgaatgttattacctgaaaattatttttccatcaaattagtattttttcttcttttatttaaatcaatgtattcatatctttggtcaatatttctattagtaagagtatgtatattaggtaaaaaatattattgttaataataatccctaaagaactatatatgttgggtaaaaatatgataaattttaaaagtaaaaattcgttggaataaaaaacactttttggcatatttcttttgtcaaattagagagaagctcttatgaccttaggagaagcagtcgtcaaagcaccggtgcatcaataacgagctcgagcctagagatctctgtcccattctcttcgtcattcatcactctatctgcgtttcgttgagcgataatg

SEQ ID NO: 2776 - DNA, 3000 bp, Unknown
  misc_feature (1)..( 3000): cDNA_ID_3069747_gDNA_ID_1620593_Annot_ID_161459 3000 nt of promoter + ATG
aaaaaaattgaaatgtgcaccataaaaaatgctaatatatagtattcattcatagtactccatacaaaaagcttttttaaaaaaaaacttatcattaaatcttattatcttttacgggtgttttcattaaagtaaaataaaaataaataagaacagtacaaaactatagcttacgtatctgaatagttcctccaaatgacgatcctacccttcacaatctctctttgtttactcaattccatgaaccgctataaatacgctctaaacgttactcgtcacttggcttgcacagaacaaaccaaccttctagattcttctccttccttcttcaactctctctcacttctccagatatggttacatctccgacgaactcaacaatcaaatttctctgtagctatggcggcaaaatcctacctcgttatcccgacggtaaactccgttacaacggtggtcacactcgcgtcctcgccgttcctcgctccgtctcattttccggttagtttcacgctctcgatctcattgtcaattttgaatttcacaaaaaaaaaaacgaaatcggttttgtggaaagagaaattaaggccacacgtgtggtgcgttttaacagagttagcgtcgaagatggcggagatgtgcggcggcgtcggcggatctataaccgtaacgatccgatgtcagcttccgacggaagatctcgacgcgctcgtttcaattacttccgatgaagatctagtgaatctaatcgaagagtacgatctcgtttcctcttcatctccgatgaaaatcagagtcttcttaaatccaccaaaatccgccgccggatctaaaaaatctcctcctccgttagcgttaccgtcatcaaccaccacgtcatcatcttccacaacttcctctacttcatcaagtcctagatctccgtctctatcaaaaccaccgctacctccgtctccaccgagaataacgacggttacgaagaatccgtgttatggttgttatgttcaccgtaattccagaaatatctaccttgttcacaacggcaatcactggcaataacgtgaagaatcttcgaatatacgattaaaaaaaaaaagaatcttcgttttttttttctaatgtaaaaaagagcgagagattataatagaagggtgtacgtgatctaaccatcgccattaatgaaatcatcccaaaagctttttattctctgtttgttggtgatgatgatgaattgggtgagtgactttaattcctttttttttccgttgatatcgtgtaactccgtctatgtccgttgcattttccccgtcaacgtttaaccggaccggtccaccacgtgtttgccctaccttatctttttttctgttacattgttctgttttgcttgcgtgttattatcaccgtttgtgtgttagtttaggttaaattcagtttgacaatttctgttgagctaacttccataatcattttttttgtcgtttgcaggtaatttaatctatccttgtaaaattcgagcaatggcgtgatcgatttttctcgtttatggtatgtggtccagttttttgaatatcactatatatacttttctgattaacttttatggtagacgaaattcgaaacgggataagcttggagaaatagaagaggaagacaaaaaaaataagaaatggattaagaatgttggggataaaagaagaaggagaagaagtgatagtgatgatgataagattcgattttaatttaaaacgggtcccgaaatacagctggtgtggagaagtacaaataataatacaagtttttaagactatcggaaatgaatttatagagagtttgggtgggggaggagaagacaccaagtacaagtttatatccaataacaaaattgaggtcttggactgtggaaaatggaaactttaatgaccttaaaaagcgacgtgagttctgaattttcggatattttaagctcataaattaggtggtggacgtattagtagggagttagggactattggcaattcataagaggaattaggcggtataaacacgacgaaagtaggcattttaggccatcaagcatctcttaggattggtcgcttatcttaatgatctaacaatgacgtgatagccatctttaagtttttttctttttctttctcttggtaatttggaaagatgggattatgattctatagttcattgacttacgtttggattttgttagcttgttcaattcacaactaaactgaaatctgatggtaaaagcaagagggtcatactagcaacatgagctgaattaatcttctttatttgtagttccggaagatgtgggtcgaacaaccggagatttgactttggaaacatacacaaagatatgaatgggtggaataaactaaacacattataggactatacatgaatggtaaataaaaagcggtcaaatcaacaaatggatttattcgtccaaccgttgcaattattaaaaccattacatttttcaaagaagtacttgcatatgaagttttagcaaagaaaatatgaaacacatatgatgtaagatagaagtgcttccgagttgaacccaaaaatattagaaacgatcaagtgtaattgaagaatgtagctcaaaaaccacattggtttcacggaccaagtcttttagatcaatgttcaaacgattaacggttgtttttttcctatgcggacaattcccctaacttataagatatcataatctcgttgttaatgccatatatcctattacattaactggacaggattggtctttgattcgattattcaaaaaagatggctcgattgactttatcattggaatcttattaatttcctcggtcaacttcgacacttttcaacccaactagacttgtgctcacaaacatggcaacatcaacttcaatgtttctgacttgttcaaccatgaacatacctttactaaaacctctcttaatctccaattacctttgactaataatcacaaaaaccatg

SEQ ID NO: 2777 - DNA, 3000 bp, Unknown
  misc_feature (1)..( 3000): cDNA_ID_1818883_gDNA_ID_1620593_Annot_ID_161482 3000 nt of promoter + ATG
gctaacaagacgttttccgaaagtaaacgaccaggaaggaacgcagactgagacggagaaatcacctcatttaaaagcttctttagcctagaagtcagcagcttagctatcactttatacaaagtgtttaagcaagagattggcctaaagtcagtcatctttgaagagtttgtgatttttggaataaggaccaaagttgttgcgttccactgcttcaataactgacctgaacgaaaaaattcttggactgcttcagtcacctctggacccacaacaaaccaaacacctttaaagaactcagaggaatagccgtcagggccgctagctttgttcctgggcaaagagaagaaagcctcttgaatatcaagatccgagaaactcctttccaagtcattaatctgatccacagaacatctgaaagaaagaagcagattcatatcactctgtgccaaagagttctcgccctctacaccacataggagggattcaaaaaaattacagctatgctcctttatgccctcctttatgccctgctgggtctcaatcctttcaccaaaatcatcaatcaagaaatttattgtattaatcgatttacgcatgtcagccatcttatgaaagtaagcagtattattatcaccctcatataaccaagagatacttgacttctggcagaaaaaactctcctcagccttagcaagaatttgccattttctggtggcctccaactcaagtgtagcatgaacaacagaagggttggtaagagtaatcctttgacggtggagcacaatagcatgggcctcagagacccttttctcaatatcagagtagttctctctactaaaacaacaaatagggagcttaaggtgcttaagctttttggagaccctgtacatcgcagaaccagagacattgcaagagtaccaattctcacgaatcagctgcaagaaatccgggttatgtaagaaatagttgaagaaccgaaaaggtcgctttgctttcaagaccgctggatctaacaccacctcacaagagctgtggtcagagaaatctggctcaccgaagttcgcgtaagcggatgggaagagagtgttccaatgatcattgaccaaaattctatctatcttttttgccaaaggtctagagctgcacttattccaccaagtgtaagaactacctttgtagacgaggtcatacaaatcagaatcaagcaagcaacttctgaacgcacgaatcttcctgccaatatttgcattgatagcactttccggatttaagatttgattaaagtcgccaagaacaatccacgacctgccaacaacaaccggagataaggcaagctgaaccaactcattccaaagctcttttctggtaccctcctcatttgaagcgtaaacaatagacaccacaaaccaagaaggagaatcaggaagaagaagctcacatgtgatcatttgcagggacctaccaataacaactaccttcacacttggatcccacaaaacccatatttttcccaaaacagagaattcataattctcaacaaaagaccagccaggcaaaaggttagagatgaacttcttctccttaggctgctttacatgtgtctcaatgagacctccaaaaagtggtttattcaaaagaaaccatttcttaaaaccgcggcggtgactggaaatattaaatccgcgaacattccaacaaaagagcttagtacacatacttaagctttggttttgaggcccttgcctcgtagattcctcttctgacgcttagacaaaaccttgatgaaagcctcttcttcagtgtcagtagataacacgtcagaggaatcatcctcaactgcacaaactgtgcctgaacaaatgccaacctcctcattttcagttgcattatcaatgattacagcaaactgtccaacacttgaatctcctttctggaccttatccaaaccgagagagatcccattggtctgaactgaaatagacccaaaaacactatcttcaaccttaagagacttggacttagccacattcttcacagaccaaactaagccaccatcttcctttcctttgacagggagccgagtttgagtctcttgacccagagaagcttcacagaccaaactaagtccaaataataaaatcagtaatttatcaaattgaactttttttctccatcttatacttattatttattgtaaattatgagaattattaaacagacgtatgggcttaggttccttcggacagacgatatttctttctcgacacttccttcttcttctccatgtttttgatgaacacctttaatgatcttttttgcgtagaatcctggcgaacggctataattgtataatcgttggagatctcctaataaatcacagtatctgagattcgaattccaaatccctaggtgtattaatgaacatttggtcaaccaaaccaatgtaccaccaaaggggcttacacgaactttacttttctttaggaagaaaaataaaagtcagttcaaaaaaatacattgtccgtttataatgggcttttaacgttaaagccaagcccataatgatacatgacagcccattcattttagtactctaatttggggtgaataatccgtcccgcgttaaaaaacacagaatcaaaattacttcatatcttcttcacgtgagagtcacgtgttcggtaaaagtggttgaaagttgaaacccattggggaacaaaaacctaaaggagtctcatttctgctgggtcgagaaatcgctgatagagagtagagagacacacgcaggtacgtgaatcttcgcgacttcgatctctttgtgtatcaaatcaatccgttcttgttaaagttttcatttttaatcttccaatttcaatctgggtctacttaaatcaatcgaaatctcaatttcaagctgattcttataaagtttcgatttttcttgctgttttagattttgagctgcgtgctctgttttaagcttgaaggaggaaaaac

SEQ ID NO: 2778 - DNA, 3000 bp, Unknown
  misc_feature (1)..( 3000): cDNA_ID_3069731_gDNA_ID_1620593_Annot_ID_161475 3000 nt of promoter + ATG
cggtggattaattttattttacttttttattaatgttgattcaaaaacccgtccctccaaatccgtcttgcgaaaaagccatttattttattaatattaattttacttatgatatgactctgaattataatctaaacattttatctaataacataggagtgcaccatatttatttaataggggaatgtaccatatgactcgaatgcacttttacccaaatccaccaaaacagtcttgcaaaaatgctatagagataagaaacgatagtcggttttgataaatataagattaacaaatatattagttaaagaatgcaaattgaaaaggtatattacactttattcgaatatagtatcaaaacttatataacacagaaatttgataattttttaattgttgaatattttttttgtgctaatttttatgtgattaagatttaattgatttcgtataaaaaatattaaattattttacgaacttatttgtttataatttggtaacagatagatatttgaatattcggtatattttgcttcagtttaggaaatctttaatgatccgtctttagatccactaagccctataattaagaaatgaatattgtcgttaaataattttggtaaccttaacgtcattaaaggatttgttttttattaaatttttttaatggcattgtcatgtaattaattacaaaaattaaggttacatttaaaatgtaattcccaaataatatagtaggatctataatcgaattatgatggagaaagccgcaaaaaatagttttgtttttctgcatcctcttattattaaaaaggaagtacaaattaaaattttgtctaatttggccttaattttgatttcaattttggattttgttctttgctattcaaaatcattaaggataatttagtcttaacaatctcctaaactttatatgatccgattcaatttaaaccgttcaataaaattaattttcttaaatctaaaccgttcaacaaaaataagtaaataacaaccaaacaaaaatttaaacacattttaacacattcctcttatcactaaataacaacccaaaaaaaatctcaattattatttagttatgtttgattaaaaaatttatatttataagtttaggatatcaaatttattcaaatatttagtataagaatcaaataaactgattaacctgcgataaaccgcaggttaaatcatagttatattcaaaaaggatataagagtatggggataaactaaaatgcctactacaagcaaaactaacccgggaagatagatttttgtttccttaaggattaagcccacgaaatgtattgaaattcctacatgtgtaaagcctattcgaaaatctaggatcaaattatgggaaataaaagatagtcacaagcaataccacacgcaacttgatatcaatgatataacatacacacgttattccccattgtttttgcattgtatgcaacataaaattatttgacaaaaaaacacacacataaaattacctcaataacatatatttcctgaatatgataagaatgtaacttcttctttttgggtcaaaaatgataagaatgtttgttacatctcggacttaagaccctaattaactaagggatgaagtttcatgaattgttttaatggctggtgtagctcgtgattgcgggagtaacaaggcttctcattctttgaagggatgcaagtggacgccaatcctagcaaatacaccaaatatttatattactgcatgttgaggattatgattgtatggtaactctactgcgtgtcgatgcatgcatcagcttgaagaatttctcttcttgataccttttgatccaagtatgcaaacgatgaaaaggatatgacgcttgccaaaattacggctggtcaaaattaggagcatgggctaacgactttatgaacgatcataatatgggctgaataaatgcccactactagcaaaactaagcccacaaaataggttttttgtttccttaaggactaagcccactaaatgcatactgaaattccactgtgtaggactattcgaaaatctaggaatcaaaagtcatgtcaactaaaaaacactcacaagcaaatgccacacgcaacttgatagcaatgatatatatatatatatatattttttttccgactgaatgattccattatattaggcgaaagtggaatgcatttttgaaatacaacaacgataagagtcgaaactctgtcagaaattaagtcggagaaagacaacaatatcttctgaaacctaagcccaaaagagagaaacaaactgtaagcaaaaagttacaaaaaagtaagcataaaaataacctaaaagctaaatctgaaactcaaaacatcataacctgcaatcaatcccatagtaacgattagcgtcgagctgaaaccaagaaacatgagccccaagaagaaccaactcagcggacaaactccaaaagaaaggaaatcccgaaaaagaacgaatataaaggctcaacaagcaacaacccaatagaacagataacaatgatatataacacgatattctagatttctagattttttttgcattagtgcgcaacataatattaaacctaatcaacaaaaatatgccaaattcctaaaaatgataagaatgtctcttaaatctcgaagttaagaccctaattaacttcattaacgcttcttaatctataaatatatagttcttcaaaaatctttcaacgcattaattattcaaaaagtaaacacatggaagccgtgtagttcacgcgccggtcaaatcgaaaccgtagaaaaaagcaaagaaaagaagacaaaaacggacttgacttatagagaaagacttaaacaatggcgaagacgaagacgatgagcaacaacaacaacaacacactagtaacaacagtagcatcagcttgaaagagagaactaaaacctagaaatcgagagagattggtggaagatttttcaccagatttc

SEQ ID NO: 2779 - DNA, 3000 bp, Unknown
  misc_feature (1)..( 3000): cDNA_ID_4359839_gDNA_ID_1620593_Annot_ID_161471 3000 nt of promoter + ATG
ccttaatcgctaagcctttgaatttctgatcatcaccttcctctttcttcttctccgacttaggcttcggaggataaataccgtggattgtagttaacaacgaccggacgaagtaatccggcatctctgcacctgcttccttaagattcttatcgaattcatcgactgtctcagagtgacgacctagatcgataatgaactcagccaaaactttttctgcagatcctagatgcgtttccaattcgttgcagacattggagacgagagagagatgattcaatttgttgagctcttctttttccattgaagaaaccaaaggaagtaacaacaaaaagagaagaagacactgtttctggataatcgacttctttctagggttttttcttatagacgctcgcagagttctgattttgctaatcctatttttttctgaaatagctgactcttaaaacgctgcgttttaatttttaaacatatgtaactttttctttaggatttatatttgggccgatgcaaaacaacttaaagttaatgggctttcgcagttaccttttttgtttttttcctcaatatagctaaccttcaatttgtataattgaaaaacatcagaacggccacgtcgtcgtctctcatcctcctcaaaaactctctcaagagagacaactttctcaataatacatgattttgatttatttttaatcatctttttccagaaaaacagctgagagaacccaatttagtcaccattgaagatgctcttacattgtttagaaaaacagggagataaacaatttatcttttctgaaagaataaacaaattgttgaatttttaatttaaaagaaaagtttaaaaggtttttcaatctaaaaataacgcaacatcatcttaaaaaaagaaatgagtacataatatggtagtgaactccgcatttttagttttctaatgctagtaacatgaaagagtactcagagtagaggtgcgtttatcatttataactctaaaactcaaaacaacttgaatatcttatagagaaataaacagattgttatccccaatacatacacattaatcacaaggtttcttgatcaactaaagatcatatctaactatatccaaatagtattgcaacataaaaataaaatcgttgaaaatcgcaaataagtataccacttattcaaataatactttgttactcttcttaccaatatttttcctaaatatacggaagaagctatcatatgtattggactacttggtaggaaatctttatcaacgttgaatttttattattttgtttatagaataaagatttataaagaagaaaagaactaaaattgtataaaaagttgataataccaataagaaattttcttcagtcatatccacacacaaaaaaaaatcattgaattttaaaaaaggagaaaaattaatcatcatgatgaatgtctttcggttgatatttgatcgtgtacataattcgtcccaacattaacactatgtcaaacgaaaaaataagttttttattgttttattgttggctacaaataggatgctaaattatcaaaactaattgaatcgaaggtgaaatctatgaaaaccaagttaataaatgacatatagttaactaaacactatgccctcaaactaacacttgaattactataatttataattgatgtgaatgagtatgtttattttctcgagcgtatatgcagttatatttgtgtattaggggtcttccaaaaaaaaatttaccacaaaattatatattaaaatatccatgatgggaaatgattgaattaaaatgatctcctctcttactcaagaaaattatgggccgaaaactcaaaatatcttggtaaaaccgaaagaaaatccacctctggttttattttgtgtagttatatcatgatgattttcaaaatacaagttctaaataagtctttttttttttttttctgaaatacaaatttaaactgaagttgttgatcaatatatgatctcccaggtaaataaaaaactatatacatatatgtctatatgatcggatcatcccaatcttccacaatcgatcttatcatgatgcatatcgaccaaattggtccaaagatcatatcttagaaatgttttgaactatttttaatgcatgtcgaccaaacattttttaatcgaaacacacaaattttatactaaccaaactgaatgaaactaaacatattcgaatatttgaaaaccaagctggataaatctattaaatgtttgatggaaaatgtattaaagtttttttgacataaaaggaaaacaaaagccataatggtaagagaagatggtgtccatcacctaactaaccagcctcacctacctcataaaccacatgatgaaatcgagttaccccacgaacacactcagctccatgtttttttaagaactaaaatgtttgatttgatttgtaatatttagtattactgttgacaatttgtatatgtaataaaaattgaagattgatttactttaacataagagataatgccattttgttaaatcattattaaaattgaagaaaaatttaaacagtgcatctaattctcttctttgactacatccaaacaaagaacaaaattcccaaatcatttttattcttcttttttacaagtgggcatttgtgaggttgtgaggcccaaccaaaagagcctctcactacattccacaagaaccacacaaattcaaaagtctcactcctaacacaaagaagcatccaaacgcaatcctctcacctccacctcacattcccctgtgccaccatcacttaccctttctcgcctctcctgaaatcaaaatcccattatgcaaatccattttcatcatcatcaatatcatcaccaacttcattctcatcatccatggcccatttctcatctatgtagattctcatctctctacctcctcctcattttctcctcttgattcactaattcttcttcttcttcttcttttcagac

SEQ ID NO: 2780 - DNA, 3000 bp, Unknown
  misc_feature (1)..( 3000): cDNA_ID_1807441_gDNA_ID_1620593_Annot_ID_161472 3000 nt of promoter + ATG
ataagagataatgccattttgttaaatcattattaaaattgaagaaaaatttaaacagtgcatctaattctcttctttgactacatccaaacaaagaacaaaattcccaaatcatttttattcttcttttttacaagtgggcatttgtgaggttgtgaggcccaaccaaaagagcctctcactacattccacaagaaccacacaaattcaaaagtctcactcctaacacaaagaagcatccaaacgcaatcctctcacctccacctcacattcccctgtgccaccatcacttaccctttctcgcctctcctgaaatcaaaatcccattatgcaaatccattttcatcatcatcaatatcatcaccaacttcattctcatcatccatggcccatttctcatctatgtagattctcatctctctacctcctcctcattttctcctcttgattcactaattcttcttcttcttcttcttttcagacatgactcttccttatcgtttctcttccgttagaaaccactcacttctacttaagacttctcatctctgcacacccagatcagctcttggttgttgtttctctcccaaggaatcccctttcttcaggaagaacactgcccaattcctttctcctcagaaacacacttctcttcctctgaaacttgtctgccctttagctagtttctcttcttatgcggattctgagggagaagagcaacaccatgctgatcaaccgatacagaaccctcacgaatcttctaccgtttcaaacgaatcagatgggaaaggtaatgcagaagctactggagacttttctggaatggctcaagcctttcacatttcttccacaacagcaagggcaatctctatagtcatcgccttctctgctctcacccttccaatcttcatgaagtccctgggacaaggactggctctcaagaccaagcttctctcttacgcaacactactctttggtttctacatggcctggaacatcggagctaatgatgtcgcaaatgccatggggacttctgttggatctggagccttgacaatccggcaagctgtgatgacagctgcagttctcgaattctcaggtgctcttttgatgggaactcacgtgactagcacgatgcagaaaggaattctcatggctaatgtgttccaagggaaagatatgttgctctttgctggtctcctctcttccttagctgcagctggaacttggttacaggttccatcttatcttttgcttcttcatcactaggttcaagacaggatttagtaaagttaataccttttaaagatggcattcacaaatgatacaagtagagaacgtaattgtgaacttgtgaatataacaggtagcttcttactatggatggccagtatcaacaactcactgtatcgtcggatcaatggttgggtttgggcttgtatatggaggagctggtgccgttttctggagttccctagctaaagtagcttcatcttgggtcatctctcctatactgggagctcttgtctccttcctagtctacaaatgcatcaggagagtaagtaaaacaaaccaagaaactaactttctaattctgaaagatcactaaagtcatactcaagcttctgctacattttcacactcttctttcgttctgtgcagtttgtttacagtgcaccaaacccaggacaagcagcggctgctgccgctcccgtcgctgtatttgtaggtgtggccagtatctcctcagccgcattgcctctaagtaagatctttccaatagctctatcacaagccttagcctgtggagtagcaggagccatagtattcgacagaatcatccgcaaacagctcggtcacctcctagctaaaacaaaatcaccagaaacatctcaaaaccaacccaaaaccattggtttcctctccgatatcgcaggaccaacaggtacacaactcgaaatagtctacggaatctttggctatatgcaagtcctctccgcttgcttcatgtcattcgctcacggaggcaacgacgtctccaacgcaatcggaccattagccgccgcattaagcattctccaaaacggagcagctgcaggaggagccgagatcgttatcccaatggatgttctcgcttggggaggattcggaatcgttgctggtctcacaatgtggggatacagagtcatcgcaacgatagggaagaagatcactgagctaacaccaacaagaggattcgctgcggaattcgccgccgcgtcggttgttttgtttgcttcgaaattagggcttccgatttctgcgactcatacacttgttggtgctgtgatgggtgttggtttcgctagagggcttaatagtgtgagagctgagactgtgagagagatcgttgcttcgtggcttgtcaccattcccgttggtgctacactcgccgttatctacacttggattttcaccaagatcttatcttttgtattgtgagtttctgtttcttttggttttgttatacgaagaacatgaaattgatcttcttcttctatgttcgtttgaatgattcgagtttgaaaaaaccctaaagttatcatctttcgattttttcacccatcggtgaagtatgatcaaagcttgtacctttcttgttcagtgtttcgtctcgtcgtccagtaaaatcgaattagagtgggtgacgtttggttacttctaaaacgtcttgttgtttgtttcctaatcgtaaaaacgtcataactttttaaacgacatcgtttttttttcgagtaaacgtgagacgcgcgtatctcttgcttttcgtacacgcgtctcgaacaaagactgacatgattatcttggctaaagacggaaatagccttacacgtttccccatttcagcgataaaattgagggtatttgagtcaaataaagaaatagaaatatctctcttcttctatcttttgattctctggttctacttgttcctctgttttggattgtggtggctctcta

SEQ ID NO: 2781 - DNA, 3000 bp, Unknown
  misc_feature (1)..( 3000): cDNA_ID_1818895_gDNA_ID_1620593_Annot_ID_161473 3000 nt of promoter + ATG
tcatttcttaattatagggcttagtggatctaaagacggatcattaaagatttcctaaactgaagcaaaatataccgaatattcaaatatctatctgttaccaaattataaacaaataagttcgtaaaataatttaatattttttatacgaaatcaattaaatcttaatcacataaaaattagcacaaaaaaaatattcaacaattaaaaaattatcaaatttctgtgttatataagttttgatactatattcgaataaagtgtaatataccttttcaatttgcattctttaactaatatatttgttaatcttatatttatcaaaaccgactatcgtttcttatctctatagcatttttgcaagactgttttggtggatttgggtaaaagtgcattcgagtcatatggtacattcccctattaaataaatatggtgcactcctatgttattagataaaatgtttagattataattcagagtcatatcataagtaaaattaatattaataaaataaatggctttttcgcaagacggatttggagggacgggtttttgaatcaacattaataaaaaagtaaaataaaattaatccaccgtttcaatacgggttacatcttgaatttttttttaagaccactaatattaaacatatcaaatcatcttaatttagaaaatgttatataaaaccaaaaatgttatgtggtatgtataatgttactatatataaaattaaactataaaatataaatgtattagagaatgatacaatttgcaaaacttttatatataataaataattcttaaattttaaaaattactacttaaaaaaaatcacgggacgggtaaagaaattaccgaacgagttttattttggaattgggttatatggtggatgtatttgaatcaatatttataaaattttaaaatattattaatatgttgttttaataagggttaaaacttcagttttttaacaattgtctcatggattcgtggtatactgttacttaataacaattatacactgtaaaatataactattttataaaaataaaatttgcaagttttaatatctattacctttaaaaaataaatcgtctcgcgatataccgcgggttaaaatctagtattgttgtattactctacgatgtggtgttttggttatatataaaattctatagattcgaatggaaaagaaaaactacatatataaggatttcaatttaaaaacttatcgtcaaccattgacataaaaatctctaaaccttcaattttcaacccacagattgatttcctactaaatatctcaaaaggtgctgcaaattaaataattttactggtaacaacttgttgtcctactaatcttatggttaagtctaaaccacatgtaaccctttttatataagggagagtcttgtaacagaacaagttaagttgagagtgaaagacattgattgatggattaatatattatagttttttttgaatgatgaaacataagttttcttcgttttacacatgaaaaagcttagttaattttgcagttggttaaaaggaaaaagtcgttgattggctttctcttaacacttgtagggttttttttacctcaaagtctctaaattaaataattaacacatagcagcctctaaaaagttagtgtattttgatataatagattaaccatcaccatgtcaattcaaatacaagtgtatgtcttcaaatttcattaatttattttcttctcatctataaaaacagcatcagattttctttttcaaaatggttaagattttattcacccaaaacaaaaactttttttaaaagtttttaacaaaaaaaaatcaaatcaatacccaaaaaaatattagaaaattgattgctagtaatagaatcctatattataatttgactagagttttaaccaaaattcaatactgacacatatcatttaataatactaccaaaacaaaacacatgtgaatccatccataatatataccataatttgattaatacaacaatgattttgtctacatttagccattttattaaatgctagttgctatattagctattttttccttaatatcataaaaacaatttttttggtcgcacgtattaacattttttttcctatataattcatgaatgattaaacccaagatcctcactcgttggtccttagtcttcgacctcctttaatctctccatctctttctcttaagatggcaaaagacaaagatataacggagacgcttctcactgcggcggaagaacgttctgatcttcctttcttatccgtcgacgatattcctccgatcaccaccgtcggtggcttcgttagggaattcaacgtggaaaccaaaaagctatggtacttggccggtcccgccattttcacatccgtgaaccaatattctctcggcgctattactcaggtcttcgccggtcacatcagcaccatcgctcttgccgctgtctccgtcgaaaactccgtcgttgccggcttctcattcggcatcatggtaaattatatccacgccttttattttgtggtttgcatttattatccaaaatgcgttttttttctttctttgactaagtttcattattaacttaaaacacacaaagatccaaaagttgggagatgtccaaatcattcaaaatgtttttgtctacatttctataaacaattttctatattttaatttatatcaaaagaccattaaattaaaaaaaataatttaacatatatacattaaaaatgtaaattcaaacgcccaaaaaaattgaagaaatgaattcatgattatcaatttgtagtcactagtcaaagtacaatttatttatcaaatggaccattttctcaagtttaaaaattaatatattttttgccttttgtaaaagtttcactttatttttttttgtaagatttaagaagttttgttttgatcattgtaatgaatgtgattatgaacgtccgcaactagcttggaatg

SEQ ID NO: 2782 - DNA, 3000 bp, Unknown
  misc_feature (1)..( 3000): cDNA_ID_3069743_gDNA_ID_1620593_Annot_ID_161463 3000 nt of promoter + ATG
cgagatccaagtgtacacctagaggttccaccaagttagttgcggaaggcccaaaaaaattgcactccttaattgtctcgcccccgggatagtcgttttcgtcgttgtacgcttccccttcactgagagagtcgtaagattcagtggctaaattaattgacggtaaccccagatttttaagtaaatctgcctcaacaacagttgagtcttcttcctgcgtaaatagatgtcttagtactgtaatggtatattcgagtggctgaatttaataaacgcagaatattttacctgatctccatcttcagtcgctgtgtccatactttcagtcgttaacatcggggaagctgcctcaacagctggtctcacagggtgttgttgtacgttggtagaagagtctccaacgttttgaccttctgtttccgttgaacgcatccagcggaggaccgcctcgtcatccataagccttttccacacaacggactcgtagttaggtgatcgttcagcgttgacgtataaaggtgatttgcctttatctgcaaatccgtaacttgaagtctgacttgttccaccatcttcggaaccatcatccaccgtttgcttggagacaaacaaactcaagtcctccaactcaaaacgcatagctagaaacactcccattgtctcctctgaagttatgcttactggcttcgtgcgcccaccaaaggtagtttccatgtccatccaatcaggccattggtaagtcaggtgtagtgggccttcaacgtattcctgtccgtacgcttctctaacaagctggcgcacagatgctaacttctccccttccccaatgctcaacctcctcactgcattattgtgattggatatgaataaccatgttccatcagctccgattgcccaggagccactcaccgtcctgacataacgatcgtcggttatttcggttataaccaccatcggtacctacacattaatagagttgcattaaatagagataaatcaaccatgagttttttaaaaatagcaacaaacccgaccaaaagaacattcattaattgcataccaaaacagaaatgatcgagttcttcgatgttgttggatacgtagtgtgtgctttataggaagaagtagaggtgtgagagatgatatcttgccatctttcttcttttatagaaaaggttaactttgttttttagggctacagtaactaaagatatttctagtaacagttgcttaaccatttgcagccacgcgaatttcaaaacggtatgatttccctcccaacacccgagggaggcgtgaagcgacaattcacgaatgtcaaatcgaagtggtaagcgttctttatttgtattgcatgttatcgtcaaaataaccaggtgatttacttagtctttgctttacacattttcgtgaaccgaggtagtatatcttctgcccccacttgcctattcgtaatcttgacgtcattgaccaacgtgtcaacttaacgacctgccattctgtagcgtatagcataagcacacaaaccttgctttacacaattaaccaatgtcaaatcgaagtgttaagtgttctttatttgtattgcatgttatcgtcaaaataaccaggtgatttacttagtctttgctttacacattttcgtgaaccgaggtagtatatcttctgcccccacttgcctattcgtaatcttgacgtcattgaccaacgtgtcaacttaacgacctgccattctgtagcgtatagcataagcacacaaaccttgctttacacaattaaccaatgtcaaatcgaagtgttaagtgttctttatttgtattgcatgttatcgtcaaaataaccatgtgatttacttagtctttgctttacacatttccgtgaaccgaggtatagattcagtatatcttctgcccccacttgcctattcgtaatcttgacgtcattgaccaacgtgtcaacttatcgacctgccattttgtagcgtatagcataagcacacaaaccttgtgttaaaaagtgctacactaaagaaaagggtttacacatacaacaatatattacgttggaagctgtatatcctctgacgccgcattaaatgcgtctgatacgtatctccatctctctttgctcgcgctttttattgtcacatccgggaatttttctaataattttctcttatgttttctttccaagttgctccgatatgattattgtgattttaaaacatcacatgttgtttccgtagtacttgtgctgtttaccaaatcgtagtacttctgctggtcatagattcaaggtaaaagcccattcaccttgttgaataatcaatccagtacaatactcacccgaaaaagttaccagcccaatatcgtggtatatactccatttcaatactaatttttttgttttttaatgattatttttttaaaaaaaaaatgaaataaatcctttcatagtacatgctgctgcagttgtaaattgcatgtattttatgaaacgttcagtacaaacttagaaagttgtagtaatgaaagctctaaattgagatctacactcataaatagttcatgctttatttagtagtaactgcataagtaatgcatgctttttttttttgatacgttgtaatcattgccctacaatctctagctcccctacatctacaagtctgctgtcgggaatatggttttgccgcccatccgtagaggctatatcggatatttcgcatggtaaaaaaacgttatatacccaacttttctgggagaaggtcattctcttaataaggatgtcaaatttggtcattcagtaaattaacccttaaaaaaatgcaaaataatttgtttatgtgacaaagaaatggattttatctataactatcaagaagaagaaaacactcggctatatatatacgtacaacacataagaaaaacaaaccaatcacttcactctctctaatcaaaaagcttttaacctcagccgttaaatctttctccgatcatg

SEQ ID NO: 2783 - DNA, 975 bp, Unknown
  misc_feature (1)..( 975): cDNA_ID_1810155_gDNA_ID_1620594_Annot_ID_161488 3000 nt of promoter + ATG
gatcaccgatgacataaataaactaataaaacatcgcggatttaaaacaacgaatctcgattttctctctcatcatttcattcactcttaaggcgggattgtgaagtcttcatcaatttaaaacatcaaatgagtatatgaactagaaaaagttataaaaataatataatatagtctaaaatcttttattttagactttttttccgagatatcctatgtatttttttttttcttcattaaagtttctaattttctatcctcttggtttttgttctgttttcattttcttcccgttgtctccatgaatttttttttactttttcctcataaattaattttaagctgtgttctaaaaagcggtttaggcggcactacgctcttaagtgactcgtagacaaccgctttgaccgcctaaatttgcataagttccggtttactgtattgttttttatttttaactatataaaactttcttataagtcttaactcaatatatattctttgatatgaatttaactaatttttgtttatgatttaacattttaatttttctaatagatagttatatataatttattatctataatattatattcaatatgtattatattataaacttttaaactgtataaaatcgtctaaactcctattaagcattgtaggcgttaggcgctatgttaccgcctgcctagcgttttcttcgacactgattttaagtaacatttcgagctagtctcattaacgcctctatttatatttgataattttactaattcatttttttatcttgatttgaaagaaaaatgttcagtggtaatatgattagtaaaattataaaaaaatttctttcttttattaaatacaaaagttcttaaaacgtgcagacttgaagatctccacaaacctccaaaagtctattcaaatggcagagacagttgaatccatcatcatcatcatcatcgtcttctccaaatg

SEQ ID NO: 2784 - DNA, 3000 bp, Unknown
  misc_feature (1)..( 3000): cDNA_ID_3047286_gDNA_ID_1620594_Annot_ID_161489 3000 nt of promoter + ATG
tatttaaatatgcgatatagagcaacaaaagaagtatataaataaagaaaattaactttgaatacagtaaatttagagtttttgaatgtaatgtccaatgaaaaatttaatattacctatggtatatattttaaatatatttctttaaatataaaattggaaaaagaaagattcattattttccataaaaaagagcatttatagtaaaaaaaatgtaactagtcaataaagaaaaataaataaatggaaatcttttatttataaaaacagaaacgtattcttaagaaaactgaaataaatattttccttttgaatttaacagatacaaatgaaataaatccaaaatatgtaaaatacatattatatatttcaaaacaattaagggtttaaaggcttttacataatgtacgaaattttatcctagataatgtaatttcttgcagtttaccggtgaagcttacctgaggttccaaaatattgtatacagaaccgttcatcgtggtctcctgtcgtacggagagagcatattcatcgcatactgcagaaccgtaacatcttgatatctcatttgaaaattctttctatagcttcgagagatacatcacattgatgattttgatatttttctcttgaatatcttccttttggtttcgttgttggaagtcgatccgttcaaaagcttcaaactttctcctgaacttgctttcagatttgttaagatcctcataggtttttttacttcaaacttttcctaagtcttaggtgttaagaggcccgtctcaatatatttataagcctttggtaaaatccaaaataaatctaagacctcttagtaatttttttttgaaataaaaatggaccttttttctttaagaatttttttgaattttgtaatggacccatggcatttgccctactctgccatgggtcagagacgggcctgggtgttaagaagggttttcaaagccaaatccattcaaaagcttcaaagtttaacctgaacttgctttcaaatttgttaagattctcatagtttttttttacttcaaacctttccaaagccttaaggaattgatgcataagatcatggacctttttgtcagcataagtgcacattgcatttaaaattatgaggttgattagtgtcctccattattcggtgatggttgatgatatatggtagtgaatgacgatatactagtctgttggtgatatggtatcgatcgatctgatccattagctaaacagaaggatttatttcaccaacattaatgacctgcatattttctacaaagctataccgttcacgtcaacaccatgtcacaagataaacatagttttttgtttgttagttactaataattgaaaggatgtcgttgaatagtcttctgagttcttaattacgtttcaatacaaaagccatgtatcttcactagttttgatattctattattctgagttcttaattatgtttcaatacaatttgttcaatgtataggtattctaaaaaactagaacaccacgtacatgaaatctaaccagtctagtgtcagtatcaacaactttgttttcgttcacctaatatgctcatgttaaacaattggagattctaattgcaaatcaagataatcattatctaaaaaaaccaagaattttgaaatatatgttatattattgttatagtcagttgtgtttttatctttctgttatataaaaaataggtgacatttgtccatatgcgttgctactgatgtttactaactatatgatatcgagttgaataagtattccaataactttgtttttaagtttcgaagctaagatatatatctatagaggaataactaaccggagcattgactacctaattctgctcatggttgtgcacctgccccggcccacccccacaaattgctacctaagttcgttagtgtatataacttacgaaattaaaaataaaatagcttcatctatattatataatttgttatactttttttataatttaggggaaaaacccccaaaaaaaaccatcgtctaatttaaatttgtccatttaataccaatttattgaactctcacataaccacctgactacgacaatatattcgtaacaattaaaaaagaaattatatatatagtaaacaccatatggttaagttttaactacagctagtgattccgttacggtcgttaattcagatatctaattttgccaaaatttaaaaaacaaaagtttttaaaagacataaaaattaacttagatattttcggacaaatttcataattcagatattaaacggggaaatttaaattagaccgtgttttttgggttttttcctaatcatttataagtgattttttctgtcttgttatttcttatattattagtttattacatgcataataaaattattcatgacaatataaacacttggatagcaaatactttcatgaaatactcaagtctcaacaactgacaattctcctaacaattataagtatccacgagagactttttacctagatcacgttcttgatagatagctttattctaatttagtgatcattactgaaatttgctacatatttaaatattttaatatatatagaaattatagtatattattttttaaagacatttttttattttatattaccaaaatttgaattttcaaaaaaaatccttataaggagatatataatgagaattaagaaaagttgaccaaaaaataaattaataaccatataaatgtatattatataaaagtttctttcaaagaaaaaaacaaaaacaataatatatagaagttgtgcaggtaaagagatgtacaacactttttattaaaggtcaagtaacaactcaaacaagtgaaaaaaaaagaaaacaatttcactttttttggaatgtgtgtctctcttccatttccatatattatataaacaccaaatgagatctcatttttctaataaataagaagaaagaagagagaaacaatg

SEQ ID NO: 2785 - DNA, 3000 bp, Unknown
  misc_feature (1)..( 3000): cDNA_ID_3069755_gDNA_ID_1620594_Annot_ID_161498 3000 nt of promoter + ATG
cactgaaatgggtccccaaaggtctatatgtaataactcaaaagttgaattacaaatattgtttgaagactgaaaagacaacttcttctgcttagccaaatgacaaatgtgacaataagcagatcctttattcttgtgtttagtagtcctcaaaatgtctgaaatagcatccagtcttgagtaagctggatgtcccatcctcatgtgccataaactaacatccaccaccgcattaacagagactgaatccaatggaggtgtagtatccaacacatagaggttgccaatgcgtctacctctgccaattctcaggtccttggtaagatcctgtatttcacaacatgacggatcaaagatcactcttgaaccaatatctgaagtcaaactactgatgctgatcagattcaaacgaaactcagggagaaataaaacatttcgaagaagaatgttttcatttatctgtactgaacccactccactgattttaacacgtgatcctgttgggagattcacataactcaccacagaatgatccaaagaaacaaataggctcttatcatggcaaacatgatgagttgcaccagagtctatcacccaagtttcagtggaaagagtatgttgggatacattcaatataccaacaaagtagtatgtagagttagagaatgagataccagtgtaatcaataggagaacgtgaaattccagcatctgaagaagaagcagttggttgtgacttcagttgagaactgaacaaggctatgaagttctgaagttgatcattggagagattaccaagcagaccatctagagtagcctgagttggaaccatcggaggcaataaagagacctgagcagcaaccggttgaggtttggtacccttctctggtagtttgcctttaaaaccaggagggtaaccatgctttttgtaacatttctctgcaatatgtcccaccttgttgcagaatgaacagattggacgccctttattaggtccattctgaacatagcaaatcttaggagtcaaagcagtagaagatatcttagagacctgaaaagcagcaggaggagaaacattggtagagaaacctttctgactgtaatcctggtcaagaatattgtaaacttcaaccagagaaggcaaggctttctttgcaatgatctgtctcctgactatagagtaggactcattcaaacctgccaagaatttgacagttttagctctctctgccttctgttgcagacgaagaactttaccacaagtacaaggatcatcaggttcctctgtactgtccaacaaatcccaaagaatacgcaactgagtatagtactcagatagagaaagagaaccctggcgaaaatcctggatctcctgtgtcagattgtacgtacgaggaagattagtcatatgaaaacgtccataaatgtcacgccagatatctgtagcatcattcatgcgtagaatgctacgataaatctgcggagacacagagttcaacaaccatgatttcaccatactattacatctggaccaaaggcgaaagttcccatccgattcaagtggacgaggcaaagaaccatcaacaaaaccaatcttattcttagcatctaacgagatccgcaacgctgcactccaatcatcatagttagtctcatctaagcggatagagacgagattcaaacctggatgatcaccactgtgcataaaaaacggagactgagtcggatccatggaatctgaagtcacaacagctcgcgatgcgccagcagagagcagatctacagctggaggagagatcggaggagagactgtgagaccagtggatcgcgacgatttccatggaacggagcttatcgacgcctttgaacgagtggatttccgagttactcgagcaacagccaccatctttacagaaaaacgagtagtgaacaagaaaaaaacgagatcggagaagaagaaatctgatcggaaacaacaaaaacttagctcgttggctctgataccatattacaagataaggattgagctgagctagggagaaaacttgttaagattttcgattcttatttcttaaagagtaaagtgtacaacaatttccttatatacaattggtctaacttaaccagtcaattaaaccggagaataatctattctaactaaatcggatggtatatatactccaagagagttgttattatacctcaagagcgtaaaggtttagaacgaacacaagattcttgagctgcgaaggctgaatgaagaggtggacaaagagattgctctgagtaagtcatgtgcagcgaagattgttcaacagcttgaaaatgtgaagcatcacagttgcagataagtaagttgttgtctcagagataggcaagcaaagaaaatggtgtaacttgaaggtgctgagaaagtgactgcagaaaaagagagcacaaagagttaacggcgattccattatctgcaacattaaacaaagataaaaaaaagaagaaattttcacagaagtggacgaaaaaagatttgccctcaccgtttgtcaaagtgagaactggttttcacggtttctcttttcattcaatttcggaccaaattaccctgggaaaacttaataatggcacaaaccaaaccgtgcaacagttcgtatcggttcagttgacggcgtaaaccaaaccctacagcagttggttttggtttagttgatgcggttcagttttgaaaaagacaaaaaaaaaaaaaaactgaaacgaagaaacccgagaaaacgaaaaagagaagagagtaacggagagatttgagagagaatcagaaagcgaaacgaaattcagtatccattgcttcaaaattcgacataacttcgaattgttgggtagttgaattgagccactgaactcccacatccggggaagtgaaagttactgtttttcccggcgaagccaagagaaagttactttttattccggcgaaatttgaacctccggcgagatagcatctttagct

SEQ ID NO: 2786 - DNA, 3000 bp, Unknown
  misc_feature (1)..( 3000): cDNA_ID_2171559_gDNA_ID_1620595_Annot_ID_161501 3000 nt of promoter + ATG
gcttttgcatttcatagatgttatcactcatatactcgaccacacctagttgtctggtaacagaatgtgcagtcgagtatctttgttactgtctctgctctttactcaaccacacccagtgcttggcaacaagttgtgttggtcgagtattttaactgtttctgcttgaatttctatttcctacatgttgccttaggactgttgaaactcaaaacctgttattgcttggcttgactctgtgaactttgattgcatcttgattgctagcatcacacccaatttggattgacaacctttagtactacaacgacatgatagtgctttaggattaattgatcataaaatcctattatcaatttggcgcagttgcccattgggtgtttatttgttacatttaagatttcagactagcttagatcaagttccttttcaattttcacttcaggtactaactgtgtgttttgcttgttgtctttttgatccaggtacacctctgctgtatgcaaactcaatcaaacggtatccagaacctcctttacaacgataacatcaatcgcatagctcaggaactataggaaggagaaacacagtcgaccttgtacaacacaagcaactactcgaaatggctgatgaaccaaatcaagaaaatggacccgcaaacattggtgctgagatgcaccaaggaatcaccgtcagaggaaagaaattgtcccaagtccagttgctgctaatgttaacaaagcggagacgcaactctctgacattgacccaaatcataatgccttggaggagaactcccctgacaatgaccgcgatatgttttgagcggaattgacaggtgattaaggttttctttataacccaatcccttcatttgctaaagcaataggtgatctcccaggaccggtagaagtactagcactcgagctgcgcaaaagataacaaacttatgagataggagaagcatccggatcttatcgaaggagaagggtggcgtcagaaattaaaatgaggttcaacattcagaggagtcaatgggttcagaggataacatcaataataagagtcaggatagagccgcggtggggcctgtaacaccaaaacctctatgagagttggattttggaactgtcaaggatttggacgatctttgacaattcgacccctagaggcaatacaacaggtgtactttctggatatgttgctattgattgaaacagaaaaacaagacaaatacacaaaggatttaggagtcaagttgggatttgaagatatgtgtattgtttctcctagaggtttaattgggggttttagtagtgtatattataaaaagcatctttcactttaagttatttctcatgatgtaaggcttgtagatctttatgctgaatacaaaaattttaatttctacttgccttgcatctatgggcatccaataccaagtgaaaaacatcacctctgggaaaaacttcaaagattgtcagcaaaccaaacagatgcttggattatgtggtagccgtcaaagtattggccgtcaaagtattggcatcctacaagacttcacaagtacaatcaattgctgcaatatgaaggatctgaaatttaaagggaaccctttcggttgggtaggcaagagagagaaaaagactatatagtcatgtttggagagagttttcataatgctgacttgcaagcctcttttccaacttctaaaatagagttcttacgattgttggatcggatcatgcccctgtaataatagatattgcaaatgagatttgcactaaacagggccaattcagatattatatatgacatgttcactctgaagacttggttgacacattgcaaatgtgttggcaaaggggacgaattgatgcacgaaatggatatcaagataagcttcgaatgtgtaaaaaagaaaaagcaaattagaagaaaagaacaaagaaaaattcagttgagaagattcaggctctgaaacaccggttagatgctgctgagagaaactgctcgacatcccaactaacagttaatcaacttagacacaatctgaaccatgtttatagagatgaagaactttactaacatctaaaaagtagaaacaaatggatgagactgggacttcgtaatacaaagtttttcaatgcatccactaagatttgaaagtctcgaaatcgaactaaggcaatcactgatgaccaaggaatggaacagttccgcgacgatgctattgggaaagtggctgaaacagactttaatgatcttttttctacatcgtagaatactggtttgacggaagttatttctaaagttgtacccaaagtaacagatcagatgaatcgagagttattatagtcattattagatcaggaaataaaggatgcagtcctttcgatttaggcaaatagagctccaaattttgacagtttcacggctgccttctaccaacaattttgggacttgatagggaatgatgtctgctcaatggtgcaccacttctttgaatcggatgacatggttatgaatctactactaataaaagcaacagtttgaggcttctcagcctagccacatatgcattctcaaaaacactctctttaatggacacgtcaacatctttctcaagacagaaaaaacaaagctacaaaaatcaacgcagctttagaccaattactataaaaaacgcaggcccaaacaaatttaatccataatgtaaactctaatctacaactaattgaaacaaaataaaacattacaaggcccaaaaaaaaacacttcaaaaaagaaagcccataccactactaatttaacaaaacaaaaattagccccaataaaaaaccttcgccatcaccacctttcaccgtcgtcttctttctctcaaattctagcgattcagattcttcaaaaacaaaaactgaaaacgtcttatcaaatctccactccctcatcttcaatcccccatacattcatttcaattgacattaaaagaaactaatg

SEQ ID NO: 2787 - DNA, 3000 bp, Unknown
  misc_feature (1)..( 3000): cDNA_ID_2171601_gDNA_ID_1620595_Annot_ID_161515 3000 nt of promoter + ATG
caatgacacacctctctctgtacttcttctgatccacctgtgtggatacaagagctgggctgtcaacaataaccataagagaatacgaggcgctctttgtattggcggtgttgtgacaccgattctgatcgcttgtggagtcccaatcacatctgatggactcgagccacgggcaatggatatcgagcatctacgtcactgcgaattcgtggagttcgcaatggttggcgacatgcaccgtttcaggtttgagcactctacggataagagagctagcatccttctccccagcccagaggttacacgcataatagagggagataacattgattttaggcctgagcttggaaacctctactatgagaacgctccgccattggatgaggatgatcttatagaagaagctgctgaggatgggatggatgaagacagagcagtggagtttgacactagcatgtatcattttagtgaacatgtacctccagcgagggagagcaagagcttgagtgaagctcataggaacaatagcaagctgcagaagtggtgcaagaagcaggacaagctactcgccaagtgcctcaagactatcaagtttctgacggatacgctgagctgttcctcttacactacaaatgttccacagggacaacctcctctagagatgccatcgaggagatttgatgagcctgagccaagtcagcacaggcctgagcctagtgagcagagagtctcacatgtccctgctagacattcatcattcgagtctcgggagcacaagagaagaaggaaggctacactcgttcgctctagcagcagatcacgccttattcactcgaggagatcactcgaccacggtgctggtcgcagcagaagaagagaggtcgagtatcctcagagcggtgttggccgccatagagctgatgaggtcgagtacccacatgctggagctgatacagaacagggcgggtcgtctatggcctgggagcaatcacaggcagccattgacgaccaactccgttcattctttgagtgaggtaagcgcctcacttcaccattgtattatatcatctcttgtgatttgttctttattttgtttctgtgattggatttgtcctaagtactctcttccaagtttagtcacacagtggattgtgtgttttaagtttgggggagggctcaggaagtgtgtgttgcattgtttatactcttgagtctgcattcatcaaggcataggaaaaaaaaaaaaattgaaaaattcaagaaaatgatttcacaaaaatagagtgttcatgtagttgcatttcatttaggatcgagtctagagtgtttcatttaggattgttgcatatgcataggggataatgatgagatagccttgtaagcattttggttcaccggataaactcagtgccctcgttgctagttgtctgttgcgtagtcaatgaaattgaagtaaaactgaaccatgcctagattgctctactcgaccacactgtcatgatctgataccattccctatcaatttgaacctgaatttgatctttaattatcttgtctgcatcaaatttgaactcatggataccctaaaatacctggattttcttattcattttgatcactcttgttaatccaagtagctgactctccttattaaagcagttaacccgaactcaaacctagactttctttcaagccctatatcacttgtgagtgtttgtgaggtcttattccgattaagcttggtagaaagtgttaggttcgtaacgatagagatagtgtctcatggagttctagttcgcatttttcggactagataggactaggtgggcgcttatactttgggttgggatgtgtcttaaagaaaaaaaaaaaaaagggttgattcattgatgagaaagggtaaaagactctaggtgaagtaagctaaagaagcaaaaaagtctagtaaaggttttgagatatgtaaagaaaagaaagagagagttcttgttagcaattgaagatgggcaaaagccctcggctttaaaattttaaaaaataggaaccttagttgtcaaagaaatccaaatccgctagatgtatcaaagtgttgagaaagcttctcctaagagttaagagagaagaaaagaatgattagaaaaagggcttaaaggattcatgaatgcaaagggtagagttaagttcttatactgggattggagatgggattaccattagagcttcatttgatatactctgggtagatgggatcttatctctgtatgcatagcttgggacttacctttagcattctactaaagctcaatcattttttgagagatcccctgttgctgaagcctattctataagggaccatctttgtctcttggcctttaccttagccaaatgagttcattgatgatacattgcttgattcacgttcgagaactaatgaatgttaaagggattggtagatttgaaaacattatgtaggtcgagcaaatgagtcggattgattgataacaaggcttggctaacctttttgagtagaattcgatcatatcgtaacttagaactatcaacttggacattgatttcatctgatatacctgctttggctctgagtccccgccttcaaacctcacctccagcttgttcttaattgtttgcttagggcaaacaaagactaagttttggggagttgataagtgtgcattttgcctgttttgagcatccatttgtcatcactttagcatcatatcatcactgttttatatcatttgtcatcatttgtcatcactttgcatgtttaggatagttttgcatgcatgttgcatatttgtgttgttttcaggtgatttggagctgttgacgagctaattcaaaaaagcggacctgatcatgtcaaaccactcgaccccctggtcgagtagacgcttcacgacctcaaccgaccactcgacccccctggtcgagtagaagacttgaccactcgaccacctggccgagtatgatgtgatc

SEQ ID NO: 2788 - DNA, 3000 bp, Unknown
  misc_feature (1)..( 3000): cDNA_ID_3069772_gDNA_ID_1620595_Annot_ID_161522 3000 nt of promoter + ATG
atttacgactacaactaaataattaggtgtacctacttaacaatgcaaaacatgttttccatctactttatacgactacggtgcgacgtttctacgactacaggacgactagacgacttggtcggcctgtagtcgccatattagcgactaaataaaatagacggtagaatagtcgttaattagcgactaaacaacgacaacaatatccctccaataatataatcgtcaaatagtcgtcacttgccgacactttgccgactgcatacgatagtcgtaaaacaacgactatgtgactacaatttttcgtgttgtcgcaggcgagtcgtaaatccgtcgccaactagtcgtataatgttacgactacgtttattgtcgctgattgtagtcgtcgtttacctgttttcttgtagtgtattgtatccttacgactgatttatggctgaagaccaagcaagggattaccctccaatactttacccagagggggattctaatctggaggctaaagccattaatcacaacatcaagcttggagatttccctatgattagagaatcaataagacaagatacatgggatgaactgaaagagacaccgcttggattaattgctaaacttgtttatagccattttgtatggtttgtaagactgtacattatctactatgcagacagttaagagtactgaagaaggagctttggtgtctcgtggctggtcaacccatccggtttggcttgaacgagttttatcatatcacgggtttaaacacagatccactgcctccagaaaagtttgagcttaaagcggactacaaagcgttcttcagtgaattgggtgtagtgatataaccctatttttaccgattttagccatgatttaggtataggttttagagcctaattgttatttctagagtgttttctagtccttttcaggtctttacatgtttgggatgcatttggagattatggagcattctggagatcagcagacaacttaagctgcagaagcaattcagagacgaaaatgcacgtaggtgtcgaacgacaccacccctgattttgagcgacaccaatacctgacggcaattttgagacacaacttattgatgttttgaagatttccaaattcggcccagaactttctcctatgtttaattaagacccatcacgtttttaagacatatatatagtttttaggtcattgttttagacccgaagcttggtgagtctattttcaatctcttttgtactttgggagcaaaaccatgtggaaactccctttggatctttcttactctatcctcttcttgttttattcagggatttctattctaatcatgttgtttacttcattcatcatgcttgagtagttttcctgttaggtttacggtttctcattagggttatagatgatttagtagatggcccccttgctaggttatctgtagaaattcttcatcttgattgttcttaatgctagttttagagtagctaactagaacttgttcttagataataagtatgcccaccataggtacttgctatttgatccatcatagatgagcctaggcatttaagaaagaacaggtaggctcatagaagggctctggtttagatactaggtgaactaatcaaacttgataataatgcatgtttaagttaaagatcttttggcttctccggttattcttaactatagtcatcgagagtttcgcggaacgccaccggttactctaaaatcatagtttgagttcgagaacggtttgataataacttagatatttctagatctactatcatctatttcctgagaataccctaagcttgacgcttttattatcttgtttcacaaccatcgattgctattgtttacttttgtttctctttattttcattactgttttacttttcttaattccaaaccttagtttattgcgtgatccgagaactttgtgaattcgatccctaagtgctgcaactgacctctttatttgagagagtggtcttaggattaatttgacctatatcaaatttggcgccgttgccgaagatctctttgagtcaccattagactaggtgtagaatttagactaagcttttatttttctttcttttgtttctcacgcattttctttcttctttttcctataacaggggagctaaaagatggaacgcaacaaactgctggcagatttcgacgacagtgtcgaccgacaccaactgggtgtcgatcgacaccatctgcaaacagacctgctaccataggcgacttcaacagagctgatcttttctactccaatcgatcagcgatcctgctacctccttttgcaagagaagactttgctattcaccctgcctaattatactcttgtttcacgaggaaagtttcgaggacattctgatgaatcaccactagatcatctagaagtcttcgaagatttagtgtcctcaatcaaagtagaaggtgtaccagctaattatcttctttgcaaacttttcccacactctctcgcaggcagaggaacatcatggctgcaacaacttgaaccaggttcactaacgaattggactgacatgaagaatgcattcatgatccacttccttgatgattcattgacataattactgcgggagaagatctcttcgttttctcaagctccaacagaaggtttgaatgcagcttggatcagattcaaatcctatcagagagaatgtccccaacatggtttccaagagagccaactcatcaatatcttctaaagagggatagccatgccataccaggctcaacttgatgcagcgagctactgtaacttcatgacaagaactactagtgaagcattactcctcattaccaatgctttaactagtcgttcgacacatgaatttgacactgaacgaagaatttcagctgagatagccaccgcaaataaagcgactcctgtttcagcaatttctgctcctatcttcccctccaccctcatcagagaccagaatg

SEQ ID NO: 2789 - DNA, 3000 bp, Unknown
  misc_feature (1)..( 3000): cDNA_ID_2171597_gDNA_ID_1620595_Annot_ID_161514 3000 nt of promoter + ATG
ctttatctccattgttgtcccattgcatagaatacctgaaaagacactaaaaagactcgagaaataacataaagactcaaaatcctatacctaaaacatagataaaatcagtgaaaattgggttatatcacaataccctcatcatggcttcaagaaagcctctctgctcagcactctttacagaggagttctaccacgcatcagaatgcttctggataccgccagcaatgggaatttccagaacaaggatgttgaagaaggccgggaattggttgagaaccttgctcaatcagatggtaattacaacgaggactgcaataggaccatcagaggcacagctgattccgatgacaaacataggaaggagatcaaagcactgaatgacaagctggacataattctacttagccagcagaagcatgtgcacttccttcttgatgacgagcagtatcaagtccaagatggggagggtaaccagttagaagaagttagctacatcaacaacaaccagagtggctacaaagggtataacaacttcaagaccaacaaccccaacctctcctaccgcagcaccaacattgctaatccacaagaccaagtgtatcctccacagcaacaacaaggtcagaacaaaccctttgttccctacaaccaaggttttgttccccagcagcaatttcaagggaacttcagccgcaaccaccacctgtgtttgcacctcagcaaaaccaaggtcttgctgctcctgatcttgacatgaaacaaatgctacaacagttgcttcacgggaaagcatctggctccatggagatagctaagaaaatatctgagttacacaataagttggacagtagctacaatgatctaaatgtcaaggtggaaacactgaataccaaagtccgatacttagagggacattgcatcttcttcagctccaaaacagataagccaacttccaggcaaagcaattcaaaatccaaaagaatatgctcacttccaacttgagaggaaccaaagacagtcactgaggacagtgaagatcaagatggggaggatttcagtctcggtaaagatcgagctgacaaaccactcgagcagccacttgaccagacactcgagcaaccactcgagcagccactcgaccacgttactcgaccaaatactcaaccaaccttcctagcaacatcaccaactgctccaaaaccagttgttgtcaagaacatagaaaaggtctttgttcctcctccttacaaaccacaacttccatttcctggctgtcacaagaaagccttggcagataagtatagagctatgtttgccaagaacatcaaggaggttgagttgcggatacctcttgttgacgctctagcgctaatcccgaactctcacaagtttctgaaagatttgatcgtagagagaattcaagaagtgcaagggatggtagtattgagtcattaatgcagtgctatcatacaaaagaagatcattcctaagaagcttagtgatcctggttcattcactctaccatgctctttaggtccattgcctttcaacagatgtctatgtgatttaggagcattagtcagtctcatgccgctctctgttgccaaaagattagggttcactcaatacatatcctgcaatatatcccttatcctagcagacaggtcagtaaggatccctcatggtttactcggaaacctaccaatcaggattagagccatagagataccaactgactttgtagtcttgaagatggatgaagagcccaaggaccctttgattctggggaggcctttcttagcaactgcagaagctatgattgatgtcaagaaagggaagattgatctaaaccttggcaaagactttaagatgacctttgacgtcaaagacgcgatgaagaagcctactatggaagggcaactcttttggatcgaagaaatggatcagttagctgatgagttactggaagagcttgcagaagaagatcaccttaacagtgctttaaccaaaagtggtgaagatgagtttctgcatttggaaactttgggataccagaagctgtactcccataaagcaatggaagaattacaaccttctgaggaattgaatggaccaccaacataggtaatggtaatgagcgaagaagggtcaacacgagttcaacctgcacactcgagaacatactcgaccaatgactcgacctcgactgtcagcgactctggagagctgatcattccaacttaagatgactggtctgaactcaaggcaccgaaggttgatctcaaaccacttcctaaaggtctaaggtacgcattccttggtccaaactctacttaccttgtgatcattaatgctgagttaaatgatgatgaagtgaacctgctattatctgaacttaaaaagtataggagaacaattggctattcattatctaacattaagggaatttcacctagtttatgcaaccataggatccaccttgaaaacgaatcctattttagcattgaaccacagaggaggttaaatcccaacttgaaagaagtagtgaaaaaagaaattttgaaactgtttgatgttggtgtcatctaccctatatctgatagtacttgggttcttccagttcattgcgtccctaaaaagggtagaatgactgttgttaaaaatgaaaaggatgaattgatccctactagaactataactggtaatagaatgtatattgattatagaaagctaaatgctgcatctaggaaaaatcattttcctttaccattcattgatcaaatgcttgaacggttagctaatcacccatactattgctttcttgatggatatagtggtttcttttaaataccgattcaccctaatgatcaagagaaaactactttcacatgttcttatggaacttttgcttataagagaatgccatttggtttatgcaatgctcctgcaacatttcagaggtgtatgacctctatattttaagatttaatcgaggag

SEQ ID NO: 2790 - DNA, 3000 bp, Unknown
  misc_feature (1)..( 3000): cDNA_ID_2171657_gDNA_ID_1620596_Annot_ID_161535 3000 nt of promoter + ATG
atagagattgattagaaaaaacttctttattaccaatttaaataattaccaaatatgttaaataataatattattcatagaaaacagataactataaaatcatataatagggaaaaaaatgttaattaatatttcttacataagatagagaaaaaagttctcttaaccctgaacatttcaactttggaaatgaaatttaaaaatgatctttgaagacatgttaaattatcagaattatgactcttttctttgtttcttatatactttttttttaaatctttcttgtggttttggtaatttgtatttaagaatttgtttaataagaaatctttcactttacatttcgaagtagagtttttggtcgatgctatcagataagcatcaaagacaaaatctttaatgacgttagaagtatgataatttttgctattaaagagaaaaatataaaagttctattctgacaaagactctacacgtatggacaacatttttgctatttaaccatttatgcacatcaattatttgggggaaacaaaagcactctaaatttgttgcgcatgtcttactataattaagttaagataagtaaccaaaccaatacatattcatattgaaaaagagaaggtgtctgctgacatcagccatacaaaggttgaaatggtttaaagtttaaacgcagtggtatgaggatgaataccggagttacgcaagttcttacttctctcagtcagtttttactgcattattaatttttgtaatagattttcgctagtgtatcattaaattgttgaacctttagtatttatgaatgtatatttatatgtgtatgtatgtatgtacgagtttgtttcgaacaagaatacaagatccacaactcgagaaaattatttgaactacgaatcttgaaaacaaacactccttgaaaactaaatgaaattgccaggttgtcttacaataagatatatgccccagatatactttataataaaattaaaatatgtaaattttgtttaagattataaagcttctagaatgattattatggtacatggtgctggacccatttagtagttcgtcacttagattgcttactattttagcactctatttatgtgtagattattaaacttctccgactataattgttagcaacatttttattattagtttggtttctttaaaatatattacagtctgttggtccacaatttcttcatatcaaaatatgctatataaatcaattttcgtgtggatattcgaattcgtaatttaaaaagaaaattcttgaaatgtaattataaataatttatttataacaaaaaagaatatttgcaaagaaaaaccggcaaagaatgaatcaatataaggaaaagatcatgagagctatacccatttatgatattatgcatgtttcagattgtcttgtcaatcatgcggatgacgagatgattaggaggatgagtatatttgtttctgatggtttccatacgtaatcaaaatattacatagtttactactttactttttcttactatttaacttgtttctaattttcaatgttcaatcacaagtcgatcgatgactaaaaacttttcaaattattctttcatacatttatccggtgtattcttaagttttctaaaatttacaagtcggtagacgaccagtcaagtacaaaataaatcgaaaatttatgatttttatcaactaaaataaaaatggttcaaattaaactagtaaaaaatatgctataaaatctaattgattaaaagatattaaatatatttaattttgtataaaaaaataaaaacaacacttaatttgtaaaaaacacatttaagctacaaatatattgaaacagaggaataagacttaaataattattgttacatcatgtgattgtagagctggtcgacacctcacacgtttaaacaattagatgtttctctcatattccatacgagaaggaccacaagttaattaaatacagtagtggtataaagtaagaaaaatgaaatactacattttgactaaaatagattaaaagacttgaggatcgagatagagcaaagacccattgaaagaagtttgaaaacttgttgctaacgtgtatatataagtccagctaccttactattactaaaagaaatattcattaattatttagtcttttcttaaacaatataattatccagtctaatgccccaactactattaaagtatataaaacattaaaattgttaaacaagagaatgttatttagtgtgtgaacaaggcaaggctccgggtttttttttacatttcacaaggtttttgtacatttgaatcattgatgtgtctttcactctcatttttttttaattgaatatacaatttattaaaacccaaccaaaaaaaaactgtttttacgggctgcatctattcgagtttttaaaaaggattagttaatgaaaaataatgtttatgtacttctggatgcaaatcatatttgaagtgctccatcatatacttatacacgcatccatgaaagtcactgatggggtgagggagttgtaattatgttaatgtttttgactgtttatttatgttaatgtttaaacattgttattcgactaatcatttgattgatatatatatatatatatatatatatatattatatatattacttttttaatttataaattttactttatttaagtacgattttcagtatgcatcttattagaataaatgggttgactggttatcttggattaacctgatcttggtttaatgttgtaatttagccttgtgtatataagctttttattttatttggtcaaaacatttatcctttcatttaaccaaagaaggatatagagtacaaaacatcaactctaatggtttgatgcataagacaaaattagagcaaatttacaacaaaggtagctagaaagattgagaaagtcttaaacaaaagggataaatccatacgatcctacacagaagaaggcaatg

SEQ ID NO: 2791 - DNA, 3000 bp, Unknown
  misc_feature (1)..( 3000): cDNA_ID_2171663_gDNA_ID_1620596_Annot_ID_161537 3000 nt of promoter + ATG
aaattttcgatttattttgtacttgactggtcgtctaccgacttgtaaattttagaaaacttaagaatacaccggataaatgtatgaaagaataatttgaaaagtttttagtcatcgatcgacttgtgattgaacattgaaaattagaaacaagttaaatagtaagaaaaagtaaagtagtaaactatgtaatattttgattacgtatggaaaccatcagaaacaaatatactcatcctcctaatcatctcgtcatccgcatgattgacaagacaatctgaaacatgcataatatcataaatgggtatagctctcatgatcttttccttatattgattcattctttgccggtttttctttgcaaatattcttttttgttataaataaattatttataattacatttcaagaattttctttttaaattacgaattcgaatatccacacgaaaattgatttatatagcatattttgatatgaagaaattgtggaccaacagactgtaatatattttaaagaaaccaaactaataataaaaatgttgctaacaattatagtcggagaagtttaataatctacacataaatagagtgctaaaatagtaagcaatctaagtgacgaactactaaatgggtccagcaccatgtaccataataatcattctagaagctttataatcttaaacaaaatttacatattttaattttattataaagtatatctggggcatatatcttattgtaagacaacctggcaatttcatttagttttcaaggagtgtttgttttcaagattcgtagttcaaataattttctcgagttgtggatcttgtattcttgttcgaaacaaactcgtacatacatacatacacatataaatatacattcataaatactaaaggttcaacaatttaatgatacactagcgaaaatctattacaaaaattaataatgcagtaaaaactgactgagagaagtaagaacttgcgtaactccggtattcatcctcataccactgcgtttaaactttaaaccatttcaacctttgtatggctgatgtcagcagacaccttctctttttcaatatgaatatgtattggtttggttacttatcttaacttaattatagtaagacatgcgcaacaaatttagagtgcttttgtttcccccaaataattgatgtgcataaatggttaaatagcaaaaatgttgtccatacgtgtagagtctttgtcagaatagaacttttatatttttctctttaatagcaaaaattatcatacttctaacgtcattaaagattttgtctttgatgcttatctgatagcatcgaccaaaaactctacttcgaaatgtaaagtgaaagatttcttattaaacaaattcttaaatacaaattaccaaaaccacaagaaagatttaaaaaaaaagtatataagaaacaaagaaaagagtcataattctgataatttaacatgtcttcaaagatcatttttaaatttcatttccaaagttgaaatgttcagggttaagagaacttttttctctatcttatgtaagaaatattaattaacatttttttccctattatatgattttatagttatctgttttctatgaataatattattatttaacatatttggtaattatttaaattggtaataaagaagttttttctaatcaatctctatcgtaatggattgatgagatctaattttaaaaaaatcctaatgaggaataggtcctctctccacctataaatatatatatttaaaccatcataagaatataaaaaacacaacacgttaaaaactaagtttatagacaaggtaagagaaatctgctaacctaaaaattcaggtaatccgttcacaaaaaaactatctgcaacaatgaatagaggtaatcttataaacctcctaatgaatctattatgtgattaacttaaatatttaaaaattttaggggttcatgtaaagttacacgtacatcttaatctagttttcaagtacgaatcttgaacgtaaaaatgtttaaacattcagattaaaaaaagacagaagatcgtataatctttggttacttggtttaactaattcaagaaaaccctaacattgccataaatgttgatacgtacagccgaaaggccacatggatacaaggtgagtcatcgttactttattgtatggaaggcattttctgatttgtttattgcccgatttagtatacacttcattaggcccattagttagagcataattatatttttatatttgtaaactaatcacaaattactcttaaagcatgcctcttttttcgttattttattacacagatgttgagattctagtggctcataagttcctttcgagaatttaaagacaacccactaatatattttataatatatattttccgccgagaactgaatccagaacaaagttatgcctctgtgatgatgtctataagaaactttttaagtgtccaaagacaaaaccttgttgttcaagaatattttctttttggtgatgacgaataaattcatggtacggatctatgtatagatttggtaatagggtacttgtagaatcctaattgggtaagaaaataatgagctggttctcattatggtatcgacacttgttcgaagaatagtggcttctcaagattgtttccgtgattgaggaagtctagctagtaaaaaaaaattatgattgacgaggctaatgataatgcatatgctacatggttaactatagagtctataagtacatgaaataaaatatttagaatcaaaacacccacaaaaagtaagaagtgactgttgtcaagcatataatagagatccacatactatttatatccacacgcacatgttcaagcagagacaaagatatagaaaacataaacatagaagagcaaattaagcaacagtcttacacagacagaagttgtagaattgatttgtgagtgaaaaactatttaagactgaacaagt

SEQ ID NO: 2792 - DNA, 3000 bp, Unknown
  misc_feature (1)..( 3000): cDNA_ID_2171849_gDNA_ID_1620597_Annot_ID_161568 3000 nt of promoter + ATG
aaaataaaaaatcatcatcttcgactattcatcgtccgaccactaacattttagatttttattcagtactttgtatctattcaccattttttttattgcaattgttattataagatcccagttatccattggaaagagagataacactaccatagaaagaaatcttaattcgaacgaatcttgctaagattggaatttttgtttttgtttttgaaccacataaatattgcaatttctaaggcataatatttaagagatctttgctccaactctaaacaagaattagccgtaaaaaccatactcattcctttatgctctatataagagaaggtaaccatctcacataatcataactcaactaactttttattgttctcaaattgatgtttatatggatcaatccatactaatccaaaatccatggataaaaagagtggaacttttggatattggtagataggatttgatgagtttcatgaattagattgaaataggttgggttataatggattagtggattatccataaccaacccaatagagtgtaaaccatatataacataattaaatatctaaaccgatttagtaaagcgaaacaaaatattctaaatcaaatttgtacactcatatgacggttgatttgatgatggtgatggtaattaaacatgagaacagtccttgataacatgctaaatagaacatgcttaaatcgaacatgagaatatgcttattgaagattatgacactcggtttgatggttaattcgatgtgatggtgatgatgattatgatgatgatggttattaattaagtattaattatttaaattgtaataagaatatacaatccattaatttaaatgagttatggtcttacgaattaatccaaactatttgctaattgagttggttggtctccctaactccatatgagatatatgagttggtttgatttggtttaactaatttgacacctctactttcatatgatcttatatcacaattatcaatcattgctaatagttaggttatgagttccaccaaatcaataggtaaaaaagtatctcttatgattttgattaatactttgctgtaaatattgatcggtgtattaactaatttgtatttgcaaccgtatacattgcaagaaatgttggaacaatttgcgagaaaagtctaacagtttacacagcgcagaagtaataaagtcattacatggaagcaatattggtgaaatgcttaatgattatgaatagtgatgtatataaaaatcctcctttttttttataagtctttttctaagatttatcttttcatctcatcctaacaattttgtattaaaattctactatcatcagatactcgagaagatgtatttgggaagttattgctgctctatttcgaggtaaattcttggacttaataatacttctggttatactcgagacaattaccatactaattggtaatttaattttcatattattgatttcagtgtaataatatattttggttgacctttgtaatctaacatttcaatttaatattaattgtttgatttatttactctccacttggattatatgtgtatcttaagtcttaacgtaaaaattgtcatttcattgatcaattgtttttcttgctatgaaggagtgtttacatacaagtaaagtagttcaatcaattcgttaatttgaattttctctctaacttgaaattgatgggttttttttggggaatttttatatcagttttaagtgaaggtcactataatttcaaaaatcagaaaattcaacgccttcaatgtttaactttgtttataaactattttgtcaagaaaacaaaattttatttgttaacaaacatcttatttgtcaaacataagttagatatgttttatgtttttgggttggactaccaatgtttcttattttgttcttttatctactcatcaagttaatccaaattagtactattttaatttgatcaaaaagaaaaataaaatccatattttcaaaaagctccttaatatatcatatcgaaaatgagttagaatcaatatgaatatatattagataaatataaaacataattattctaacttaaaattgatgtaatattcatagttagatggaaaataaataaagaaaaattattttagttaaattataagaaaaagtgataattgtactaatgatatatatatatatatatatataaatgagaaggattgtataaactttatgtcacatatttaatattctatattctaatggtttatgttattttttattcattatgtatatatacacactctgtttaccaaaatcctataatgttaatgtagctaaatggttgagtgtctcttatgaatccaaaaagtcagatgtttgattccccttgatcacaaattttgcttcttattttctaatgtctagaatgacgtcattttgattttacggagattctaacggaaagataattccgtgattgacatatcctaaatggccaagtcaatgaaagtatgaaacttgattatttttttcaaaagtcaaactaaattttaggatttaaatgtcttcttgaaagttcatgttttttcatctcaaatttaaaagtttgggtttttttcgacattttccaacaaaaaataatattttctcttgtttctttatttgttttcagaaaaattggtatgtagctaatttgtctcttcaaaataacattttttaaaaaaggaaaacaaggccttagactttgggcctttcttaagaaaaagactttagaatgggccaatattgagacagtgtacttagctcataaaccgggcgttgttgactccttgtacatataaccgtcgtgttttaatatacgcctgagaacgagaaaacgacgtcgtataaattcaaaccgccgtcgatcgtcactacgtatataaagggcttttaattacacggcgaagtctctctgttctcaagaaattaagaaactgagaaaaaaaaa

SEQ ID NO: 2793 - DNA, 3000 bp, Unknown
  misc_feature (1)..( 3000): cDNA_ID_3069857_gDNA_ID_1620597_Annot_ID_161572 3000 nt of promoter + ATG
ttttgttttctttgactaattattaagtttttgctgatttcaattttagtttttcggattattctagtcaacaagtcgaaattgtaaccattccatttccggctaatttaattttaataattataatagttttttatgttaaccgaaattaattaaactcaaaagaactaatcccgaaagatattgtttacatatgtgatgaagccgttcgctatgaatttttcgtgcattataataaagttctttagaataattacttcaaagttcccctataattttttcaattcgactatttttttttccataaatcatgttagttttcacttcactatattcaacactatagtttgctaaccaattctttaccactagccgccttacccctatcccacaactgtctcatactcttatcagtaactaggtaaataatctatatttatggtaaatgcgtttaatatgttcttctttctttctttcaatgcatacattaattcaggttttcggcatctatatttatggcaattgatatgaagatttaagttactatcgcactattgctcaatcttgtggtccaaatcatacaaggctgtttgcatgaatgaaataaatgcgtattaattgtgtttgatcattgattatttcttagccttcttttggaataaacacttaacacactaaatttcattttgtgaataaagaatggaaaaagtatctttcaaagagaggagtagtctagccaaattgatggggacgatattgtcactgataggtgcacttgtggtgattttctaccacggtccacgtgtcttcctcgcatcttctccgccctatgtaaacttccgtcagttttctccaccgttgtcatcttcaaactccgattggctcatcggtggagctcttctaaccatgcaaggcatattcgtttctgtttctttcattcttcaggtaccaattttttttccttatatatagtagaaataattttaaatttatggttaagtcaaaaattagtcattaaaaaaggtggaaacatacgaacacatggtttagagtagacctaggcgttcagatatttggttcggttctagttcggttccaattctttcggctctcgagtttaggattcatataggaactaaaacagttttggtttggtttgggttcgggttcggttttttcggttctgaagtttaattaggacccattcggatatttatttcagatattttttagtattttcggatattttcgagtatttttggatattttggtatttttatatatttttcaactatattttcggtatttttgaatgttcaatctaaaaataactaatatttttggatatataatcatatttagatattctcggatacccgaaatatttcagttcggttcgggttcggttccaattattttggttctagaatttaggattcatttgagtattttaccattttggtttggcttcggattcggttctttttgctttggttccagttcgtttttttttggttcgggtattatgcccatgcatagaggggtgaactttggtttttggttggagatgatgttataatacatgtgggaaaacacatatcttcatttagtaaacatcatttcattctaatatttattctatataatgatttttggacaggcacatataatgagtgtatatccagcagcattcagagtctcctttctttacactgtatgtgtttcaatcgtgacctcgacgattggactagtagttgaaaagaacaacccaagcgtttggatcattcatttcgatattactttgattacaattgttaccatggtatgttatatatatatatatattttaaagatatcaaaatatctactttttgatcttaacacttttttaaaaataaaatatttcaggcaatagtaacttcagtatactatgtgattcattcatggacagtacgacataaaggacctctgtacttagccatatttaaacctttgtccattttaatagcagtggttatgggggccatttttctcaatgattctctctatctcggatggtattaatgaatcaatagtcttcataaacatatctataaacaaaaacatctactcaccttcgattttgtccttcgttttgcagtttgatcggaggaattttgataacattaggcttttacgctgtgatgtggggcaaagcaaacgaagagaaggatcagttatcattttcagaaaaagagaaaacgcctcttctattaaaccgcaaaaacgaccaagtttaaaaagaaaaagaatatagacaataaaactactaatagttaacaaatactgttattaataccatatttataaaattgtcttatgtctctatgaacctaggagttggaaaaaaatgtgtgtatttagatttttttttcaaaatactccaacatttataaatacgagttaacatttttccttgactcctttggaacatatgaaaagcttaaattgatattctttgaagcaatgataggtaactgcaccaagtatatatcccggtatagtcacacatcccaagtttagtgaactacacgaattatgtgtattgtatgctaatgtataccaattagtaacatatgatcaacaccatcatattccttttacaccgtttgtcaaatccatttttaaaaccacttttggtgaattacgccgtagaaaaacaagtctaacacattgtaacattttgaagtggtaataaaatttctgattcaaggtttcaatatctataattattgaagtggtttcaatatccattattggatgatcatattttggcacaactgttttcaagtctgcgcaaagaatagggaatcttataataaattcaagaaacaacaattattggacccacaatacaccacttcccctctaactagtactatcataaatgaaaagcaaacaaattaagcgataacaaatcaaagactcacatttcaacaccaaacctttctaccatttcca

SEQ ID NO: 2794 - DNA, 3000 bp, Unknown
  misc_feature (1)..( 3000): cDNA_ID_2171885_gDNA_ID_1620597_Annot_ID_161575 3000 nt of promoter + ATG
acaaaatttaaaccataaccactattttattaacccaaaccgaaatataatttcgttttaatcacaaaatctaaactctaaccactattttatcaacccaaaccaaaatataattttgtttaatcacaaaatctaaaccctaaccactattttatcaacccaaaccaaaatataattttgtttaaccacaaaatataaaccctaaccactattttatcaacccaaaccaaaatataattttgtttaatcacaaaatataaaccctaaaactattttataaagccaaacaaataatttctttaattaaaattttacagaatttgttttcttaatttcttttgtttggttgattttaatttatttattctttaatagatgacatgtcaaattctaattggtcattaaaaaggggtgaatgaatggattcactccttaatactcgataaattaatatttttcataaattaatactcgataaattaataacctctataaattaataaatttttctggtcccgagttgggactagtgtaaaaattgatacaaatcgataaattaataagataatatatttttttaaaatcctatgtaaatatatggtctcatcaatattataaattaataattgtataaatttatgaatatatatttatatttatgattatatattatgtaaaacttagtaaaatatgactttagtactgtttttctttaatttatattaattctttgtaaaattcaattctaataatttttctacgtataaaaaagtttttgtttttgtttttaaacctaataatggttttctacttgtaatgatttttagaaaaattattgattgtatagaaaaagtaccttttagatcacatttttgtaaaaaattacaaaatttataaaatctctccataaattaataatttatcgataaattaatacctctctaaattaataaattttttcaggatcccgacattattaatttatagaggttttactgtagtatgcttgggtaatgggtccaatcagtccggtttagtttagaatttcggtaattcggattactcggtttgggtaaaagagtcctgaaacgacttgaaatagaggtttagggtttaggtaatttggttcggttagacaatcgtttttttcgatttaggtaaaaatattccgaattaaaaccacacttacatggataatgcccatttattcaattttgacatcaatgatgagaaattaaaagctagaatgcagcacatagctaacactcgcttaagtccaaaaaacgctaccatattggactactaatcaaccatcattaatctatcactctgtatttttagatatgactggttctttctaaattgttctagcttctatctttagttttagttagtgtcacacaacaattaatgattaactagtggattaatcttcaaagcatgactgttcttttaaccggcggaacgaagggaattgagttcttattcttcctttcgtatgctttgtttcaaactcctatgtagtttttttttttcatctttgagagaatcaagtaaaatttaaacaaaaaaaccttagcttgagtctgaaattatcaagtcgcgggtttggtcatacttataatgcttccttttgacgagataaagcatttgtaaaatcttcaatattttaattatgctcttgatctcactaaactactacgaatgtggcatggcaacccctaatcctttgaatagatcacacttttaccatagaaaaaaaataaaaaagatcacacttttaccaaaatgtcttgaatagaaaagctaatttatgtgtttaaacccatcagtatttttttgaggacgcaagatagacaaatatcaaacttttatataatcgtcgtgtaattgacttcaaataacatttattggatcccatataagtcttttttttcttttttttctttttttgaaaacaggatcccatataagtctagtaattattattctgttgtcaaaaagttttcatatttataactttgttggtttttaactgaggatgatgcatccatctaaactcaagatgcatcttaaaaaatagtcttttttggatgagattgtcaaacgcatttggatgctccatctaacttgtctgcaaaattgtacttaaacgaacatcagttggcatatgcagttagatgcatcagtctcagaaacgaacatgacctaaacgtcagtacaaatcttggttttttgttgtcaaaattttttatatttatgacgttttttggttttatgatgatgatacaaacagcttgggcctaagcccaacataaattatggtttcatatttcttttttaatttttgattagtccatagtaaaagatctctatcggatttccacgggatctcatcattcagtactctgcatatattcacctatcaatgtatcatcaattcatcatgattcgtgaatcgtgatctttcctttttattggtgaatgatgaatatagtacaaatattttcaaattattagaaatagcctagtatacataagttttgaaatcaataaaagttgtgaaaagaaggagaatcgagaaagattatagtagacgcgttacacatttaaataaaatacttaaaaagtggcaacaaaatttcaacaaaggaaaaaaaagagattacgccgtgaaatgtggtttagtgcaagaaaactagaaaaaacttaccaatccacaattcacatgcaaacacataccacctcgtagcacgccacgtgtattcatctgacggctaccgttacgtcatcattgaagaaaacaaacaaaaatatcataaaaaatcgccgttataactttttttccttcacaaattttcattttcaccacccaaatttaaacttttttaaggaaagagaataaaaagaaaaatctctacgcgtgtatatatagaattatagacatatataagtttattcgttggtaatgtttctagggatgatcgacatgcaacgatg

SEQ ID NO: 2795 - DNA, 3000 bp, Unknown
  misc_feature (1)..( 3000): cDNA_ID_2171853_gDNA_ID_1620597_Annot_ID_161570 3000 nt of promoter + ATG
taatataccaaattgagaaagaaaaaaatacaaaataaatatgtgattgtatatatagacgttttatgaatatatgtctagagatgtatcacatcacatcactgaaacatatatttttgtagttttacttttactatgtttagattggttagagatgcaactgtaggttaattgttgtaaatgtagctttgttttttttttctctgtataaaatatcttatagtatctaaatatttaatataactgttttggaaaaagactcaaatatgaacaaacacaaaatatttcgagaggtattactggtaaagtcttattggtaaatcaaagtctggagacattaccaattcacatacatattttggtagagtaactattaagtttaaaattatattatcgaattacagttaaacctttataaattaatactcgataaattaataatctttacaaattaataaattcttccagtctcgagttgggaccagtgtaaaaagtgacacaaatcgataaattaataagataataacttttttgaaagtcctatgtaaatatatggtcccatcaatatcataaattaataattgtataaatgtatcaattatatatatacattatatgtaagaaatttttttgaaatataattctaataattttttgcttaaatttgtatttattcttatttaaaatttagatttagtattttactgtatcaaaaacttttagtgttgttttctaaacatgatattatgttttacttgtaattgatttttgaaagatattttctagaatgaaaaaaatcctttagaaatttttgaaaagttactaaattaggaaaatctctctataaattaataaatattaatttatcgataaattaaaacttctctaaattaataaaatattgcagtcccaacattattaatttatagaggttttactgtatatgtatttgttgtaactcacgggttcaatagtgataaaggttaatatttctatatcatgattgaatttgattcccattgaacattaactatgcagattaatggcgacaaactaacggtaatctttaacatcggtgttgataaatcatgacgaagtgcttatgtgaaaagtcgttcacaaaatcgtttaccatagaaaaatgaaaagatttaagatttgttaatcatgaatattaagacaattatttattacaaaattcaaaatttaaggtattttctaatgatagcgtaacaaattaaaaaaaatacttatttacacagaatattatttatactattttttttctaacatgattttagtcttaaccaaataagtttgtaagttcaaaaatgtgttggttatctattataaaaattacaaaatttgattgaaaaaataattataatgctgattgtaactattttcgtaaaaatgctaattgcaatataacttttctataagattatttttttatatagcttttatttatttataagtctaattaaaacaacatgtacccaaaataaacaaaacacaaatcatagtcaatggtgtttaaaaactaatgtctcaaaccaagaaacatatcaatctcctttagtaatataattataatcttaaagttatttgttcacaactttttaaagagcttaatttaagtttatgatttgaatctaaaattgagaggtgggcaggacaaagtgagatgtcgagacaaaaatacagataagctaatttgtgcggtggattttacacaaactttgtcagtcacgagactctttcttattctaatggcaccaaaccctagttttgttcttttcttctttacttttttatttatcataaatattttatttggattctcatactctcatatgtctctttccctattgaccatatctttttatctcatctcttccctttcttgtgatataactttttactctattattatgacaagtcggggctagatatggttgtagtccaatgatcttattatttgctagactatagatttatatgtattggacacacacacttgataagaccatattttattgattctattaactagtaagcactaaatatagtctcgatatttttagtcttttttttttttgtcatctgaaatttaattaataaaacttgttgtggaaacaaggagagatacatatgcccaaacaagggaaactaaagctggcggacaaaagaaaagtccccagaaactaaagccggcggaatacatgatttccccggaaactaagccctgtgaaagggaagttaaaaacaacagaattaccaaacagaaaattcgaatcgaaagaggacgatgctataaactaagaacagaggaaaaaggctaaaatcctaagggaagcgataaaccaaagaatttctcgatatttttagtctacaaatcataatttcttttacgattcaaaattatatattttcgacaaataatttctattattttatctaaaaaactcggataattagtcgggtacggattaggttatgaaaataccttcgtaaaaccttataatatgatattgttttccggatattcgagtgggtgttctgacctcaaatgaagataaatccctaaaaccttgtaagttgtaacatggttttagggaatcatgttaatttttttggcaggatagggaatcatgttaatggcattaactaatagtgtgtacctaattagtaaagacatgtctattaagagaaaattgactaaaccggacaattttggttagaccggataaagaccatgtggtccatttagccttagtgatcatatgtatactcgatctagttgtaagttgttgtcatgtagctaacttcagaatcttactcactaacacttcgagtttcttctcattggcacaaaacttaactccattctctttttctctctctcttctatctttcaccaaaatgccataactctctcttcccctatataccaaaaattaatctgtatctctctatccatcaagagagagcatcaca

SEQ ID NO: 2796 - DNA, 1998 bp, Unknown
  misc_feature (1)..( 1998): cDNA_ID_3069894_gDNA_ID_1620598_Annot_ID_161585 3000 nt of promoter + ATG
cacttaaaaactagctttaaagcatacggtttgtttcctgattatgttcctaaacttgttatgtttccacctgcaggccaatgactctggcttggcttcgtatgttgctggtcaaattgaccgtaccttgagctggaaggtaagagaatacaacaaattttcagataccacagcaaaaccaaaaacttgattcagattgctctaactttcatctacaaaaacaggatatccagtggctccaaacaatcaccaacatgccaattcttgtcaagggtgttcttacaggagaggatggtgagtttccatttgccaaacaaataatttcaacactctagtgtcatagaaatacctgacaaggtcaactattattgtccccatgcagcaaggatagcgattcaagctggagcagcagggatcattgtgtcaaatcatggagctcgccagcttgattatgtcccagcaacaatctcagcccttgaagaggtagatcattctcgactacaaacataaatctgtgttctcgataagtatttatgtacaagcacattagctttgttctcttgtgttcaggttgtcaaagcaacacaaggacgagttcctgtcttcttggatggtggtgttcgacgtggcactgatgtcttcaaggcacttgcacttggagcctctggaatatttgtaagcatcacatcatatatccattcaccagaaagttgcttaaaaacagtaaatatttaaaatgccttctcaatctcagattggaagaccagtggtttttgcactagctgctgaaggagaagccggagtcaaaaaggtgcttcaaatgttgcgtgatgagttcgagctaaccatggcactaagtgggtgccggtcactcagtgaaatcacccgtaaccacattgtcacggaatgggacactccacgccatttgcccaggttatagagaagaaaaaaaaaacagagaacagaaacaacacggcaccaaaacgtattcatattctgattgatcactttgcttctactctgctatatttatatctcgaaaaacttgtttctccctatatcggatcacaaaaacgtgcgtagagattctctgtaatgctatttggctacattttacctttccgtttattcttattgcttgtacaatagatgttgattcctacaataccaatgaatactaaaatctgttcccggaaaactagtatagtcagaaaatcttacattgcacccaacttccacaatccaaacacagttcaaatcttatattaacagcagccaaaacctcacagaaactagctaccaaaagagcacaaaagaatactataggagaactcagattaaggaaagacaggtttgtgagatttacaataccttattgaagaagaatgtaagcgaattcatccttcactttgtgctgggctaagtattgcatcgaaaagcccaaaataatttggctcacgaattcgaaactcttggatttatgcacttttctgaaaaaaaaagaaaaacgattggtttacgaattactactatttttctacgagattaagaacgataatatgtaagaaaaatctaagacacacaccatccatcagatttttgtccgtatctcctcatcaattcttcacctccagcttctcatccatatttctttctttccaatgcaaacaagttttcaactgttaaaagataaaccaaaaactcacaagccaattaatctatcagaaatatttaacttttaaccaaataaaaacgttgagatatatataatataagcgttccttaccactcacacacttcatctctccccagagctctattcccatcaaggtgtgtgagattctctgctaagacaaaccaaaaaccagattgttttgcgttcatggacatgttcctctctggagattagaatcgtagctatgactatgtctgaatttcacaagaggtagctaactcaggcctttttgctcttttgacagaaacacacttcggaagatg

SEQ ID NO: 2797 - DNA, 3000 bp, Unknown
  misc_feature (1)..( 3000): cDNA_ID_2171810_gDNA_ID_1620598_Annot_ID_161602 3000 nt of promoter + ATG
tttgtttgtcatcagtatggaagttctctcaaagatgttagatcaggcagcgggagcgaaacggtttggttttcacccgaaatgcaaaaaccttggactcactcatctctgttttgccgatgacctcatgatacttactgatggtaaagtccgttcagtagatggcattgtcgaagttatgaacctatttgctaaacgttcagggttaaaaatcaatatggagaaaacaacattgtacacagctggagtctctgatcacaatcgtcacatgatgatcagtcgctacccatttggtttggctcagctcccggttagatatctcggtctcccactagtaaccaaacgactcaccaaagaagacctctcccccctttttgagcagatacgcaatcgaattggaacgtggacctcacgttatctctcttttgcaggtcgtttaaatcttataagttctgttttatggagtacaatgaacttttggatgagtgcatttcgattaccaagtgcatgcctaaaagagataaacagtatttgttcagcatttttgtggtcaggaccagagctaaatcgtcgaaaggcaaaggtatcatgggatgacatttgcaaaccaaaacaaggaggacttggtctgcggtctttaacagaggcgaatgtggtgagtgttttaaagttgatatggagagtaacctcgaatgatgattcattgtgggtcaaatggtcaaaaatgaatctgcttaaacaagagtctttttggtctctaaagcccaactcaagcttaggatcttggatgtggaaaaaaatgttgaagtatagagaaacagcgaagccgtttagcagagtagaggtgaataatggagctcggacttcgttctggtttgataactggtcgggaatgggccatttgatggatgtaacaggacagagggggcaaatagaccttggaataagccggaacaaaacagtggccgaggcttggagtaatagaaggagaaggaaacatcgaacagaacagctaaatgatattgaggcagccttaaaccagaaatatcagacacgcattttgcttcgggaagatgcagctttatggagaggtaagggggacgtttttaagacaagcttttccaccaaagacacatggaatcaggttcgtaaaaaatcaaacgaggtggcttggtataaaggggtatggttcagtcactctactccgaaatatcagttctgtacttggcttgctttgcgtaataggttatcaacgggagatcgaatgcagctttggaataatggctctgatgtgaagtgtacattctgctccacatctattgaaacacgagaccacttgttcttctcgtgtagttatgcctcagcgatttggactgcaattgcaaagaatgttttacaacatcgattctcaacagattggcagacaatagtgaattacatctcagagactcaaactgatcgaattcggagctttttgtcacgttatatcttccaactcacagtacacacggtttggaaggagagaaatgatcgacgccatggtgaggagcctagaacgtcagccaatctcattacttggatggacaaacagattcgcaatcaactctccatcataatctcgacaggagaccgccgctacgagaacggattacaagtctggttctcgacaaggctctagactctctctgctctttctgttaagctctcaaattgtaatttcttatcaaaacaaataattcaactcacataagattaagctgatgtaaaaagttatttttctttttgaatataatttgacattttattaaaaaaaaaaagattggcttaataccactcccctaatcatccaaaaactgcatttagtattccgtttaggaaatgacgtaggatcctacgaggtacacctcaaactaaaaaggatatctttggttcttgtgatttttgttttcctcttcttgtagtcctcatgaataaatgatgtttgcagactgagatgagcagaggagagctggccaatgggataaattgttacatgaaacaatatggagtcaccaaggaagaagcaagccaagagttgcttaaaatgtacagcgacaacaaaaaaatggttatggagcaattcatgaacacacatgaccatgtgccgcgccaggttctgctgcgatgcctcaactttgtacgcctcgtcgatgtgatgtacatagagggtgatggatacagtgaacccaaaggcaaaactgaacactttatgacctccttgttcgtccaccctatacccctttcataatgacgtgcaacacacaccaattttctaagttaatccttgcttcttcttattttgtttttcttttttaataatctctaagaagaaatattatgactccgtttttcctatctaggtctatttggtgatgttgtgtagccttttgcaggttctctgtttgttcactgctacgccaaggcagataatttctacaaaaaaacaaaatttcttatgaaagtagaaagaatggttgttttgtgacttcctgaaaccaaaaatgccaccatgtcttttctgcaagttatattcaccaatttagttgttatagcaaattcacctcataatttatcgttatcgtttaatcaaaactaatagatgttgaatgtaatcacttttccaattaaatttagtttattaatattctataggaaaatattttagacagtatcgaaattcgcaagtattgattgccacatgttgagttatagccatgttgcatattttatagttcacaatctcatgagtcatggactaaaggattggacaaaggtaaactcgtaaaacttataaccatgttgtatttaaatattataaccttgtttattcatcccgtaattcatactactttgttggaagataatgcatttttaattcatactatttccaaatccaataaacctattaagagctccacatgctattaattggcaaacacaattactcttggatcggccatg

SEQ ID NO: 2798 - DNA, 3000 bp, Unknown
  misc_feature (1)..( 3000): cDNA_ID_1020575_gDNA_ID_1620598_Annot_ID_161586 3000 nt of promoter + ATG
acacacagacatatactatgtgcattttttgtttttggatttacctatatgtgtgttttgtgtgtctgtttacgtttataagagatagaaaatatgtgtgtatatatatttgggatcggtatagatataagaaattaagtcggtatatatacatagagttcataactaaatttttcgattttattcaaaacaaaccggtcgtgtcctcttattctcaaatatatagaaactattttggtcattcataaccaatatctctagtaagacgtcgttatttctaaattgggactccttaaactcgtcaaatgagtgtatatggtaattcaaacccgaattattttatgtatttatttctgctccaatcgtcgtcactgatcaaaataagagaaagtatatgataaattattgaaaaagagagaaagtattactctatcttgactggggcacgtgttcgtagttcatacattggcataagatcgttgttttggataaaggcgtcaaagcgataaatgattattgcaacaaatagaaaataagtttaaaattcattgttggttttaaaatgtgaagaattggaggagagtgacgaacaagatgatgtataccactataatcgtgcctcatatattataaaatgataaaatgccaataatgcaagccacattacttatacttccataactttagcatataatatcctaactaactagtaactaccatatatattagtctcatcgatccaataatatagattcgaattttacttggatatcgatcttcttcatagaataatcgattcttgtgaatgaatatttgatgctgaatatatacattctttatagatatataatgtaaagctccccagaaagaaaccaacagcattaaacagctgggagatttgtgttgtgtggaggtcgacctttcagcgttaagataggccaatcatgtctttgatatatgatgatatttaataacatttgtgtactagtatttaattgttctatacttattctatagtacaatcttttttttttttttttaaaggaaaatagtacattattttttttgtacgtttttttgttgttgttgttgctgctgcatactaaaattttgtttgtttgggtttagtttcataggagtctacttggtgttcatccgatcaaacccgatatgaaccaaacctaaataactatagtttaactggattcattatttctatattcgaaaaaccaaatcctaattcgaatcgaaccatgcagaaagagaaaaagcagtttaattatataaactaaatttatttggattaaaaatacgtttgatctaatctgcttgtgaatcaaatatgtaccaaataattgatagaaaatagaatctatgttagatgttcattgaccgagaatgccaaggaaagaaaaaaaaagatattgtgacgaattttcggctgaacacgtttacaacacaaaactcatcttcagtagctatattgatgtattagaagactttccaaagatagataatacgtctcgaaatatcaggttcgaaccttgctgtttgggaagtgactaattgacatactctaagccctgcttcgaggggattgcaaaccaaaaattgggaatctcttggttattcaaaataaaaatgaaaaatgtaagcacgtaatcttcattgaatccatagatctagaagcggatatgctgatctataattggcttaaaacaatgttacaaaacttttgtatgaacgatatttaagcatgacatgtttcaaaactttatccaggacatttgaaatatagtttcgcaagttattacaataaagtattaatcaggttccatatcttacaatatcgcgacaaagaaaaatctgtctggaggcaagtcaccatggaccgcttaagatgatgatatgaaaactaagcacatgatgagtgaaagccacaaaatggataaagcataccaatcttcattttttgttatctttatttttcttttgggatttaactttaacttcaatttgctttcatcatcgacatattcccgaaagggataaaatgtcataatcagccacgcgcattagcctctggacgtattagaggttttgaagggcagagaaggacacgtccacgtgaccgtcaacgtaccacacacccagtctcatagggcactcactgattaagaagaagaagaagaagaagaacatatcttctctctttaacattctcttctcatctacttaacgacatgaaaacgatgcttcttattttggacccacttggagtttgaaaccaaaatggaaaatctgataaggtcaatagaaacaaagagagaaacaaaatcgatcggccgacatattgggactacaacttctgatcaggattgttggtgttggaattcgtactcaacccggccagtgataaagcccttgaagaaagcgagcccacacacaatgtacaccttcggctcaaatatccaggcccggtccttgaaaacgctaatttgaaatttgagtgtggaccatatatccataatgatcacttcacaaacaaaactatggttgccaagtcaagtgaagaatgctgtaatcatctaatccaacacagagaaatcaactaacgcaccatcctttcaatgaacaactactaagcttttaagctaccaagttgcaaacttcagatgcaacttcgaaagataggaaacgtttcttcagctgtggaagcgacgttattaaaaacggaactgtttttactatatcacggtgaacaacttgtcgtttctttgatcctctcttattgggctctgatgatatatattaaccttttaaaaataacggcccatattttcgtaagtttgtaaaatgctttattgataaaagcaaaaagacttgcaacttattattcgttaacggaaaaactaactcgccggtaagatttgggagagaactaacgagaagcgacggtggtctgttattaaagccggagggagaattttaccgacgatg

SEQ ID NO: 2799 - DNA, 3000 bp, Unknown
  misc_feature (1)..( 3000): cDNA_ID_2171784_gDNA_ID_1620598_Annot_ID_161596 3000 nt of promoter + ATG
atttccgtttattttcttgtgaaacgtatatagtttgtctcacctacgtaccatttgtggtcaattcttctttcactataaaaagacgttttcatagtatataaatgttcaaggaagtttcttagaatttgttttcgaagaaaaatagaaaaaggaactcaattccaattttgttagctcgaaacctcgaataaaaatttggtacgttggttgatttggtatcttcgagaagtcttccgataaatcgagaatgtgttcatatttttttttttttaaagaacggtgggaaatgattgtatacgtaacataattacacgtgaatgaaaccaatcagtgattaaaaaaaatcatttatgttagaaaccaaagaagctttttgtttggttgacttctggtatttagtgtagttaagggatgtaggcccatgaaagttaggcctaaatattagaacccaatataaatggtctcttattcgattagtgatgttgagtttttgggaaataatgatgggcctaaatggccaatgtgttgtgggacgattgtttggactttttgagtgactttgcatgtgttcataacttaaaataaaaattgcattcccatacctctttaagaattcaaacttctaaaggcctttaactcgtacaataatttaacgtgagacggtcataattcagttaagaacggattgcgaggcttggccaaaccctaaaggtgttggcctgctcatgaaatgcaacattagttggatcttacgagaccgtacgtgggaaaccaagttccatggacaatgttcacgttttgaggccaatttactagtttacagtttacactgggcaattgaataacagtaaacgaaaacaaaaacaaaaacaatcgtatcactaattactagaatttgtcgagtagggattgaatgtttatatatatgagatattaatacaacggccaacacgtgtgtatctgaaagtgtacatactaacatttatggtagaaaggaattcgtgtcatcaagtcaagtaaaaccttttttgtccgttgtgtaacctacacaacgatatattcaaacaaaacatatgacacatataatcgtatgtgtcatgtttatacatatacaatatgaaaagcaaagagaacgacacattagttgtttttagttacgtttggtcttaaaattaacaagtccctcgttaaacatcagccgtgtgataattaacaagcatccatcgttaaacacttccaatataacattttttgtcgtgaaagttgattttgttcaagtcttcttcgataggagttactcatttaaagaaaatagcatctcttgtatgtaaatttgatcactccttccaatggtccagactccagaacaaaggaaactgtattcacaacgaataaatagataaagggatccagaaaatcatgtaatgcatgatacattattagaaatatatatagaataactgagtaaaaaaatatatatatatatatatatatatatatatagaataaatgagtgacaactgacatcacattagtattctctgtatatataagataatttatatttagatgaaaatgtactcaatcgagaaaaatgtaataaacgaaactaattagttgacaaaaagggaaaatcatcaaagataaaagtttaactacataaacattataaattcactttctaccaaaaaataataattataaatttactttattccagtttcgacgaggagtgtggattctgttgttgaataagcagatatttgattcgccgagattttagattacaatattcaaataatttcgaaaatactggagaggaacgagattaacgataattagaggaaaaaagaagacaaaatcctaacaaacgcaaaactttatgcagcagtagcagcaggcagcggacttattagttatttaacgagtctatgactcaaaagacaaatacgaaacaataaattgaaaacaaactataagaaaaataagaagaagagtttaacaaaaatgaaaagaaaagcaaaagagaagaatataaccacaacgtggaataaaataatagcatggtcgatattgtcactttatatgattccttatacgataacatatgaagtagattttttacttagacacagattgcatcgaaatttgaaaatcgtatcaatataaaatcatcaagtgtgcagtattttcgatatctctgctaaaaatatcatatttactagtagaataaatttgctatagaaccaatagatacacaataagttaagtaggaaaatcgtaaataagtgacaaatcattttgttttcacggtttaatgaaaaagtcatccgcaatcatacatgtattaattaaacaatgtgtcattggataaaatgagataaaaccaaataaaatctaaaaaatgttattttatccaaagattattttgcaaggaaaacttgatagggagtagtatttttagtgagtgtaagctatttattaattccattatttagggtctacgtaaactatgaggcattcgtgcaaacaataaaaagatagcgggactcaaatgtaaattaattatgacactcacaacaagaataattctcattttttttttttttcagtcttatgaatgaaagttagcgtcttagcgaagtagaaaaggccaaaatagagagcggccaaaacggaagcaaaaaaaacctcatcattcttcatctcctctcttctcttctcttattcatgctcaccgccataaccacaccaccacacataagctttcttctgtaatctcaaactcttttatgggctaattattacattttcactatatacgtctacgagaacgagatcaagcacttgctaattattttgttgaagttcttgaatggttttccttcagtgtgtcacatttttggatttagctgaattgttttgatcataaggagaaaactttctcttccttgtttttttttttggtctaaattttctctgttttttttttatcca

SEQ ID NO: 2800 - DNA, 3000 bp, Unknown
  misc_feature (1)..( 3000): cDNA_ID_3069918_gDNA_ID_1620599_Annot_ID_161627 3000 nt of promoter + ATG
tcctacgggatggatgaccatgaggaaaaaatctacggtgacaatcaaaccagcatgtcttccgtccattgggtagataaaaagactttgtactttccatgcaaacaggacaagacaatttaccatgagtagtccatcctgataacatgctatacgccggaaagtcgctaatcgtccacagtagtactgcttttagattaaaattctgactcaatgaaacatcgtacgcatcgactccagtagaccacaactcttttaactcctcaataagaggttggaggaagacatcaagactagctcgaggatgatttggaccagaattcagaatggtaagaaataagtactctgtattcatgcacataccagggggtaaattataaagagttaggatcacaggccacaatgaatgattacgagacatgccaaatggattgaacccatcagtacacaacccgagataaacgttacggggttcttccgcaaactggggatgtaaccctaggaaatatctccactctgctgcatctgaaggatgattcatttctccctcctttgattggtgctcagcatgccatcgcattgccgctgctgtcttatggctctgatacattctcttcaaccggtccccaataggtagataccacatacgactatatggtactttggttcttcgacggtcgtccttaggcttccatcttttcgcacaacaaaatcgacattgatcttctttttcgtcttctttccaaaatagcatacaattgttctgacaaacatcaatcgtatgatatggaagtcctaaattgcgcattaacttctcggtctggtaatgtgaagtggttgtctggtttccttctggtaaaaaatctgtaaacatttcgcaaacggagtccaccaacttttcactcatattatactccgccttgttgtgcatgagtcgagatgctaaggataattgcgactgcccttcacgacaaccattgtacaaaggattatttgcaccttctaacaagtcgtagaacttatttgaatggttacggaccggttcttccacattctgataactatcatcatgacgatagttatcatcataccccacattaaaattaaatgcatcgttcaccatatccacatatggatcttctacaatattacccacttcttcatgattctcactaaaataagtcctattcgtgtaactcgttcctatatccatattcatttcttctccatgcttataccaaacataataatcaggcataaatccatgactaaacaaatgactactaactcttctacccgagatgatgtgtttttcattcttgcatacactacaaggacaatgaaatttacctcgactactctgtactattggctgactattagcgaatgtcatgaattgctcaactcctgcgacgtattcggctgacaaattccccgtcacttcatcaaatctcttgtacatccaatctcgatagaaaccgccagtaccgccataattgtagtttcccgccattatacaataaagtaactaatatttttttttctctttgatgttgttgttgttttgatttgttggtgaaagaagagttgcgtgaacgtttattatataggccaatttttgtgactaatttacgactacaactaaataattaggtgtacctacttaccaatgtgaaacacgttttccatctactttatacgactatggtgcgacgtttctacgactacaggctgactaagacgtctaatcgtcctgtagtcgccaaattagcgactaaataaaatagacggtagaatagtcgttaattagcgactaagcaacgacaaaattatcccttcaataatataatcgtcaaatagtcgttacttgccgactctttgccgactgcatacgatagtcgtaaaacaacgactatgtaactacaatttttcgtgttgtcgcatgcgagtcgtaaatccgtcgtcaaatagtcgtataatgttacgactacgtttgttgtcgctgattgtagtcgtcgtttacctgttttcttgtagtgataatccttaactagttccgaggctaacaacaaattctccattataagccgatctttgatgaatacagactggttattcactacaggaaaatgggtttttaatagcacagaaatatagcgttttatgtcaatatgctatcattgatagaaggataaaataaagataacgtctccaaaaatgaaatgctatgatagctttactcactaaaaattattttcacgtgttaagtaaaaaaaaggttaagtccacattcagtcttctctctcactgttcaactcgacaattcctctctctcactgttcttcaaaaaaatttctttcaatcgtcgaattgttctgtctgtttttcaaaacgattattgttctgtctcttttccaaaatggttattgttcttcggtagctcatagctcgattggtcttcgataattcactctctcacaaagcccagaaatatctgataaaggtattttaatctgttcaattcaatatctgatagaggtttgatttcaattttgatttcatttcaatttggggattttgatttggggattttaggggttttagggtttcgtttcgatttggggattttagggttttgttttgattttagggatttcgatttagggatttcgattaagtgattaattgtttttcgttttggtttattttaattttaggtcctcgtttcaatttggggatttcgattttagggttctttagttagatttagatttggttttcaatttggggatttcgtgttttggcttttagtttgatgaaaactaatagtcattttctttatgcagattattgtttcagaatctacaagagcttaagaggtagcagattcttatctatttctatattttttggtttatttgttgtgagatgagtgtttgataaatgaaattattgtcacgcatgtctgagtaatccgtggttgagctctggtgttataac

SEQ ID NO: 2801 - DNA, 3000 bp, Unknown
  misc_feature (1)..( 3000): cDNA_ID_3069908_gDNA_ID_1620599_Annot_ID_161631 3000 nt of promoter + ATG
agagagagacgaactgttcctgtggaggacgtcgaagagagagagagacggagagaacgatgattaccataatttaggtttagggtttccaaaaaaaaaattaaacactaattccaaaatgacaagagaaaaatcgtttaaaagaacttgctaattatcaatatcccatatgaaaaattaattgaacctaatcaaactaaattaaccataccatacgaattgaaccaaaacggttcgaacatacctgaaataattttggttaaagttcaatttactagaatcgtataactctaagggcacaattatcagaatcccagtctctacatattctcttacaagtatcttcatattagtcaccttgactactctacagattcgtgcattaatgtctctttcacgttaaaaaaatcttgggaaaagaaagcaaaagagtaattttgaccgtctagctctctagtctctatataaccccaatcgttaacagaatgaagataaacttaaaaacatggcatcacaaaccaacaaagagcttttcgtgggtggacttgcaaggattttgaaagaacagcgacaagtcgatgtccggctgaaggcaggggacagcgatcagaagggtgtatctatatctgctcataagcttgttctggtctcttcctctttccttattattttttcatcatcatatgattcttaaaaaaacatttacgaaacgttctttactcgtactgaatttcattgtgaatgttatggaatgttttatagtctgcaagatctgaggtgtttaagatgatattggaaacagaagagatcaaggctacaactacgctagacacaatcactctctcagagctaaaacacacagagttagtggctttggttgagtgataagtaccaaaatggcttatcaagatatgtaacagaaagagatgagataatagaagaaataggttgagatgcagaagaatttcagagaaggagaaggaagatgaagaagataaacattcttaagattataatcaataagtgtttttcaatgactaaagaagagtttaaataaaagacattactaaagtaaacatgccaaacactaagccttataaaaacccataaggcccaactcctgaacctatcaatactccctcctttgagagtcaccttgtcctcaaggtggaagaaagtgaattccttggacgagtgtcctaacttcggttgagcctacagctgcaaccttctttttgacacttgattcccacttatcaaccatctcctcaacatgcatttgtgtaacctctttaccgaattcaatcattagccttgaaaccacagttttaaaaggatgatacaatcccacaacttcaaacggttctgcagtccttacctcctttgatatgaccgcctctttagtctgttatgtgtgcacctttaacacacacggagcgggtttggtctttctcactcttggttgacatgttccgcgtacttccagctacaacttcactgtgtttcaccccgggttgcccaaaaaatgatttctcatcgtcattctctttagtatccttctaaggttccaaccatgaaacttcttccaagtgttctggacttagcttcaactcttgactttcaacgctcttaacatgtccaccttgtatttccttagcgattcctccacatgtaaccttactctctccttttaaagttaccttgtcctcaaggtaggaaacaacaagcatttccccatcgttatttctctgttcttcaatatcctcttgctcattttcactcttcatctttacttttgtagtaacttgctcaagttcttcgtgctcagcacaaagagtgatccattgttggttgtggctgaaagagaaatcttgattctgccaattaaccattgtctctcccagttttgagagccactcataaccaagaatcacatccacatcagtcttggccaagtctagcagaaggaaattctcagtgatttcaacttcttgaacccataatctaattccgagacaagttcctacgctttgtatgcactgcctttgtcccaataaaactgaagcttggtttgtaatactcgtgggtagtttgagactgaaggctaactcaactaagataaaattgtcggttgctccagaatctatagctacaacgaccttatgatctaatatgaagccatagaatctcatacctttgttcctggttaaatctatcactagttgctccattccctgtctcaaggtataactatcctgctctaattcttccagctcatttataactccttttttcttctttaccacatccagcttagcttgtaccagggtaaggctcatcagctccgcctgtcttgattggtagctgttctcaatgacgacacaattccagaatttatgagattattactttcttctaaccattgtgttgtatccatcatttgtacaatcccattcggtttcaattctcgaactgcagtttgcaaactaggttgcaacccttgtaagaacatctcctcgaagccttgtcctggtaaggtaactgagcgaagacaaagagcttcaaacctttctctgtaatcacgcactgatccttcttgttgtattcccgaataatgaggttgatgatttaacttcattgtcgtctttgtctctcggcccatcatacacttaaattccttccagcttgtaggtgaattctttttccagagatgctttatccattgcctagtctctccttccaagttagcataaacaatttgtaacctctcatgctccgaaattttattctcaccaaaataattctcaaagttatttagacagcttcttaggttttttccgtgaaaagcaacgaggctctgtactagctgaaagtcctcagtccacggctcagttccagaccaacgtcaccacggacagctgcatcacacctcaagctccgttaaaggcaaaaggggatgggattctacccttaccgctgctggcagtaccgatccaaaca

SEQ ID NO: 2802 - DNA, 3000 bp, Unknown
  misc_feature (1)..( 3000): cDNA_ID_2172027_gDNA_ID_1620599_Annot_ID_161634 3000 nt of promoter + ATG
agctagcaacatgaaaggaaagttcaatggactgagatcattgattttgaaagaaaatagctctgcatattatgtgcattgcttcgctcatcaactacaattggttgtcatggcagttgcaaaaaaacatgttgaagttggagagtttttttatatgatttctgttttgctaaatgttgttggagctttttgcaaaagaaaagataagatccgggaaatcgatcggcaaaaagtggaagaaaagattagcaatggtgaaattaagacaggaactaggttgaaccaagaactttcccttcaaagacctggaaatactcgttggggttcacattataagactttgttgcgtcttgaggagttgttttcatctatagttatagttctcgagtatatccaggatgaaggcaccgacaccaccaaaagacaacaagcatatggtattctcaagtattttcacacctttgattttgttttctatctggagttgatgttgcttgttatgggactcagtgatagcttatcaaaggcttggcaaagaaaagatcaagatatcttaaatgctatttcattggtgaaaactactaaatgtcagttgcaaaaggttagagacgatggatgggatgcttttatggctgaagttagttcttttagcgagaaaactaacattggaatgcttaaaatggaggaagaatttgttgattctagaagaccaaggaaaaagaccggtataaccaacttgcatcactataaggtggattgtttctacactgtcttagatatgcaacttcaagagtttaatgaccgctttgatgagttgaattctgaactacttatttgcatgtcatctttgagtccgatagattcttttcgtcagtttgataagtccatgctcgtgagattgacctagttttatccagatgactttagttttgtggagcgtagatctcttgatcatcaacttgagatctaccttgataatgtgaaaaacgatgaaaggtttacagatttaaagcgtcttggtgatcttgctcgtgtgatggtagagacaagaaagcatctttcacatcctttggtatatcatcttctaaagctatctttgattcttcctgttgcaacggcaactgtcgaaagatgtttttccgcgatgaattttgtgaagactacattgcgtaaccgtatcggtgatgtgttcttaagtgattgtcttgtttgttttattgaaaagcaagtacttaacactgttacaaacgaataggtgataaaacgattccaagatatgagtgaacgtagagttcatctttagagtttttatttataatgacattgttatgtttatagtaaagtttatcgtttcgtttaatttttttttgaccccagtgagtcattgttctggctccgccactgactggggcgggtgctatccgagaacaattagccaatttagatttgcaaattattatagaaaatttgttggtagaatggaaacaattaggagaagaaggacctacggggaatgaatgggaagatcgaaaaattgtaaaaagaaaaaaaaatttagttagacgtatgaaattagctaagcattttctttgaacaaatatagaacccgaatggatggttttactaatgtttatgtttattatgttctatgatatatatattttgttatattaatagatacaaagaaacgttaaatatttttttctgtatagatttgtatattttaattgcatacattaatctatttttgttttaatatcattgaataaattcaaaagtataaattaattggagaaaaaaatcagaagtaagactaatggtaaaatctataaatatcctaataaaatttagatgtttaattaaatagattgaaaagttctgagagaacgacacataagtatgacattttcgttaaaatagctttaatcttaccagaattaatacatggtgattttaaacacttttcacattttttttttaatgatttttctaaataaatgttcgtaaagcaaaaattagcttccaaaacttataaagactatatcggtcttactaaaaaaatcaataaatgcattgtgttcacaattattttctaatgaatccttttattctatatatatcatgaattatgataaataatattcaatacctacatacaacttaacaaaatcatattttaaaaaaaaacatccgcggtttgacgcgggttttgctctagtatttgtaaaaatgtttagtttggattgaaatctacatgctaccaaagttggatcgaaattggacttttaccgtaatgtatatgggctttactgggtctaagtctaagtaaaacaattaattagcatagaaactgtttatagaattaaattaaccgacccgagcgaaccagctccgaagacccgacccgaaaacttgacaacacgagagatctaaagaccccaccaagtcacgtctaagccactaaacttctttcttgtctctctgcaaaaaaatccttgggaacaccaaacgacatcaaaacgctgtcatttcatctcctctcagatccttaaattctcttccactccaaattctctggggaaaggtcaacatttggaattctctctgtctccgacttttgttcttcctctccaaattcatctgtaagtttctttactgtaattgttccggagaaatttgtacgggatacaaaatccagatcgatcacttgtgtaatgatacggacatatatgtacgaactactgttttgataaatgcttttaagtcagatcatctttgttattacaaagtcttagatttttgcttattacacgttaattgtgatttaactttgcattatcttaattaatcagttgttattgttaaaagttaaaactaaagaatcatttaattgttcttgattttgattttctctctttgaatttgttatactttcttcttcaacagattggattgaagtaagttagtgatgcaaattctgagtttttcgagtttagtatg

SEQ ID NO: 2803 - DNA, 3000 bp, Unknown
  misc_feature (1)..( 3000): cDNA_ID_3069916_gDNA_ID_1620599_Annot_ID_161628 3000 nt of promoter + ATG
cgctcgatgtacccatttgagaggtacttctacttctaactctctaattatgtgatatgttgttagttagctttattgaaatcttcagactctaaggctagtattttctcttatgatgtaggtacatgaaaaaattgaaatcttatgttaagaactatgcaagaccagaagcgtgtattgcagagggctatttggctggagaatgtgttgcattttgcacagagttcctacgcaactcgttaccatatgaagaatcagttaatcgcaatgaagatattgagacaaatgagaatgtgcttggaggtcgtccattatataagggtacaaatgttacactaatagagaaagaaagagagataacacatcgatatgttctaatgaacatggctgtgactgaaccttatattgagtaagagcactgaatctcctgtatatatctttattcatcgagtatgatctttacattaagttttgtcttttttcagtatgcatttggaagaattacaagaatttgatgatagttgtgcaagaaacgaaactctagtgttcaagttacacaacaaaagatttgcaaagtggattaaaaataaggtatgagttcatcacttacaaatatgatattgtttctctgtaatgatgtattgagtattgtctgtttttattagatcccttcaaactcaaaggatcattcaatgaagctaaggcggatagcacttggaccaagactaattgctcagacttacaaggggtttatcgtaaatgggcataggttccacaccgatgatgtaaagcgaaagactcagaatagtggagtcacatatgaagcctttagtatgcgtagatcaagtgcacgtgatagtaggcaccaagctgacatagttacatattatggagtcataaaggagattttattgcttgactaccatatgttccaaatacctattttcaagtgcaattgggcccataaaggtcatggtgtgagagaagaagaaggattcacgcttgtgaacctccacttgagccaagcagcatttgtaaaagatccttacattatgccatcccaagcgagacaagtgttttactctagagaggatgatttgagtcagtggtatgtggtaatgagagcgccaccaagaggttatcatgagttagagactgaagaggagtttaatagtgcaccattttcagtccaaccaattgatgattcaggaaatcaatctgatgatgacagtttttgtgctagggcagattgtgaaggggttacagtagtggattaatgtatgatttattgttaagaatacatgtttaactttggagatttgatggtttttcaggttatctgaaatggctaagaaaggtgaactgaacccacgccgtagtaagcgtcaaaagggactagatgcgagtcctgtcatatcatccttgaagaagaaaaagaagcaacaaaaggaagtgcttattcctgtgatagaagaaagcagcaaggagacgacttttaatgatgaagatggagttcaagtagagtttgaggaagtaacccaagcttctcgtggtgctgattcattggataaaaatgaagaagctgatgaccaagaagttgagagaacagaccctattgaagaagatttggagcctcctgctcaagaagaagattttggccagccttccactgaaaggcttacaactgcgactgctgaaacatcaacacaagtgtcagtgaccaagaaaaacagactaagaggacccacaaagctgcgaagagtggccaaaagtgcacaagacaaagttgatgtcgaatttacagaattgggagaatttgtgggatctggttcagttaaactttcatcatttcttggagcacttgtgagagagtacgtccctattattctggatgattggaggcagctagatgatataataagggacacactatgcgaggaaattcaggtaagtgtattgatcatcttattacatttacttgaaaaactaattaagtaaagaatagtgattttctatacatttgtatactaatgtaggggaggttcaatgtggaccaagaattgcaaagaagagaaattttcaaacatatgggttgtttgtttagggcttctaaatccaaccttctggcgaaagtgagagttgctaaatggttttaatcataggaagtaagagataaagtctcagatacaccacattcaattcttttacttgtagaaaaaagagagttcagacccctcgcaggtgacaaggagtaaagtttgggttgcaggacacacgcattctgatggaagaccagtcaaggccgaatttgtcgagaccattgtaagtaatatctaatttcttgtggtttactctgatattatctaaagctagctacttatacctgtttgattacatatttgaatgcaggaaaaaataaaatcttttttttgaaagaatgtaaaattgtattcagtcaaaaacctttttacaaaagatgtaacagtgtgtgtaaaagtttagaatataagctgaagatacaatagctgaaagaaaagactagagaggttgtagaggatgaaggggtcgagtggagaaccaaagctgcaggcaagtgttgtagctgtgatctcctgtatctcggattgagctgattcgattacgaactgttttgtcaatgagcttgatgagcctattcggtggtgagctaagttcaccatgacgtctagcattcctttctcgccaaatgtggtagattgtggcttgaaaggattgtagattgtggaaaaaataaaatcaatagagagtgaaatggatttcacatccactagtgttaaagaagatgttgtgactcaagtactaggaaaagacaaacctgggagagttagagggttgggcagaggggctacattaacctagctggcatttttgcaagttagagactcacatgtgcataaatttgaagctactcaagaactattattgagcaaggttgaagacttacagaatgttgttaaaaaa

SEQ ID NO: 2804 - DNA, 3000 bp, Unknown
  misc_feature (1)..( 3000): cDNA_ID_1380688_gDNA_ID_1620600_Annot_ID_161637 3000 nt of promoter + ATG
aacctggaaatttttctgagaattggataattttgtaggtaattgctgagaagtattgcaaaacggatctgcctgccatcgagaaaaagaagtaaaaatttctcatcttaagattttgatgatctcgtcttgcctagcttatgacttgtttgattaccaaaatcatctttggttcaatttatgctttactgaaagctaatttatcctataacttcaaagattcatacacatttttaggagttaaatagctgatttagtttcaaagttatcacttttgatttgaataagtggtttcaatatgatctgagagttgtctttgaatgttaggtttctggttccaagagatatgtcagttggccaattcatctacatattgagtgctaggttacatttgtctcctggtaaagccttattcgtgtttgtcaacaacactctccctcaaactggtgagtttctgcttcaattgggttttgcttctaggctttttctaggaatagtttgtttgatgtcttctgtgtttccttttctctgcagctgctctgatggactcggtctacgaatcttacaaagatgatgatggattcgtttacatgtgctatagcagtgagaaaacctttggttgatccaataatgatgttagtgtctgtgtacatatactttaaacataagatgttcactacatcaaaagacatcaaacacttgttaagctttatatgactgctgcttgttttatccttagactttgttcatctgtgcacaatcgttctactacagtctcagttccaactagtatttccccttaacgctctctttgtcatcattgtttatcttcctgaaaatgcaaaagaccaatggattgttttactaggggaagagttttgtgcttcctctccagcaagcaccacgaagtggccaccaaccggcaaatagttctggctacttttggtatctttattagattctggttcaggctctgggctacaaacataagaaataagacttgacattgtaaaggtaaaacactaaacaaaaacttggaagaatatagaggaaacagtgtggaagagtatacacatgtattgtctgtctgatatctggataatctttccaagtatagagttaacatattcgcaatttctgatggtaaatgcctagtgtttatatatttgtattgtggctattttttctgttcttacaccttttctggcttctaattacataatggcttgtgcattcaagaactccaatcttcttttaagaaaatagaggctcttcttctgaacaaaggtatacttttcattaccatcaaaagccaacataatcaaatgtgcttgcatccttcaaatgtctcaaggcagaaaattttggtgacaaattccaaaaccatgaacggttttcagtgctttcaaatgtgtgcccaaaaggtataagctttgttctgaaacctctggagagaagaagaaaaaccagccttgtctagaggttggagttatttagctcttgatttacataaaagatgagtgaatataactttatgtcaaggaaagtaaaaaaaaaaaacaaagaacagccaaacccatatctgtaaatgggcctttaatgggctaaaccggttggtatgatttcgcactcgtgatgtgatgtgataatgaatgtgcaatgggaataaaaaagaaaaggaagagagaatcttatttttggcatgtacgtatggttgtgaattgtgataatacaaccggcatatggtcatgatattctaaaacgggaccattcattgtcgtcttatttacaaatcacatggagagaaggatattacaaaatatcgaaacagagagactatgatttatttgtcttcttcgaaatattggttttttttagctaaatgcatagaagcttatctagttagtctctttccacggtcaaaattgtagtcgttcgtgaatgtacttcgtgtgttatgatttatgaaaaaatctatacaaaacagttactgtttgaaaatgtgtcaaacgaaatgatcctttttaggtaattcttatcttagacgaccaaaaccaaattaaaccataatgatggagtttagtttacagtcagaatcaaaactaagaatgtaactaaaaatcgttcactgtatatagtaattaattggttaacactagaatacaaatgccatttagcatctcagagtaagacaatgacaagtctatgcattaatttcattctctttgtcatatatataaggtaaaatatctctataattgtttttaatatacaaggcaaatcaagggaaattgtcttcatccttctcttatccctatcttcctccacaacctctcaatcctctcacattaggattatctctaatcaaaaccgtagcacatatttagatcattatacatatattcttattcagctgaattcataatacagagtaaaatctatgctacataatggataatcttcaatacatctttgcatattcatatcattctagtaaccctcaatttttaatttctttttaatcaaacgatgttttagcatacatatattttattttttttgcatggaacctatataaatttgaatccgaaaatataataaaatactttttcatgtagtcattttttttttttttaatagtcaataattctatctgaacgaaatatttttttttcaattttaaatcagaaaaaatgttacgatttgattgtcggtcactattaggcagctacaatgtatcaataaatattatgtttatcaatttttcacgaaaatgaaatctaactaattcgttcgttagtttctaaaaatcgcaaaactttttgaaattctgtggaagtcatgattatgttctgtgatgagcttttcgagcaaaaaaccataaaaccaaactttaaataaaaagaccatcacttcactttgctctcttctatagaaaatcatcttctactacactacacatcgagagctcactgtgaagaaaaaaactcgaaacaaatg

SEQ ID NO: 2805 - DNA, 3000 bp, Unknown
  misc_feature (1)..( 3000): cDNA_ID_2172187_gDNA_ID_1620601_Annot_ID_161654 3000 nt of promoter + ATG
tacaagagccaatacatctctcagcttacataaattcagttaagaaaaaagacaaatgttccagagaatgagttccccatcttgaactactttctaacacatatctttgaaaacgagtttattaaatcagagagacaattcacctttatgagatgtctccaacagattgaatagctttgataatgtggaaagtaatacatccatcccttgcttagccataccttgtccatactcctgtgctaaagcctataatttccagaaagaataaattatattagagacattgacaacctttgcaaacaaatataagctaagtacaataacatgatggttgaacaattagacattttcaatgaaaaataaactcaagatataaactcattacaaggtccttatcagccttgcaatccttggatacaataagtgtaaagatagcttagacgactacaaccagctcaaaacatttccagttccctgagatcttatcataattcactttcgaatcctctgctattccttaaatagctaagcaggagtatcccgaaaagagtgcacaaccaacagccattattacgatcaacagaaatgtcataagttttgaagagactaaaggtgacacatttgcgtatgcaatgaactccaccctctaatttatataccaagactgagaaactgaggaaagggaaaaaaacagaataacaaaaatgcccttacatcgataccaccaaagcgtccaaccgttaattcggcagttctgtcaataccatgagataaatcgtcataaacgctgactgcctgtctgatattctgatatagacccaaaaggttcaatgcaaatttcctctctgcttcctgcccagagaaacaaaagtcatgtgccttcttcatatgaaaatcacaatatctacaggtaatacagcaacctctcccacataaaatcatacaatttttcatggaattaagaatattaccttttccaaattgaactccacattagcacccccagccagagggatactcaacaatccagacgatggttcagctccagcaacatatgatccacccaaccaagatgcctaagtatattataaccacaccattaacttgtggtcacattatattaaaaaggaaaaaaaaatagtgtttgcacttagaatgacaggtgctgttaactaacaaaatcattaatgtccttgtcagtcacatcagaggagggttcattgacagacacaacaaccacttcattgtctgcagaattttgaaaagattagcagaatatccaaagtaagacttaaacccataaagaaaaaaaagttagaaactagtcatgctcagatggttctggtattcaagctgatagggcacctggaagttcagtatcagctttgtacgaatcagacttaatactgctccttatggcattgcccaagaaagaatgactaggggaggtttccaaaagcatatctgcaagtaaaaaacaaacacttgaatattttacaactaaaatttttggttcatgtcagaaaactaaagctttccaatcacataccatcagctccagcgatttctagcacaaaagcagcgcgaggcctctcaaatggattaggttttagaatcttgttcaactataacaaaatgcaaaacaaataaacgatgaagtacaggactttaacccagagagagaaaaacaactctactataatactaaaataaccttggatgagccatcagctgtcaaagttgctgaaggtgcaaaacccaacaaggcagacactgctgcagatatttcaacaggcgacatgggaagtgcctgtgcatttcaattcaaagaaaagagatttaactaaaattcatcaaaaagaactattaaatcacaaactttagtacttgtcaaacataaatttgcaatctgtccattgatctctcatcaatatcaaaataacaaaaaaaaacagacaagaaaactacaaattggtgccacttagaccaaacaatagatcttattttactacttcaatggaccaaactcgtataatttccagaaacgatcttagattgaaatataaaatgatcaaatttgagattatttcaaatcggtcatccacacatttgggacgaaaatcattacctcactggatgatcgtggacgaagatattgattgttggatccatcaatgaagaaaacagaaccacttgcttctccctatacacaaacaaaagtcagatccatgtcattacatacaagcaattccgtaaacgagagcaagacacgaaggaacaaaaacgaaccctataattcaaggtgagaagaagagcaacaacgaatacgtagaaagctttcatctttaagaacgagagtcgacggagagagaaagaaagagatggatcggtgttatcagacgagagatgtttaatggaggagacgaatccagatttcagaatcaatcaaagtgttagacacaactccaaaacggtgtcgtttgaaattaatattatctgttcaaaacccggttatttcaattccggtttagtaaaaagccatattaaacgacagttgccgacaaaaaaaaaaaaaaaaacgacagttagtacaaataggggtataatagacaaatcacaaaactggttcgtttttaaagaagcggtcccgaatcacaccatttccatttccatttccagaagcggcaacgatggagacaacaatcggagattctatgacgatgatgatgacggagatgtgaccggtatgagctcaagtagacgaaatctccaaacgattcagagcttcaaagcttcagatctgtttccttggatcggttaaaaagagttttaaggttgatttttctttccacaccatttggcgactcgtacatcgaactcgctgatcggaaaatactcccggatagaaattgaaccgattagtttgatgagtgagtgacttgttacttcgatttgtagctgagtgtgtcactgctcaagtgtgtgaagaaggagaaaatg

SEQ ID NO: 2806 - DNA, 3000 bp, Unknown
  misc_feature (1)..( 3000): cDNA_ID_3070000_gDNA_ID_1620601_Annot_ID_161658 3000 nt of promoter + ATG
aattaacaaaagcctaatagcttaatgatgatcagaacatgggtaaccacagaagaaacttacagagaactgattagacatcataggtgatggatcgcaagtcccaggagtgatttgccactgcttaaactcccctctgaagcccctagatatgcttccacttctgcaattacaagcacgattggtcaaacctaaattacgaaactatgccaaataaaaccaaaaatcagaggctatctgctatgtaccccattcctccgagtggaacaccttgggatgcagatggtttgcagttctctttggtgaagggatcgataggtgctttctgtagtaatcataagttaaatctccgcaaacaaagaccaaaactttgtaccataaatatgtaaatcaagaaactctattgatcaagggagttacccttccatgggaggcctcttctctgacataagaccataatcgtatccccaagcgtacctgtaattccgaaaataagaagtaaagagacgccccatacaacaacgaagcgaaggaaataaacacaagatgtctctttgtttaccattttaatggcttccctaaaagtaatagtgaattcttttaagatattggcatggcagtttaatctcctcctccatgcgtgtggtggcggagcagcactatcaaaatcgagctatggaaacaaagacaagtcaaaagtcaaattttccaatcgtcatgattcctaaactactaaaaatagactcaccaattgcaaagtacttctgctgatgaattcctcagtcggccatgaatgctttctacggtgaaacaaagttgctccaaccatatttactatacttctcgattctacactgatttgatcaaagaaaattgaaagcaataaggaattaaggatcaacacgaaattgcatatacttcttaactttaaaaaggttgaatttttttaccttttatttacataaaagaacaaaaggtatttctcagggaagcatttgcagcgaattgaaacggcaccgtctcagtcgcaacaatccccgattcaaaacctaaaggaagtgacaatgaaaacggttcacattcagacgaatcggtagaagcgaaattttgaatacaaaggcaaatcaaaacataccaaaaagttttgtattcgatctgtcacgttgaatagtcaataggacaaaaatatgaaatccgatgagattttctcagaagaagaaggaggaggaggagaagaattggattcgaatcttcgaaaatcggtttgatggtattggtgagatttagaggaatctatgtggatgctgacgtggcgtcgtcgtggcgagcggagaatcgaccgtcagagacaaggttctcatacggtggcaagtggtttttaaactcttttgatttgcgtgcgtctccacagtgacgaagacgaagaccaaagagaaatagaaagagagactaattttgcattgcgtttttttacgttttagtccttttagttttgtcaaaagtgttgttttgacactttttttttaatctaatcaggaacatgtttaaagaccacttaacattattaattggggaatctttcaccgaccacatctggataatagggttggatttggaaatctcttgtctggtttttaaatttaattatcgtatattgtagtaatttataaacatattaacaactaatataaggtaactaattaaaagagattatccagattagttgtacacttgtctttttcgagaacgtatttgtacggttttacaaattttcttctaaaaaatgtgtcactgtcttaagccaattatttgctgaattagattaaaaaaacaaaactttctatgataacgtattttaagaataatttatatataaagacattatattatactcaaatgccaatttgtagtaataaaaaaaggtattatcgtttttaaaataattttaaatgtcaaacatacaagctcatgtctaaactattaaattttacaattgttaggtaaattaatataggaaacctaattaaagagttggagatcagttgttttttttcttgaacaaatattttgattggacaaatgtctttttcctactatggctatggacctatggtttacaatgtttctttttaattgcgacatttgatgctgttggtaagattaagacaattagttattgaaatacataagaaaacatttttaaccaaaataaaaaatacataagaaaacactataacagcgacatcgacgtcattaaatattgttttataagaaaaatatatcatactcaaatggcaaattatgtaacagtataaaatagaagaaattttaaataactaaatgtcaaacattttaatatataattgtgtaaataggtttatatcttaatatagttaccttttgataatccgaatagtaactatgttttgcgatataaagaaaatgcgatgcaattcaaatagtaacgaaaatacataaatatatatatatatatagagagattttaatattgttataatattattgcgatgtggttttggatgtggtctacatcatcattcgtgttctatacatgagttgtgattttctccaatgttaataagtgaatatcgaaatcaacggaggaatagaaaatataataaaagccgaaaaaccaaggtggcgccgacgtagcacaaagaaaaagtacaaaaaagtcaaaactcgttgccgacgtaatgactatcggtgtaaatccgaggtcgcgacttcgaatcgttctaaaacccattttacatgctcccattttttttttcgaacaaatgatgtcacaatctcagagtcaataaataaaatggaaacaaataatcatcatatgaacttggtcttgccacgtggaccctccattgccgttaccttccggtgaaataccaaacactccgcttccacttagagccgtagaagagctactacttcatcaaccacaaccactatctcctcaaaatctctctctaccgatcg

SEQ ID NO: 2807 - DNA, 3000 bp, Unknown
  misc_feature (1)..( 3000): cDNA_ID_2172236_gDNA_ID_1620601_Annot_ID_161670 3000 nt of promoter + ATG
tttggttagtgatttgtagaaaaaaattacatttgctaatgaaattaagccagttgattgcttatgatgtctgcagctaaacatagtaaatgacttttctttgttcttccaagttatgtgtttgttgttaattcacattggtgcagctatgtttttgtgcagttgatttgagtgaggagtgagattacttggtaaaatagtgggcctatatctggttacgaaaggcccattagtagcccattatgttttgtccgtttcagactaattattggtcttaacttaagtatattacccacatacgaattctgaacttagaataagccaaatgcatttgaatccaaagtttgattgattccttgaaaagttaattagtacgtgtcgattttcaaaatactaaaaacacaattatataatcttaaacagaaagttaagtataatgtttaattaacataaatatttaaattgagggagtaagtaagtggtaatgttaaaaagaaaaaagaacattttgggaaaataaacaaaaacatggagagattcgcacaaggagagactctcgaggcaaagacccttgaaacaaggcaacacttcttatttctttatttctaaaaactgcgccgtttaagactcttatggtctttttctcctttatttcttttgtttacttgtaataatggcttgtggtgcgctaattattctatgaactttgcttaatttattaaatttttcaaaagtaacattaatacgtattagaataaatatttcaatgtatgtcatgtgccggtaaataaaacattttttctctctctacgataaaaatccatacttgacaactttgcatagattacttattaatttgtatttttattttttcaggtataactaaacttattacagtaaaacatgaccaaagtttttcgaaaaaagtaataaactaatcgtaattcaatatttgacatgaccaaaatgctgataagtaataagagaaaaagagttaaagaaaaaaaaacaatttgggattttaattcaatcaaattggagtttaaagtaaaataaaggtaagaatcatgagagtggagaattagggtaggtgagaatgagtgaggctcggtgtggtcacgtgaggtatcctcaaaatcagggattgttgttttgtccactacactccctaaacctaaacccactcatcctttgcttaacctatttcttaatactatgattttagtaagttttctatcaataactctctttctttttgcatacctttttggtcaatattttgtacttataagttttaaaaattggaaagagtgtttattttaaatatatgaatagaaatttgacaacaagtcaagctacatcttaaaatactttttgaaaaagtgatggaaactcggaaaggaaacataattaacacgagattatgttaatgattttatttctcagactgtatttgtattagataaaaaatcaataaaccattagaaatggaaaaaaaaaaaatgaaaattcattggatctagcaaaaggttcaagtctagtcatcttatttcaaaggattcttaatgtgtgaaataaacagcaatacaactatatctaatttatagagtaaccttgttttcttaagattacatttcggctcaaaggtttaaagtcaagaagataacaactatagaaagaaacagtaagctactagagtattaactaacatatacaataaaatatactcaagtagaaacaaagggaataaaaacgaatcactgattcaaccacttgcttggggtttgagcaaacgcactcgtttacttacaggggattaagctaaataatttctttaaaacaatcttaattaactgatccaacagtaacataaataaaaatacttatacccataaatttacgtaccaacgcatatatatcagacggctattgagtccagttagcacaaaactgttggaatctcgataatagcatgagcaactagttatttttgtataataaactacgatgttatatagtatataagtagataaaacattctaatctcgaagtaatatttatatacacttttcgattaagcataatttggcttgttttagttttacttcagcttagtcctaagagatgaaactgaacttttgtagtttttacttatatcttttacaaatttaaccacattatattagatcgacaaaaggggaattaaaataagatataagtatgtacattacatgattcacgtaaactataaattacactgcacataccactagtggttatatcaccaacaataagcatgtatccataggtaattttgtactaattctagctatttaacaatagaattttctttttaataatttttatccggaattctataccgagataatcatattttttcttgaaaactatattgattagatatttacatagtaaaaaaaatagaatatttccccatattgaagagcattttaattaaccaaaatttttttgttacctttaccatgtctttaaccaaatatgtttagctatttacttaatatcacttttaaacatcttaccttacgactatttcgtttagttagatatgtttctactctccacgcaatgtatatgtataataatactaaagaaaattagtactaaaatattactggtaaagaagagataggccataaataggtgaggtggcaaagaggtggggtggtgcagttttgttgatctcaaggcattgtgtttccctattttcctttgtactctttctcctctcttaaatcgccactccattattttaaatttcttatcttgataaaacacacacacacacaagtattagaagaacttaaaccctcttatgttctcttcctaagcttgagtttaattcaagcaagaaacagatttcgagagaagagtaagcacagagatagagagaaagaaggcaccaaaccctaaatgggtctaaacccaagattttaatcttcttttcgtattttgaggcaa

SEQ ID NO: 2808 - DNA, 3000 bp, Unknown
  misc_feature (1)..( 3000): cDNA_ID_2172228_gDNA_ID_1620601_Annot_ID_161666 3000 nt of promoter + ATG
aggtacccttttccttatctataaactccgttttgatttatgattccatccgaagtatatgaataagcaagcaataggacacaacccactaaaaagaaaaagcaatacttgtttgaaacccgttaaatcacaaatactaaaatttgaaaacgaagatgcatctactctgcatagacgaacataaatattggttgcttttatgtataacaaaggttgtaaaaattattttgaaaaaagcttgtaaaaatggtagaaacgaattaatttctaagatatgaaaaatctcaaaaaaaattcagaagttaaattttttatatatcaaaatcgtgatatcaaacaattttaattttttcagtcagttttttttccttcaattttatatatatttcaagcggacacataatcccctataactataaaattttaacatatatccaactagttatgaaacatatacaaataataaatatgttaatgcaaactgaacacaacagatcatatatatcactaatctacatatacatttttgtagccattttgtgaaataaatcctggagttagaatttatttacaatggctgccactggatttaaattatttgattttttttaattaatggtttgaatctttatacgacaattaattgtgtaacaaaccaaaaagattctaaatatatggcaatcccatatgtcacgcaaaacacaataatttaacttctccttatctcacctacaatattcactaaatcttaaaacaaccaaaatttgaactatttaaattatttgtattaaatttcggcaataaattaaaacaaatgtgaaacaaaccaaaaaatacatttacgattccggaaaatgagcaaacccaattatatgtgcagctaaaaacattctttattttggtttggatattccatggaattaatagtccataacttttttggcataaaatcataatcacaattaattccacaactaatatttaaacttatagaaaaaactaaaatatcatgagacgaaaaatatagcgtgacggatttggattgatatgaaatatagcaggactggtttagattgatataacacagattaaatatttattttattattttatcatcaccaaattttttaattacaatatcaatataaaattatataattttaatactaaactaaaactttaaaatttaatattattatttataaaaataaaatatttgccctgtggtataccacgggttaaatcctagtatataagtaaaagactaaatgaatatcaatatttacacaatcacttcacaaatttcggtatctaatattgtattttgaggttcacactgatctcattagaggctattttttcaagtgactaaattttgtaatgatttgcatattctacataacttgctttatccaaaggtgattttttttttcccataacccgtacacgtttcctcaaatatatcttactaatactataatgtatttctgaattagttaaaatttatacaaagtggtttataaagtttttgtatggatttagattaattcattttgagcaaagtgaaacgaaattcaaattttgtatggctgaataggtttcaattcaacttgaattataatctatgaaatcctattgacgaaaaaggaaaaaaaaatataggtttaacattaaacagaaacaaattagcttacaatactttctacaagtactttataacccttgataccttttatcgtaacaataagtaacgtgaaagatttatgttgatataaaaatagctagctctattcacgtgaaagctttatgttgatataataattctcccacattaagtaattaattaaaataaaatattaaaactgtttaatacaaccaaagtagtaaggcgtaaacttattaaggaacgcgtcttaattacctggttttaggttccttaatgcttgcttgcttactccatcataaagtttgtagataatgtctaatattggaaaacgaaaatggcatttcttctagttggttgtagtcagcttaacatctttgttaatagaactttatctttacatcgacaactaaatttagaaatattcacctacctataggtatactatataaatgatacccaaagaaagtcaagtgacttctctagtcatggacggttaaggatatatatgccttaaagtttgtatgaatttagcatatcacaaaatgctttttctattgttgcatgaagcatccaatgtcagattttggaagggtctctaaaatttatttcaattaatagattttgtggatgaaagttttccgtaatctaatacatactagttatgcatgcatgatttggccgatcatcaatagaaagtgataggcaacataaatggaggattagaaaatgcttgtgaattaaaaaaaaaaaaaaaccataatgcagcttataagcagtttgaaaatgtcatgatttgaattacaaaaaaattggttttctcataatgagttatcttatattatccttttagaataattgtatccctactaaaaaaaaaagattcgattaaatttcaatatggattaaaggaagggatgattactaaaaagtctagaatagcccaaaaaaggaggttttacaactagagtggcacacaaaacttgtaggttaattcagtcatttctatctccaaaatagctttgaggaaaaatagaggactatgttgaatttgtaaccaagtaaatggtttttcctttacgttacgtttagaagattttagtaatgatgctattatgagacggttagaaacagttaagagagaattggttacattaacggcgttaaaaatcaggtgtattttcaatgacccgcaaaagtgtgaccagagtaaagttccgtttagtatcggcgttatttaacgacgacgttattgttcgtttgcaatataaataacgaaagacggttttcttggagcttgtgcactctctgtcactcattttccctttgtttgcaca

SEQ ID NO: 2809 - DNA, 3000 bp, Unknown
  misc_feature (1)..( 3000): cDNA_ID_1032141_gDNA_ID_1620601_Annot_ID_161655 3000 nt of promoter + ATG
caagaaacatatatataatccttaattaagatacgccaaagaaataattaagggagaaagaaagttgaatttgattgtgataggtgtcacggtaatcttacgtgagatgggtacgtaggatctccaaaaataaataatcatgcacttttatacgttacttttgagttttgagtttacaaatatatataagctccttttaatttattgcatgttaatgactcgtgaatcacgagtgtacattactttttataaagcaatttttttctttgaaaagaattttcttgtatcagaactggtctgaatgtttaacatcaaccaagatttacaaactgtttagtgatgaagctacaatgaaccctcaaaaatgctaattaatttggtgaaatagatcaatatcaactttcaacgacacacctttgtttttttatgaaaaaaaagtctcattttcgtttgttttgattataaacaaagttggtctctcgcatgcaatgtacgttcacgctgcaatgacaatagtgtacgttctttgttgtaatttagtcgagaatccatctccgacgttaggaacaatctatcatctttcctttttttctttgcacaaatatcgtaaaagtgatacccacgattatctacaccaaaagtggtcactgacaatgtacgaaaaaacttagaaaacaacttaaaaaaagacagttcaaaatgatggtatttgatcagtgagtagcttcttcagtattaaagctcaattacatttattcaacctatggttatgattatataaactctgttttctctccaatttaccctgaatatgttagcacttgtaactaacctaattctttctattaatttcacatttaaacaaacatatataaatggattaactaattcttggatccagaatttagcttaccatacttaagatcaatccatggatctttattataaaacttgaagcgaacgctaagactagtagagtcaataaaatagtaaaccaataaacctgaagcttttacaacaactaagcaagtcctaaaggaagtctccacacaaagttctgtgctttttaactctcgaatctgaattctgaccttcactatttgaaaaccattcaaacctatcattcttctttacctctgcgaataaacataactcttcttggtttcttcccgggtaagcccgactagacccgacatctattcttgtagacggttctgaagatataccgagcctcaaggataaatcacagaccctctcagttgcttcttctgagggctttataccaataggcatgccaatgattatgggcgcttcagggactctaaaagacatgtcagcttgctgcgtttgattattaccttcgtaatacaaaggatagaccgaacccaagttgactggagctggagcaggagcagaagcaggaccagttccttgtctaattgccaatggcttttgatgcatctgcatggattcatgaagaaacgggtaaccgcgaggagtagctacacgcttgttgctgttatcaagtacatcaacagggactgcagcttgaactgtctggcttggtttggttgatgattgttgagcttgctgacgatattcatgatggtaagacggctcattagtcgacgcagaaaccggttcctgaattttaggaccgaggtaagtccttccgctactatgtcgttggcttcttgaagctcttacagcaatacatcccaaattaagagcagctaaccatataaaaaaaaaccacatcaacaaacaataaacagtacaaagcactaacttctaagtagtttcaataaggatcactagagctaaagagagaaacaaaaatgacaattaccttcaacacatggaggcaaaagaggaccagtttctgtactctcatctcttctaataattgtatcaatggcatcatttactctattccacatagtatcagcatctgtatactcttcctaatggaaaccgaaacccaattgtcattttgtgaagctgaaaacacactaaaaaaagagaaggaaaatttgtttaaaacctcggaattggctttagagtacatgatttcttcagcttttaacacaaccacaggcaatttctcctgccattctttgttcttcctcgtcgctgcgctatgtgcttccattgcgagtctgaaatcaaacaaagaaaaccccaaattaagatacaaagaaaccctagcgtacggttttgagaaagatgagtgaatgaaaaaaacctgaaaatctggcgaataatcgaaccacgaataggttgatgacgatcgctatgccaagctcgtttcacacactcgtaaggtcttggtcctggcctcggcattttctccttcttcacacacttgagcagtgacacactcagctacaaatcgaagtaacaagtcactcactcatcaaactaatcggttcaatttctatccgggagtattttccgatcagcgagttcgatgtacgagtcgccaaatggtgtggaaagaaaaatcaaccttaaaactctttttaaccgatccaaggaaacagatctgaagctttgaagctctgaatcgtttggagatttcgtctacttgagctcataccggtcacatctccgtcatcatcatcgtcatagaatctccgattgttgtctccatcgttgccgcttctggaaatggaaatggaaatggtgtgattcgggaccgcttctttaaaaacgaaccagttttgtgatttgtctattatacccctatttgtactaactgtcgtttttttttttttttttgtcggcaactgtcgtttaatatggctttttactaaaccggaattgaaataaccgggttttgaacagataatattaatttcaaacgacaccgttttggagttgtgtctaacactttgattgattctgaaatctggattcgtctcctccattaaacatctctcgtctgataacaccgatccatctctttctttctctctccgtcgactctcgttcttaaag

SEQ ID NO: 2810 - DNA, 3000 bp, Unknown
  misc_feature (1)..( 3000): cDNA_ID_2172195_gDNA_ID_1620601_Annot_ID_161657 3000 nt of promoter + ATG
cttcaagtcacaactatcttttctactcttagctagaagagcagtaaacaaaatattacctctttaactttcttgtttattacatcccctgcaatacgcgatagaaaccctccagcaaccgaaagcaactggataactcgagaagcaacagcacgaggccgtttcccccaataggcagaaatggtctccggatcatataccaaaggtaagaactcactgctttcaccagtctacaaatcccaacaaagacaaaattaaaacattacaatgctaaatacaatactaaaatctcagctgaattgccaaagagtgtttacctcaacaagccttagctgaatattatcatcagcaaaaaccgaatccttcaaattctggccacgaagccctctcatcaacacagataactgttcatcttcttccatttgagctcgtactcttttaatctcttttgatacatcgttaattctctgtaccattgccataaaccaaaattcgaggttataattttacacaatccaatagaaattttctatgaaattgctcaattgaaccataacataatcggcagaggtaggagtagaaatcgtacagtggaaacattgttgttgactacttttgacgcagacgatggagaagaagatccgtttacggtggtggacttgggtggactagtctgtgtaggtttaggatcagtagcgacggctagaatctggcgagagcgtttattacggtgaggaatcccggagacgaaggagcggcgggaggagacggagaatcgaattggctccggtccgcaattgacgagacgtggcactgctgcttccatcgatcggtagagagagattttgaggagatagtggttgtggttgatgaagtagtagctcttctacggctctaagtggaagcggagtgtttggtatttcaccggaaggtaacggcaatggagggtccacgtggcaagaccaagttcatatgatgattatttgtttccattttatttattgactctgagattgtgacatcatttgttcgaaaaaaaaaatgggagcatgtaaaatgggttttagaacgattcgaagtcgcgacctcggatttacaccgatagtcattacgtcggcaacgagttttgacttttttgtactttttctttgtgctacgtcggcgccaccttggtttttcggcttttattatattttctattcctccgttgatttcgatattcacttattaacattggagaaaatcacaactcatgtatagaacacgaatgatgatgtagaccacatccaaaaccacatcgcaataatattataacaatattaaaatctctctatatatatatatatatttatgtattttcgttactatttgaattgcatcgcattttctttatatcgcaaaacatagttactattcggattatcaaaaggtaactatattaagatataaacctatttacacaattatatattaaaatgtttgacatttagttatttaaaatttcttctattttatactgttacataatttgccatttgagtatgatatatttttcttataaaacaatatttaatgacgtcgatgtcgctgttatagtgttttcttatgtattttttattttggttaaaaatgttttcttatgtatttcaataactaattgtcttaatcttaccaacagcatcaaatgtcgcaattaaaaagaaacattgtaaaccataggtccatagccatagtaggaaaaagacatttgtccaatcaaaatatttgttcaagaaaaaaaacaactgatctccaactctttaattaggtttcctatattaatttacctaacaattgtaaaatttaatagtttagacatgagcttgtatgtttgacatttaaaattattttaaaaacgataatacctttttttattactacaaattggcatttgagtataatataatgtctttatatataaattattcttaaaatacgttatcatagaaagttttgtttttttaatctaattcagcaaataattggcttaagacagtgacacattttttagaagaaaatttgtaaaaccgtacaaatacgttctcgaaaaagacaagtgtacaactaatctggataatctcttttaattagttaccttatattagttgttaatatgtttataaattactacaatatacgataattaaatttaaaaaccagacaagagatttccaaatccaaccctattatccagatgtggtcggtgaaagattccccaattaataatgttaagtggtctttaaacatgttcctgattagattaaaaaaaaagtgtcaaaacaacacttttgacaaaactaaaaggactaaaacgtaaaaaaacgcaatgcaaaattagtctctctttctatttctctttggtcttcgtcttcgtcactgtggagacgcacgcaaatcaaaagagtttaaaaaccacttgccaccgtatgagaaccttgtctctgacggtcgattctccgctcgccacgacgacgccacgtcagcatccacatagattcctctaaatctcaccaataccatcaaaccgattttcgaagattcgaatccaattcttctcctcctcctccttcttcttctgagaaaatctcatcggatttcatatttttgtcctattgactattcaacgtgacagatcgaatacaaaactttttggtatgttttgatttgcctttgtattcaaaatttcgcttctaccgattcgtctgaatgtgaaccgttttcattgtcacttcctttaggttttgaatcggggattgttgcgactgagacggtgccgtttcaattcgctgcaaatgcttccctgagaaataccttttgttcttttatgtaaataaaaggtaaaaaaattcaacctttttaaagttaagaagtatatgcaatttcgtgttgatccttaattccttattgctttcaattttctttgatcaaatcagtgtagaatcgagaagtatagtaaatatg

SEQ ID NO: 2811 - DNA, 3000 bp, Unknown
  misc_feature (1)..( 3000): cDNA_ID_2172063_gDNA_ID_1620602_Annot_ID_161677 3000 nt of promoter + ATG
ttgaaatcaaaacagtgtgtatataaatatatgatcacaagtttgggagaaacatcgttaaggtaaagtggatacgagagattgcaattttaagagaaacattagttggatacatgaagaaacttatatcaaaaattcatcttcaaaaatgatgaaacaaaaggtgtgtatggaagaaccagatggtcaacttgacacatattccactgatattaataactgtttaatctatgactttggaagagcaatgattcttttttcctatagaagtgagagaatgttcatattagagagaaaaaaaatctttgataacaaaacaaaatcccttgtctagttgtggtctcaagtagaaatttttgtttcactcacttccaacttgtctaagacattatatgttcccaagcgtttaaaccactgaaaaacttccattcattaaataaagcttataggaaaagatgcaacaagtgtatgacgttaatgtctacacacccaccttacctagactgttgttagaacactagtttaatatttttccttggctaggttattttactcaaacttacctttaataaaaaaaatttaattattggatagttccgcttaagggtttgaacccaaatacttatcggaaaaccgatcgaatggattcaatttttctatatccgatgaaccaattccgaatccaaaccgaaaaagagaaaaaattgatgtagaaagtttctttgtaaattaagaatatatttgaccaaaacctgaatccgaaccgaaatcaactgtaccaaaccatctattttagattacattttcagtttgaaaccattattcatataccaaacatataaaaacccgaaccggattggaaaagcgcattagccaatcagtaggcctaatttatcagtccccgtaggcccaaattatttaataacgtaacatcaaaactcaattactggaggccatatgcaggcccaaattagtgtttcgcttgctagggctttaaagtaaggttatggattcttgtttgtaggatcttctcttgcttagccaaggcaactatactctattactagatgagtatccgtactacgtgcgagtttatgtattattatttacaaattgttttatataatgtatgttcatataaagtaaagttgaatgcatcggttttgaaacataaatataatttgtaattgtttttgaaaagtcctactatattagttcatctgaaaaacgaatgtgcttgagttattttttattgttgttttaaattctcaggttttttttaatttatatatccttgttttttggttctaagtgtagattgtgagacggtgaaattttagaaaatttatttcttacactaaaaatataacatgtctttattaaccatgtctctgcatattcaatctaagcttattcaacttgatgttcttgaaaagtttagttaaaatcttgtcataatcttatatctcacgttttagttataaggatagctcatcaaacatctttcaaattacttgttttcttagcataaatctcgaaaagcatctgcatattcatttagtttctttcataataattgtctaatttttaggcaagtctaatttttaggcaagtaatatatgtagcatgtttggattttatgatcactttagccacttaagtggatctcaaaattaaagaagatatattgaattaaaaaatatagaaaaagtgatggttcaagttctgattaattatatcctttatgttgaattaattactaattatgtattacttattttatgaagtctaggtggcaagctctcatgtgctgatgtgtcaagttgtgggagagagttagcctcctttcatatatatgattctacctgttccacattaagctccagtttacaggacagtactcagaccgattttagatgcttaatagcttcagctctgtgacagttctccacactatatgtctatatcgggtataattactccatgttcctctcgttcagtctgatccaacgctgcctagctaaactaaggcagcatcaacgtcactactttccgattctaagaaatctaaattcagaaacacttcaaatttctaagcagctcagactttgtttacctgatgaaacccaggttcatgagtcaatgtaacaccaagctcatgtataatagagtataaactggagcttaatgtggaaataacctgatgaaacccaggttcatgagcttaatgtggaacatgtagaataatagagtatagttacactcttactttgatattttcagatgaaggctccacgtcgccaatgctgtgacatctctccatcatatgaggaaacaaaaggctaacttttcatggttcagaaacttgtggaagtctgtatccgaagatctctcgacattctgacaatatttgtcgatgggtttggtcgtttttgtgtaataatatgcaacattgtttaaccagtacggcttctcttctcttgttattaagttttcctagttaaactattaaatgtataaaatgctaattgtagatgaaactgaaaagttgaaaaagaagaagatgaaactgaaagtttaaatcttatatttgacccaaaataaaataaaaacagagaagcttgtaattatagaaaataataattccttcatttcaggttgtcaccataaaaatggtgtgactgtaagagtctgaactcagtcacacctctttactttttcttcggccttcttgtagccgcaaatacttctctgtcatctccgttacaagctctaaacatttatttgaatttatcaatagaattcgtataatgtaaccaaaaaccgtaaactaaatatattttataaaacttatctccattcaacatccaaatccgttcgagtctcacacaaaaatccaataaaatgtactattcatcgccgacatgcttcgttttgatcactatatttgccgtggtggtaacacaactgatctttatgcgcaccgtttcgtccttgaac

SEQ ID NO: 2812 - DNA, 3000 bp, Unknown
  misc_feature (1)..( 3000): cDNA_ID_2172140_gDNA_ID_1620602_Annot_ID_161702 3000 nt of promoter + ATG
ataaaaataaataaaataaatgataataataataatttggaaaagaaagaaatatggctacgttcacgacaaacactcaaacttgtaaaccaaaatgggcttttggattttccttacagaaatgtataaagtaaactctcatctagattctctatttgaaggtatttttttttaaagtaataactctcaaatatgccttttgttttgttttgttttgttttgttaaagtagtaattagcaaaacctttctatataaaaaaggaaaattaaaaggccttaaagaaaaaaaggaaaattaaccaaagaaccgtaagtttcgtctttccatattccacgtccgtttacgtttgtttgcagttgcaaaaatatttataaatcaaagattaatccttcttttttttatataacaaagaagattgatctttatcaggaaccctaagttttgtcttctctctaataagtctctctggattaccttgtgtaacaaggatgggcagcaccgtcttggacgcaaacccgtcaaccttaagagaacatccaccttcctcatattccatcaagtttgagaatatcgcagaactcgacgatggcaaatacgaatctagtcttttcgcagctggcgggtacaactggtatgtatacttacaaatacaactctttgtttcactaattgtgtacctaaatttagcactatgtatatgtttaatctaacttatttcgaatctagtctttaattaccttacaaagtttccaagaaagatgaagaactgaacataatagagctcacggtagtgagtagtttggaccttggagacaataaattttttattgctagatgtgatttgtgagacatatcactccatgaagaatgatcatgtttttaccctctatgattttgttggcaactttttaaggagattggtcatttatccaaaaggaaacgcaaaagacgaagggagtggatttatttcaatgtatgtggagattgatagcacaaacctcttgtcatcaccactaactggcgtgtttgcgtatctcgtattctttgtctacaacaagaaaacagacaaatactttactattaaaggtttgtatatatctaatatatttcacatatacattgatctattgctagtttgttttccatttagtatacattcacttctcgttttctttactcatcgacaatttatgcacgatgtcatagattcagaactgaagcggttcaatgcatttagaacggtgtggggattgtctcaagtgctttcgcttgaaactttcaacgactctaaaaactgatatatctttgagggagatcaatgtgaatttggtgttgatgttctggttgctccatcccttactaaatgggaagtcgtgtcctttaatcagaaaatccttgatcccaagttctcgtggtctctcaagaaatttaaagagttaaaagaggagttatacaactcagacaagtttttagtaggaggaaggcaatggtgaggagtctaaaaaaaacttgttttgctttttcatattacatatgctatgttaacaagtgcaaaattgttctgtaggtttctaaaggtgcatcctaagggtgttaaagcacgagacaactcgttatccatttatgtgtatttaagtgaaagtgaaacactcaatgcagaggagaaaatctacacgcgagtacatcttagagttttagatccgtttggatccattcaccaagccgggcaatgtaagtttccaaaacaataagtatatcatatcatcttatagttgttttacttcactggttgatgaaacataatgtttcatttggtgctctttttcgtccctcgtttactattttaaattataagttgtaattatatttgacttataatcaatatgcatgcttatatttcttcctctgttgttgcaggcaacttctggcgcacaaatacaaataaaaaccaaggctatggttggcctacttttgcgtctttagataaagtgcgagagaagtacttggacaatgagggttctttgaacatagagattgaatttgcagttgtttctagcaccaaatactctcctgttaactaaattctgctttagaaaagacaattatatatctaccatttgattcaaagacaatacaatgcagtgttttgataatggcttattgagttatttatttctgaattatttaaatctgaatctttttattaatatttttaggttatactttaaactttagtcttggtatgtatatatatgattatgaacaaagaaacgagaaagagcaattgaatgcacataaaataaactagagcctagaggtgaacctatctagtcatcaaagttcagtgccggtaaaatatgatgaaagttactggcaaaataaccaaaaaataagggatgatcattatctctgtaaacagaatacaaaattaaatttaaataactatctcactaaataaaaatttcaatacgtatatagattatattattccttgtccaaaccctagaaataagtggggcaaacaaaaattaaccccaccccaaaggctcttcttcttcttctctctctttgcttcaggtacgtcgagtctttctctagctctctcaacttttcaccattctttagagaatcaaggataaaacgagctagctctaggtacgttgtttaatgtttgtgaattctaaatcaaattttctccctgtcccacatactttgaatatagctcgattcgtcgtcgaatctttctttagttttctttaggtgtaaaagacagtactcgtcgaatcttttgattttgtatatgttttgctatatatggtcgatgggtaattttttggtttagtagttaaattttattttctagttaggatatatgtaacagaaattctaaactttggtagttccctttcatctcttctcttctgtcacatatacacgattttttttcttcttttttggggtagattctgattctctctagtctcgcttcaggttcaatg

SEQ ID NO: 2813 - DNA, 3000 bp, Unknown
  misc_feature (1)..( 3000): cDNA_ID_2172144_gDNA_ID_1620602_Annot_ID_161703 3000 nt of promoter + ATG
gcgacaaacagtcgacaaaaaacatataacggaatcgtcttcgttcctcgtgtcgccgcctcctcttcaacacccaatcaccacaatccacgtgtatatctctcttttcttaattatttctttcttctatctccacccaataatcacaagccacgtggatatctctctgttttattctcttcttcacacagtcacgcatcattctcattttctcctctctctgttttttccctttcgccggagaaaatggagacaccagcttacgatttcgactcactcactgacttaccaccgcttcctccttccgatttcactccttccaacgccttcaccttccccgaccacaacctcgacttttccttcctcgactccactctgtctctcctcaatcggcaccatctctctgagtccactcgcttggaacagattttttacgactccactcacactcagctctttcacaacgacgacaccaccaccaccaccacaccgtttctccaccttcctgatctcaaatccatcgacgccgttgaagaaccgacgacgatgaagctgtttccatctctctctcctcctcttcccgccgccaaacgtcagaagcttaactcaacttcctcttcaacaacctctggatctccaactgcgtcaaacgacggtggtattattaccaaacgacggaagatctcagacaaaatcagatccctggagaaactcatgccgtgggagagaaagatgaacttagcgatgactctagaagaatctcacaaatacatcaagtttcttcaatctcagattgcttcactccgttggatgcctctcgaatctgtctacaacaccgccggtgaagtaggagaaacagatttgctcaaatctctgacacgtcaacagattcttcaggttcttgcgaattctccaggctcacgaaacgtactctcctctcgtggtgtttgtgtcttctcttatgaacagcttctctctctcaagacaatgtcgagaaacctctgaatccaacgacgtcgtttgaagaaacaccaaaagctctctgtttttgttttgtttaacgtttcttctacatagcgttttaatggcgttttgattctcagtttcaatgtacaaaagttttggtttgattgatgatattctaaagaacgaactatatgagaaactttgcaattttttcacattaaggtttcaatacaaacataaacgatacataaagttctcaaagacaaaatcaaaacatgaaaaattcctcagggtttagtggtagaagaagaagcaagaagaagctcaagcatctgattacccaaatcctgttccttaagacacaaagctttccatccatcattcaactctttagctttatcatcaccaataagcttgactctctcaaaagcaacttcttcagaaatcaaaccttgagctacaataatctccactaactccttcaaatacggatacttaacccaaaacccttccacagtttctgtaacacaaaaatcagagatacgaatcgattacacaacaatctcgacataacaagactcgttcaagcttattcagagtagaaacagaggaaatggtgaatatgaaccttcgtttacgagattggagagagatccttcgtttgtgtttactaactcggacgattcgtcttccattgattcgtcttcagatgaattagaaatttcggaaccgttgtactcttcgtcggatgattcaggtggagagttgatgaggaagtgaatcggaaccgccattgtcgttgggatttgagcttgaagaaacgaataagagtcgatttgtgcttgtgtgtatcaatttattttacggagtacgaaattgtttgtaaatttgtttagctgacgtggattgaaccggttctagaagaagatggaagcaagatcaatataataaaccaaaaataaactaaaccgaaaattgaaaatgcgaaatatgaacaagattaaacgttgccaatataatagtacacaagcacaatttgatgagatagtaaataaaagctattaaaaaactctactgttcgttcagatctctctttttttataatcataatttaaacattttaaactggtttttagattatagatttttaaaagctcaaaaaaacaaaactaagaccatgaatggatgctaatttagattcagtttttgagtttagattttagtttatagattttagattttagttttagatttttgttattatatttttgtttagaaaacccaaaaaatttggtttttagtttttgagaaaaataatgttgattgaataaaaactagattttctaaattttaggaaaactaaaaaactaaaatcatgaatggaaaactacagtaacatagttttactaaattgtagggaaaccaaaattttaaaatcttgattggtatgaaaataagtttttaaaaaacaaaaaccaaaaactcttacaaaatctacaaaacattcaaggcctttagattacagattttggattctacaaaataaaaataaataaaataaatgataataataataatttggaaaagaaagaaatatggctacgttcacgacaaacactcaaacttgtaaaccaaaatgggcttttggattttccttacagaaatgtataaagtaaactctcatctagattctctatttgaaggtatttttttttaaagtaataactctcaaatatgccttttgttttgttttgttttgttttgttaaagtagtaattagcaaaacctttctatataaaaaaggaaaattaaaaggccttaaagaaaaaaaggaaaattaaccaaagaaccgtaagtttcgtctttccatattccacgtccgtttacgtttgtttgcagttgcaaaaatatttataaatcaaagattaatccttcttttttttatataacaaagaagattgatctttatcaggaaccctaagttttgtcttctctctaataagtctctctggattaccttgtgtaacaaggatg

SEQ ID NO: 2814 - DNA, 3000 bp, Unknown
  misc_feature (1)..( 3000): cDNA_ID_2172121_gDNA_ID_1620602_Annot_ID_161694 3000 nt of promoter + ATG
cacttgcgatccttagtgttaacagctcaatctcaatcctcaaacctatatacattaatcgccaaaaacccctaacttaatcgtaaagcaatctttgttaaatcacaaacttaatctccaagtttcgttccaaaaccaacgtagaatatttgtatttttgcaagtctatccctcaagtctatccagcttagcaaatattcatctaataaaaacatcctaatggtgattctattttctacgattgataaattagtataaatttgaactttgacttttaccaaaaaaatttttttgaactttgactttttcataggctctccccatccctcgccgaaaattcccaactcatctctgtcctctctgttatagacaaaattccttctacaaactgaaatgatcaaaaacaaatatagctttgagttagagaaaaatagttaatttagttactactgagacgaatctgctaaaatccttattctcctctagaaaaagaataaataaaccaaaacaatgttctcttcatattctctatgcaaatgcctcgtttctttccatatattggctatacaagtcctcataagctgtgcgtcttccttgaatcttactaatgagtatctgaaccacaaatgtcgcgtgatcaaggaaaataccaaccaggaagtgagtacgagaaagaactcaacactctcagccgtagagttgctacccttgactttacagatggtttcacacaccggtccaatagtagagataccaaatctgtcaccatcatattccaatgtcgcggtgactcttacaggtccaagtgcaactcctgctatgctaccgccctcgccggggtaatgccactttaacatgtttgcatatgtgtagtctatatcttgtcgttcgctataaacaactaccttaactaaagccaaaagaaaattgactataagaaaccaaaattcaggttagagttagaattacctagctgaaacaaatgtgagttggtttatacacatcaaccgataacaattaacataactgttatatacactatacaaccaaatttgtggtgtgctaggtgttggcttggtgttggcaagattatttacccatttggaaaagattatttacgtccaaaactttcttgttaatatatatttatatattaagtcatctctctttaagtcacaactatttgatttttcgttaggtgaaaacaacaaaggtgcaaggttatcttgtattgaaatgttaagattgctttttaacttgatttatttatcaaaacatttattatgattggtatttagtatttacatatcatccagttagagatatcttctatatcatatcatttggtagattattacgggacaacttttaggtacatatgtcaaaaaaaacttttaggtacatttcgccattttgcatacaactgatttcgtgtacatctcacggttcctacaaaaatatttatgaatatgtatatgtatattacagtttcgtagtaggtgtccgagaaacaaaggtggaataatatggtatgaccaatgttttctcgatgttagtatgattaatgacaattccccaagacggatgaactacgataatattttttctatgcacaacccaaacaacgtgagagggaatgtaaactcattcaacaaaaagacgactgaattcctctacaaactgattggaaaagctgatagactcgacgtggacgggatcaactttctatattacgcggcaggggaaatgaggcttgggaagcaaacattgtttgcaatggtgcaatgtgcgaaggacatattgagttgtaaggattgtttggaatggagtatcaaggagctttctaagtgctgtgatggtaaacaaggagcgagagttgtaggtacaatttgtaatcttaggtatgagctatacccttttcttaggacttaaagcctctttggtaataaagcagcggttttgctgtctctctagtatctcttttgagctttttacaaatttttctgtttattttactgcttatacttctttttattttgtttgtttaagtcctaactatgtctatgaatagggtcccaatcaaaattcagtaacctaattttgaaacgaaagggggaaaactatgtacgtagcaaacaaaatgcaaatcaatcagtcccaccttctatttcaattattaataagagcaaacttggtgaccctaaaactgagacaaacgacatttttgttttttcaaattgcccgttaaacatattgacgggttttttattggaccgacgatgacttagtagcacataagttgcccgttttggcatgctattttaggcccatgacaaaaatccgattcacaatgcatggagtatgagctaatagccgtggaatgttagtttatcaatgttttgggaaagaaaaaaaatcgtttggtaaatgaaaaatgaaagactttgatttccataatccaacttagttataaatagaaagggaatgaattatttatagcattcgaagctaaatatattagcatttttctttctcaatctagatagttctgttattaaatcatttttatattacaataatatagtcatatagattcctaggtattagcatttttctttctcaatctttagatagttacgttctctaaaaatgtttgaagaggtggagatgtgaaataagtacagagaacctctaaaactttgatccttgatcaaaactagtggtgattcaattctctcagacttttaacttggtaaaacatttaaaatttgacttttccattggccatcctcacccttcgccgaaaaatacccgacccctctctcctgtctattacagaccaaaaataaacattttttctacaaactggaatgatcaatagaatcttgtatacactaacaaaaagagagaatattattttagatgatgtgtgtccatcagctaaaattcttctgactcttgtaaaaacatcttaactatataaaaaaagaatccaaaaca

SEQ ID NO: 2815 - DNA, 3000 bp, Unknown
  misc_feature (1)..( 3000): cDNA_ID_3070027_gDNA_ID_1620602_Annot_ID_161692 3000 nt of promoter + ATG
gctctacgtgaagtagagttacaatatcattggattaaaaatatgagctcattgcaatggaaatgatataactacaattgaaaattaaccttcttacacagggtcactacgcatgaaagttaaaacatctattgctcctggcacaaaaccagtggcgcactacaagtttggaattgggtgattctattttctcagagttttaacttagtaaagcatttgaactttgactttttcatatgctctccacatccctcgccgaaaataccaaactcctctctcttggttgttacagacgaaaaaaaacttctcaaaactaaaatgatcaaatccagttttgtataaggtaaccataaaggaattgtataccgtcttgaaaaaaattagttaatctagttaccaatgaagccaatcagctaaatccttcctactctcctgtatatataaacatcacaactcaacgcttcatttataataaaaaagaaaaacaaaacacacctaactcttgaaaaaaaacaatcaaaacaaaatacaatatgtactcttcatgttctcttttacaacgtctcgtttggttccctttcttagccttggtggccacacaactcctatttatacgcaatgtttcgtccctgaacctcaccaatgagtatctgcatcacaaatgtctcgttagtgaagggaaatataaaccaggaagcaagtacgagtatatccttaacgattacatccgttttctcgcagccggaaattttcgctcaggttccatgcacatgactagtggtctaaaacccaatgctgtaaccattctctaccagtgcagcggtgactcctataattctaagtgccgctcttgctatgctgccggcatctccggggtaacattatttactctcttcatatcatattaaatgttattttagccaaaacaaattgttttaaataagaaatattatgttctgtgattatttgtatacaacaatttatgtttgattcaagattttcttgtgcccaacagccctcaaggcttttaagtctgtccatagcgaccaattcaatgaccctagcgtacaatttatcaaattaggtaaataggaagggtaatgaatggtattgtttttttatgtctaacagattcttcattcacattttcaacttatgaaagcctattttctaatacagattcatgaattagttagaaagcacaaacgcacaatgattgtttcttatatatttatatttatttaataatattttagctattatttcataatttaatgtattaattattttaacacgtcaaaacatgaattaattatgtaaaatgtaaacgacagcttcgtaggcgatgtccgagaaacaaaggtgggataatatggttcgatcagtgttttgttgagattacttcaatcagtgtcatcgacttcaacatctcaaagatcaattacgagaacaatttccccttacacaacccgaacagggtaagtggcaatataaagtcattcaacaatgagacaatggctctcctcaaagagttggcgttgaaagcaaataataaagacaacatggacaatggcaagatggcactgtacgcatcaggggagaagagggtcgggacaaagaaggtgtacgcaatggttcagtgtatgagagatctagttaagcctaagatgtgtaaggagtgtttggaaagcattataaaggagtttcccgagtgttgcgacggtaaacaaggagggaggattttgggtacgagctgtgattttaggtatgaactttacccttttctaaggacttcagattcaaaaactgtttgatgacgatgcacaacacattctcttgacaccttacttattttacttcagttccggttttttgagctttttactagtttttatttatattgtttattcttggatttccctttgtgctggtttagatcacatgtgcctatgactaagatcccaagctgtgtttttcctcactctttatttggttattaattacagttgttggctatgaataagaagctctattattcttgacatcttaaatttgttaacatagaactccgttttctaatttattgttggcgactaaatagcgtcacgtgtagttaatttagacgaatatttccgcgtcattgcttaatctgagtcatgatcctacaatttccaagtcattcaacgggtaaaactactccctgattgacaagataattttgtgattatccgtagctctatcaaacctgtaattaagataatgcaaacttctaacaagcaagaaatatttaaccgatcataaagattatgtactggatataagcgtcagttatggtgaatatatattcagcataaataatttatcatcacccatattatgtcgttcaagaagattcatgatgtatttccgttgtgttacgtttatcctattgaaaaaatctgtgatgtcaaatgtatttggatcaacgaatcctcgtagcgttagaaagtttccactctatcgcaatgcatgggttttagctaatttccatggaacattttcttttttaaaggaagtctacgttactacgtatgaaagttaaaacagcttcacaaatcacaagatcccaacacccaaaatcatcctgctccttgcacaaaaccggccagtgcgtatcctatgattatgttttctaaaagttttaatttagtaaaaggcgttgaactttgattttttcatctgccctccccatccctcgccgaaaattctaaaatcctctctcatttctgttacagccaataaccattttttctacaaattgaaatgattaaatctaatttgtaaaggtaagttaaacaaacaaaaaaaaagattacagttgaaattattagttaatttagatctaatgaatccaatcagctaagtccttttgtctcctatatatatatagaaacatcccaatcttagcctttcatatatggaaaacttctaactctggaaaaaaaatcaaaacaagaaaca

SEQ ID NO: 2816 - DNA, 3000 bp, Unknown
  misc_feature (1)..( 3000): cDNA_ID_3070074_gDNA_ID_1620603_Annot_ID_161713 3000 nt of promoter + ATG
tattgttgctgcggaggcatgaatgaatgaatcaatgatagacgaaaacatatagtataagctacatagttgaaaattaatactttaatagattaaaaaaaaattaacaacatatcatgcgtgaggggatggtgggtttattttataaaaatgcaaatgttttattaaaactaaaacaacaacacattctagtttctacaacatatatcatcccgtaattcagagctaaacataactctcagttttgctcataatgaaataattttgctagtaaaacagaaaatatctatgtttcataaaccatcgtttatcgttatcgttttcacacaggttagaaaactatttgaatttatataaatgttcatactttgattagttttagattttttttttttttaagtgtatgttagtaaaagtcatcctttttcttttctttttgataaaagttgttaaagtgatttagcgacgaagcactttgataccatatcgaattaaattacagaagaaaaacgttttacttattctattattcaattcaactaagagggtttcattttggtttacacattacactggttagttaattgctactcaaatttgataataacatggtttacttaaaccaaacactctttaactaacagaaataataaacaaagattgaggagtgtttccctcctagttttagacttttttcggatagcaaagccatgaactttgcgaaaaaggctacaatgattgaagagtatttggtatttacagatattacattaatataataaatgataagaaattattaatatgaaataatgtagtctttattaggcaagttgttatacttattcctagatagttactctatgcggtaggccaataaatttaaattattaatgatttctctaactctgaaccctatcaaataaattccaaccccatcagaactcagaagcacaaagtttccctatccaaagtaaataggtcacacaactaatgaaatcttttacagaactgtcgaatcatgatagcatccgttcataattattattccattaacgtatagttgaaagacactcccaactttcaaattttaaattttttgcatgccttaataacctggaaatgattactgttattctcactttttttttgctacacaatttttttctcacctttctggtttcaatctttttttttttttgtcatccaaaattaattagagctcaaaatattcattcctgaggaatgatgtttacataagtgatatgatgcggttagacacgaactttacgcgccaaattatccgctttgacatttgcactatgagaaattaaagataaagaaaaatttgaaaattctttcttgtcactctgcaattcctccaaatacactgagaagaccggccattcggttgggaaagacaccatcttcaccagatccgaacagtatgtgagaaacacaacatcttgattttcggcggcaatcatgcaataaaagtataaaaaataataataacttcgatcgttgttgttttaaattagtaaactatagttttttatttattttatttttgctaaacaaccctacatgatttaaaagcaatattatagttttggtttctacaatatttatagacagaataaggggtccaaataattctttccacattcataactaaaaattttaattaataaaatagagttaagagtttgactatatataatttttaaatcaacaaatatgtaagagtaatataaatattttttccctccaatgacagccagaattgagtcattttgataactcacaaatggtaaaaatcattatatgtaaatacttattcaaatagaacgtataattaaggaattccgaatatttcaatatgactaatcaagtaaaaaggattacaagacattaattatgttaatcacccatagtataaaattctccgacattattaattcctagtattaattaatgattaaaacacaaaccttgtaataataatagagacgcgtttagaaagaagaagaagaaaacctaactccgttgtgtagttccgaagtcgtaacctgctccattatctatggacaacacaccaatcctctcttctctctccttttatatatgtcatccacttccgtacctgtcgtctctaattaatcgcatttaataaacgcgtctcaagtccgacattgcgtcggtgttgtcaccataatcttcttcttgactctatatcgaaaaaagcttccaactttatctcgttaaccgaaactccggcgacaaagcttctacctttatgttctaaaatcgaaactccggcgataaagcttctattttaatttgtaaattgaacttccggctgaattttaaccggagtatgtagattccggcacacaggtgtttatctttctcttactgtatttgtccgttactgttacatttctttattgcgttaatcaaaattccggcgataaagtttgtacctttcgccggagaatgcagattccggcagactggtctttgtctctctgtttttttgcagtctttgtcagttgaaacgccgtcgttttttggtgaaattacttttacagttcttttagcgaaatgtttggtgaagaaagaaagcagaagactttaattttgcgatcgctttctcttataacgttttctgcgttgtttttcgcccaacttgcctttttttctctctctgttcttatggtgtcggtaacgcagtttctgcgtttgcgtttgtaaacgttactggaagtttagtgtatgtgtatctctttgtgattgatacgaagtttgattaataaatgcttctgatttgatgaatatttggttgctcttaattttcaagattctttctttatttcccaagattttgtttcctttcaaagtccaagtaaaatattcagtaaggttttcttttcttaaatccgaaatttgattgagaaaaatctcttctgattttgtgatgtttcaggctttgaagaaatg

SEQ ID NO: 2817 - DNA, 3000 bp, Unknown
  misc_feature (1)..( 3000): cDNA_ID_2174947_gDNA_ID_1620604_Annot_ID_161723 3000 nt of promoter + ATG
tagttgatagtataatatgatatcaatatcatagtagtgaatcaaagaagaatgtacatatgattaaagtgagtaattcttgtatgagtggaatggagatatcagatatcttctaaaagtgatttcgaatcatggacttgtaaaatttttcttaatttttgactttttgatgaccaattcctctatttatttatttatttccacaaccgaccaaatattttcagataatatactctgatgggtccattgtattttgggccaaaaagcagtcctctattttatcaggatcagtgggaattgactcggttttgttctacttgtaatgggttatgacaaactgagaccaaaccagccattttacccctgcattcttattacaaaacggccaatgttatattgtcaactgaaatagttgagaaatacagtttacaaaaatttggcacctaaaaagagattgaaacattctacaaagcgataaaactttactttatctttgaccggacaataaatgataggcatttctagaattttaggaaaaaaatgaaaaaaaatcaaaatgtgaacgttgatacaataagaaagtcggtgaacaaaaaaaagataatataaaagcataatatagacaatataaaaattggttcgaccatcccaaacactacggaggacccaaaatatgagccaagagacagcgatagcaagcttcaagaaattccaacagtcatggatcgagcagctacgaaaccacctgaaccacctccgctccgcccaaaaccatcaccggaactctgctaccggtgatgaggaacggttaagggaggctgtggacagagtgatggaacactttagagaatatcacagggccaagtgggctgcgacggataaagacgtcatcgaagttatggcttctccttgggcttcagctcttgaacggtcgcttcagtgggtcggtggttggcgaccaaccaccttgttccatctggtttacactgagtcgagtattttatttgagtctcgtatcgttgatatacttcgtggctttcgcaccggtgatctcagtgatctctccccttctcagttcaggttctacacgaacccctaattagctactttgtttactaatcacaactactagtaaagatttttttatctaatttaataaaatatccttaagttacgttgtaatttgattgaagtaatatcgtgatttgcgcgtgttattgtttaccaaaactaatacaggttcactcctacacctagagatatcaaatatgtagattagtttagaacatacgatgtttatttgtttacttttcttaccaaaaatgttttagaaagtgaaaaacacatttgagggataacaataaatttgagagattaaaacacttattttactttcttttttttcaatgtgtaaacaataacatatggactaactaaacatattttgattacttaatatttaatatttagggttccatttgtcaaaggcaggacggtaagtgagctacaatgtgagaccgtgaaggaagagaatgcgataacggaagagttgtcggagtggcaagacgatgcgagtgaccttgtcatggggacatcgtcagatcccgaccagaggatccgacggctagcagaaatcgtccaccgaactgatgatctgcgactgagaacgatcacacgtgtggtggaggtcttgagtccgctccaacaagcggagtttcttgtcgctgcggctgagcttcgtacaggcgttgctggttgggggactagccacgaccgtcgtcgaagttccgaagtttaaagctaactaaaaccggtctaaaggtaatgagaatcgaggaagaaaaatagtttttggatattaattatatgtttttaccatgtttttggttatccagactgagtttggttttacatggttatgaaaacaaaaaaaactcatatgttatgtctctacggttgcaataaagatcaacccacgtgtggtgcttgttagtttaccttttttagttagaattttgtgtgtttgattttttttatgaggtaattatcggaccttattggggcttctgatagtttgtatataaaaaatactaaagacagagaatcggggacatgggtcattgttggtttctatagaccaagtggataaacagaaaacaaaaagtcagctacagaaaaagacatgaagtgaacgtggcactgccatgtctcttgaagacatgcaagaggacacttggtgtggtacgcgtcctcctatcacggtgtcgattccaaacattttgtttggtttagttttaagattcttcttcgaaagaatctcatttttaatcgaaagatatgatgacatgacaaatttcttcttacataaatttgctcttataatgtttattttcgtgtaagttttatatattttctaaaatattgaacttaaactagctagaccctttataaaaatactatcagcccttttatataatgctttggtgacaacagaacgacaagaaaaactgagaagagacctaaaaacgattatagcggttttgattggttgaagatgtgtcacaattttttttgtttatttcgtttcatttttatttaatatgctagtaaacctgttttttttttttaaaactgtattataaaaacgtgtcttgttaggcctttaaagcccaaataagcccaatgaaagaggaaaagaggagacactgagatttggcccaaactaacgcatatatttgtgttttacatttatacccctatgaccgacatcaatttaccgacagactctactttcgagaatggcgggaacgtgaactgaaccctaatcaccttttttctcgattccccaccaatggctatatgattacagtagcccccttcgtgtctcttcgtttccagttccctctttatataataaatcgctccactctctttttccgagaaagaacacagtatctcgtctacaacacctgtcacattttgagaacaacggcgaaaaca

SEQ ID NO: 2818 - DNA, 3000 bp, Unknown
  misc_feature (1)..( 3000): cDNA_ID_3070102_gDNA_ID_1620604_Annot_ID_161735 3000 nt of promoter + ATG
gagatctagaagaagctattgtgatccttgacaaggtcactgggaaatcgaaagggtatggtttcgtcacttttatgcacgttgatggagctttactagctctgaaagaaccatctaagaaaattgatgggcgtgttacagtaacgcagctcgcggcatctggaaatcaaggtacgggttcccagattgcagatatatcaatgaggaagatctatgtggcgaatgttccttttgatatgccggcggataggctattgaatcactttatggcttatggagatgttgaggaaggtcctttgggttttgataaggttactggtaaatctagaggctttgcattgtttgtctacaagacagcggaaggtgcgcaggctgctcttgctgatccggtgaaggtgattgatggaaaacatttgaattgtaagttggctgttgatggtaagaaaggagggaagcctggaatgccacaagctcaagatggtggttctggtcatggacacgttcatggtgagggaatgggaatggtgcgtcctgcaggaccttatggtgcagctggtggtatcagtgcttatggtgggtactctggaggaccaccagcgcatcacatgaattccacacactcctcaatgggtgttggttctgctgggtatggtggacactatggtggatatggaggtccaggtggtactggcgtctacggtggacttggcggtgggtatggtgggcctggtactggaagtgggcagtatagaatgccaccaagttcgatgcctggtggtggtggttatcccgagagtgggcattacggtctttcatcatctgctgggtatcctggacagcatcatcaggctgttggaacgtcccctgtgccaagagttcctcatggcggaatgtaccccaacggtccaccaaactactgaaaaggtgcggttgttctcccttgtatattttggggtttaagagtgtgttgcattatcatgattcattgcatagttatatattcttccctactttgtggcatattgtttttgcaggttgtgcgtaattttcttgctagaaattctctgctattcttttccctgtgtctcttttagtctatttgcttgttagtactgtgttagctacttgatgcaatgcctttagtcgatgtttttttgcttgtgttcattcctttattttaacgcatgaaagatagccagaaaagtggcaccttgaacccttttatggggaatgtttgtggcattctttcatgcagtttttctgtttgtctttaagctgctagtctgtgcaccatgctttgtctctctatcatttactttttgtagtaatgagagtacgcatgtgatcgttccatcttgagtccttgttttccttctcagtatttaatcttcttctgaggatagcatgaggttgatttctttgataatgctaatgaccaaattgagttgtgaatgggtgttgattcaggtttgtgacagcatattgggtgaagatgctttttgtgcttagtggtgattacctgattgcagctctttaatctctggaatgatgaatgtatagctgctttgacctatctgcacttgacctgaatgtgctttggtttctataatgaatgattagactaggatatatttatgtacttttaaatatagacatactcggcaaatgagttttgttggtcagattagtgagtcttcaataatatgttgtattttctcctacattgttttctggtttatgtccagccactctattgggcttcctgattggtggttatatttcttgaactttgatacttaaatgtttgtgacttttggatatctaaaccttgctgattggtggttatatttgtgacttttgaggacatccagactggccctagaggctatgatttgtgattattgactaatgatgcctaggtaaagtggtgcatattttgtgaccagtcattggcactgtacgtgtttatccatgtcaaaaccataacttgagtagtgctgagtttgcataaaaatgtgaaacatgaaggtggtgttgaagtcttgctgttatttcatgctaaattgcgacccagttggtattgtatgacagaaactatgttctttcaaagcttagtgtggttattccaagggtatggaggatatatcgagttgttgacttgtttaaattatgacattattgtatcgtgaaaatctcatggcttgtgatgtcgaggtgttgcttctctgatcccaagatgctgagtttgtttttgttttttgggatttgagaaaatgataatgtgttcttagtctatggtggggtcatttatttgtcacttcgaagacagattttgatgcccgaatagctcttcttgcttctttcttggtcacaaacaaaagacaatttgtcaatttgtgtgttttaggtgtagaaaaaggctagaaagctgtcattgttaagcttgtatagactcttttcttgccaatgaccattcgttttttttccccttacattttgtcctttttgtcgagcgaatcttcaatgttcctaactgaaaacggagtgggctgaagaaaatctcaacaacggctggaggcgatgtaacttgagctatcgaaaaggaatggaactgcgacgaaaccatgtaaataataataatagtgtattgttgttctttggtatattttcacacacactctcttctgtaacttacaaaagaatattcataatcacgtttgaatagctcttagacacaaatgagttgggttataaattagtaattaacaatggcatgttacaaattagactaacaacattgtagcaaatcaagccgattatattttatttaattagtaaaagattaacacaacaaaagaaacctgaaaatagttaagtggagggccccatgaccactaacaaaaacatataagctcttttcgttttgttactctctccattgaattctgtcttgatcactttcgattctctcaaaaaatcccataactttcccaacgaaaa

SEQ ID NO: 2819 - DNA, 3000 bp, Unknown
  misc_feature (1)..( 3000): cDNA_ID_2175004_gDNA_ID_1620604_Annot_ID_161741 3000 nt of promoter + ATG
tcaactctttattcaagcgctcagaactgaaacaaactgaaaatttcgcctcatgatacttaaaaaagaaaaacacaaaagttggaaaggcaatgtgtaccaaggtaactcgtccaagggcacttttggttccttgactgacaccaaccatttcacagtccatagccacttcatctgtcaaactacccacagattggtgagatttgatatacaagattgcacaaagaaagaaacatctattggcaaaatccttttttctttttttgcttagagctatttcaacattcttttactatttaagctacccaagtcaattccacaaccaccaacattcacaaaaatgaaaagcagaggaggatagtagcttataaacaaaagttctatacaagatattataattcatcaacaagaaccctgatttcccagagcaggaagacactaacaatgtaaagctcatgacattgtgtatatctgagctagttattagtcatcatgtagcaattaaaaccatttactaacagaaagtccacaaagccaaatagcaaacatgaccaacctggaatcgtcgttaaccggagctaagggattaatcttaggaacatcaacctccgaatcgggtctctcctttcgcttccctgcaagtttgttgtgtgagttaagacaactgagaaaccaaaccagtctataaaccctaaacccaagcttaaagttcgaatttttaggttgaatgctacctaatatggagctgggattttctgggtttgaagattttcgagtgttgccatgagaatcagatttcagtttctacaaggaaaaataacgggaaccaaatcaatggctgaacaaaagtctggaagaaaaacaggagaaattagctaagagaagaaagaaatagagactaacttgttggaggagtgaccaattagggtttaattgaacaggtttaggagttatcttcttcttcggctttctcttcagatcagaactcatcttttttagttcagcgggcgcttggaaaatttgttgacaagcacgaagctccttgaagcggctcgagaatcacaagagtaaggtttaagaattaagacctcccaaaacgctgccgtttctctagcatccaataataataataatacgattttcaccacgttatgatttttgctttgattatactttggtatatgataaaatatacacatgtattaaatcattgtttcatagcttataaaagctaagataagatatggttgtatttagaagaaaaaaaaaaagacatggttgtatttttataatgttctttcttaacataaacagagagacttggatgattaattgggcacaattagattaggtgagaaggtggtttaaccaaaaagaagcacatgggattgggaatcacctccctataaatattcgcatcatatgttacttgcctcatgggataattcaattctgttccgtcgcattgatctattgttttagttctaagttttgcctaatttttctgtttctcaacattttgcctaactttttttttaatcgtcctatgatagtgaaaattccagaggtctaatttttttaaaaaagattgttagttagagtagaagcataccttcattaatggctgccagtgacatgcttatcttgttgttaaattcaatggcatgctttagtacaagacaaaaacgatcatgctattaaatgtagtaattagatggggaaatcaaaagattttgagttaattattttcgatccttgtacgatgtcgtttggtaaataagggatattcattttttaattagaataaaaaaatatttgctgtccgaaaactcaagaaaccaatgaaaaaagggcaaataaattaataaaaaaaagcaaagataagcataagagaataaatgaattaaataaaactgagaagaagaggaaaataaaaaaccttccgtcaccgtgagaggaaaataaattagaaactagaaaaccgacgtcttaatcttcatctaatctctctctcgtccgtccttggatctctctctccctgaggaaaataatcaggtacttatctcttatgatcctaacgattatcagattctcgagctttttgattatgagtttttatttgtcgtttttggtgaaatatggttttgaaattgtttttaatacgagagctgctgaagaattgcattgttattggttagtcggaatttaggcttaatcttcttttgatcgtctaggttgttaattttctaaactctgtttatgcttcaggggagcttccgattaatacgagttggttggtttttgctgaattttcgaagctttgtttcttcaatctttgatgctagaaaggtcagcaacttaataacaaatcttctctacttcttttctaaaattttctggtttatgtttcgtgaattgggtttgatttgattttcctaaggcatgtctggcaacgtggcttgtgcctcattaaattgtaatttagtgttgttttctgccacaagggtggtgagttttgctaaagccactgcttagtttctgtgaaaattattgggttaggaaaaggttcgaaggatttacttttttgaatgtttggggtttgatctctgcagctaaggtttcatattctacaatgtatccgtggaccttgaatgttctgtgctgtcaggatactgttttttttgtgtgtgtgtctccattacttgcgatgatgacgaaaaaattctgggatgttttgagacttggcttatcccattcacgggacaagttgggatgatatttacttgttgtatgttttgattccattattagatatcagtagtttgtgcactagctagaatcagcgtgcggtgtaactagcatcgagttttagctgtctttgtgggtgaattttaattgttgttttgttgcattgttgctgatctttgtaaattcaactaccaggtgttttctgcaacaagcaatatgcgacaaagaaatatgatgactggttcagacatg

SEQ ID NO: 2820 - DNA, 3000 bp, Unknown
  misc_feature (1)..( 3000): cDNA_ID_2175002_gDNA_ID_1620604_Annot_ID_161740 3000 nt of promoter + ATG
agaagagtcttcacccaccaaaaaagattagatttttaacgacctgaaaattaaagagtagagtttggaattagatcgatccattgttgaaagtttcgattttttttcaattttctgggtaaaaaagaaagtgaagggtcgttttcaatcaaatcttccaagagatttactcaaggaactcaatcataaccgcaataaattgaaaacctttcatgtgaacatgataattaggtcgttctttttttccagaaatctcgaatcaatgaaaattgtagcaaaccaaaggtcggattccaagaagatgaatttaagcaattatctcaaagagagatccagaatcaaaaaaaagattcgagaaattacctgaactctgggaagaaaaagaaataacagcagctaatcaggtgcacgaaccaggtaagcgatctaaatgtttttagcaacagagagagagagaccaaaaacaagaagacctgaatgatattttctagaatttggtatccgtacaatacgatgccgtttttgtaacaataagcccaatagagtaggcccaaatatagtttgtatacaaaaagaaaccaaaccagacaaatttcagttgtaaacataaaccggtttttttgctaatgattgatcaaaattatccggaaccaggctttttcgagttaccaacttcatccggtttagcagaggtttttgtgatcacattattgggtgatgatttctccggtttcttagatggtttgatcggtttaacgacgtagcattgagccctaatctcccaaggtcgagccgcaatccaccgttctttccaactccatccccagctttctttgccaaggttaaacgaagcttgacctagatactgtgtagcattagccctccactacaaaataccaaaaaacagaaagttacttgagccacaagttatctaaaacacaaaccaaccaatgtaagtttaagaggtctcagttttgattgacctgatgagagaaagcataagccattgctctttcacgcttaaccgtagcttcttctttctgttgtatctttgcgagaatctcctccattgtttcagagcctccacaccattcaacttctagctcgtgaagtttgatctccagcttcaaacgattctccaatcttttgtgttggagtctaccttgtgtcaccatatacaaacgtcgtgctctgatctgattctgtatatcgtaccaagaatgaatcacattgagtgcagtcgaggtttggttcatcactgtatggccttggatcagcgagttaaatctcctcgcactcttcaagctgcatagtctttttctcgcctgcagaagattcgcaacaacgttaggtaaaattggagcggtaaataagtggaaaatgacaaaccttgaatgctcgaaaagccttttgaatgcgaataacagcgacttctacggtaagcttagtagaagcagcagagcttgattcaaccggtttgacacggtttgatgtttcagaatgtacctaataataacatatttaaagtcatctacgacaagaaagaaaaagagaatgaaacagagtttttttcactaacgttgcctcgatttgatttgttcttctttgttccgtttagacagatgattgagcggagcagccatccagatcccataacagaagactggctcagtttaaaggtaagagattcagaacagcacaatgttttatcggttatgatcacaaaatctggctcaatatttaactagattatgtgaaagagatatgagattataatgtgttctttgttttaaggcacaagaaggtttaatgttgagtggttttcaagtaaatgagagagagtgttgaagcttcgctctctttgtggtgaataaacccatcttggtgattgacatttcacccaatggggaaggtgttgttttatcttttcttcaaattcaaggtggtgctgtttctgatatttttattagtttaggctaagattgtggagaccgatcaaataaaggatgagattggcaaaagaggatgatgtaaaacaaataaattttcaaccattggtcccggcggggctcgaacccgcgaccttcggctcataagaccaacgctctaaccaactgagctacgggacctgtttgaatattatgttccatacttttatttctccttttttttattaatcctttttagcaattaatgaattaaacattactattcccaaattcttgcatccaaataaatttccaaattcaactttgtattgttaaagctaggttttatgcttttctcaagctcaaaaaatcatgtattatagacacatgttagtgaatagtgagatgcttacataatacgcatgtttttcactcttgatgcgtggtggaatcatcaaagctttgggcagcaaaatcgcaaactgagaaaaaccagggagattcacccgttttactgcacttgtagacttgtagtcctgaagaacaagtcttgttggttcctgtttattaattatcctccatatcctcatcggacattaagctattccataaccactctacagaaacatctctaagaaagcttttccaaaaccagtatggagctggagctcgttgaggatatgctagaagaattctgtatccccaattttttagttcgcacagcgtacgagctaacccttccagttgctcagaaccgattatgagcattatagtagctacgtgtttagtttatatgggccattacgtgtggcccaaataattacttgtgttaggtttaaatcgaagaatatatttgattgggcttataattacttttacaattggcccagtccaagaatcagatggatctgaatccgacccgtaagaagatgtgagtaaaaatttcatccacttgcgtgtctctccctttcaaaggctcaaaatttaaatctctcattcttcttgtgcggcgtttctttttctccttttgtccgtacgcgttttcttaccggtgacctgaaagtctcaaaaa

SEQ ID NO: 2821 - DNA, 3000 bp, Unknown
  misc_feature (1)..( 3000): cDNA_ID_2175013_gDNA_ID_1620604_Annot_ID_161745 3000 nt of promoter + ATG
cttagattcagatcaagaacttgaagtgtctgtatagactttccaaagggttcgtttttatttggattttgtctgtgttgcaaactactaagccaagtaatggaaatggtttagaaagatcatttttgttgtcatctattacttggaatcttaccagtactaacaataaacataacaatcacatttctgatactcttcttgattaaaattgaaactattacttgctatatagttaaaccccagatctaacgtgagaaaactgtaaaggtatgagagaacgtagatgtaacctcaattaattgaagacatgcttatagttgctaaatgtgtgacaccaaactaaagttgatcacatgatcgaacaaatcccacaaaatcaaaatccaacctcatagaaatagcattctctgtttcttacttgattaaattatgtttcaaagatcataacatgtaataattaattaatttttaaaaaggtctggaagtgtcattaaaagcataacatgcagtttaattaagtgattaaatgtatgttttgtctggttctcgtcctttaatggtctctagtcaaactcatctctcctctaccagatcaacaaacaactgaatcctttttacgcgccactctgctgcgcgtgtacttcacagcctgtcatagtaactcctagcgacgtcagtgagaactgagaactttctccttctttcctaaattccaagtcttgaacacttttttctgttaaatgttagtgccgagtctacgaaatcgaaaccttcttaagttctttaatttcttctaaatatctctagcaagatcatactatatctacgtacttattatttttgggggaccaatgagcacatgtttatatatcaatcatattaattgtcagtaaaagcacgtagacaccttccatctttgtaatcaatttggcatttattatggataattgtttgtttttgtatacaacaaatgttcttgctgttgaaaacgggattattacatcttatagtaccattctggtcatagtaacaacagtataatataatttacaaaatctatttattttttctgaaagttgtctttgtaacaaattaaattattaatatagcagaagaaagtatgcatttagtatttactatatatggtttttctagcatttagaaaaaataattagtctagttgaaaaataaaataaaagtagaaaaagagttattaaaagcatgttaatgctaatatgagggtggtcctgttagtcttataatggtctggtcaaactcctccttctcacgactgccacatcacacaacccatcttcttccattttctgtttagtgtgaccgttgcttcgcgccttcgcggttcagtgagaagctcacgcgcgttttcttacccgcgtgatttttcaccccattatctcctttatgtgattcttctgttaaagttccggtttatgtatctgatccgaatatctcctttatgtgagtcaaacatatgtgtatgagtgagtttatgtatctgattatttaattttatggcttccttaattgaatgatttaagattaatagtatgtctctaactatttggccaccatactcacattcggaacaacataaatgataaagaagctagcgaatgggtccgactccttttaagtgctacaaaaagcgacacgacgtccttagtttcatgcatccatccacacgaaaatgtaaagtgagaagaaaactcaaaaactaataagaaatgttaaaattaataagaaaaaacaagggccatgtcgaatcattaccctatctctcggtactccgatcacgtgccaactttgggttctataatgcttttattattcatatttaatgtatttttttctttaatttcttttattatctgtcttcgaccgtatttagtccaaaccatgtgaagatttccggtctactgtttttatcattatgaaaaagaaaaggaaaaaagctatggtcctctctaattagagttgattaaaaatttgaataagaaataattaatttatttcactctctccagcttgttctttgtggtttggcttatactgaaaaattgaattcccaaatgtttggtcctattgagtaaatatcatccatttatctaaaatgataatcatttcaaacctaaacacaacaagaaggattttaaaacaatagacctgaactcaatcttactaattcattggttaagttgtcacgacatgtatatgttgataacaaaaggattggttacaatatgggtgcaaattgtggttgtggcttaatgtttttaaaattcacaaattttcaaatattgtctaaaagtatcccacttgtcataaattaccatccaagatccttccaatctctacatgcatatatgtccaataaaatctagctagagtacgagaaaaatatccaaaacttttgaatttgacaaaaagtcttatctttccaaaggaaaataaaagtttgtattatttatttccaccagaaaaaaatctactaaaaaaaaaagaagagactacgaaaacaatacatgcaaaatacacaagagacatgcgtgtctgagtgtttgtgtttttgggaaagccaataataccttttccctttagtgtgcacatgtgtgtatccacagaagcgtacgaaccctttctttaactcgtttcactctcatgggccacattactttcaccatcccctaaattaccacttcacccttcttccatatcattcacacaactaatcaaattacctcaaaaacgcaacaaaactaaatcgtgatcagtcaaagatgattacatagatttaggaagaaggaatctcttaccctaactagatccaggggtattttagtaaattatcataggtacccctaaaagtctctcgattccgttacactctcaatatctctccaatggctatggttactactacactcttcttcttcttcttcttcttcttctccttcttctcactgtaaaaaagaaaaaaaa

SEQ ID NO: 2822 - DNA, 3000 bp, Unknown
  misc_feature (1)..( 3000): cDNA_ID_1013341_gDNA_ID_1620604_Annot_ID_161742 3000 nt of promoter + ATG
tgaacctgtcccatatgactgtatgaagcaggatgcaaagtctcagcgtatgaggctgaaggcatgtgagggtatacgatgggaggaggaggtacggggtgatggctaatatagtggttcctttggtatacagatggcgtggggtttctgctactagatgtttcatggtatcttgggaagcaaacattaccagattctatagatccagtagcaatgttacctaagagatcattcaagaagaagaataaaattatcaagaacttgccaaaagaccaatcgcaatgctgagaataagttaaggatagtaccatgcatataaggtacggcaggtgcttgagaccaaagcgaagatgatccatcagatctgttgccattacagtgttggtcataccagattgagccaagaggtggaaaaggatgagctgcatagtttccttgactgaagttgttatgaccatgagagagaagtggatccattgtagctgctcctgctctgttcctcacacttctctgatctagtggttgtggataagtaccaaaatgtgggaatgaaaaaggtgctgtctccgatgtattcaattgagggaaagaacaaggagcaactggatactgagaatttccaggtattacttcagaactctttcttttgaatccgtgatccataaaatgggcatttctctcatgttcagtggaagtaactccaacaactgcatcattacttccatgagacaacagaaaactcggtggagcttcataattcacataagggacatagaaatttggtgcggttgacatgccagaaccaagatttgaagcatgttgatgatggtactgtggaggcccgtagaacattgagttgttatcataaggttcttgcagagaatgagcttctaaatgaggaacagtgttcactggtgggatatctggatacagatagttagttccaatgcgaggttcaggatggggaacaaagctttgagaattctgctccatgtctgaaccagtcatcatatttctttgtcgcatattgcttgttgcagaaaacacctggtagttgaatttacaaagatcagcaacaatgcaacaaaacaacaattaaaattcacccacaaagacagctaaaactcgatgctagttacaccgcacgctgattctagctagtgcacaaactactgatatctaataatggaatcaaaacatacaacaagtaaatatcatcccaacttgtcccgtgaatgggataagccaagtctcaaaacatcccagaattttttcgtcatcatcgcaagtaatggagacacacacacaaaaaaaacagtatcctgacagcacagaacattcaaggtccacggatacattgtagaatatgaaaccttagctgcagagatcaaaccccaaacattcaaaaaagtaaatccttcgaaccttttcctaacccaataattttcacagaaactaagcagtggctttagcaaaactcaccacccttgtggcagaaaacaacactaaattacaatttaatgaggcacaagccacgttgccagacatgccttaggaaaatcaaatcaaacccaattcacgaaacataaaccagaaaattttagaaaagaagtagagaagatttgttattaagttgctgacctttctagcatcaaagattgaagaaacaaagcttcgaaaattcagcaaaaaccaaccaactcgtattaatcggaagctcccctgaagcataaacagagtttagaaaattaacaacctagacgatcaaaagaagattaagcctaaattccgactaaccaataacaatgcaattcttcagcagctctcgtattaaaaacaatttcaaaaccatatttcaccaaaaacgacaaataaaaactcataatcaaaaagctcgagaatctgataatcgttaggatcataagagataagtacctgattattttcctcagggagagagagatccaaggacggacgagagagagattagatgaagattaagacgtcggttttctagtttctaatttattttcctctcacggtgacggaaggttttttattttcctcttcttctcagttttatttaattcatttattctcttatgcttatctttgcttttttttattaatttatttgcccttttttcattggtttcttgagttttcggacagcaaatatttttttattctaattaaaaaatgaatatcccttatttaccaaacgacatcgtacaaggatcgaaaataattaactcaaaatcttttgatttccccatctaattactacatttaatagcatgatcgtttttgtcttgtactaaagcatgccattgaatttaacaacaagataagcatgtcactggcagccattaatgaaggtatgcttctactctaactaacaatcttttttaaaaaaattagacctctggaattttcactatcataggacgattaaaaaaaaagttaggcaaaatgttgagaaacagaaaaattaggcaaaacttagaactaaaacaatagatcaatgcgacggaacagaattgaattatcccatgaggcaagtaacatatgatgcgaatatttatagggaggtgattcccaatcccatgtgcttctttttggttaaaccaccttctcacctaatctaattgtgcccaattaatcatccaagtctctctgtttatgttaagaaagaacattataaaaatacaaccatgtctttttttttttcttctaaatacaaccatatcttatcttagcttttataagctatgaaacaatgatttaatacatgtgtatattttatcatataccaaagtataatcaaagcaaaaatcataacgtggtgaaaatcgtattattattattattggatgctagagaaacggcagcgttttgggaggtcttaattcttaaaccttactcttgtgattctcgagccgcttcaaggagcttcgtgcttgtcaacaaattttccaagcgcccgctgaactaaaaaag

SEQ ID NO: 2823 - DNA, 3000 bp, Unknown
  misc_feature (1)..( 3000): cDNA_ID_3435496_gDNA_ID_1620604_Annot_ID_161732 3000 nt of promoter + ATG
ctttatgcttacgtcatcgcacacgtctatcttcttttggttaaagtgataaaaaggaaagtcgtaaatggcttcgtcactgagtctttcctactattttaaccccattagtgacactcctttcttctccactacactccatttctctttcttcttgactcgaccatcgtttctctaatctccgcaactatggcttcatttacgaaaacggtgtgtggggtttcacgatcccgagatcatacttttttccctcctcgtacgtaacgatttttttttgtgattattaatccaaggttttttggcgtctcttttaggttttgatccctattgcgcacggtacggagcctctagaagcggtggcgatgattaccgtgttgcgtcgaggtggtgctgacgtgacggtggcgtctgttgagactcaggttggcgttgatgcttgtcatggcatcaagatggtcgctgatactcttctctctgatattaccgactctgttttcgaccttattgtgctccccgtaagtctctctgctgatttaacattgtccatttgttttgtttctttgtgtgtaatctaagaactaaggacagccaataagtggatcgatcaattatcaattagctcacttaactaaagtttcgaaagtgatgtttatagttcctactaagaacgatggtttttagatgtatctgttgcaacttttgttctctgaaacaacttcatagattcttgttttctgaaagatttcataattgtgttgctgatatactttttgatatgattgggaaaagggagggcttcccggtggcgagactcttaaaaactgtaaatctttagagaacatggtcaagaaacaagactctgatggccgacttaacgcagctatatgttgtgctcctgccttggctcttggtacttggggtctactagaaggcaagaaagtaagtcagaagtgatcagtatatttccaagggcgtttatttatctttttttcaggccttgtaatgtcttgttattacatggggtttcttgcaggcaacgggttaccctgtttttatggagaaacttgcggctacttgtgcaactgctgttgagtcaagagtgcaaattgatggaagaatagtgaccagtcgtggaccaggaaccaccattgaattctccatcacgcttatagagcagttgtttgggaaagaaaaagctgatgaagtctccagtatcttggtatgttttgtctctgcctcttttatcaaccgctgtggtacgtgttcatgtcacctcctcgtagacttacttgttatccttttgaaatcagctgcttcgtcctaaccctggtgaggagtttacttttactgagcttaaccaaacaaactggtcatttgaagatacaccacaggtaaatgttcagttgcctctccacttggcccttttaacatttttccaagacaggctttgtttgatccgttatacagattcctaggaacatgctgtgttgtaaagcttttgtctttcttgatcaatagtcttttatgagtcagagagataatgttttcccttttcagattctcgtacccattgcagaggagtcagaggaaattgaagctatagcgcttgtagatatcctgaggcgggcaaaagcaaatgtagtgattgctgcagttggtaacagtttggaagttgaaggatctcgcaaagctaagctagtagcagaagttcttcttgatgaggttgcagagaagtcgtttgatctgattgtgttacctgtgagtattgctaacttccaaaatgtgaatatactatttagtcttaaattaaattttaatattctatgatgacaaataaccaaaaacataatccaacttctttgatgaactacagggcggtcttaacggtgctcaaagattcgcaagctgcgagaagctagttaatatgttaaggaaacaggcagaagcaaacaaaccatatggaggaatctgcgcatcgcctgcttacgtcttcgagcctaatggtttactcaaggtgcataaatcaaacagtactagaattgtagtttcttgttctatcttttaagtcattaaactgagatataagagacatgttttgtatagggtaagaaggctactactcacccagtggtgagcgacaaactttcggacaagagtcacattgagcacagagtcgtggtagatggaaatgtcataacaagcagagctccagggactgcaatggagttttcacttgccattgtcgaaaagttttacgggcgagagaaagctcttcagctcggaaaggcaacacttgtgtgatttcaaacaatgaaagtatgagagtggcttgaataaaaagaaggctttgccttttagttatctctctccattagtaattacttactttatgatatatgacatatgagcttggcttagtgattggtgtgtaactttatgcctttataaatgaataaacgagatttttctatgtatgttgccgatattttctttaaacctctgcaagagctagagggtgtgctggagaaaaaaattattttatggagaaagatattttagtcacacattttcaccaaattgaccttacaataactctaaaatacgaatttgcccctatgtttagctttggaatatttcatatttgtaaaccatttaataatatgattattaccaatttagtgaaaataaaatcttcagtcttctcttcttgtataaaaatagcttttttatcatttgaaaacagagtaatgtcactaatttcttggcgaaaatgtgtttatttgtaacttaaggtaaaataggggcaattttgttgaatctgataagatcagggggtagtaccgtagatttcgctgtccagttcagttatgaaatacctaaaatgccctcgactcataatctactattaaaccctcataaaacccttgatttcatttctagctcatctgttttcacactctctcctagggttttatctgcgaagcccaatctagagcttcc

SEQ ID NO: 2824 - DNA, 3000 bp, Unknown
  misc_feature (1)..( 3000): cDNA_ID_2174959_gDNA_ID_1620604_Annot_ID_161726 3000 nt of promoter + ATG
gtgactagacaagtgcctacgccgaagaatttgctgtttaagttttgtgaacatatgtctgaatctcttaaacttggtgcaggaatgagagaaaaagttccatgtctgacccttaatcgatgctagagttggtaacttgctatgagatatatgcgaagctgtccagtttttgtttggcttgcttgaggatttccaatcttctggaccaagctctgcttaacgtttaacaatgtattgagttgctcctaggcttcaaatgttgctgcttcttttggagatatgactctggttaaagtttaaccaaacattcatttatctggttaatctcaaacctttgctatgtttgttatcccacttttttcatatggttctttctagatctctgtatctggtgtgtcttctctcgtgatctcaacattcgatgtgaaaccaggtagattgtaatattgtatcatagactgcaaaagataacgcaaaagagaagtctctgatctcaacctgaatcagacttgttaggagtccctcttgtttggtttaattcaattttccggttcggatttctggattataaaccgaattaactacaaacggaaaaacgtaccgcgttattgcggtaaccagcaactttaattggcctatagtagaatcaaatgaaaagaaaagagcaattttttttttttttttttggttttttggttaaagaagaaaagagcaaattggaaaaacaaatagataagataatttatatgatttaaaagtcaaatgtaatcacaacatataaattttaacttataaaatatagtcacaccattgcctcatcgtatttgctttcatgaatcatcccaccacttgtaagctttattttattaagaatgaaaacggagaaatataaattgaacactatatactattgtcgtcaccctccccgaatgtttctgataaataatgttaactatcatctaatacgtcaaccggattatcaccgacactgaccccacacctaaccactgatgcacaagtttatattagtgtaggtatcatccacaatatattatccaataattgaaccttgttaatgtctttggttcataaagcgatctataatcaattcagcattattgctaaaattcaaattaagaagacggcatgatttgttaaaaccataaagaaatacaaaagggtcaatgataaaactgtttaaacgaatcagtctacccaagagccgtctctcgaatactagttttaaattcataagcgtatagagtttagtgattccagaacactttacaggccaaaatctaatatttcgatattttgaaacgacatttttagtcctataattaaatttgcaacgtattagattacttttaaaatgtgatactgcgaagaaaatgaatcaaaagattgaatcgaatattcgaacagacggacaagaacccacgaagcgatacagatcagaaactctgcttctttttttaacaagagatcacaaacttggttgacttgagttcatattataatgacgtactcagtgattcgaatattccataaatagtcgtaagaataaagaccttaatgtatacattgttcatttcgtatgccacattgacgaagatcactgatataaatttcaattatataaatgtaaaataacaaaacaaaaagttacatgttatcaaatagtgtcattagctaaataacatgttacttggccaccacatcacttttgttgagaaatttctaaaatttggctatttagtgcatataccctttaaaacttgttgtaaaagcaaggaagaggaaaaaagattgaacctatagcaaaggaaaaagaaaagagagtacatattcttaagtcttgattacaatattttgttcttcaacatattctcttagagttgagataacataaattataatatagatgctctattgggtagcagtagatagaagaacatatgctgaaaatcatttttatagatctagcaaatcacctttataaaggatccagatttttttttttttaactttttgaaagtcaacttgatcatatgtgaaagttagagtcagagatttatgcatcttcgtgcatagacaaaatgcatgcacgagctcacacgatcctgtttttttttcttaatgaggtaattttcttgctgtcatttttttttctaaagttaagattcatataaaaaccatatcaggtaattccttaattttgtgtaataattaagaaatcaggatcattagatctttgaccaccaaaactcaaatttgttcccaaatacactcagttaaagtactatctttaatcatttcatattcgttactttgtaaattagtacaaagtaagtaacaaattttagtttacccaatgaaatggaatgaagttaatgaaaatattcgttcttttagaatattcttctgctcttgacagtgtttaattatttaattttcttacttgaaaaaataaaattgaccaacaattatttttcttacctcatgtagataacttacaaaataaaacatatatatatgtatatatatatttattttcaactcagaaataaataattctaacgaaaaaatatgaaataataaaaaaatctgacttaaaaagcgcgcatcgctcatgccaacacactccctcgtctataaatacttcactctgctttcctcaatcacatccatctctgaatctgattccacatcttaaacccttattccctaaacatcgaatttggttccttctcccacaatccgcagagatttcttcttttcaggtttgtcaattcattttttttttcagtttgagttttgttttgttttttcgtgattttcggtcagtctaccaaatcccctgtttttccggcgattcagttgtcaacagattttgcttttctttttccctttttgtgtaaaaaaactcatttcctttttgatctgatgattacagaagaagtaagagggtggcgaagaagatttgattgatcggcgata

SEQ ID NO: 2825 - DNA, 3000 bp, Unknown
  misc_feature (1)..( 3000): cDNA_ID_2174967_gDNA_ID_1620604_Annot_ID_161728 3000 nt of promoter + ATG
agagatgcctcttgtagctacgtgcagcaaatatcgccgacagggcatgtgtagaatcctcgtggctgccattgaagaggtacgatatttagaatgtaaccatgtggttgttcttgaagctacatccacattaataatgtctaaacttagtacaatgatagacatacagcaccgctcatatgctgaccttgataatcccttagctcatatgatctctcttccagtcttgtcttgatccctgggctatcaatagataaaactattcattggttttggctgcagatgcttatgtctctcaaagtggagaagcttgtggtagctgcattgccgagtttagtggaaacttggactgaaggttttggcttcaaacccatggatgatgaagagcgtgatgctctcaaaagaataaacttgatggtattccctgggacaactctgctcaagaaaacactatacgagagcacaaaacccagcactatgaaaggtaaagccaactcctctctccctctctctcgaacgaacttcatttgatttttgctcctgtacaggtgtatgtctttctaaagaacgcaataacccatcaaacaaagaagcagatctagagccaggtctagacaaagccgggtctcccatgagtacccaagttgagagctgtgatcagatggttccagcaggttcagatgatgagccatccccaggcttccccgtaccactcggagccgatcaaacagaaccaacttcagaaacagagaacccaagccgagacagcaatgccaatgataggccaaataaaacaacagtagtctctataggagaagaagaagaagaagaatgtttgcagaaagatgtatcaaagttatcagaagaaggaaaagaaacgacaagggcttcttcttcctctgcagctttagaagaagttagtggtctaggactaggagtagtaaataatgttagcgatgagatgttgctttgtgttgatgaacagcttgactctgatagctctcaggattcggaataatattattagactaaaaaactatgatcgtttctttctctatatcctctcgtcacttttttttttttgaaagaaaaccctactaagataaggaaaccgcataaaagaggattctatattttcattttcattttcaagtcttatcaagcctcaaaaccctaaataccaaatatcaaaacgcccatttttccgaacaaatcatggtttttgatgctgtcaatccagaccccgacagcttcgtttactattatccgatctataacgatgaaggcgattttggcagaacccaaaacttgatgttcaagtttcatttatgttacaatcttgcccctgaagtaaattcagatggagaagatgaaaatcctctcgatcttgaaactctactcgttgatcgaactcacgagtttgataaaggattgcttttcagtggagatagggagcaaatacaagtcattgtctgtcacattcttgatttgattaaagcccctcgttatattgatgttgttacagaactcattgatgcgatccttgatttaaagaagtgtgataagatctctaacgtgaaagaggtagatgtagtcatcaatgttattgtgtggaggtttcctgatgatgatgatgatgatgtagatgtgagacttgcggtggccccggcgagcaatgaagcggtggagcaacacttggagacggttgttgttgagaatgaaagttggtgtgtgatatgcatggataagatccggattggattggatgtggctgcgggtcgaatgccgtgttctcacgtgtttcatcgcacgtgtggtgaagattggcttaggtgtagtgggatttgtccggtgtgtcgtgccatgtttccgacctaaaccctaaaatccatctctcaaccatttgtgttagtttcgtttaccgtttacgtaatcctttcattttttctttcctttatgcatttgaatgttctgtacaatatgattcatcaagctatttcattgctgttttattgatttgtggatctaataaatttggtgggggtcaaggatattctgatgatttaaaaaagattgttagagattttatagaaactaaaacaattgttaacgatttggtaagatttagtaattagttggtagggttttgagtgatatcgaaagtgtattcatttccaaatatcttgatagagggtataagaacattttctatgtaatttttgttaagtttctagtttaagatattgcatttgccgtttcttgtaactcttaattatgtgtaaacaactccgatatgtaatgtcttagtaatgaaaacgatttcaacatctttcatcattgagttaaatactgtaatttgtcttcatttgttttgagcctttgactagtggaaccgtcttaaaaaacaagattctattgtgatggtttcccaaaatagagaaaaatggtctcttaaattcggtacagtactctctatatatagtcctttgaattcaatatattcatccaagtgaatgtaacctaatgatggccaatggtgagagttttcaaccctcatcccctagtaaacaaaataagtattgcctactaacaacttttagcaagtaaaacacaatcaacttttttattatcaaagaatgctgttcttatctattttgtttttatttttattatttattcttatctacttaatttgtgtatttattcacataaaagagtcttcatttgtgggtcaaattaattaattacctgcctaacttttgttatcattaatgttctaaaattgtatttagtcatacccctagttctcaaattgtatttattcacaatttccatacaaaacatacacataaatccgtgtaccttcaaaaggatccgacccgaatccgataatcggatccacctgatctgaataaacaaaacaaaacaaaaaaaccgttacaaacgcttccgagaaagtggatccgccgtagctggaggatccgtcgttacaaaatcatg

SEQ ID NO: 2826 - DNA, 3000 bp, Unknown
  misc_feature (1)..( 3000): cDNA_ID_2174980_gDNA_ID_1620604_Annot_ID_161731 3000 nt of promoter + ATG
ttattacctgaaagcttcactctcttagctttagtgttaaaatctgaaccatctcttgaagcagatgcctcaaaaccttgtggacatgcatatccactagttaccacagagttggaactcagagaggaattgacattcttactggaatcacattcgaagttaatggctccagtaacgagacatcttttagtagtatttccaggatcacttccaaagaaaacttctctgaatatctgatgatcctcatatgacccttcaaagcagtcacctcctaacatctcaatctcagctccgggaagcatctccacaaactaactgcatattccacttcaccttaacttaaaaggaaggttgtagatagatacctgcaattatataaagtaatgaataaactcacagaacccaaaagtttggaactcgacatcctaatccaaaacacatacccataagcggaagcggattcaaaacaagataaaatcagagatccttctagaaaggccaaaactttgaagcctagagcaaaacgatagaccagatttcatgaaattgagatgttataatgactaattacatccaaaaagaaagctcaaaaattgggaaatgcaggacattaccagcatgcagaatgaaatcagagctgtgaaatcggagaaatggcttcttctcactgaaatagactcatttcgtcgcccttatcctctccaaccgcaagtgggaaacgcattttcattccatttcacgttctctgcactcacacactctctctccttgatctctatctcacacacagaaagaacaacaatttgtctatctttttagctttttctataattgtggaagaaacccacctctgattcggtgttaaatctctcaaccaaaattcatcagatagataaattctgacgaactttttttcacctctctgaatctgcctctatcactttgttgtgcacagtgtgtgtatacttattattggctatttctttctcttctcgttttttttctttttttcttttctataaattgtgtgctgtcaccaaaaaggcatcttcgtgtttttattttatttttccttcgttatactgaaaaagtcattcttcatttttcaccttaagattctgtctcctctctgataacaacggaccagcagttatagtatatggagtacttaaattcgtttaattacacaaattaaaacccaaatattcgtcgtttttttcttctgttatcaaattcttaatcctgttaatgacgatcgtatcactataagccaatattaatgactatggttttaagttcttgacaaagtttttttttactaaattcgccacagacaaaaactgttctgacaaaaataacagacaaactaaaatgaaaaaaaaggttagcatatttaattgccaggtttctaactgttcttctgttgtcgttttaaatcatttcagcttatgtttttgtcctttaaaattcagtcatcaccgattgtaacaggttttgtcttaatatgtataatcaatatctgttaagtggattggatgctttgtaatttgcgcggggaatctttacgtgtcttaacgataacaaatactgtactatcaaataggtgcatgcgatgatggacataagtcgtattttaacctattttgttgtgtgaacagattagttattgcatgttttgtattaactatatataggaatacggctctgaatctttgtttcttcttattcgattttgatatatgaaaattccaaaaagtacatgtaccagtacgatgaaaacgactgtgttatgtgaaagtatttgtttttaaaaaaaaaaatatttagaggggatcaattctagatacttttttcatttttaaggtttaactatggttaaaaagaaacgattcttttttaaaagggtagatggtagacctcatttgctaattttgatccacataagtcaataacaaataattcggctcgcttgcgaagctaatgcatgagccacgtgttttgctttatatttggctttctgtattgagacattcttcttcatcctaattgtgaatggaatatgttggacccaacgaagccatcaaacatggttaaaacacacaaacatgtgatttaatctagtttaatttcgtctattacaatataagtgaattttgacacacatccttggattatatctaaaacgttaagtttgttaaaaacactttggaccggataatgggtattgatcatttattgtttgttgcatgttgggttagaaattagagatcataacaaaaatcatgatttcaggctgtccattttgaaaaatgtgtgtgtttgtgttaatttgaatacaccgattcatccaaaaaccatctgaacagtctcttaattagtttaccgtgtatatatatcatatttatgggatcatatttggttaagtttaactagtagtttcaaatttcgcgttaatagctatttgaaagggtaggagtactttttcgaccggttaacactcccatataaagcccataaattattggaacgctacaaaattaacaaaacatctcttcagaagttcgtccggtttactctactacaaagtacatgtatcaaaaacgacaacacgtgcttccacaaaattaagaaccaggacgtgatgtcgttgttgtaatacttttttctcgccaacttcacgccgtcttagtttaccgaaaccaaagtggctttttctgattttatccaatacaatgacgtggaaagactcaaaagaagctttcgccacgttccaccaatgaatgttcgacacgtatcgtcgagtttctttttctttatgcttacgtcatcgcacacgtctatcttcttttggttaaagtgataaaaaggaaagtcgtaaatggcttcgtcactgagtctttcctactattttaaccccattagtgacactcctttcttctccactacactccatttctctttcttcttgactcgaccatcgtttctctaatctccgcaact

SEQ ID NO: 2827 - DNA, 3000 bp, Unknown
  misc_feature (1)..( 3000): cDNA_ID_3070106_gDNA_ID_1620604_Annot_ID_161730 3000 nt of promoter + ATG
gtcggtaatatcagagagaagagtatcagcgaccatcttgatgccatgacaagcatcaacgccaacctgagtctcaacagacgccaccgtcacgtcagcaccacctcgacgcaacacggtaatcatcgccaccgcttctagaggctccgtaccgtgcgcaatagggatcaaaacctaaaagagacgccaaaaaaccttggattaataatcacaaaaaaaaatcgttacgtacgaggagggaaaaaagtatgatctcgggatcgtgaaaccccacacaccgttttcgtaaatgaagccatagttgcggagattagagaaacgatggtcgagtcaagaagaaagagaaatggagtgtagtggagaagaaaggagtgtcactaatggggttaaaatagtaggaaagactcagtgacgaagccatttacgactttcctttttatcactttaaccaaaagaagatagacgtgtgcgatgacgtaagcataaagaaaaagaaactcgacgatacgtgtcgaacattcattggtggaacgtggcgaaagcttcttttgagtctttccacgtcattgtattggataaaatcagaaaaagccactttggtttcggtaaactaagacggcgtgaagttggcgagaaaaaagtattacaacaacgacatcacgtcctggttcttaattttgtggaagcacgtgttgtcgtttttgatacatgtactttgtagtagagtaaaccggacgaacttctgaagagatgttttgttaattttgtagcgttccaataatttatgggctttatatgggagtgttaaccggtcgaaaaagtactcctaccctttcaaatagctattaacgcgaaatttgaaactactagttaaacttaaccaaatatgatcccataaatatgatatatatacacggtaaactaattaagagactgttcagatggtttttggatgaatcggtgtattcaaattaacacaaacacacacatttttcaaaatggacagcctgaaatcatgatttttgttatgatctctaatttctaacccaacatgcaacaaacaataaatgatcaatacccattatccggtccaaagtgtttttaacaaacttaacgttttagatataatccaaggatgtgtgtcaaaattcacttatattgtaatagacgaaattaaactagattaaatcacatgtttgtgtgttttaaccatgtttgatggcttcgttgggtccaacatattccattcacaattaggatgaagaagaatgtctcaatacagaaagccaaatataaagcaaaacacgtggctcatgcattagcttcgcaagcgagccgaattatttgttattgacttatgtggatcaaaattagcaaatgaggtctaccatctacccttttaaaaaagaatcgtttctttttaaccatagttaaaccttaaaaatgaaaaaagtatctagaattgatcccctctaaatatttttttttttaaaaacaaatactttcacataacacagtcgttttcatcgtactggtacatgtactttttggaattttcatatatcaaaatcgaataagaagaaacaaagattcagagccgtattcctatatatagttaatacaaaacatgcaataactaatctgttcacacaacaaaataggttaaaatacgacttatgtccatcatcgcatgcacctatttgatagtacagtatttgttatcgttaagacacgtaaagattccccgcgcaaattacaaagcatccaatccacttaacagatattgattatacatattaagacaaaacctgttacaatcggtgatgactgaattttaaaggacaaaaacataagctgaaatgatttaaaacgacaacagaagaacagttagaaacctggcaattaaatatgctaaccttttttttcattttagtttgtctgttatttttgtcagaacagtttttgtctgtggcgaatttagtaaaaaaaaactttgtcaagaacttaaaaccatagtcattaatattggcttatagtgatacgatcgtcattaacaggattaagaatttgataacagaagaaaaaaacgacgaatatttgggttttaatttgtgtaattaaacgaatttaagtactccatatactataactgctggtccgttgttatcagagaggagacagaatcttaaggtgaaaaatgaagaatgactttttcagtataacgaaggaaaaataaaataaaaacacgaagatgcctttttggtgacagcacacaatttatagaaaagaaaaaaagaaaaaaaacgagaagagaaagaaatagccaataataagtatacacacactgtgcacaacaaagtgatagaggcagattcagagaggtgaaaaaaagttcgtcagaatttatctatctgatgaattttggttgagagatttaacaccgaatcagaggtgggtttcttccacaattatagaaaaagctaaaaagatagacaaattgttgttctttctgtgtgtgagatagagatcaaggagagagagtgtgtgagtgcagagaacgtgaaatggaatgaaaatgcgtttcccacttgcggttggagaggataagggcgacgaaatgagtctatttcagtgagaagaagccatttctccgatttcacagctctgatttcattctgcatgctggtaatgtcctgcatttcccaatttttgagctttctttttggatgtaattagtcattataacatctcaatttcatgaaatctggtctatcgttttgctctaggcttcaaagttttggcctttctagaaggatctctgattttatcttgttttgaatccgcttccgcttatgggtatgtgttttggattaggatgtcgagttccaaacttttgggttctgtgagtttattcattactttatataattgcaggtatctatctacaaccttccttttaagttaaggtgaagtggaatatgcagttagtttgtggagatg

SEQ ID NO: 2828 - DNA, 3000 bp, Unknown
  misc_feature (1)..( 3000): cDNA_ID_3070110_gDNA_ID_1620604_Annot_ID_161725 3000 nt of promoter + ATG
ccaaattttcaaagtcttaaaagtgccaattccctacattgttgctgatactgtgaagattataaatggttttgttctgcaaacaggtgtttatagcctgtggagtctcaagttctggtggtaaaggtggtaaagatgacctttaccgcaaacccaaggctggaatgtggcaactcatgaagaagcattttaactctggaattgcaattgatatggataagttagttttctccccacctgctcctaaaaacttgaatttacctgaaacttctagcaatgctggaagattacactcatttgtccaccagccttactgattaaacactccgtttaagtccactagcacattttttgttgttgatactgacatctgtgctatgctcatcagatccttctacgttggggatgcagctggaagaaaaatggatcacagcgacgctgacatcaaatttgcacaggtatttattgcaaacgtcagacaatacccatcctttattttataagtcaccctatttacttttctgactttcctcatagacaactactttctttggttgcaggcgagtgggctaaagttttttaccccggaggaatactttatcccctcaagtacatcgccagggacttagctgtatcagtcttgtgcttgtgtttgcagtttgcaacttcttttgcttttttttttgtgatgaaactagtagctagcttttgtgataaaactagtagtgtgcttttgtgatcaaagtattagtatgtgttttaactctttttgtatattactgatatttaagcgtcaactagagcttattgaaccaggaaaaagaaactcctttgaacaggcaggattgcaaagtcaacataacaaaccactgataacaaaaaaagttcaaatttccgactcatttacatacatgggattgggaaagtttaaaatctcttatgatgctaataacatacatcaaaaattcactctccttttcactctttaatcagaagactcagacatgaaatcactccttctgaccaatctcgccttccaaaatggcgtgtcttgtcagaacaatctctttgacaaggtttctgtaaacaaagggcctaacagcagcacggagaaagagctcaggtggaatcctactcttctttatcttcttcatccaccttccatatcctactgtcttccattcttctggcttcacttttgccttcttacctctcatttccaactcatctccttcaatctctcccttttctcgttcctccaatgcctttaactgcttctcataaaacttatctgacaccaccatactcatctccgcaagcttctccatccgctccgcattgtttgtcgctttgttgaattgctcttcccagtacctctcatcctcttccggatccgactcctctatttcatcttccaaactgtcttcttcaacgtttccctccacatcgacaaccatgttatcatcatcatctacttcttccacctcaccatcatcatcatcatcatcatcatcatcatcgtcattgtcagcttcatcttcaatccattctgagaactcagccttctctgagcttccactaatgctaatctcatcctcatcttcatctggagcatcacaccctaactccatctcctccaactttgctttccattcttttgtatacggatgcaacagctcgttcgggtggtttccaagcaagaacttcaacactctggacttcttttcatcactcaacttctcataagcattcaccacatcatccacgaaagctgtctgtctcaccttcaacatcttacacaatcctccgtaataagtactcaactccactctaccttcatcatcctccacttcacacacaaatccagattccgtcaccgggtttaaataagggataagcgagttaaagaaatcttcttgaggctcaaacctacactgaaacacaggcttcttcacatacacaatatcaggtctaaaccaagccgcacattgacatatcaaagaccgagacttgttccctaatctccccatcaaattccacttatccaacctctgcttcttatccgcttccacaaccacttcactaaccaacgtccattgctcccacggtaactcactgagtctccatttcggatgcctgacaaacacccaaaaatacctcaaaccaacattcgaatccaactccttaaccctcttctgaaaagctatattcatctcatgctgctcaatcttctcaaactcttcatgattctccacttcaccaatcatagtaacacactcatcagagatagtaccacgaaccggatcaccaaccacaacaccacgccacgagtaaggtccaaactctccatacttgaaccaatcataaggatgacgcaatctcgggtcatccttatccataaaccgaaccatcctatcgtaaccaagcccaatcatctcaagctcctcctcagtaaacttatccggatgactactgagaatctgactccgactcttgtcagggttattatacaatctataaaacaaagattccgctagcttcttcgacttttcacgagcattcctcttcacctgcttcctcatatccgaatctccttctatccttccaccagatgaacctcctccaagctttttcttgctcctcccggccaatgcccgcacgtctcgccggaatccaccatcttctctgagcaaaagctccgaccttttgacactaaacgcataattcctctcggtaattgccggtaaaaccgaaacgatccttcgtaccccggaattgagtggagatttacggaaggaaaagctagggttcagggttttagaaaaggataaatcttgactcagcatttcttctcccgacacagcttagagatgacgtagcaactgtaataatataagccaaacgatacgacggcgttttgctactgcgccattagtaatcagaaaaagttaaaaaccttgtctttttttttttttttttggttcaatagattgattagcg

SEQ ID NO: 2829 - DNA, 60 bp, Unknown
  misc_feature (1)..( 60): cDNA_ID_2049270_gDNA_ID_1620605_Annot_ID_161752 3000 nt of
aacgatcaagctgcaagcacgtcgagccataatgtcttttgtacacaagatcaagcgatg

SEQ ID NO: 2830 - DNA, 3000 bp, Unknown
  misc_feature (1)..( 3000): cDNA_ID_3070129_gDNA_ID_1620605_Annot_ID_161766 3000 nt of promoter + ATG
gcttaatgttggaaaacaagaatgtgttgttggttgaccttacatgttattgtaccagctccacttaagaatgctcttgactgggcttcaagaccacctaatgtttgggcggacaaaccagctgctattataagcaccggtggaggttttggtggaggaagatcgcagtaccatcttcgacaaatcggagtcttccttgatcttcatttcatcaacaaacccgagtttactctcaatgcatttcagccacctcagaaatttgatgcagaaggaaaccttgtcgatgaagtgactaaggagaggttgaaacaagtccttctctcgttacaagcattcacacttcgacttcaaggtaagtaaatgaagtggattaattcttgatcatttgagattggtcgtgtgataaaaataatgccaattgttgtgataataaacagtgtataacactctatttctcattcatttatgttttattaaacgattggtgaactggtgattttgttttgtccaagcaacgagattctgaacccaaaactcacaagtgttttacgaaacttaaaaaatggttaggatttcttattttaaatctaaataaacaatttgtcgtttgcaataatagaatattttttggtgaattttccacctaatttttccatcaataagatgatgttatataagtagacaaagaaattgacttttgagttgcaaagtggattcaatcgacaaaaggcatatccaacgaaatcaacaacaattatgagtgttgtaaacatttcgattccatatgattagtttaattattttttttcaaaataataatttattttagactccaatctattaaccatctttaaatgtttgcgtcgctatttttttgttaaacaaaaatttataaatttataaaggtattaattttgggatctctataaattaataatgttgagaccgtaaaattattaatttatcgataaattattatttataaatttatagagagatttctctaatttcttaacctttttaatttatatgaaagtataagatttttttcattatataaaatatttttctagaaacaaattccaagtaaaaatcaattatcatgtaaagaaaacaacacaaacttttttgatacagtaaaaatattgaattaatttcaaacaagaactaatacgaatttaagaagaagaaaaaaatattagaattatttttcattgaagtttcttacatataacatagttgatatatatattattattaatttatgttgattttcttgaaaaatatagttttcatctctttatgatcacttttgtaacattactttttggaaaattacctctaatcacaactcttcatttaatatattttgctctagattagggtatctttatcattttattttgtacttacatttattttaaataatcctagaaaatattttggaaggtcggttattatcatctatgtacctttttcaaaatatgaataagatgtaaaatttattcgaaaaaacgtttttatatcaagtgcaacatatggttaaaataattgtatacaattttttgaaaatcctactccctcttaatgtttatcttgatgcaaaccaagcttccatgcatccatcataccttcagcctccttgttcacgaatggcggatatcctgttctggatttgtttgtccacaattcgaagtagctgtgatggtggtagaggtggttctccatgcctcctaccatttcgctctctccatatggaatagaccgcaaattgaaagacatatttggttaggaatatcaagtctccccgatgacttatccgtgaggattgtttgaacgctactccatgtagtagtaaatttctgtcctagaatttttcggcttagtccagacaatatctcttcagcataactacacttgaaaaacagatggtctctgactctctgtcctctagtaagttgtcgcatagaacacaagccggctttgctcccattgccaattcaacattctgtcgctggttgctaggcggttctttaatgcaagccatgctatgaaagagtgtttaggtgtggcatgaagaaaccaaatacctttacaccaatccactagtgacgtatgccttctcgaattgcttcccacgtctcatttgtgctgaaactgtttttgtaaagatcaccttttcctttccataacaccacatctttctcttgtatgagacctttttatcgaatctcggcaatcaacgcctctatattgttgagactatcgagtctgtgccttctctgcctatgacttgctatcacatcttccagtgtggaataaatcgttattctcatatcaatgcaacctctttgacatgtgatgtcaattagcttcctcatgtgtgaccaattgtcgtaccagaaagacgtgtcttttccattcttcacctctgtgcctttttcacttaactgtaacaattgtaaaatgttttggagtggcatctatttatcgacaatttttataattaatttaatttcatcgaaaaataatctacagtttactaatcaatttaaagaagtttcaaaatttaatataagactaatctaatcgactaatcacacagaatatgtaactatctaagccacctacccaaacttctattttctcgattagccaatgaaccaacgacacttgaggcaaattatacaaaaaaatatttcccttattttgtccgttagtcgatgataatttaaaatttaggcattttttaaggtttaggcatattttaaagttttcacaataacgtgggaataaaaataattaaggacagtagtttcaagtttgaaccaatccactaatgtagtagatatataatatcaggaagaacatttgggtagagagacagagaagtttgagaaccttaagtattaatctatgatttgaacacgaaaagacttgtctctcaaacaaaacaagaaaatattttcctattttgaaaatttttgagtgctaatcatg

SEQ ID NO: 2831 - DNA, 3000 bp, Unknown
  misc_feature (1)..( 3000): cDNA_ID_2049205_gDNA_ID_1620605_Annot_ID_161773 3000 nt of promoter + ATG
ttataactcttatccagaagaatacttaatcatcaaaaagacaacgaaaatattttattttttttgctatatattgtcacgaagagcctcatgcatgtggtgttaagctgttaaaaacttcaaattaaaaacaagagagttagttgagacgccaaaagaaatgttgaatgttccaaaaataaaataaaatagatactattatgggatctattattattattcctatttgtaataaatttgtactctcacatttcagctaacaataaagttgtgtgatctctgaccacgttgtgttgatatcttccgcgtaggttttcatttaatttacactataaattggtcattaattactcaaacatgtatataagattcgtgtatttttttgggatttatttttatttctttcacatattgttgcgtcgtagttaatttacacatagggacatacatatgcgtacgggtcgttgacacgtctatttattattaaccacactgggtacgtagtaaatttcatcagaagggacacgcaaagtaagatagcagcaataattgagttgaaattaaaccacatgttttctcttttaaaaatctggttttcaaaacagtagtaatctttgccgggaatttcgacaccaaaactatgagtttaacaaaaagaaacactaattagaacatcaaattgaaaatgacatatagaactaaatttctttgcaaaacttttgcactcaaaatgtaaacatacattatttttggaaaaaagaaacgtaaaatatttaagatgaaagtggtatacaacataatatgtcatctattgcatgaatatgttttacatttttcacaaatttttgttggtaactaacacatcatatacattatatatttttggaagtacatcatatacatttatcctttcaatatttctttctaaatgatttcttttaaatttagttgtatattacacaaatttgaaataaaaccgaaatccgtgtatcaatttgttgatatacatgttggaaatgactttgaccttttagaagaaatattgttgcgaattttttagaaaacatgaatgtgttgtaacttaaaaacgcgactagtagttggataaacaaaaattcaattgatttaactgcattgaaaatttcaaataagtttgatttaaaaacatttacgaacatcttttagacgtgataagtctaagatctggatattgaatgactcatatatgaccataaactcatcatttcaatcaattcaatataatctaccctaaccgaattaatgtccaactaagaaaaagaatttcatttatgtttataaacaaagcgataaacagagatgagatgaaagattttgttaagaaaaagaaaataagtttgtttttaatagacgagaacaaatgtttgatcacaaagattaaatttttaaaaattgcttaaatagcttaatagtatggactaaatgttacttgaaaatagtcgtctttagggctttggtgattggtttacactaagtagaggagtgacttatcacctaagatagaattgaactcgtgtgccttgtctcaatagttgtatgagctttgaacaatttgttagaaacaaagatgatagaacagaggtgttataccacactgttgttacattacaacagatgtgtcacatatatattaaacagagaaagaacatttttgttgaacgatactttattctctaaataactttctcatttgtctcttgtgatttctcacaaatgagactacatgaatatataaaaaatgaaattgtaattgcactcattaaactcattgattcataatgtcctataattaaacatgaaattgaaacccccgaattgattgtaaatccaaaactgataaatgtgcattttggtggctatgtcctaatcatcttgtaacatgggaacaatttacacaacaataaggcagtttaaaataataaaaatgtaaggaggaatgtttcaaagaggggacctagctatcaaaaggttctaggatgttatcgctatttctccatcaatgcttaactgtatattgtaattttggatttatttgtttcctcaagaactgtaaagtttttatcgtgtattgaccttaactaattgaagttgggatgggttaccctagtaataggaacttgaatggcatgaaatgcactataaatctagcaagtggactagtttgtagtagttgatatgttttttgtataatgagacatcttcttttcacaagaaagagtatgttgtcatcatcgaagcaactgtcaattattgaatgcctaactagtaaaatttgtttaaggtgagactattgcaatggtaaatatcatatgcatctattgaggcccgactgattaaaataatggatcatgtactaaaacatatttttaaagctagaataaagataaaaggccctaaaatgttgcaaaatatttttggaccatgtacatatgctccactagaacacccaaagaaccggcccagcatctattgtgtagatgttttgagtgattccttcttatttcctcatgagcaattttattttgtgagaacacccggcccataagaaagcgcttagaaaacgaatcttgttctagatgattggagcgtgttccacatgaaaataccacgtattgtattcttatttgtaggcataaaatcaaatccaacatttatgatattgcttaataagaatgagcaatacatgatttgttgaattcttaaaaaatatccaaacacagtaactattaatagttgttgaatatatataattaatgataaatgaatctgggactagaaatctttggctgaaacacaaacactgcataaatgttcaaccttttataaattgtataaaatttatatttaatagttatacataatcaaatcgtgtttttaacatatttctcaaaagtaattaagctattctataacttccttctatcatccttcctttcatagctcatactcatattgaatatg

SEQ ID NO: 2832 - DNA, 3000 bp, Unknown
  misc_feature (1)..( 3000): cDNA_ID_2049263_gDNA_ID_1620605_Annot_ID_161753 3000 nt of promoter + ATG
gttcattgttatagcctcatgccttagctgtactttctgtatatagcaaaaaccattttcttcccgtctcaatgagtttgacataatctttattcaatgttgaacagttgaagtcggcgaatatctaagaagattttcataactatcgacttactaaattatatcatgtgcagtaactatctttgaaatcaaagaagatcttccattaaagatacataagcaaatattctttttagtgaatatggtttttaatttcactatactagggtaatatatttttcggttcatgcaatattcattcaattaaactatcatgcctttaccattacaattcacttggttccggttagatcaactttgtttttggctttggtcgattattaacttggcccaagtcatgcattccacgcatgaagcaccctccgaagttcctttcctatgttctctctaatcttgaacctgagggattgattgagagtgacaactctttcggttgagagcaataaactcatttgatgaataaggttttcgacctttgcatccattttttttttcctttaatctagagggttgtcgattcagaagcaagagtcaaaactaaatttggaagtttagttccacctaattcaaacaatgatatatatgttaaaccaaggttaataatgttaaacatagtttcttacactattatgtctattatatgtaggaattgattgattattatttttaattattatgaaaatgtctactgaaaaaaattaagagttttggctaattaaaaagctagacaaaaaaagtttttggccattttctctatagaatttgctctttctgttgttacttacattaaatgctgtcttgcacctatatggcctgaatgtgaggaaggcccatatctattggtgaaagagcccaaaggttaggccattcagtatttttctgttcttgaacctgatatggatcttcttgagtttatttgcctcactattcctgagcctattatcatcacattatatcatacagttgcatcaattcaaagcctaaacaattgcattaacgtgtttctaataaaaaaggatcggaggattattgatagttatatcttattttaagcccaaaagataaacacatttgtggtggttgtttacttcgcgtatgtgtccttaccattcagacacaaagttatactgtattatttaatgtatcttatgagccacttggcagagagatatggaacgtatgaactcgtacttaccacacgtctacgataaaagcttagttttgtctatcgataaatataaattattcgatttgtaacgttttggattttaatatatcatcggaacatcatcctcatctcgaccacacttcccaagaccaaccacatcatggtttttgacacttgacatacgataattcgtcatttcatttttctttgttttaacatgtacaaactatacaagttgttattttgttcctatagtcaaatttactaaagaatatatagaacgatcctttgaaattttagtattatgcggagaagataatttatttgagatgaaaatttattatagaagttgtactgcattaattgttaccattcacaaaaacttaattataaatgttataaatttttttacttgtaattttattgtacaactcttttctaccgctttccactattccaaaaaaattacaacttcaactaacaactaaaaatttaaatttttgtacagttttatgtaatcaaactggatttagagttttttttgtttatctcatgattgagtgggtgattggttgggctgtaactgtaaagtttttgctgtagagattttggtgtagctgtgttagctgtaactgtaacttttattgttgtagaattattgctgtaagtttttttattttaaataatttataaaaaagaactaataaaatataatagttgtaatacactttttttatatagtaaataaaatgccttgcattactaatttaaataaatatattatgatgatataaaagtaaaatatagtaaatattttttttgttatatatttatgttgataattttaatttcttagatttatttaatgaattaaaatttctacaccaaaaaaaatttggctttgagaatttactctcctacaaccttaaaaataaaattaaaaaaaattgggctgtaggtttaaaaataaagctacaacatgattagtacgtaatcaatacttttaaaaaaattaaggatgtaagttagacttatacgccaaccaatcatgcactgaataacatcaactcttatcatttctacacaaattattctaaagtatttgattgaatataatttcagttaaatttgatcattattctttatcatctaaaatatatatacttttaaaaagatgaaagcatatgcatcagcagagaaaaaaaaagatgttcaatgcagaaaaaaatatttaattttcggaattaaatttaaaaaataaaacaaatttaaataaaccccattaaagcttcctaccaaaataaaaacctttaaagcttattttatttatcactaaaatcataaaaccactaattattacctaaatcgttgaatatttcaatttgatgtaattttacttttaacgaattaaataataattataccaatgatgatgggccaagcaagtcgtgcaagcaaagagttaagctaggtcccactctcataataagtccagaaaatggacgatctagatctagtgtagtctctatccaactctaatcttcaccgtttgttattacacaagtcaaataaggataaaactgtaaattcacaacaaaatcgtcgaaatatcatatcattcactggtggaggaaactgaagaaaacgatccgataacagcattttctattttcttctgtgcctcaaaaaatcataattttctcggaaaattaaaaatcatgtttaagattttctcgagaaagtaaaaaaaggaagaagaagaagaagaaacc

SEQ ID NO: 2833 - DNA, 3000 bp, Unknown
  misc_feature (1)..( 3000): cDNA_ID_3070131_gDNA_ID_1620605_Annot_ID_161765 3000 nt of promoter + ATG
caatttcgaacgttcgttttcgagaagctaagattaaactacattaaaaaggaaaaatttgattcaacgcagcagccatgattcatgattcatgatttctattggctttgtcagcaattacgtatgcattttcctatattgagtagatttggactaaaattcaactttacacatacacacacatataaaccacataaataaatttatggttaattgatataaaacatgaaaatgttactttaacatggctgttgaagtaattgacgtaagtgatagcgatgatttatgccctatttattatgtaaatataatatcgtactaatatatacgtgtccaaaggttcttgaatggtcgacattttgttgaaactaaaaatatctctacctgtacttttactttcttaattcttaatcaaaggaattgatttaaatatcttgttttcatatacacaaagctatattttaatttacccattttactaatttttgctaaaatacaaaatttgtttgagttaaagaatcatacatatttccgccaattaatcaacgaattccaagtttaataacgtcaagaccatcactaattttcaatagtaaacttttcagttaggcgaactgacaaactgaatgtaccatagcaaaaaaaacagatcgaataaattttttgaaaataatcgaatggatattaaatattagaacaaaaataactggaaccgatttgatagcgaaccaaagtattttaagtagcttaaaatatttgaaatacagttatattcaaaaatattaattacttatagaccaaataataaaaaatatttgaaaatatataaaaataataaaatatttgaaaataatcaaaaaaatatccgaaagtacaccaaataaccaaaaatatcggaaaatattcaaaataaaataactgaatagatacaaaattttaaaaccgaaaggaccaaaaccaaaccaaaaaccgaactaaaaaaatagtaaactctaaaattaaaatctaatgaaccaaactgataatcaaacgcccaaaagtactttttatattttatcaaagaatcttctacaatgattccagatattaaaaatagtaataaacatgaacttattttcgtagatactacatcattgtcaaatgatttgaatacattttaaaaaattactaccaaaacttgtggatcaagtagcatgattcgcttctagaaaatccacgttatgcttcttctctaaatcttttgatacaaatacacaattgagtcacattaataactatcttacactttaattaccaaaattgccatttccatgtgcccccaaccacttcctcctatatatacggctatttatacaacaagacaaaaaaaaaaaaactccattaaagcaaaaaactccaaaacctctctctctttcttcctcacacgcttttttcatttctcaactgtaaaaaatctgatccaatggagaaagacgatgcaacggcgtcgttttcacctagcttcagtacttattccggcgatagactcgtcgaaatcgccgaacgagtctgttacaaagagaaatcagacgccgaattcgagttttcgacggcggcgacttcttcttccggtgacggtggactagttttccctgtatttaacaagaatctaatctccggagatgtttctccggagaaagtaattccgttgaaggatctattcctccgtgaacgtaacgatcaacaaccaccgcaacaaacatactcatcgtcttccgacgaagaagaagaagacgacgagtttgattcgatcccgagcgagatctattgtccatggacaccagcgagatctacggcggatatgtcaccaagtggaggatgtagaaaaagcaaatctacaggatcatcatcaacctctacatggtcaacgaaacgatggcgtttgagagactttctcaagagaagtaaaagtgatggtaaacaatcacttaaattcttgaacccaacaaacagagatgatgatgatgaatcttccaaatcgaagaagaaagtttcagtttcagttacagtttctgcacatgagaagttttatctgaggaataaagcgattaaagaagaagacaagagaaagtcatatttaccgtacaagcaagatcttgttggtcttttttctaatattcatcgttatggcaaaacttttcctccgttttgattcattgatttggatctattcggtgaaaattatgattttaaattcgtatttaataaattatgtaagatgtagatttgtatttttaataattacatcttaaattatgtttttattagtttgtaaacaattttgattattttcgtaatcatatagttttataatttgggtgaaggttttgatgtaaatatattttatttagttgaaaattgacaagttgtgagtgtattttagtgtgtatttgatgttttttcaggaagatcaatggatatagacatgtatgtaaatgaagacaacaagatattaaacttttatggatggacatcattaatttgtaaattgacaactatactttattttgattagatttttttttttaatggaccatttttcgtaaatgcgatcacttataactgtgaataataaacttttgattaaattaatgtttattagaggagggtcagctactcatctatagattcgataccatttcgtagctatagaattacacattgttattgaaaacaatgtgttattgaaaaatctgttaattggaaaagcagaggaatcacttttcaataaaattaaagcgcttctctcttttgggcttaagaccctctttctcttttaaagtattcgcttctaagtggaatagagctttagttatggtgtttctttcctcttagccgcatttttaacctactttcagtttaatcttcaaaagctcagccgtttctcttcatcagctagccgtcaagcgagtttatcatgattaagtgctttttgggtcgtctcataccttatccgttact

SEQ ID NO: 2834 - DNA, 3000 bp, Unknown
  misc_feature (1)..( 3000): cDNA_ID_2174902_gDNA_ID_1620606_Annot_ID_161790 3000 nt of promoter + ATG
cagccactaagatcaggctgtgatcaaagccagcgactgcttgaagaacacaaccctctacatcctctaacaacatcggttcaggctcatcgctcgagcttcctaaaccgagcctaccattcttcccacaaccccaaacccaagcttctcctttctctgttacacacaaggaatgcacacgccctgctgatactgaagctggactttccccatcgaaaccttctacttctcttggcaggttttccggttttcccctaccaagctgccggcttcggttccaaccccatgagagaatatttctttcacccctgttgcagatagctagtgaatgaccaagaccagctgctatagagatcggagattcagttatatcaacaggtttcattcctagatcttgtttagaccgacccaactgaccatagatgttgctcccagcgctcaaaagtgtgccatcatctgaaataagccaaaacctatcagacaaaactaatcctctttttgtttaatatatactctcccatagtgtaaaacggtctcatttacttacgacaaaggatcaaggagtgatcggaaccgcacgcaatatctgctaccttctcgttacacgtttcttccaccagacaaggttcccaagcaattggcatatcgttctctttactcattgcttccacaaccttcttttcagctgcctcaagattcaaatcaccagcagcatggtgacctttcatcgacccatctgtaattgaatctagcagagatgcttcaagtggaagtccaacattgcctactcttccatcagctacataaccccatccaaaaactttaccatccacagtaagcgcaagtgcgtgcccccaacctaatgatacctatcaaaatcaaaccccccttcctatgaaaacttaaaatcattttaaagctgattatacaaagacttgattatccaaaccttaacaacgtgctctgcagctaaattttcaactctcgaaggaactcgagcttcaatgataccatttccaagaccaagctgtcctcttttagatcttccccaaacccacaaagagccatcatctccaatagcagctgaaacaactccagacgcaaacgctgcctggacattcacattctctagaccttccactctcttaggttcactccttgaatctctactaatcacatcatgaaaacatcaggtatagtagcattactagcataagagacccaccaaatcctaaataacatcatgactagcaaattcatgttaatgattcttaaagtattctcactaattgacctatcaaattcaagttcaatcactactttactctgatgaaatcaattcaaaattgggttctcaggtagagattttacctagaatcaattacgattcgaccgagctggccttcgtcgttgcgaccccaagcccaaatctcaccgctagatgtaacggcaagagaatggtaatgtccggcggatatggaagagatatcggaaggcaaattagaaactacggtgggttcgtaagcgtccattcccatgcctggaatcgacgatgatgaaagaccaagagcgccaaggtttccgtcaccgaagctcatcactgttcttctttcgccgctagtgctcgtgaattgtcgtctgacaactccattgaagagaacgtgtgtgcaaaagcgagaatcggatgaataaactttactgatttgtagtttcgcgatcgaccatgatcgaagcatatcgccggagaaagaaaagttttcattgtgtaaatgattccggcatcttgagtgagtaaccgaaccgatccgacacgatatttaattcggggtttttcggaaccaattacaaaagggaactataattacccgattacccaacccgacccaaactatctaaacccgacaaaaataataatcttttaaacgtcttttattaaattaaaaaaaaagattacaaatatatcgatgagtatacaagctaatagaattagcctcaactatctataaattaatatttttatatattaataaaattttatggtttcaacattattaatttatagaattttactgtaaactgatgtgaacaaatgacatgaaattgttttgagtatttttgttttggcttacgtggacacatcttcttctattagtagaagaatttgcttttgattttcagtatttacttaagtatttttagtttcaaggttattttgtacccatttcctaaattaagggtcactaaaatattcttcaattatacgaaagtggttggtactacgtcaaaactaatcattgcctttatttatttgaaattgccgcctctctcttcttctgatttatcattttcagcttccccaagcaatctcccctccataaaaacttcatcaatatagtaatcagattgatggttactactatgttggtatctcaccaagcaattttttttagaataagtaaaaatacattatttgagttgcctagttgggatacgtaaccatatgacgggttatacttggtatgactgtcgatcatatagcccatcttttatatctaaactgattattgactctgccttcagatgacctatacattttaaaattgtacggctgtaaactttttcaaatctatataatataatgagggaagatccgccaactacaaagtccatggcgccattaaattaaaagtcgaccgttcaatgcttttggtaaataactgaaatattggaaagattatttcaacaattttgtttatgaagagaacgtgtagtgcataaactcgtatactaaactcttgtaataatattatagtactagtattgggataattaatatctaatctccaaattgatcattgactttgtagttggacagcccgtaagtttgagaatgtctcgtgatattttgatgtgtttgtataaaaattagcatttagaaacataagccaaataatcatctcatatctctcgttgctcaaaaaatctctcagcatctctatg

SEQ ID NO: 2835 - DNA, 3000 bp, Unknown
  misc_feature (1)..( 3000): cDNA_ID_3070160_gDNA_ID_1620606_Annot_ID_161795 3000 nt of promoter + ATG
gaaagagaagaggaatgaaactgaatcagtcattatcactctatgtaaaaagtgtaacgtttttggctggattagtttccaatttgtgaccaataaaacccaaatttcgaagataagagtttgggctcagaaccctttattgcttctgatgctcagaactaatgtacagtaatcttttgcattgtgtagcttttgatagtgaaaaatatttttgaataaaaagcttatctactgtaccattctagcagcagcggttggcaaggaatcgcaaaccaagggttgttccttactgttaagacactctcatatatggaaagcaatgttaaatactgcccttgtccgttgcaacagctggctatctgtttcggcttttgtctgtctttataacattctaaacatttcattgtactcatagttcagcctttaaacagattactttctttcagatttgtttcaatttgggacccatctctcttttagttttgtcaaaacatggttctgtgtggccatggttttcaaagttcttagttttccatgagctcacatcgcagaccttgatttaaagaaaatgcttgataatcacacagtagctgtagcgtgcttaaagcctcgtgaaaccaaaaggtcgacatgcatttaagtttcgtctcttcgttttcctctagaaaggttgatggtaacaaatattaatgcctcgttaatctaaaagttggagacagctatcatcatcatactttcgactctttgtagtcctctctaaaggttgtgacttttgcaattccctttcatgtctatataaagacacgtatgttcagaatgttatctaacacttaccctctttatttcagagatgtcttcttccattgttaaaatcggaatagatagcatcaaaacaacggtaactgaaaaagagcgagatatcaaccgtcttgtgaagacattcttgtccaacaaaaacaacaggaagaagatcattggtcttgataccgaacgggtgcaaaagggaagaaagctaaataagaccgtcttgttgcagctctgcgatggtgacaattgtctaatagtacaacttcccgatgaagatgaagatgaaggtgaaggtgaagatgataatctgccactccccctcttcaattttctcaatctacccgagttcacatttgtgggcattggcataaacaagactatgatgaggcttgagagtgagtttggtttgacctgcaagaatgttgttgagattggacccgccacatggaatctgaccaatatgacgaccgatgtgaaatttaggatcagtgctattgtttcgactgagagaccatcaaatgccgtacttgaggactgggagaaatttgttctcaataagaaccagatcaagcttgcagcctccaatgcatactttgcttttggcattgggaacattttgttggatgttcagattttaagttaatgaatctagatttctgtttgtctttctttgtttttctttcttatgttcttcagtatcttgttgtagtttgcatttcaaccgttttaaagaccacaaaatgtggtatttggttcttcatttttttgttcttgttctctctgttagaccacaaagtgtaatattgggaaagttttgaggttaattagactgccacaataagcgttcaactagctagagtctgaatgattgtagccaccctaaactctgaggtcaaggtaaaggtataatattattactacaccacgtgagctattgaactgggcctgataattaaaagttgattagggcctattagaccacataacgaaatcttgagccgctgctgctagggggctgaaggatgattaattaagtgttcaacttgaagcaatgaaatagcttctgagagaagagagagttatgaaactgaaatgatcatcattttttttcttgggacaaatcagtcatcatctcttaatcttatctatgtaaagtgtaacttttttttgcgggattagtttccaatttgtgattaataaaacccaaattttaactaatgtataagagtttgggcttagaacccaaaataagtgggcctctatgcattgtctacctttagatagtgaaactattttagaataaaatgacaaagtagaactgtacagttttttgatgttttccatgaaaaagaaataagttccatgtattggagagaagagagtcagaaaaaaagagtcaaaaagattcttttgaaagacgggtaaacttcggagttccaagtaattattgcattttcatatacgctctgttcctggattcactaaatcttatttgaatacaaatgcatatgtagcaaatttaatattgtaactatatgtaaaatgttattttacaaaaaaacctccaaagtatttagtttttgcaaacttaccctcctaatccttaaagtacatgacaattgacaactacccaaccaaagaaaaagctgcaatacaaatacaagcctcggttatatcgatcatccaaacatgtgttttctttttattcaaaaacgaaaagcaaggagcattgtttgattgcatgaaaacgaaattaataactcagatggtaaggaagctcgttgttgaccctatagaatacatagaatgcttcaaaaaaaaaaaaattgtaacaagtgtcgttctctatagagaaacaacacaacataaaattcttaaaacgacattgagaaaaggtgtgtattactgttttttccgttggtggttagttaattgtcattcatttttggaatataaacggtaaacttttgcaaaaaggaatattacaaggatttgtattgcaaaaacaaaaacacatcaatagttacttcgataaaagtaaaaatggttgcagagtattattattactcaataggccctagctcagtcacacaggtacatccataatagtgccccattaacttctttcactctcttattgtgtgttgaacagtgacaaagaaagagagagagagctttgctttgcagaaaaaa

SEQ ID NO: 2836 - DNA, 178 bp, Unknown
  misc_feature (1)..( 178): cDNA_ID_1830250_gDNA_ID_1620607_Annot_ID_161804 3000 nt of promoter + ATG
actgcaccaattaaccattacttacttctcaggtaatctctctaccttttctcatatgattatagttagtatagtatttggttacattatatatgataatctttttgaaactatttggttacgtttctaatcgcaggtaataaatcgtaagatttatcaaacgcaagcaaaagagatg

SEQ ID NO: 2837 - DNA, 1533 bp, Unknown
  misc_feature (1)..( 1533): cDNA_ID_3070187_gDNA_ID_1620607_Annot_ID_161824 3000 nt of promoter + ATG
actctctggtagcatgcgttcgagctctcttcacggcgacactctaaatactccaagattttgtaaaccttctcaggcctagtattatcgtatcctacgccacatacattgaaacctttattctcgtactcgatccatttaatctgtttcaaccacggattccaaaaagctgttcccttgggactaatccaagagttacaaaacaagaacccatcggccatcgcaagcagtgatggttaagtaagcaaatttccattcacggtaagggataccagaggagtctagcacatgtaacttaatcgttggatcaacgccgtcgagaccgatgatctctatcgaataaatcttggaatcggtaatgaagatgaactgaggacgagcacgagcgaactggtccttgttgaaacttttaacatcaaaaagagcattccatcgtttgcaaaccgatctgaattgaacaagagatcgaggtggaagccgagacagtatatcttcctccagctcccatggaagcagaaccattagctctgtatttttttggtttttttttttgtgtggggggggggggggagtcaacgagatcttctctttgtcgttgtagtagcttaggagaagagaaacaactattattttattttatactccattagaaaagtgacacaattttgttatcatgattattggatcaaatgattttaattaatttcagattatatagttaaagaataagcaaatagtgattttaatagagggacaattggtcagaaaatctttatcattatcatttctgtgttttatttttaagaagcccgaaactttttagagttctaaaaaaactttaataactcttttaggactaataagaacccatcataacttggtttgaagccatctcctctgttttggatacgttaaagtttgttgttggctctgttttgatttatttatttaagtttctccactagctactcatttgaaacatacgattattgccaaaaataagagaactgccaaaaattaatgcgcccaccgtggggttcgaacccacgaccacaaggttaagagccttgcgctctaccaactgagctagacgggcttagatgtttgaatttatacttgtaaatacctaaattcaacagacattcctgtgtttattcaagaccacatccttcaagttcaatggttttttcttttctttaacttgaactattttgtgttccattttttaataaagacattgtaataccattaccattgtatttaacatctttaacagtactaccaacatttttgttagctataaactttatagaatatgtataaatattctttcagttcaaagaaagttccttggaaagaaaaaggaaatcaattttctctagttatttactctaattatagatgaaggcaagttttcatgcaaaaatggaaaataattaaaaggaaaaagggcaatttattataaacacaaacaggttcgagttttcactaagatgaattatcaatatgcttttccggtcgtgtgttggtatg

SEQ ID NO: 2838 - DNA, 3000 bp, Unknown
  misc_feature (1)..( 3000): cDNA_ID_3070193_gDNA_ID_1620607_Annot_ID_161822 3000 nt of promoter + ATG
cttagaattagtctttgtatagtattttggttatatatgtgaacctaattggggcctatattagattatctttaatagggctaacgaaagaacggacccgataaccaacctaatacccgaaccaaaaaaccgggttaaggcgggttaaaattttaggaaatttccttattgggtagagttttagtaaacccgtggatatctgattggtccgtaaattacccgttacccaaaaagagtattcaaaaatccaaacattaatttaatatctaaaatattaattatatttaatcgtaatattatctaattatctaagattataattataaatctaaatatatcaattaattttggacctaaatatttaaaacaactaaactattcaaaaattatttgttatgtttgtaaaaatttagtaaaatatattcaaatataattaaatttattaaaacttaacaaatttaaaagttttttttttgtttggagacccgctatctacatacaaatttctcgtttctattttttttggtatttttagggtctgaaacgttttgtgcaaactgacccaaacccaactggatccgacccgaaccagaaccgaatatttagaattattctattaggtagtaaatcatatacccattaatcccaaacccgaacgagttctacccgaattcgaatgagttactcatatgcccaatcttattctctgatttaattatctaaaaactcccaaaaaaaacatatgttttgctgactactttttattcaaaaaaatttacatcctcttctgccaaaatcatttcataagacatcccaaaacccttggaataatgattccatgaatgaagaatcctaatttgaatataccaagaggttttgaaaggttttaagtttttgataggtgtgtatgtgagaaggtacatacatcgtgatggtaatctgcttatttataattttaacttgcagtataccgcaggtaggcttatattttagttaaactaaaaacttttattgtaaagatgattataaatatatgatattattttatttgattttaaatgtatagtaaactgcgagttgtatatgttttgttgatattatttatattgtttagtgtttaaaattatacacttgtattttgattgttaattttagagtttcacttgtagtataccatcttgtattaatatcgatttaaacccgtcaattctaggattttccagcttgtattaaaaattgaatcacatcatacatataaaaatatataatatgttattaattattgtaatatataagattataaatttttaaaataatattatgaaattgaatataaatattcaaattatgactcagtactcagtagaaaattttcttaaatctatttttgacccgttataatatttttcatgtattgaacagtttatattctttttaaaaattcaagttatgtcatatgcgaaaaaaatataattattttttataacgatagtattattttttgcaaaaatagaatcatataaagatgagaggtgaactataataattaataaaaaattaatatgataatttagatatcaaatctaatttgttgattttaattggttacttttttggaaattaataatgtatttcgtttttaattaaatttaattaattaaattagtatttgactttttaatttttaaagagatgaattaatttactctttaaattttatttctaatggcatacttatgtaattacttacaaaaaataagattacatttaaaatgtactttccaaataatatagtagggatagacgtggaatgacttgaatgatacaagagacatgaattaaatatgttccattaattaaggcacactgtataatggaatcaattattcgaattcaataaaattgatttttctaaattgagtttggataggtaaaaccttaatcatatttaaaaaaaaattgtaagatcttggaacgtcataacgaactttcaatcgtatataaagactctcggtcagtgagacagtcactagttttgcgaagaaagtttaagactttttattatgagtatttattgtgttgaacataacaaatgttaagatatgttagttttttcagtggcgaacccatgtatgccactgatatcatggaccaataaatgatatgatcatgaaatttttggttgatcattgtacaaaataggtctttggcataattggtagtatttgatcacctccatagtatcaagtcttgagtttgatgaccatcccttgcaacaattatgtctctttgctttctgaagataatttcctttcaaaatatcataattacactttctttttcatttagtttatgcttcatttctcttagatacgttctctttgaagtattaacttccattacaaacactttatgagtttttcctatgaattaagaattgacaaaaattgttaagtcaacaccaaatactttcagcacacacatacctaaccatgtttatgacgtcattatgtgagatttaaaatacttaacatgtttcaatgtggttgaattaagcatattgccgaatgattcagcttaagattgttgatacaattttctaatatgttctcaccgtaaaaatattataatcgtttatagatatattgtatgaaaaaaacattaaatgtatttataatttacattttaaatgatttaaatgtatatatatctaaacaaaaatatattagatttatttaaccccggtaaaagaaattctcgctgttttgtgactacaaagtctaaaacttttgacttgtgacattattttgtcgagaggtgcaaccattatccatggatcatatcatctattggtccatctgattttatgtcactttcctccaaaaaaagttaatgaaaatcatatctaacattcaaagagacgtgtgacagttaaccatatcatcattattaactttccaattcttgcaacaaatctcacaaaccttaggaagagccatg

SEQ ID NO: 2839 - DNA, 3000 bp, Unknown
  misc_feature (1)..( 3000): cDNA_ID_3070205_gDNA_ID_1620607_Annot_ID_161810 3000 nt of promoter + ATG
gggatgatggtttctatgaagatgtgaggaaggtatatgtaggacaaggtgactccggtgtgtcttttgttaagtttgagtatgctaatcgcaaggagcttgtagctggagttggccatgggaagatgtcaattcttggaacagaggaggtttttgtgctctgttctcgtattgacctaataatgttttcttgagatccaagtttcactggtctttgtattttgtggcagtttgtgctcgattctccaaatgaatacattgtatcggtggagggaagttacgataaattatttggagtggaaggcgagttggtgacgatgcttaggttcaagacaaacaagcgtacctctccaccgtttgggctcgatgcaggcacaacgtttgcgttggagatgaaagatcataagatcgttggattccatggcaaagctggagattttgttcatcaagttggtatccacgtcacccaaatcaccaagtcttaaagctttgtgagctttctcttctattcctagaataaaattaaaaagccatgtctgtttgttactcctcagcttctagttactctcttttaactatgtcttgcttcgtttgtttgttatgtgttatgaagtggtctgcttctttgaataaagcatcgttttgttggaatgtgataaactgataattgtgttatgctatacttggatgcatgaggataaatgaaaactaactattcaactaaaccctaaaacctatacgatcaaaattatagtaaatagtaacacttaatgagactttaaagttgagatgtgtaactagtcaccactcactcatgttagtgattcatgtgtgtgtcagtgtgtgtgtgtgtgtttttatcaaggtcttctcttaagattcataagtgtgaatctggtgggacttaattggtctggtggagtagaacctatgcgggcaatgaggaaggttaaggtaggctaaccgagcccactctctaagtgtttaatttgtaaccttaattcgtaaataaaagctgtttaatttgtaacctttattagataaaattttgtctttttttttgtcaaaagataaaatgttgtcaatcattttaaaaacaaagaaaaaaacttttttggcaagaatttatatatttgcttgtcataaattttccattttgtagtattttgaaaaaaatattttaacgaatggaagcaataactcgacaaaaagagtcaaactaaagtaccttcacatgcaaaacaaaacgtaaatttggtatttttttcccattaaaaaaaatatatatatattcttggccttgtgtgcgaagacgatcgagaacgagaagaacgataagctcaatacgcacgaacgtagatcgaagactggaaaggtatatcttcatcaaaatattcatgattatggttgagtttaattttgtttacgtatttgttttaatttttcaaaagtccactgttggctggctgttgctatcttggaatgattttcatatctcaataactattgtttactctaagttaaattattggggtgctatttatgatgactgatgaagtgatgggaacatgattgcaatattaaaatctcttttttatttatattaattataagtttgtacccacttcattttaaatagataatgccaagacgtaggtatattattactgaatttattttttaataataagtaaatatgcaggtttcaactagaaaggtaacacatcaacaagaaataccaaaaaccactagcttacatattttgatcatataagtattgaataatatagttatagatgatcaaatagttattattaattacttagctagtgtaatttctatcgattgtttcacattcgcaacagataattatataaataaatacatactacatgttaacctttgtttttgttaaataggatgttttcttgattgatgatctagatcaacttttaataatttatacgtaccagctttcattcgatcgtgcgacttcttggaatatcccatggtacatttgcagtcgagctagaaagcttttttgataatttatgaatcatattaagcgtctctcaattagattaatatttagtaccagtgtaaatgatacaattataaatctttttaccaacgaatacagaatttgttttagaaatattcttcgcaaaattttataatatttcataaatcagttataaaaaaaaaaaaagcagttttgaattcagaggaattcgtaaatttccctaagagttattaaaactagttgtgatattttggagtattctttatggctagatccatatgatccggttcttgtatctagattttttttacggaatattgtatgatatatctagtctcctctttggttctaaacttctaattaatcttcggtgatttgaattaaacgttactgtttttaaattatgattaaggctttaaaacatgttcatacaataattaccaaatcttaaccaattagactcttaataaggagaacgtatatatatgttgcaacttgcaactttagccctttacaaataattaatcgtacataatctaattgataaacgattctttaaattttaaaacaatgaattagcttgctgccatcgtttaatgggccaacgccaatataaagacgattagttgagaagttgtgcaagtagaagtatatgaatattttcattatctaaaaaaaaaaatgtatatgaacatgcgtttttcccagtaatgctttttatataaatatgcctcgtggatcacgaaagaataaattattatttcccttattatttcatctagtacgatcaatatcaagaagtcaatataaataaacatacaattcactttaattgatcatagcaccgataacaatctactctctttaaaaggtcttatctctattcttctctattatgtaaaaattggttaatagtagatattaacaatttatttttgcaactacagaaattcgtaagtactatcaagaagcagaag

SEQ ID NO: 2840 - DNA, 3000 bp, Unknown
  misc_feature (1)..( 3000): cDNA_ID_3079746_gDNA_ID_1620607_Annot_ID_161812 3000 nt of promoter + ATG
ccaaaccaaatttgactaccatccgtttgcaattagaattcaattttcctttcatgttactatttcaaacagaaacatgccaaaaatggaacttacctcattatgtccgataactaaccgttatgctactccttaagaaacgtgtgctactatcatatcattaatacacaaattcaactcatttgcttcatattcacaacaatttaatagtttcacgtatcgtggatatatcgcgagattatacaatatcttctattaattaattgctggcatgattgtaaaaaaaaaaaaaaaactgctggcatgtattcaaaaaaatcaatatatacccccatgcagttcttcgtagatggatcactcgactctttctatctatctcttatcaggtcaaatcttattctctcatatctgatagtatttttgtaaatattggttattaaaaaattgtgttcgtaattacaggtaattcgaaagacatcaaaagcaagcaaaagatggctcaaaaggtggaagcacaaggaggtattggaggagatgtatgggatgatggtgctcacgacggcgttagaaaggtgcatgtagggcaaggccttgatggtgtttcgtttatcaatgtcgtgtacgagaatggttcacaggaagttgtaggaggtgaacatggaaagaagtcactaattggaatcgaaacggtacgtaaaaatgttttgcttcgaatccactaatcttgtctttattttgcttaagtttatattatatgttcttaaaactactaaactctcaatactagggatataacgttatgataggataatagctcgcggaccatccaattagccatgtttagaatttaggtcgtatcagttctaatgattaattatagttctaaagccaaacctaaatattaaaaataagaaccaataattaccagaccaattgacgccttatacgtataattatggttctaacaagccaaacctaaaccttaaactattactcaatatatctttctatttttgcagtttgaggttgatgcagacgactacatcgtagcagtgcaggtgacctatgacaaaatatttggctatgactccgacatcatcacatccataaccttctctacattcaagggaaaaacctcgccaccctacggattagataccgaaaataagtttgtactcaaggaaaagaacggtggcaaacttgttgggttccatggacgcgctggcgaaattctatatgctcttggagcgtattttactacaaccacaactcctttgactcctgccaagaaactaccggctgttggtggtgacgaaggaactgcctgggatgatggtgctttcgatggtgttaagaaagtgtatatagggcaagcccaagatggtatatcggccgtgaagtttgtgtacgataagggcgccgaggatattgtaggagatgaacatggaaatgatactctactcggatttgaagaggtataatacttcttgctttcttctcttgtggttgaatgtgaaatgtttttacaaaatgatatgaatatcttacacaaaaatatgcttgggtaagggaatccacataaactttcgtggataaaatcatgcatattttatattagctagtgttgaatatctccatttttgatataaaatattttaactaactcaattgttttatttggtttccatcaattgcagttccaacttgactatccaagtgaatatattactgcagttgaaggcacatatgacaaaatatttggttttgagactgaagtcataaatatgcttaggttcaaaactaataagaaaacgtctcctccctttggaattgaagctggcacagccttcgaactcaaagaagaaggttgcaagatcgtcgggtttcatggaaaagtaagtgcggtgcttcatcagtttggagtccatatccttcctgtcaccaactgatcatcacatatatatatatatatatatgtctcttctataccaccaagtttgtcacgtgtgatatcttcattaagttttaagttttctaatttttcttgttctgtttatctatgttttaagtgtctttaagtatggtgttttgtgaagttgttatgcctgtaatattatatgtgattggctttaataaaagtgggtgattattatacatatcagttgcacattaggagaaaagcttatattcatactcagtatctcggcatctagtgtatgatggaaacaattatctttaagactttagcattatttaaagtgagaaacaagaaaacttcgccataattggagaattggtcattttgatcaaaatccaacaccagactacgcgcagtccgtttcgaaggaggtacactccacttagtatctagatttaatttattatacagtatgtttaattttttttttttttcaaacacatatttttcttcttaagaatatatatggaaatataatatgttaattatgtaatgatcaaataatattaaaacacacatatatatatatatataaaccatatgagcaattggataacgggtaaaatctaaccaggtttcaaaaattgtaactattgttgatttttttttttttttgatcaacaactattgttgagaaaaacatgtattatgtgagcaaaggaaaaaaagggaaaaaaaactacagatcagtaatatcaactactccaattcaacttatttgcttcatattcacaacattctaatattttaatgactcgtggatcacgagattatattaacatttctatagattaattagtggcctacattcaatgatatcaataattacacattttatccagaaataaaaataatcaataaatacgcatgaaggtcattgtaatgcatatcaataactcgttccctctctcctcaggtaaattctcagtctctcgtctgataatagttttgtagagtttggttaataaaactaatcgtgtacgctactaatacgtacaggtaactaattaatattcaaaaag

SEQ ID NO: 2841 - DNA, 3000 bp, Unknown
  misc_feature (1)..( 3000): cDNA_ID_3070201_gDNA_ID_1620607_Annot_ID_161813 3000 nt of promoter + ATG
tgagccacctcctcccataagcatctgataagaattggattttacacaattaagtctttgcgtttgaaagatcaagtaatgtatttgagtcaggcacctgaagaacagttgcaatgatagcttccttctcgttattccatcctggcacttcaaaagcaagcgcaaaatgtgtagcctgagaatggtgaaacaaaaaaagaaagatattaggaataataaaccttcttttactcaaagaagcccattgaaacgtcatatttgtacctctccacccgtatgttgacggaaatctccaccgacatattgagactttggctccgcaggtcggggtacattagggaggtcagatagtaatggctcaaccacttttagaagttcttcatgatcaactccactagctgctaggaccattcgtgaagcagtgtaattctcctgaaatttcagaacaaaatgagaaaaaagacacatctacgaaataacaaaccaaaagccagtgatactagttccagcgaatgcaataatctcttgtgttaacggtcttacaaaaacaaaattctccaagacctccccagtcaatccagtaattgcagattcaggtgcatacaatggatttgccaatgcgccagagtaaccagcagaatgaactgcctccaaaagaaaacccattggattcgttgcgaattctcctatctctactttcacctttcggagctgccaggagaaaaatgatgaaaacagtgtaaaaaaattgcttagctttaatgtttgtgagatacatgcaacatgacatgaagtacctcttcattcacttcccaatccaaaaaagcagggttcctcacactatcaataagcacttcaaccatttcgggaacataggttttgagagcatcaattgtgtaacccatctgctctcgggatgcagaagctgaagtattacctccaatagcctctatttcccttacaaggcgaaaatggcttctgttcaatgtactcttgaatgccatcctttcaagcaagtgcgtcgctccacggaattgaggagtctcataaatagaaccacagtcaacgtataaaccaatggaagctgctggattctgaacaaaatttcactcaaaatcactttccagtagtttttaacaggaagttgatgttgggattactaaaagaagctctcaccggagacatctcagtggctatagtcagaccatttggaagagtagtggtcttaagtttgctaggctcaacatggtcagagagtggtggtggaagagagacaccagccaagggaatgttcatagaaggaagtgaactagagtagcctccacttagccagctggaggaagaagagctcgttgcaacagcactagaacttgcataacgagaagctcgaaaattgtggtttagaatgccctataaacacacacacacacacacacatcctaagcatcattaatctcttgattcaattaacattgtaaaaataagaactttcgaaacagagacatttcataaacctgcaaaaagcatgaataatggcaccagctactataaagcgataaaattgaatcaagatctataagaatctaagagaccctttaatccaaatccaaaaacaatgaatcatacaaattgttcaatactaagcattctcctaaaaaaaccagaatctcaatggaaacaagtgaagtaggacattgaccttaagggccttggctcgagaagctgccgtacggtacatgatgatgactgcgaaaccctagcttggtcagatgagtaccggtgaatgtggctgacgacgggagagagatagaggccgagtcagagctgaaaagaaacgagagaagggaacgattttttttcctaattaaggttattggatcgggcaattgcttctaattacattgataggcccatatgatataatagtcttggcccaaattataacatatagaaaagatgaatttaaagcccatgtattgtagtggtgtgatcctattatattttctctcaattatattttttttcttttctttttcacgtaccattgtgtaaaaattcaagtaaggtaacgacatttacatgcagtcacaaatgaaacaagaatttttttgaggtgtgtgtaaagtgaaacgaaaaaagtactaagaaagtttatcttctctaagttaatagaattattttgaaacgtagtatccacatatatagaagactcgtgtgtggtgcatatatatactgcataacttcaattgaactgtattatataactatgactatccatccatgggaagataagaatgagagccgaatgctaaaaagcaagggacccgaattaaacaaaaatgaataaaggagaaaggtttgtgtgattttgtcaattgtcgtcgtttagtggatgtgtaaaaatactaaatactataacaggtggtgtgggtctatctttttttttttttggtctaatgttaaatgtgggtctatcttaataatgcagaaatagtgcaatacgattcatgagtggaaaaaatcatatttgggtactctcatatatagtctcattaatcattatcaccgagtggggcgtacgatacactttttcttctttatctgttttcatctaatcatcatactgtatgtctatattatcgtagcattcatcatcgagttatgaaacttatgccaaaagaaaagaaaaaaaaatcatttgagattggttaaatttctattttaagatttaaaccaaaatgtttaaagttctataagctctaattaaagtctctgcagtccattaaaatggataattaggatttgccgaacttgaaaggagtaatgcacattttgatgctcacgtgaacaacgagttgtaacggtttcgctataattggaggcagatgagaaatggtcgtgtgtgagttttaataccacgtgattaacggagccacaatcatattcatgggccattctcatgagctataatttgaggtgtagctgagagatggtcaaatg

SEQ ID NO: 2842 - DNA, 3000 bp, Unknown
  misc_feature (1)..( 3000): cDNA_ID_2175176_gDNA_ID_1620607_Annot_ID_161818 3000 nt of promoter + ATG
gcttgggcttggagtgggagctgggcttctgggaggagcattgggtgggctcttaatcagtgatatagtatccgacattggttttgatttttaacctttttaataacttgtgaaaattaagaaactccttttttcctgctttttttttctttctaattgtttgtcgtgttgtcgataattaacaaaataatatctacaattttgtttaccacttaataatcatattagataataataatcactgagtaaattaatatcaatgtttacaaaatctattgtatatgttatttatcggttttattttatccctgttatgtataaaaataagattttcccatagaaacaattataatttgttgaataatagttttgctcttgcttaaacaacaaataatcatacttgttaaatcaatgaaattcagctgttaaaaaacaaataatcatatacattgttataggttattataaatagacaactcataatttgtgagattgtatattttaaaccatccatgaatttttaattattttactttgatatgtaaaaactccacttgcgtaagaggtgaagccttctggaatacaagtctgataagaagagatgagaaaaaaaaaaaaaaaaattagttttctatagtctactctaaatatgcaaatacaagcacccaaaaacatgaacaaaattttgaagaaaggagtacaatcaaatatgcaaggcatgattttttttcattcaactctaagaaacttgcattatatatgtgataaattcacaaaactactagtattagtagtcaaaactcaatagtcaacccatttttccataaaggcatgaagttcatgaacattgatgatcaacaattgggctcattttcagcgtgattttcatgggccagttatactagaggatcagttcagaccttatccatatttggattattttttcttttattcctctttttattttgttaaaatgatatcaatttcttacatatactccttttttagttcactaaaaaaattagtgagtggataaaaataattttatttcttggtgaaaattctaggaagagcatcattgacaccaccactattctcacttgcttttctttatttcccttgatatgacattcaattcacgagttgtttttttgttccttttctcctgagtcggctacttttttaatcggatgctttgctttgtactcttttaatcacagccgtcacatttgctatatctctattcacttctacggctttgattaaagcccaaatttaaaccttatcgtacgatctcaaaatcttgtgcaacttcaacatgtgtccactgtctagtttgtctgtgcggatctagttagtgcggttaagttaaaccggagaggttcaggttatgttaaccatggttaaggttttgtctgacagtgagggaagaaagtcacggagttgggtaaaacggcgacaagatatgactagagacacactccttcttcaatttcctaaattacccttccttacttgaccggaactctcactcgagatttttctacgtcggctttatcgtaatatcggtgtcacacgtacgtgggagagacatgtacattcttttccccctcctgaaaaaccaaataaaatagcttcaatctttggttgaaaaacttgaaatatgttcttgatttacgctgcaaaattatgtacattttttaagatcaaaggaccaactacaattgtttctgctaaagtcttttcttttgttatttttatcaaaatatgttgattttgtagatttgagaaaagaaaatttttgattaggaaaaacaaacaaacagttgactatttacttggttggggaagcaaattaaattataccatcgtaatccacacgtacacattgtttttaacttttgacaaaataattgtttagctacctaacaaattgacatattgtgtggcaaatttataaataaataattacatatatctcactgagacgccatgcagattcgtatgtttatacaatgcctcacccatttcttgaattctctcaattgatcttcccatgatgttcatttattatttgctttatgtatatctttgtagaatggtagtattactattaaagtatcaaattaccatgacgacctatagaaaaatgtttttagaaaagcatagggatatgtgtcttatggacagtggataagagagtggtcctaaaaacagaccataaattatgggatcttcccttagttcctttattgttatcatattttaattactcttattagtatttttttaatggtcaagttgtttattggaattacgcatttaattatttttctaattcgtatacttgtgagaaacagaacagcacgctttgcttcttttactagacaaacccttaattagcgatatttgaggcagaaaaaaagacaaggttgcgtgtgttttactccacaaaagaactcctaaaaccaaaaacgttaaaacccacttcttttttttcacagtattctcttttcatgtcaagaacaattactgtttttcttggtatgcaatctgtaaatttattgtagttttcatttctacttttggggtttaggagtaaaagtggagtcactctactttgctttacctttttctgagtttttttttgttcatacaaatccaaatttccttttctttgtattcctattttttctcttctcgtccctttcagaatctttagagagagagaacaacaaattgagaaagaaaaaaaggtaaggctgtgtgagagagaacccaccaaagcgtgcacgagagagagaaaaaaaaagctttgattttgtataaaatcccaccactgctctcttaccataccttcattacacatctctctttctctctctcgctctcagttttgtgggattgtttctttaaaaggggttcttagggtttagtgaagctatagatttcaatttcatacatagttaacgtatagaaggaatcttgggttgatcaatg

SEQ ID NO: 2843 - DNA, 3000 bp, Unknown
  misc_feature (1)..( 3000): cDNA_ID_1830267_gDNA_ID_1620607_Annot_ID_161814 3000 nt of promoter + ATG
aatactagaaagaaagaaaaaaaaaacttttgggcaatttcaagaaatacaaagatttgtgtacctcctctgttccaagtagtgtttgcttcccatgttcaagtgatacaatcttaccatctttctcgtaatcaaacttgacataaacaacaccagagtcaccttgtccaacataaactttctttacattgtcataagcaccaccgtcgtcccaaacatctccaccacgaccaccttgagcttccaatttggtcagaccacctgataccggcggagtcagcggtgtagtcgacggaattatataaactccaacagaatggatcaaatcacttgaacttccatgaaatccaacgattttgccacctcctagctcagcttcttctccagaggttagtccaaaaggctgagaagttttccccttgaatgtcttaaagattagagccgttacgatctctatcggtgatccaaagagcttctcgtagtaaattttcactgatgttatgtaatcttctggatcaaccacaaactagcaaaaaaaaaaaaagacaaccaaaaatgatcagttaatgttgatgacaagagaactctcattgaaaacaaaatatttacctcctctgttccaagtagtgtctgcttcccatgttcgtgtgatacgatttttccatctttctcgtaatcaaacttgacgtaaacaacaccagaatcaccttgaccaacatacactttcttgacgttttcgtaagcaccaccatcgtcccattcttctcctccacgaccaccttgagcttccaactttttcgccatcttttcttcttaacctaaagttatagtacccatttcttagaaactgtaaacgcacaagagccatgaacagacactactcaagcactttcatgatgatgaaactaatctaatctgaggactataatacttccactaggacattactttaaacaatggtatcatattctcatagattcattatcatataaagaaattcaataattcaaataaaactagtaaaaatcaatataacgattttgtgaaagaaagaaaaaaggagtacattaaagggaaggaagaaacacctttgagtgtgagaaatggagatgaagatggaatatgaatgagttaatcttgggattttgtatatatactatatagtatatataaaacatttttgaatacgaacattaaattctcttttcatccaatactaaccactttttttttctgccaatactaaccactttttcttttctttttgagagactttatattcaaccaactcgtgcttcacgagggatggaagctttgattagttaggacttaggaacttgtattaatctaaatatctttttttttttaaaattgaatctaccttacaacataaaatttgtaaagagaattccaaaattccaaaaaaaatcacctaaaattttaaaatcgtgaaagcagcatcgtaaagatgttctcttctgttttttttttttttttttaactctcttttgaatattggattagagattttcacagtgtcgtagattcttcgtagagtctgttatgagttgacatttaccataggaattgcattatcgtgagaaggttaaatgataaattgacatttataaattctcaaaatgtaggttatgagttgtcaaagaaatgtaggctatgaaaaaaaaaacttacgtctaaaaaaatgcaaagttaagaaagaaatactcaaagttcgtggcatttgaccatctctcagctacacctcaaattatagctcatgagaatggcccatgaatatgattgtggctccgttaatcacgtggtattaaaactcacacacgaccatttctcatctgcctccaattatagcgaaaccgttacaactcgttgttcacgtgagcatcaaaatgtgcattactcctttcaagttcggcaaatcctaattatccattttaatggactgcagagactttaattagagcttatagaactttaaacattttggtttaaatcttaaaatagaaatttaaccaatctcaaatgatttttttttcttttcttttggcataagtttcataactcgatgatgaatgctacgataatatagacatacagtatgatgattagatgaaaacagataaagaagaaaaagtgtatcgtacgccccactcggtgataatgattaatgagactatatatgagagtacccaaatatgattttttccactcatgaatcgtattgcactatttctgcattattaagatagacccacatttaacattagaccaaaaaaaaaaaaagatagacccacaccacctgttatagtatttagtatttttacacatccactaaacgacgacaattgacaaaatcacacaaacctttctcctttattcatttttgtttaattcgggtcccttgctttttagcattcggctctcattcttatcttcccatggatggatagtcatagttatataatacagttcaattgaagttatgcagtatatatatgcaccacacacgagtcttctatatatgtggatactacgtttcaaaataattctattaacttagagaagataaactttcttagtacttttttcgtttcactttacacacacctcaaaaaaattcttgtttcatttgtgactgcatgtaaatgtcgttaccttacttgaatttttacacaatggtacgtgaaaaagaaaagaaaaaaaatataattgagagaaaatataataggatcacaccactacaatacatgggctttaaattcatcttttctatatgttataatttgggccaagactattatatcatatgggcctatcaatgtaattagaagcaattgcccgatccaataaccttaattaggaaaaaaaatcgttcccttctctcgtttcttttcagctctgactcggcctctatctctctcccgtcgtcagccacattcaccggtactcatctgaccaagctagggtttcgcagtcatcatc

SEQ ID NO: 2844 - DNA, 3000 bp, Unknown
  misc_feature (1)..( 3000): cDNA_ID_1830254_gDNA_ID_1620607_Annot_ID_161808 3000 nt of promoter + ATG
ctatcaactataatcatatacagaaagaaaaaaaacaagtgttacatcacgcttagcttaaaagtttcgactttttgcaccgtcatatttcacgtgtaagcaagaaatacaaatgtaaatagattataattaatgaattctctcgactctctcaacatagtatataaaaggaaatctacacatgaaccgtatctttctcacttttgaaatattttgatgttttaaagaaattttttcaaaattttatataaattataaattaatttaatattttttgattatttatatttttcatcagtcttgttcataattggttgaattgttttaaagtaaatatttctttagctaaaacatcttatacaattaaaagaaaaaagtgtaatcaaataaccaaatataaattagtatttcaaattatacttattgcagggtgataaaccttttgtcccaagtgaagttaaacctataaatatataccccatttagagggtcctatataactaaagtaccacatatttggtggtttatatcattcaatttttttgtaactaacttaatatttgatatgtaaaatcatgttaaaataggatcagcagatagaatatataaaaaataagtcatgtacaaacgtaacgttcttcatatcttaggtaacgtatctaacaattttgttaaatattattattttaaaaaattgaacatattatttggaaacttttcttttgataattttgaaatggcactttgtaattaagagtttaataaagaacacgtcacacacaaaaacgaagaaagagattatagaaattaagttgtgttttcaatcttcgtgtatacaaaacaaaaataaaaattagaaatgatatttcatacgatgttgttaaataatataattatgaaaattagttgtgctttatattattatttttgttggaagctctagaaacgatcgacctaatagtatatttttgtcactaaaaagtgtgattaaaatatatatatatatatatatatatatatatatatataatattgtaattttcaaccaattctcggtttaggtggtttattattatattgttttttgaaaaaattaaaaaatatatccttattagttcattcttttctggtcattcgttcacactttacaacttggttaatggccacttctcaagttatcgttctttcatttgttctacagtcgcaagaaattatcgttctttcatttgtcattatgcataatgatttctcttttctttttagtgcataatgatctcactacataaaaaaatctatcttacgattcaactatatttagtcccatgcactcgctgcataacacattactttcttcgatttagagtgattttcacaaccttgtttctgtattgtatatttagttagtgtttgtgattaccaaaaaaaaaaattgtttcttcttggcttagtctttttatcttttttttttttttgcttcatctatttttcctcccatgacagatgaagacggcaagagatgcagcaaatctcatttatgatctatctgaagaatcagcgtcatcgatttggagactcgaaccataacaaaaagagcatcacagtttcaatttaattgctcctggcgcttcctatttcagcaacaaacattaaataattaatccaatagagatgatatatatggaaatttcaaaaccaaaaaaagaaactttcaaaaccaaaattgcgaagccatagaaatcgtggatcatggaattgcgaagaccaatgttgacatatgggaatttggtgtcccaatgagcagagatcactaagattggttttcgggaggaactttttgagttcatgatttgaagaattgtctcgcctataagctatcgtccatagtttgagattcatgcgacaagaagaaggtttgattcactttctccatttaattgaatcatcttcatagatatattttcatacttaatcaatgtttttaccaaaaaaataatgttattttattattttggttttatgtggtttgggattggtgtagattataaaccgattaaaccaatgtttttgtgttctgagatttcaaacttttgaactaaataaatatacgttttggggaatatccaatatcaatatgtatcatagtttggactctatctattccagtatgataattcccgtggaaaaatatatcatcgtctctattttatacatgcacttgcaacacaaaccagccataaagtgggtctattcttataatttatgacaacatggaacactatcattgggccacgatgcaaggagcgaaggacgatgcgagaaggtgctttactgatttgatgaacgtggaggtgattctgaatgatacgagatctctaagctgaatatataatagtatagtttttcgtaatttttttttgttaaattttttatcgctgctaaagattaaatggcgagtaaaactatactattatactttcaaagatcacccgagaaaatgatgactgcacatactttcaatatcccatagatgacatatctgttttatttccatcaagctattcatcgaaacaaaagcacatgacgattatgggagagaaacactactctaaaatcccgtaataagctgcaccacctaattttttgtgccttgaccaaaaaaaattcaatgttgcagttcaacgaaccttcttacggaggatctttaaacaaaatttatttggtacatagagaaaaatattttaatatatactaatttaatgcctcgcgatcaacgagtagagaaaaaatatgtcgcgtgtatcttcttccattggtcaataaataccaatgcaatgtttactacacaaatcattacttcagtctcactctcaggtcagctctctccacatctctctcatatgattgtactatgtataagatttggtaatatttgtaattacaagtaaaattcgtaaatacagataatattcgtaagaggttgatcaaacgaaagcaaaagag

SEQ ID NO: 2845 - DNA, 3000 bp, Unknown
  misc_feature (1)..( 3000): cDNA_ID_2992185_gDNA_ID_1620607_Annot_ID_161807 3000 nt of promoter + ATG
tcagcccatcgataaacacctttacgtctttgacctcgagacccggacttggtccattgctccagccaccggagacgttccacacctctcttgcttaggtgtccgtatggtgtcagtaggatcgaccctctatacctttggaggccgagacttttcacgccaatacaacggtttctactcgtttgacacgacaacaaacgagtggaaactgctaactccggtggaagaaggacccactcctcgtagtttccattcgatggcagcggatgaggaaaacgtttacgttttcggtggagtgggtgctatggatcgaatcaagacactagactcttacaatatcgttgacaagacgtggtttcattgttcgaatccaggagattcctttagcataagaggaggagcagggctcgaagtggtgcaagggaaagtatggattgtgtatggatttaacggatgtgaagtagatgatgttcatttctacgatcctgctgaagacaaatggacacaagtggaaacattcggtgtgaagcctaacgaaaggagtgttttcgctagtgcggctattgggaaacacattgtgatatttggaggtgagattgcgatggatccacgagctcacgtaggtccgggtcaattaatcgatgggactttcgcgttggatacagagacgttgcaatgggagaggttagataagtttgaggggactccgagtagcagaggatggaccgcgtccacgactggaaccattgatggtaagaaaggacttgtgatgcatggtggtaaagctccaaccaatgaccggtttgatgacctcttcttttacggaattgactctgtctgattaagcgcgatttgatcatgaccgtttgtgttttatttgtttgtgtgtctgtgtgtctgtgtgatgcaataagggagggatcgtgatacctctatatgatccttcgtcagcttatccattttattttttattttctaaatgtatctttttgttttttgttttctgttttgtatgtttaatgtttcgtggcttgttcaataagatgtttattttccgaattttttttgggtatgttacgttatactacaaacaaaaatattatgattttgattttctctaaagatgaaatgaatagaacaagaagtcagcagatagggtggtttcatctacttttgtggttggtaaatgtggttagaaaaatttgcattgaattgtaagtttctatccataaaagaaacaaaaaattaatgtaatcaagagtggaaagttaccaatggattataaaaatcttgcaattctaataaatcctcatgtcaacggtacagataagataagggtaaggggcaaacaatcttgttggttcaaatggcaagtaaacaagggcaattatatccacctaatccattgcgttttctttctctaatcttagaatctactttaattgtatgtttttctctttcatctactttccaaaactatataacctcatttctatactttttatgcatttattttgaaacccctttatcaaaaaaaaaaaaggggccaatttttcttcaaaaatggttactttaagattctcatatacagtgtgccaaaaaaaaaaaaggtacctaaaatatttattatttcagatattggtcaacatattatctgtaacagaaaaatgttcacgtgatatttgcgaatcacatttttctaggggcaaaagtgatatatgagaatcttaaagtaaccttttctagaataattgcccttgtttacttgccactgtagtcatttatttaatttatgttcaaaaacagattacctacctaattcaccgaaacgaaaaattttgttgccagtttttgttttttttaattttttttttcctctttttagtttaccttctcttttttctgttcaacattaaactagaaggtagagtaataaataacgatggatggatgtgttgaaaacgcgctttatgcatgattcatacgagagcagctgaggaggagacaaaaaacgggtctacactatatcagacttttttttgtttttttggtgtaaaactatatcagatggaaaaatatcaaccaaataatgtagaaactatatcaaacttttaacaaaactatcaacccaatattttatattttattaaaaaacaatactaataatttttccttttcctcgtttttttttttctgatcaaccattcacacgttgtttttcgtaattatgattctgcataatgctttctctaaatcaaaaactccacgccacggttcaactgatgtagtgcctccaccgttgtcgtttgactcgttgcagaggacaccattatgcacttcgattcattttcaaaatcgtctttctctactgaattgttactccatttaattttttggtccatagataacatagaccattatactagtatgttaaatgtatacttatcagttaccgcacaacattaattcttaaagagggttcattttcgagaattgagtacaacactaccattaggccaaaatgcgagaggcaaaaaaagatatagcatatacttatcatgaataatgaaaatcttttccatccaaataaaaatctttcttctcataaaagaaagaagagaaaaaacaatgagtttgcatatctttatcctgtagaatgataatcttccccatcaactactgtagatcgtcaacgtgtactcacttccattatcgatcgaatcatcaatttaatgcctcgtgaatcacgagatcatataatatgacaagaaattcgtcccgtttatctactgctggtcaataaatactcatgcaattcccaccaatagatcactcaaccaatttcttctcaggttctctcttcacacctctccccttctctatgattatagatagtatatgatttggttaaattatctatatttcttttttgataaaggatttggttaaatttttaattgcaggtaatactcgtaagatttatcaacacaagcaaaaaag

SEQ ID NO: 2846 - DNA, 722 bp, Unknown
  misc_feature (1)..( 722): cDNA_ID_3070212_gDNA_ID_1620608_Annot_ID_161838 3000 nt of promoter + ATG
taacagatacgaatatcaaggattttcaggatatcctgatccgatttttaactattggttccggatccatgcttctggatttccggatttcggatatccgtccaaacaccaaaatctccgtaggggtccgaatccgtaaaaataacaatttatttttaattaaaatagtaataataatgataaaatttaatttcatataatataattttagaaaaataaaatctgaaaataaaaaaataaacaaaataaacaaaatctgttctaaataattattaaattttaaatatcaatacattttaaaaattattaatataattaacttttaatacaattaatgatttttgattcataaattcattattcggatccaaccaccccggagattcttgtttctccatcataattggatccaggatatagtcctaggcctcagtagctccgtgtttttagatatgtcaaatctaaagcaattagttctcttttcatggtttttttcttgtctgatccttagctaaatatccatgaagatatactaaaggcaatgatcaattttatgattttaaatcaccttctcttcattccacattttcttttggtacatgtctccattccccattgaatatgtaaataactcacggttttgttatctttaggccgggatggtaatagcacaaagtttgctatggaaagaaatcactctactgaaaaaaatacaacatatg

SEQ ID NO: 2847 - DNA, 3000 bp, Unknown
  misc_feature (1)..( 3000): cDNA_ID_2175122_gDNA_ID_1620608_Annot_ID_161839 3000 nt of promoter + ATG
ttgccgaaagtccggttattaatgaaatattccctttattttccatctattgtagttttcatcgggcctattgtttatatcaaccaccattactattttatgttcagtttgtttcttccacaattccaccatagttatcctaatcttgtttagcatttttgagtctgattgatgacatgttcttggtgtttaaaaaataatggttaagagaaaaaagtaattgtgaaagtttgatctcgaatcgctttgggttaaggctcacttggaaagtgtcttggagttttgctgcccgtgttaagtatcgataattttctgtcaaggtattttcctttagcaccctttagctctgattttgctgatcgtgaacttcacgctaatagagtatccgtttctttaggtttgtctaatagttacctttgtcgagatcaacagttaagtttagtatgaaccctatctgaaattctctatcacaaccaatagagtgaaaaagactggcattatgaccccgtcactacagagtaggggttagcggagcttttttcaactctatctctccattcgctaattatcgggttcattcatgtgaacatcaattgtttgaataatttgcaaacctctgatagtgtggaaggagcgatattatgaccctttctccgatagatggttaccatatcttattccaactgtttgacccgtccgcctcccctgtagagcatcttttcaaaggttcatttgctttgtttgcgagaaccgtttatgactacacgttggtcgaggatttcgataagtcgaggatttcgataagtccgtcttcaaggttgaatttgccaagatctcaacagattttttaaatcttgtaaactcttttaaaagtacacagttctttagaaaactcatgaaatttttatttttattttcttgtattctcttagctttaatttgtatgaacttcccttctttaaagttaatgaatggaaatctatggtttgacagaaaaaaaagacagaaaaatgtaaatcaaaagttgtaagaaagaacagtgttattctataaaaagagaatgaaagaactatgttatttttataaagggaaaaaacccccaaaaaacctcaattaatttttatttagacgtttaatacccaattgtttttggttggaaggtaaatacacgaaataataaaatcgtacaatttaatacacaaacaattaattgctgttatttttatattcacgatctcacaacaaaaataaaattccaattttacccttaccatctcaattaactattatttttttgataatatgatattaatttttatgattttgaataaaaattaaatttattaacataaactaaaatattaataaaattattttttattcaaaattataaaatttaatatcatattataaaaattaatagttaattgagatggtaagggtaaaattgaaattttatttttgttgtgagatcgtgagtatgaaaataacaacaattacttgtttgtgtattaaattgcacggttttattacttcgtgtatttacctttcaaataaaaataattagatattaaacgtccaaataaaaattagttgagattttttttgggttttttccctttttataaatgtatcgtaccgtttgtgttaagcccctagaatctttcacacacacgtctgtagttgggcacagaacaccaaactgaaattcaaaactataaaaagaaaaggaaagattcgagggcctatttcaagaatattaaaattaatataaaccaaagatatgttggatttctccttagaggtttgaggttatctattgggtgaattggtaattattcatagaatattgcaacttgcttataaatttgattacgtgagctgtgattagtccataaatatattatctaatgagacaagaaacctgatgatttattgttatttttttctttttcttttgtcgtaattataaataaaaaaatgattagtgcagaacatacgcgatttttaaaatgaggccggcgcttactatatacatttagtttactccaaccatatattaatgcactctaaactatgcatatattgatatatatcattttagataatcttttggactacatatctcaaaggattaatacaagaacttcagatataatttgactttaacacatataattcgattttgttcatagttcatgacaattattgataagcttggtgactttaacacatatagtttcgaattttgaatgactagtcggctttacacttgagaaatatcagccagtttgtgacaattcatgggttcttataagattttttttagtatgtatcatctttagaaaagaatgttaccacggatttattaacaaggaatgtccgaaaaacaaaaatttcgttccaaacccaacagccacaataggccttactcaaatttcatgtatctcgaaataactctatctggtttgttaacaataatttgcataactgattaataattaaaacgacatataacagagatctatattatgtggttacgttttatatagtatttgcacatgctgcacataatggttatgaatatattatgattaaaagacaacacatattgattgacttttgatttatatatattacatctatgatctatcttcattatataagatatcacgtttctctcggttacatatatatattatgtttgattattgaatgaatataattatataagataactgtctctctgtctgtctgtctgtctgtctgagtggattcgtatactatattgtgatgagagtcaccacaacaaattcgttgacatgagcctttcatatatttttgaattatactgaactaaaacccatttaaaagcccatttaaagacccattataagagtagagatactcagcccatttaaagataaaattacgtcatagcgatttttccattaaaagagtgaggaagagacaaaagtgattgattggtcagaaaaaatg

SEQ ID NO: 2848 - DNA, 3000 bp, Unknown
  misc_feature (1)..( 3000): cDNA_ID_3070208_gDNA_ID_1620608_Annot_ID_161840 3000 nt of promoter + ATG
aagatgatacatactaaaaaaaatcttataagaacccatgaattgtcacaaactggctgatatttctcaagtgtaaagccgactagtcattcaaaattcgaaactatatgtgttaaagtcaccaagcttatcaataattgtcatgaactatgaacaaaatcgaattatatgtgttaaagtcaaattatatctgaagttcttgtattaatcctttgagatatgtagtccaaaagattatctaaaatgatatatatcaatatatgcatagtttagagtgcattaatatatggttggagtaaactaaatgtatatagtaagcgccggcctcattttaaaaatcgcgtatgttctgcactaatcatttttttatttataattacgacaaaagaaaaagaaaaaaataacaataaatcatcaggtttcttgtctcattagataatatatttatggactaatcacagctcacgtaatcaaatttataagcaagttgcaatattctatgaataattaccaattcacccaatagataacctcaaacctctaaggagaaatccaacatatctttggtttatattaattttaatattcttgaaataggccctcgaatctttccttttctttttatagttttgaatttcagtttggtgttctgtgcccaactacagacgtgtgtgtgaaagattctaggggcttaacacaaacggtacgatacatttataaaaagggaaaaaacccaaaaaaaatctcaactaatttttatttggacgtttaatatctaattatttttatttgaaaggtaaatacacgaagtaataaaaccgtgcaatttaatacacaaacaagtaattgttgttattttcatactcacgatctcacaacaaaaataaaatttcaattttacccttaccatctcaattaactattaatttttataatatgatattaaattttataattttgaataaaaaataattttattaatattttagtttatgttaataaatttaatttttattcaaaatcataaaaattaatatcatattatcaaaaaaataatagttaattgagatggtaagggtaaaattggaattttatttttgttgtgagatcgtgaatataaaaataacagcaattaattgtttgtgtattaaattgtacgattttattatttcgtgtatttaccttccaaccaaaaacaattgggtattaaacgtctaaataaaaattaattgaggttttttgggggttttttccctttataaaaataacatagttctttcattctctttttatagaataacactgttctttcttacaacttttgatttacatttttctgtcttttttttctgtcaaaccatagatttccattcattaactttaaagaagggaagttcatacaaattaaagctaagagaatacaagaaaataaaaataaaaatttcatgagttttctaaagaactgtgtacttttaaaagagtttacaagatttaaaaaatctgttgagatcttggcaaattcaaccttgaagacggacttatcgaaatcctcgacttatcgaaatcctcgaccaacgtgtagtcataaacggttctcgcaaacaaagcaaatgaacctttgaaaagatgctctacaggggaggcggacgggtcaaacagttggaataagatatggtaaccatctatcggagaaagggtcataatatcgctccttccacactatcagaggtttgcaaattattcaaacaattgatgttcacatgaatgaacccgataattagcgaatggagagatagagttgaaaaaagctccgctaacccctactctgtagtgacggggtcataatgccagtctttttcactctattggttgtgatagagaatttcagatagggttcatactaaacttaactgttgatctcgacaaaggtaactattagacaaacctaaagaaacggatactctattagcgtgaagttcacgatcagcaaaatcagagctaaagggtgctaaaggaaaataccttgacagaaaattatcgatacttaacacgggcagcaaaactccaagacactttccaagtgagccttaacccaaagcgattcgagatcaaactttcacaattacttttttctcttaaccattattttttaaacaccaagaacatgtcatcaatcagactcaaaaatgctaaacaagattaggataactatggtggaattgtggaagaaacaaactgaacataaaatagtaatggtggttgatataaacaataggcccgatgaaaactacaatagatggaaaataaagggaatatttcattaataaccggactttcggcaaaaatccaactagtccccatttttttgtgtaattttttcttcaatctcttaaaaatacagatcaatcgcacgattattattttttattttgtaggattagcgtatatatttttgggaccctatatttttcttttgtagacaacccttaaaaaaaaaaaagaaaacgcaaacgtcgggtgttttaaaacgagccacatagctttaacttgtgggctatatatatagctttgcacacataagaacgaaacataatgtggcttggcttatctctcagcacaagtgtttcctcttaaactcatccaatagtcctttacgccttcaaatccttcttcattctcccattcacaattccttcatttttaatttttgattcatcctccattttttttttctgaaaaacaagaaaagttcaaaaaaaaaccaaaaaaccaatctcggttttcgtcattgtattcatctttaatggtagaccgtagacacgtattttgaaggtagattttaaataactctgtataatgagaatttcttactttgcgtaattttattgagaatctaatccgatgaatttggtcaatgcaacttatttatctacaatgcagggaattacaaaattttaatactatctcttaccaaaaaattagaaaatagagagaagaaaa

SEQ ID NO: 2849 - DNA, 3000 bp, Unknown
  misc_feature (1)..( 3000): cDNA_ID_3594385_gDNA_ID_1620609_Annot_ID_161844 3000 nt of promoter + ATG
aaactttccacgttaatgattgtgtatgtggctttggcctttggaagttccctctgcattcttcttagagccacgcttcttgtcactgctggttacaagactgctactgaactgtttcataaaatgcatcactgcatattccgttctcctatgtctttctttgattccactccaagtggaagaatcatgagtagagtacgtcgctggccactatccttatttgaggatttccatatatatatctatttggtaatcattgtgttccattttttccttgtataggcttctaccgaccaatccgcagtagatttggaactaccgtatcaatttggatcagttgctatcacagtgattcagcttattggaatcattggagtaatgtctcaagtttcttggctggtttttctcgtcttcatccctgtggttgctgcctccatatggtatcaggtacttttcaataaactttacaatttagtcttccataagagttgttgattctgacaaaattaagtcaagtttatttaagtgatgaagttgtgacaaaaagctttcaactttgcagcggtattacatagctgcagcacgagaactttcgcggttagttggagtatgcaaagctcctctaattcagcatttttctgaaacgatttcaggggcgacaaccattaggagtttcagccaagaatttagattccgttctgacaacatgaggctaagtgatggttactctaggcccaaattctatacagctggagcaatggaatggctttgctttcgccttgatatgttgtcatcacttacatttgtcttttcattggttttcttggtctccatacctactggagtgattgatccaagtctcgcgggattagccgtgacttatggactcagtttgaatactctgcaagcttggctgatttggactctctgtaatcttgagaacaaaatcatatcggtagagaggattcttcaatatgcaagtgttcccagtgaaccacctcttgtgatagaatcaaaccgacctgagcaatcatggccttcacgtggtgaagttgaaatccgtgatcttcaggtatccatatctattatactttactcctatcaaagtttgtgatatagagctcgcacttgttttatattataccttgaccgtttggaatatttggacacattgttaggtccgatatgctccacatatgcctcttgtgttgcgaggaataacatgcacattcaaaggaggtttaagaacaggaattgttggaaggacaggaagcgggaaatcgactttgatacaaactcttttccgcattgtagaaccttcagctggagaaatcaggattgatggagtgaatattttgaccattgggttgcatgacttgcgtttaagactaagcatcataccccaagatccaaccatgtttgaaggaacaatgagaagtaacttggaccctcttgaagagtacacagatgatcaaatctgggaggtgcgtcggtttaaatctctgaaagtcgcacgttcttctttctttaactagtttaaacaatgttcagtcttggctaatgtttgcgcggtgttttaggctcttgacaagtgccaactaggagacgaggtgaggaaaaaagagcaaaagctcgattccagtgtgagcgagaatggagacaattggagtatgggtcagagacaactagtgtgtctcgggagagttcttctcaagagaagcaaaatcttggtgcttgatgaagccactgcttctgttgacactgcaactgacaatctgattcagaaaacgctaagagaacacttctcagactgtacagtgataaccattgcacacaggatatcttcagttattgacagcgacatggttctgcttctaagcaatggtttgtctgaaaaaaatctcaaattcattcgatggaacttgtgtgcatatgaaacattgagaaatgtcttgttgtgttctatttgcagggatcattgaggagtatgatacgccagtgagattactggaggataagtcttcctctttttctaagcttgtggctgagtacacctcaagatctagttccagtttcgattgaagcaaagactctgctattttcctgctgatgatgacgatgaagaaaaacttaggatgtctgaatctggtttagccacaacactagctggattatgattcacacaagaagaaacactatcttttgttaaaagcttttgttcttagtttatagcttctactactgttgaacccctaaaaacgattattctacatcgctagtttcaaatcaatgcaataaaagattgttcacttctgattgaaaatttcagaaacgtttctcaataagtcattattgatttgatgaaagttaaaacaaaaaaccagggatcaaaaacaaaaaacaaaaaaacagagcttgatagactcaaaacagatgaaagtaaaaccgacgcagcatctttgttgaagagcaaaccgggttagtttttattaaatcaagatcacacgggtctatgaacaaaaaccgggacggtttagtaatctctttttgcgtggttgcttggttggtggatgcgataggggtattaatgtaattaactattatctgcctgccacttgctcacgagcgactttggtctgagaaaaacaattttgacggaggaaaggctgcgccttttttctccgcaacttcaccattttcggcttttcgctgccggaggggtttccccattgccagctatgaaccttagttctcattctcaaaatcaccattttactttcactaaacagataactatccttttggtctaccaattttagacgcttctgagcatttacagagacattgactgagtaaggaggagccgtcttatctttcttcatacttgagctcttcccacacgtcacataccggaggcatttttagcgaagtttctagctccaaggttctgtttttgtttgctctagggttttctattatcaggttcttatgatgggtatg

SEQ ID NO: 2850 - DNA, 3000 bp, Unknown
  misc_feature (1)..( 3000): cDNA_ID_3070216_gDNA_ID_1620609_Annot_ID_161856 3000 nt of promoter + ATG
atcatcagtctccaagatttaaactaaatgttctagaacaagataagaatgggaccactaaccagtctaagatctcggtcatccaaatcgcgagtccgaaaaccgatagtcctttcaacataactcatctcattgctcccagacccttttcctttctcattcaaaagatcagcaaaagcaccaccgtactcaattctcatcaatctgactgcagatactgtataggctccacaaacaaaaactgttataagatattgggacaattcaattgcacttaacaatattgatgcaaagacttcaaaagactctttgtactcattaataataattttctaagtactcattaaacgcaacgactctatgtcaacctagatattcagtgtaacactatcactactcaagctagtggtaactaaatcaatggatttactctaccagctctatgtggagaaacttccaaattcagattctgagatttccgcgacggagccaccggacctgaaaaataggaaattttccgagagattgaagacagaaccaggcaaacaacgtcgatactgccattatttttctatttttttaaagaaaccaaaaacagtagagaactattcacctcttctatcaggcgaaaatggttttcgagtcttttgggttcgcttaaacgaccctggagaagctttctgcgtttcagcagacagataaacgcgaaatgagagcaattgcgccatggatgctccactgctggagctagagccaaacctgggaactcttatcgtactttcagaagaaaacactcttttccgccaagagtgttggtttaatgggcctaaaagcccatactttgcagatctcaatttagttcaatttcggcccgtctacttttttttttcctttttttttacatttaacgcaaaggcaaaaacgtaattatctaaaagtcctcttcttccccagttttcctaatttggtaacccttgttgcaggcggctgttgctgatcgggtctctcttctccattttccgattagtaagtgtttattctactcattttgtcaaaatatcacaatgttaatgcaaatttacatatatcaactatcaaaaaggcaatcttttattgaaacgtgttctaagtttgaaaagactaaaactttcactgtgctgctgtaggattaactaggaagtcatgtggttcagaataggcaattcacgtgcaatgacagagataaagtaaaaaaagaaaagtatagaggtacccgtgacctctttcttacacgaacgtgacacgtgagcatgattgtacattagagacgaagctgccctctttcctccttccattacagtgttcttaaggtacaactatgtttctttactttctcttcagggcattgctacttcttaaagttcttcttcccattgacaaacaaagggatcagtgtttttatttcgtcccttcctttgtctgtattcttaagagacaaccaaatcttttttgtttagtaaagtttacgagtgaatggctacttttcataccgttagagatgcggtgaagctctttgacgctggtatttctggaggaaaacatctcaacaaaggacaagaagaggtattgtgccttttgtgtttctttcaccctctgtaacattgtgtgtgttccttggtgtgatataatactgcaatattttctgaaaatttggttattgttgcagggagtgttggtggaggagacaaatctctgtctctggaataaagaggttaacaagttgaaagaaaagataaagaatgctgtgaagaccaagattgaggctttgttagaactggaggaagctaagaaaacggttgagcaactcagtcaggagttgggaattaagcggaacatgattaatgatgagaaagatttagatttgagtagtagtgtaagagttgtgacttcagagctaggtgttgctaaggaatcgattcatagagtagctgaagaggagagtgagctgtgtatgttaatggagtctcttaagctcgagcttcaaaacgtggagaaagcacattcagagcttaaagagattgagcaaagagagagggatcatcaagccattgaagatctgaagaaggaaacaaaagatgcaaaaacccaactctcgttgttagaagaagagctcaagattgctgtttttgaagctcaagaagcaaaagatgcagaggaacacgccagggaacggctaaatgttgcagttttagaatctgatttcagatcattagctgtggtgaaagaaagtgctgctgaagaattaactgagacagaagctttaagagcttgcagagatgaaacactcaagacattagagatgagtgagagagaaattgaagatataaaagctgcaacacaagatgctttgaagaaagctgagatggctcaagaagctacaattgtggtggatgttgagctgaaacgacggcgtaaagcagcgagtaggatcttggcagaatccaaaatgtgtgccaaatctaccaaggaagtgctcaagtcaaaaccaagatcatcgtcaaaagaaggttgcctggtcaagtgttagaagaatcttggtcagagttgtaattgtgaaaatctgtagaacttcaataactagaagaagtgtcactttgttggttgtgttcaaagttggaagatttaataagattgtagtgcgaccatttgtggttttgaatgtatatgtaaacacattcactatcagcattcagcaatcggataactaaacaaaaacaatttgatgatttggagatttggaaatttacagagctaaaagtgaaaaatgccagtgattaataaaagaaaagataattaaggtcggttagtaaaaagacgtaaatataaataaaaggcttgtttttttatttttcactttgttctctctctctctcgtaacacgcctgagagttctcgtcgtccttatctcgatcttggttgattcgctctccgatcggaaattagggcttttgttttctgaag

SEQ ID NO: 2851 - DNA, 3000 bp, Unknown
  misc_feature (1)..( 3000): cDNA_ID_2105500_gDNA_ID_1620609_Annot_ID_161854 3000 nt of promoter + ATG
ttccagtaaaagctgacttcctcttctgcgatctctatcatctaatgatagaaaaaaaaaactcattagtccaaatcataatgaaaaggcttgaaatttattatcttaccattgtatgatttgtcttttgatgagaaatgtctcctctcacgctcttcaagctcatcacgaagatttatcttctggagttcctcttgagtgtgttgcccttccctcctgccaaaacaacaataagtaggagacgtacgtgagtatagagaatccaataaacaacgagacatatgtgcttaaatagaaaccagtatctttcaaatatcaagcacaaataagtccctagaaactattgatcctcaaaaactacaacaagaaaaccggtaagaaataaacaggccacaatactaccgatttcagcaacctaaagacaacgtacacaggccttttctgaatcaccgtatgtcaaaatccctagcacgctattgcaattaaccctagattctggacaatatcatcaatctcagctaaagtttcgatcgaattcacaggtagtctaattcgcgtcggattaaaggaagagaaccagtttcgaaatcttaccttggctttaaagttgtgtgagcggcgacatcacgggacgaatacttctgagatggaccaaagatccgagcaccaccttgctcgttacctcccttagctggagcccaggttggtcgtgctgcagtcgtcatcttcagaaaacaaaagccctaatttccgatcggagagcgaatcaaccaagatcgagataaggacgacgagaactctcaggcgtgttacgagagagagagagaacaaagtgaaaaataaaaaaacaagccttttatttatatttacgtctttttactaaccgaccttaattatcttttcttttattaatcactggcatttttcacttttagctctgtaaatttccaaatctccaaatcatcaaattgtttttgtttagttatccgattgctgaatgctgatagtgaatgtgtttacatatacattcaaaaccacaaatggtcgcactacaatcttattaaatcttccaactttgaacacaaccaacaaagtgacacttcttctagttattgaagttctacagattttcacaattacaactctgaccaagattcttctaacacttgaccaggcaaccttcttttgacgatgatcttggttttgacttgagcacttccttggtagatttggcacacattttggattctgccaagatcctactcgctgctttacgccgtcgtttcagctcaacatccaccacaattgtagcttcttgagccatctcagctttcttcaaagcatcttgtgttgcagcttttatatcttcaatttctctctcactcatctctaatgtcttgagtgtttcatctctgcaagctcttaaagcttctgtctcagttaattcttcagcagcactttctttcaccacagctaatgatctgaaatcagattctaaaactgcaacatttagccgttccctggcgtgttcctctgcatcttttgcttcttgagcttcaaaaacagcaatcttgagctcttcttctaacaacgagagttgggtttttgcatcttttgtttccttcttcagatcttcaatggcttgatgatccctctctctttgctcaatctctttaagctctgaatgtgctttctccacgttttgaagctcgagcttaagagactccattaacatacacagctcactctcctcttcagctactctatgaatcgattccttagcaacacctagctctgaagtcacaactcttacactactactcaaatctaaatctttctcatcattaatcatgttccgcttaattcccaactcctgactgagttgctcaaccgttttcttagcttcctccagttctaacaaagcctcaatcttggtcttcacagcattctttatcttttctttcaacttgttaacctctttattccagagacagagatttgtctcctccaccaacactccctgcaacaataaccaaattttcagaaaatattgcagtattatatcacaccaaggaacacacacaatgttacagagggtgaaagaaacacaaaaggcacaatacctcttcttgtcctttgttgagatgttttcctccagaaataccagcgtcaaagagcttcaccgcatctctaacggtatgaaaagtagccattcactcgtaaactttactaaacaaaaaagatttggttgtctcttaagaatacagacaaaggaagggacgaaataaaaacactgatccctttgtttgtcaatgggaagaagaactttaagaagtagcaatgccctgaagagaaagtaaagaaacatagttgtaccttaagaacactgtaatggaaggaggaaagagggcagcttcgtctctaatgtacaatcatgctcacgtgtcacgttcgtgtaagaaagaggtcacgggtacctctatacttttctttttttactttatctctgtcattgcacgtgaattgcctattctgaaccacatgacttcctagttaatcctacagcagcacagtgaaagttttagtcttttcaaacttagaacacgtttcaataaaagattgcctttttgatagttgatatatgtaaatttgcattaacattgtgatattttgacaaaatgagtagaataaacacttactaatcggaaaatggagaagagagacccgatcagcaacagccgcctgcaacaagggttaccaaattaggaaaactggggaagaagaggacttttagataattacgtttttgcctttgcgttaaatgtaaaaaaaaaggaaaaaaaaaagtagacgggccgaaattgaactaaattgagatctgcaaagtatgggcttttaggcccattaaaccaacactcttggcggaaaagagtgttttcttctgaaagtacgataagagttcccaggtttggctctagctccagcagtggagcatccatg

SEQ ID NO: 2852 - DNA, 3000 bp, Unknown
  misc_feature (1)..( 3000): cDNA_ID_2175278_gDNA_ID_1620609_Annot_ID_161846 3000 nt of promoter + ATG
ttggagtgatgggacaggttgcttggcaggtccttatcgtcttcatccctgtcatcgctgcatgcacctggtatcgggtattcttcataacactgacaaacttagattaaagcttagcttcatacctttgtcttgtatagctcatggaaatcacgataagataatctaggagacttaatgcaatcattgatactacacatactaactttcttgaagttctcactttagtcttgatattgatttaatgtatgtatgcagcaatattacatatctgcggctcgggaactagcaagattatctggaataagcagatcgcctttggtgcagcatttttctgaaacactttcagggataacaactataaggagctttgatcaagaaccaagattccgcactgatatcatgagacttaacgattgttattctcggctgaggttccatgccatttctgcaatggagtggctctgcttccgtcttgatctcttatccactgtggcatttgcgctttcgcttgttatcttagtttctgtgcctgaaggagtcattaatccaagtaggtcaccgccctttaatcattgtatttgttattgtttactttcaagactaaaaatcttccgggtcgttcttggtattttgcttcttaaaggctttgcaggattggcggttacatatgcactcaatctaaatagcctgcaagcaactttaatatggacactttgcgatcttgagaacaaaatgatatccgtggagagaatgcttcaatacatagacatccccagtgaaccatctctcgttattgaatcaactaggcctgagaaatcttggccctgtcgcggagagattactatctgtaatctgcaagtacgatatgggccacatctgcctatggtgctgcgtgggctgacatgcacttttcgaggaggcctgaaaacgggaatcgttggaagaacaggatgtggcaaatccactctaattcaaaccctttttaggattgtggaacctgcagctggagaaatcaggatagatggaataaacatcttgaccattgggctgcatgacctgcgttccagactaagtatcatacctcaagaaccaaccatgtttgaaggcacggttcgcagtaacttggaccctcttgaggaatacgctgatgaccaaatctgggaggttagttggctcttgtttctttcaatgtttctgcagatagaaaaaggaaggttctcacacgatttttgttgctctgatttcaggcactcgacaagtgtcaacttggggatgaaataaggaagaaagaactaaagctagattcccctggttagtacggctaaaactatagtcgacaagagtcatctcgaatctgttaaaacacatctaatgaaaggaatctctaatattgcagtaagtgagaatggacagaactggagtgttggtcagagacaactggtgtgtcttggacgagtcttgctaaagagaagcaaagtattgattcttgatgaagccacagcttctgtagatacagcgactgatactctgatacaggaaacactgagacaacatttctcgggctgtacagtaataacaatcgcacacagaatatcatctgttatagacagtgatatggtactgctcctagaccaaggtaatgatcatacacttttttaatacgtttgttctatcagaaggaaggcttagatgaagattggttatgtatctaaaaatgcagggttaatagaagaacacgattcaccggcgagattgctggaagacaagtcctcgtcattttcaaagcttgtggcagagtacacagcaagttcggattcaagattcaaaagaagttcaatgaaaacaaactagttataataaaattaataatcttgccttgtcgtgtttgtttcagaaagaaaacagtaataatttgtaagaaatagtatttgtttgttttctctctgatgaggaacgaattacattatcagtttacaacacgttttggtctctatttctctcttttacaattttttttaaatcacaggcatgacattttaggatctcagggaacttcacgatgaaactcttttccatcttaaggtgagaaattagattcaccgcctgaccgtattgtcaaagtgagctggttgctgtgatctatttggtgggaaaaatgaagaatttaccatttgccagcactcaggggtacgtatattgttaccatcagtaagtatcatctgtttctgttacaacatgtttgtgatttttctaactcaaaattttgatggatctgcttctacacatctgtctatgttctcagaatggtccactgtttgcatcagtggagtttcagaagggagtcttttaacattattaaactcttcatgttttgttggttaatggttacggcgtcatcgtatatatatataattttctcttttgttcttttgtcttggtggtctgcgaaagtaatattatttattgactcagtagcctatatatatatagatatatcttgtcctcagagtgaacattttggtcaacactcagttcctgatggaaaatcctatcgattctcttctcctccagcccatctacctttcggtactttcgtttttcttgaatctggtgttgttgctaattctttttggttcatggcttttcaaaaagagagtagcttgtgaagatactgatgctatcatgaatgaagagtttaaacacatatctttctcgtataataaactggttcttatttgttgtgtctcattatctgtgttttattctgtgctttcgttgctaagttgccttcactggcatacaaatggttggcctttcttagatcttctgttggctgcccttacttggggttccatctctgtttacctgtttggtcgatacactaattcttgtgagcaaaaagtactatttttgcttagagtttggtgggttttctttttcgtggtttcttgctaccatcttgtggtagactttgttctatacaagaagcaagaaatg

SEQ ID NO: 2853 - DNA, 3000 bp, Unknown
  misc_feature (1)..( 3000): cDNA_ID_3070222_gDNA_ID_1620609_Annot_ID_161847 3000 nt of promoter + ATG
tgcttttttttttcacagcattactgaaatcatacataatttctgcttccataatcttatattttacgagatcggttttatgataaactttcaagtagtaccattatgggttgtattttcttttactaccattttgggtttattgcaatttgcataaacatattcaaaactattttgcgttcaaccaaatggttaaactctggttcatattgatataccaaaacactcatattggatcaaatatgtaaggtgataataacactgatatgaactagtatactatgtcttatgagtcactattttctctaactttaataaaagtttagctgtgattcattattcgtgattatggtatcctcatatcagaattgctttgttctaattcagtcttattgttcactaatcctgatcgaaaatacatggccacattagaagcatcaaacaaacagggttttatgttttccacactcgaagagacaatattttcaacggctgaaactgaaaggaaacaaaatataattttaagacaaaaaaaaaagaaaagaaaacatatatttcttcttttggttgtagtattttgagacctcactgattgtcggaaaataattggaggggttcccactgattttgaatttctgtaataccaattgtttgttttattagaaaacaacaccttcaatttgtattttccccttgttgtttgggatggcagttacttaaataaaatatttatctaaaacccatcgaagaaattgattctaaacataacaaatagttattttttttcacacaatctcacttggatatagtttattaagtcgctggtagtcaaatatcttcgttttaacatataagctttttattatgttaattttttggttttcacatcatatgattatgttaattgataaagctatttaattgatcagaaagagcgagagccacatgataaattcaagtgactttggcttgaaaataggacgatggcttcacggatctatagactaactaagtcatctgtcattacatacgtcacgtttatttcattttataattacaaaaacaccaaagttaaatcaaattattctttgtttttgtcaactgatttgatattgataaatttgttgaaattaagtatatagtacacacgggagtgactaaaaaaaaaaaaaaaaaaagagaaactaaagccgatatgcaatgaataaatactcggaatcaaaaacgggaggaacacaaaaaattattggagtctaagccatatagaaaaaaaaaagatattaaaaccacaaagcataaaactcaaagcaaaatgaaaaaaaaacatatattcttacctaaaaatataagcaactaggcatatataaaccttactaaacaacactagttaagtcaaattagtcttaaattgatttatgaaaggtctattatacacgtctaacaaaaagggtttatatatctcgaaggtggcaatgaaatatatagttcttgtgttgaacaaaggtaatgaaatatttaaaattaaatttcacttgtatgggattgcacttgctcgtattcacgtcatagtgaattgtgataatatattcttttttttcttttcattgtgataattttattttttagtcgttatagtttgttgttttggtatatacaaaaaagaatgaacaacaaaaaagtgggttgatggtaaccaaaaaaaagtaggtgtcacaaaaaagaacatgtgatagatgagcctcactcccgaaaagaagatgtacacaaaaactctgaccacaatttaaaatgataataaacatgtgttttttaaaattcttttaccaaacaagtgctactttattacgacagtcgacatatatgtccttttaatttttgttaattcaatcgcacgagaattaaaacaatgattcgatttgctatgccattttttttcaaaaataaattacacacatttttctaaattaaatcccaaagaaaatataaacaaatcttattatataaattatggttttcaaagttactaactcatacgattataccacgtgtcaagtctatcgatcagatgttgatacgtgtaagaaaataattaacttttttcttttaaaaaaaatagaaatactaaaaaagaaatcaattaacttttttcttcttaaagaattagataactaaaaaataaatcattattaacatatactaattcatatgactatatctaaaaaagattacattttatttttcttaaccaaaaggataattaacaaaaaaaatatatatatgttattggtcaaatttttaatatatatggtattaacaaaatttgtattattattaattatgttttgttaattgttaataatttttaatattaactaagatatagatttgatctcatataaatattattttgacatgaaattattatcaagtaagatgaagtgtgtagaattaaaatcgagttttttatgaaatagatagttaaaatgtattacaaaattgaatgtgtaagataaaaatttgtttttttattctaaatactaaattataataaagaaaaaatgtgtatgttactatttagacttcaaatatcatcaataagattgaatgagtataataaaataaaatgcataaaactactattttactattcaaaattatatatcaaaacaatatataaattattattttactattcaaaatttaaatattattgataaaaaattatatttacatcttacacctgaccttatctagtttcttatataagttgcaataaaaataccaacagattcataactttttttggcacccagtctctccactcctagtggccactagtgttcacacacagtcaaaaaattttaatacaaaaaaaattaggaatcgaattcaaaaaggaaagaaatctaaagaagaagacagagagagaaacaatctccaaaatacataaatttgttcacatccttccgttttttgtttggccgagaaaaaaaaaaaatg

SEQ ID NO: 2854 - DNA, 3000 bp, Unknown
  misc_feature (1)..( 3000): cDNA_ID_2175293_gDNA_ID_1620609_Annot_ID_161850 3000 nt of promoter + ATG
cttcatgactaaatcgctttcatccatggtttatagtattccagcgtttagcaaatgacatgttttgcaagacgaaccgctgcattgttatcacagtaagaaatctgcttcattcttactgatttcagttttgactagttttcatttccattttatgtttgacatcaaagttacgattgtttttggcagggaagaggatatccagatgtctcaacaagaaggtacataacttaatcccaggttcctggaatactattttatcagacattatcttctattgattaatatatcagcgaataacacagattctttccaggttcttgcgactcctgatggagaagttgcatctacctgtgcattgtctagtcgactgtgatccatatggctttgagatcctagccacataccgttttggctccatggttagattctgttacaaaatatagatgactgaactcggaaaatttcaccgcttgcattgtttttgttgatagtgataatgtgatatggcactgacccatttcattttgaaccattttccttatgtcacttgttttctttctgtaagcaaatggcctatgatattgaatcattacgagcaccagatatgaaatggttgggagcttttccttcagactctgaggtatatagtgttcccaaacagtgtcttttgccactgacagaagaaggtaagagatcattaaacaccttatcgccttaaatctttagattttcctatttttcactgcttccttttttgagattgtaacaacttccccggacagataagaaaagaactgaagcaatgttgcttagatgctacctgaagcgtgaaatgccacaatggaggtatgaaaaacttccctgacttttttatatttacatttcaaccaaatgacaaaaactagtcttgatcaaaacgattttggtcgtctaaggttggaacttgaaacgatgttgaaaagaggggtcaagtttgagatcgaagcactctcagttcactcactgtcctttttgtcagaggtatatattccttctaagattcgtcgtgaagtaagctctccttgagcttcatacgagataactagtctccaactcaaggtaatgctcattgttttttttatgactctttctaagctttttagtgcaaaccaaatgcattggtagaatggacaaatgaacatagttttaatggaaaaatcataaatatacagattataaaaaataattctcagtttttaatttttaataatacaaagtacattcactaatgactaatgagtaataagtttgaaattttgaataatacaaaagtaatttagggttcatttgctttatattgttaccaaacctaatttgaagtattaaagccgttcccctgactaaaaacctttgaacactccgatccaaaaaaaagaagagaaaaacctttgcatacagctaaaaacgatgtcgtctctctctcgctttctccttcgtggcaacttcagcttcagcacccacacgaatcgccgcttcttctccgccgttaccgctgctgcagccacaccctcgccacccaaaccgtccctcatcaccctcgtaaatgacgaacgcgaccccaaattcatcacggagaagttcaagaaagcctgccaagcagagtggttccggaagaatatagctgtctatgagagaaccgttcgccgtctcgccgcagccaagaagtttgagtgggtcgaggagatcctggaggagcagaacaagtatccaaacatgtcaaaggaaggattcgtggcgaggattatcaatctctatggacgagtcggtatgtttgagaatgcacagaaagtgttcgacgaaatgcctgagagaaactgcaagagaacagcgttgtctttcaacgcattactgaatgcctgtgtgaactccaagaagtttgatttggttgaaggtatcttcaaggagttgccaggtaagctctcgattgaaccagatgttgcatcttacaatactttgatcaagggattgtgtggaaagggttccttcactgaagctgttgcgttgattgatgagattgagaacaagggtttgaaacctgatcatatcaccttcaatatacttttacatgagtcgtatacaaaagggaagtttgaggaaggagaacagatatgggctagaatggtagagaagaatgttaagcgagacatccgtagttacaatgctcggttgttaggactagccatggagaataaatcagaagagatggttagtctctttgacaaacttaagggtaatgagctcaaacctgatgttttcacattcactgccatgattaaaggatttgtcagtgaaggaaaattagatgaagccataacgtggtacaaggaaatcgagaagaatggttgtcgcccgttgaaatttgtctttaactcattgcttcctgcaatatgtaaggcgggcgatttagagtctgcttatgagctctgcaaggaaatatttgctaagcgtctgctagtcgatgaggctgtcctgcaggaggtagttgatgcattggtgaaagggtccaagcaagacgaagctgaagagattgtcgagctagcaaagacgaatgactatttgcagtgcaagcttcgtctctttcccaaagagtagttaattggcaaggcttattgactagtttttaatttagtctgtgtttccctctttttaatgtcttgttgcaaactgcgagtgcggtgatttaataattgaactatctctatctgtagtgtgtttgtgttgctttcaattctcaaagttaaaagaaattttcttatttccttttctggttagagaacggcatgaatttaagatttagacacaaaaaacgctgcgtagtccaggagtagaaacggcacgctgttttattttgtttttcgcattcactgcataagacctagccggaggagcactcttaagtccaaaaccctaaaccctcacactcaactctgacattttcaccacctgcacgaagctatg

SEQ ID NO: 2855 - DNA, 3000 bp, Unknown
  misc_feature (1)..( 3000): cDNA_ID_2175274_gDNA_ID_1620609_Annot_ID_161845 3000 nt of promoter + ATG
ctaaaaatctcccacgcctttctcggtattttgcttcttaaaggcttagcaggactggcgattacatatgcactcaatctaaataccctgcaagcaactttaatatggacgctttgtgatctcgagaacaaaatgatatctgtggagagaatgcttcaatacacaaacatccccagtgaaccacctcttgtgattgaaacaactcggcctgagaaatcatggccttctcgtggagagattactatctgtaatctgcaagtacgatatgggccacatttgcccatggtgctgcatggactgacatgcacttttccaggaggcctgaaaaccggaatcgttggaagaacaggatgtggcaaatccactctaattcaaaccctttttaggattgtggaacctgcagcgggagaaatcaggatagatgggataaacatcttgtccattgggctgcatgaccttcgttctagactaagtatcatacctcaagatccaaccatgtttgaaggcacgattcgtagtaacttggaccctcttgaggaatacactgatgaccaaatctgggaggtttgttggctcttgtttctttccatgtttctgcagataacaaaaggaaggttctcacacgattttctcgtcctcttttcaggcactcgacaattgtcaacttggggacgaagtaaggaagaaagaactaaagctggattcccctggttagtgttaataaaactattgtttacaagagtcatcttgaatctggttatcacatctaatgaaatgaatctcttatattttagttagtgagaatggacagaactggagtgttggtcagagacaattggtgtgcctgggacgagtcttgctcaagagaagcaaattactggttcttgatgaagccacagcttctatcgataccgctactgataatctgatccaggagactctgaggcaccactttgcggattgtacagtgataacaatcgcacatagaatatcttctgtgatagacagcgatatggtcctgctcctagaccaaggttgtgaatctgattatacacttctatttacgcttttataactagaagacttatattaaatctgttttatgtatcctaaatgcaggtcttatcaaagaacatgattcaccggcgagattgctagaagacaggtcgtcattattctcaaagcttgtggcagagtacacaacaagttctgaatccaaatccaaaagaagctgatagaatcaaagatccataaaaaaatgggaccaaacaagtttgtttatcgtctagcctttgtcgtgtttctatgtaatttgtgatctgacgtttgtgcttgactttgtaagctgatgaaacttccatgaaaatggcataattgaagtggaaaaataaagtatggacaaagacttgtcaaaagaaagaaaaaagtagacttggcctttctagtccagtagctatgaccacatacatgcatacaaggctccaatatcgtgatagacttaacggctaatggaatgataacatgattattagaatatgaatttgaatgcggaccatattattattaaatcatagttacaaaaagtaatattatgagatgagaatgatgttgtgggacacagccgttgactgacaagatacagagacttatcatttccttgcagcccaatcctctatgaatcttcttgatttccttcccaagaaatttttgcactgtgacaacttcccaaatattccaaactttatagtagtttatttttccatttaccaaaatatcttaacccaaaaaatatgataacttagttgttgggttatgcgttgttatttattacgttaaagaaatgtatacatttgttaaatggtttcacgttcacctcttgagtggattagagaagatttgtttttagtatttgtgatttgttttgtagaatatgaatcaaactgaataacgagtcgaaggaaatctaacgcacggatattggtaaggttcgtctatgtaatgtattagtgtgtcagattttcaacaaagaaaagaaaaacagattcatgtgagatagaaaaaagtgacataaagtgaaactgaagcttataatatgtactaatatcttaaatttacaaccacaagctaagaagacaactttagttaaaggtaattcgtacgtcatcagagagacatggaggatactagttgaaaagtcagcaattgctttggagaaaaaggagttctatcccctatcttctgcaatgagagacatataaaaataaagaaatttcttttaataaagcttaacaaatcgattttctcttcttttttaatacaaaaacaactaaatcgaattgaacagctccaaaatacaatttttgatataatgagaagatcaaatagaagtaaaatacaatttttcaactcaaaatacttggagaggtgtagaagaaaaatacattattatatgaagaatgaaaaatacggataaaacaacaagagttctaaaggtactattagtaggtgccaactttgtttttatttttgcttcttcaaaattcaattaaatcaattcgtatcaataacttggcaacaaatcagctcgtcttaagaataggaaaaaaaacatagtaacaaaaacagagagatattaaaagaatatccttttttggctaaaaaacagtaatcaaagtttgtttttttttcaacattttaatgaattgaaaaaatagattgtcaaagacccgtgaaagaggtaaaatacaaagtgttaccaaagtgctctggtggggtttgagaggagaggaacggagcgttgtctctttctccttcttcttcctcttggcttcgtgagcgtgctctccaagatatactgtctccatcatcactccactctccttctataagtattctcctcctccaaaactcgcctccatatttatttaattacaaacctttttctcaaatcattggaaaacagagagaatagagagagagaacagagagctcaaagccatg

SEQ ID NO: 2856 - DNA, 3000 bp, Unknown
  misc_feature (1)..( 3000): cDNA_ID_2105221_gDNA_ID_1620610_Annot_ID_161871 3000 nt of promoter + ATG
gatatacactaaaaatagattttcatattaaattagaataataaatttcaaataagtaaaatttattggtcaacaaaatagacaaaatcgtagtttaatatacgagttgcggctgatatgtaggattttcgaattgaacatgtcaatatatacaaatcatggaaaaatacgagagatgattaatcaaatgcgggtttgcacgatttttacatggaccttgttaagatattgataggtaaatctagtcaatcacaatttttcaaaagttgacgcatagtttcccactttcccacttaggtcacggatgcaaattaacaaaaattaacttaaatgttaagacatgacagtaatattagactattagtacaagctactcttctagtactaatagtaaacataaagcgaagatgtcactaaaaaactcataagatgacatagaaaaagcagagattggagaaggatgttaatggagttaacatcatcaacgctatttccaactcgctgtgttcatcaagttgttgaatgatgagataggaatatgaaaagggagaagcattgtgttgaggttttacgatgctccaaggatttcacttactcctgtgtttgctcagttgaaacctcaaaaccaggcggtataaacacaatgtcgtcccagtttgacgtcgtgctttcctgcaatttcgcccgggaaaacaggttcagcaaaaccaatcattcttaaaggaaaatgcattacagaatcatgtttgattgtttaccctcattcccttgacaatatcttcgaaaactgcaacctttggaatacaaaatcatgaatttcaatatgagatgacagaattatggattgacaagaaatagggagactaaagttaaataacaaggaacctgaatatcgcctggtttcagagcagggttaagtcggttctgttggctggacgctcgtattagagatttttccaagtcctcctgtcaaaactcaaccaagactcaagcttgccgatcatgtaatcagtgtatggacaaaggtgaactgtgtcttgttagtttaactaacctttctaaagaaaacagggcgataactcatgttttcacttcgtagaatcaagctctttgactgagacaacacaagtcagatcgttaagaaaattggacattaaggaaaacatgtctcgaccattttaaggaagaaataatgattattacgattccatggtagataaatatccgaaactatattacagaccactagatagagtaaaaacgaaaaagctagtcacaaccattaaaagtattggttctttcgcatattacctggaaaaccggaacaccatggaagtcatcatcatcgataccagctgttttcctttcctgtatacacatatagaagagatatataatttacttgtactgtgtctaaccaaatgctacagtctgttttcagaaacataatcgtacatctaggaaggattacatccataagacctataccctgcaaattaacccgaccacctttgagtaaaaatgtaccaaaactgaatgcaattagtgtactcctaaagaaaaccaactgttgacgcagaaaaggtattctctctttatttactcactctctgaatccacatacagaactgagaacaaaccaaatcaaagcaccaatgatgaattctaaagcaccctcaactctcctaagcccaaaccaatgctagaccaatccagaatcccttctccatctgcatcaacttccttctaatcagttacctctctaactaactgacttatctatagtcgctgaaacagagctacaataaaccactgaagtaatcaaaatgcccctgaactaaattaacacaaaagctcctcgttaatgaatgatgacagtcatattcagcaggtctaacgcctaccgtgacaaaaagaaaagtttttgagtatccaaagatatgttcgatcgtaaaatcaactcaccttcaaggcatttttcacttgagtagactcaggaatcaacctaaatgccacaccattaacttttaactggaacacctgcaacaaacaacacacacaaaaatcaaaaccactaaacagaagaatactaaaggagctaattgagttattgattcctccttataccttgctaagagcaagagcaacaacttttgaaccttctttcctcatacgaggatccatactcttcatctctttaagaagagtctctgcatcttcctctttacaaaacaacaaacccagagatttcccagaggaagtccctgaaaccaacacaaactcctcattcgaattactcaacgcgtaaacaggaactcccgccaatctctcctcaatagcatcagcagataatcctttcccgcttccgcgaatcggaaccgtcacctgagccctcgcaccaccaccgtcgtcagaaattctcgcccagacaggtgccttaccagaattgaatcgagagattctagaatctaaagcttgcttagcttgatcacgaaacgaattgagagcagagaatatattaggtttgttgttgttcgtgttggcgttgaagagaggattaagggtttgtgaaacgttgaggagtaaattggagcattgagattggagatttgagaaggattgttgtatattattaagctcgttttgttgtttcgatggtgggaaaatgtttgaattcatagttttctcgggaaaatgatgcttgagactctgagaaagagtagtgaagggtttttgaaaggctttgcgaagaagacgacgacactgaggaaaaagatttgatctctttgcttgaattagaattgtttttgtaaagaaaccctctaattatccaatgtttacaaattgatcctatatgttttaaaatatagcacctgtgagctgacaaatgccacgtcaccttcatctccagtctctcactttcttatccaaaatggcaaaatccattaaccatcattaccttcaatctccgtggcttttttgctctaccgcgcaacaatg

SEQ ID NO: 2857 - DNA, 3000 bp, Unknown
  misc_feature (1)..( 3000): cDNA_ID_3070251_gDNA_ID_1620610_Annot_ID_161883 3000 nt of promoter + ATG
ttaagaagccttaaggttgattatttttccctttcagaaacatctagagaatggagagagactatttagtcgtttggatggataaagcactactttataaggaagaaaagtgaataatatctcgacagatcattggtggtctctggaatggaaatgaaaaaataattaatgtgtaaggtaagcaccagtaaattcagtattccaagtgtagtgacatcatccaacaacagttaaggctcaagcactaagaagattatgtaatagattgttattctcctacactatagagttcgaaagtgttctatataatcaactgcataccttgatccgcaacaagccatcgacaggagttatcagcaaaaagtgcaatcttctcgtctgctttcactccaacgactcgtaaaccctcaacaaagtccaagatttcttgttccaactgcaaaataagatgattgaaatgaaaggttccattactcatccaaatttagcatcactgtaaacttcaaaagtaattacccacctatctagcaacaggaagtatttcaggcagataactgaaacaacattggttcctaacatatagattaacacagcaaataccaagggacatgcctgacaataatcataaggaaatatcaatttagtatgcttcctaacattcgaatatggttcatcttcagcaccctctagctaccttcttattgacaagcagttaagatatgtagatacaaaactaatcgataaagaaaaaaagctgatggccaatcaatcttaactcttaaacttcagttttttccctaagttctgtcatttgctttaaaaacctctatttcaaaagtgtggggatctaaaataatagcaatgagatgcgaagtagtgttacctgtctgtacgtgaatgtagaaggcgggtcatgatacggatctaccaccgcaactctgtcaccgtacttctccacagatgatctccaaatatcaggaacagacttccattcattagagctcaaagcagcctcccttggcaatgataagcgttctaagaatggcgaacaccgccttaactccttctcctgaatctataagaacggtacacaattgatgttacatataattcaggaaatgaaccataaggtaaacttacaagaaccctataaaagcctttcaggatcaagctgtttaaaccctggtcatcagaagcaattcagctttcataagacaagtatcctaaactaataagactcagaagtcagagccactcgttgtctattttggtgcaacagctaaacttgaaccttccccaaagtcaattcatttctttagattacttacttcaaaaatcaaagtgaaaggagcaattttttaagtccacaaaccaaaaaggaactcgccttggattcgcagcgaactcgaaatcccctgcgtgaagttctgcagccaaaagccttgtaaccaaacaccaatctcatcccagaaacttgaaattcaggagctgaggagcagtgagaaacgagaatcgaagctccgagagacgttgaagccatggctgaggagataagaggttatcgtgatgaagttgcttgcatagagagaatatatgagaggagaaagagagaaagatgaagaagcaaagaaaggtagaaagaaagagacgagaaagtaggtcgatgtcatgattacgatttttcacaggaaagatcagttccaagttggttggcaccgctacagaagcatggcttcttcagactctcagagataataaaacaaaaaacagagctcaatacttacacttatataataactttttatttacttatatattatatttctataattagatcagatttaacctaataaatcaaactacccataattatgatgtcccaaatttggtaactatttgatgattatttctaaactgtaggagcaaccccaactttgtatcttagctaatttttaggtataaaagtgattaaatttaatgaaaccaataaactttagctaagataaacatctttattaagcctctccgtcactcaccaaaaaaaaaaacatctttattttattttttttggttaaacaaaaacatctttattaagatattttcttaaaactaagaaaagcatatgtgttgtgttttgagtgggtagacattgtgttgaaatagtttgttgtttcttaaaattctaatcgttcttaaccattgaagtagaaattggttaaacttcttcctaacttttcttaacttagtaaaaacaacattttaatttaaaataagcttaagatccaaaattaaaaattaattgattttaaaccattgggattgctctgagcttttttagtgaattatgtgttgttttttttctttgtgttttggtcaaaattaagttatatatgaaatttattaaaccaaacaaccaaatcgaattagatgtaaaaaccaaaatgtagatgttacaaattttggaaaaaaaaaaagatgttacaaattttatgtcatgtgaacttctaaatatatttccttttcactttaaaataaaaataaaataaaacttaaacataaaaatatagataccaaagagcaaaatttaataatattgtctactagtactagtgacgtcaatttcttcacttctctttgactgcttcgcttaaccactgaaaaagtgtgccaagggttttctacgtcgaatctctccgcattctcagcgattttccggcgacgtttactctgcactcctccgacaccgccgttttactccatcgtgccagctttaagcaatcaaggtacctattttaggtaatacgctttgattctgcttttaagcatcggagaatatgttatggagaatgattcggttctaagggaaagttgttgatttcgtgtttgtattcgcatgattgcattttcgtggttcatgattttcacagctttttaatcaatttctctgtctttgtttagggtttttgttcgtacagtgtgttttgaggtatgccagatatg

SEQ ID NO: 2858 - DNA, 3000 bp, Unknown
  misc_feature (1)..( 3000): cDNA_ID_2175252_gDNA_ID_1620610_Annot_ID_161885 3000 nt of promoter + ATG
cacttacattgatcaaagtcagcctggcatatacggaaatgaaaagagtttatgaggtttgtgaaccagataatgccctctttagtgtttcatgctacctaataatttggtttaaatgagttttttctgcttgttcatatttctgatgcttggagtcgtcataagtactttgctctgctgttgcagggtctttgtttgacaaaaaatcaaaagcctccaatgtatattgtttcgttggtggattggttgtgggcgagagtagttgcatttttcctatggccattgcatatgttggctgaaaagcttgtacacagaaaaattcgttcgtctattgggataacaaaggtagtattacaacattctacttcattttcagttacttgttttaaaatttttttaccttacaagcaatattgtaagactgacttgcaatctattctctgtttcctccaggctggtgttagtggaggtggtagtttacctatgcatgttgacaagttttttgaggttagaccgccaatattgtttcttgaaattagagataaatgtttttttttgcattcaaacaaagtagtctgtccatatgtaaacaggttagttctttatgcaggccatcggtgtgaatgtacaaaatgggtatggtttgacagaaacctcaccggttgtctctgcgcggaggcttaggtgtaacgtaagtttaaactcacacctcaataacctctccttttgtgacctctgcacagaaaaactgtttagatcttattcatcaattttcctaactttttttatgaaggttcttggctcagttgggcatcctattaaagatacagagttcaaaattgtagatcatgagactggtactgttcttccacctggttcaaagggcattgtcaaagtcagaggcccaccggtgatgaaaggttactacaaggtgatacacactttctgctcttagtttgattacattttgacgacaaagttgtgaaaggatgacacagctgtttttagctatcaaattttctgtccatgagtgggtttgtttgtgaatactgcccttatatataactagattatgtgaactcttttccttcttggtctcatcattaaagcatctcttggaatctacatttcttgcaatctatttcccttttgatacatatgtagactccttgaataatctctgtgttttcgatgaatgcttttagtttggtgattagatcagattaactcatctttctgttgattatctcagaatccactggccaccaagcaggttatagatgacgatggatggttcaatactggagatatgggttggattactcctcagcactcaacaggacggagtcgtagctgtggaggtgtcatcgttcttgaagggcgtgccaaggacactatcgtgctttccacaggtatatcacatttgtactgtttgttgtcagcgtccacataaaccagttcctcggaaacctgaaacaaaattatgtttcctactgtctgtatgataagcatacattttaaacactacaagtcttaacaacaaaatgtgcctctcaagttaaagatgaatccaagtgaattgtaaccgccttgctgcacaaatattgctaagaatatttgatagcagtttaattgttgtaggtgaaaatgtggaaccattggagattgaagaagcggccatgagaagcaatttgattcaacaaatagtggttattggacaggtacttgtttggagactttggtttaggaacaatggtatgggctgtttcacttaattaatcttcgatttggatgcgtccttgatcttttgttctcaggatcaacgccgccttggagctattgttatcccaaacaaagaagcagcagaaggagcagcaaagcagaaaatttcacctgtagattctgaagtcaatgaacttagcaaggagacgataacaagcatggtctatgaagaactaaggaaatggtaatgattcaaaccaagtgtgatcccactctaatataagagtaaactttacctaatcaggcaattactcatatatacaccatatgatgcaggacgtcacaatgctcgttccaagttggaccagttctgatcgtggatgaaccattcacggtaggttcttttattcgctctcactgataatcctttaatatgcaactcaaagatttgaacctcatgtgaacgttctatgaatatcgttacagatagacaacggtttaatgacaccgacaatgaaaataagacgggacaaggtggttgatcaatacaagaatgaaatagaaagactctacaagtagactagaaattttagcatcctctttattttacaattatcttgttaaggattagcaaatgtgaaccagttcttactccattgttaatataagctgcatatatctttgttcatcaactagggatttccaagttctgcagcactatggatacttattgagtctaatagaatcaataattggaagaagcagttaaaccggtcaaaagacctaagtatgttggagggtttgagatatcttgacattctgtgtttagaggaaggctagatgttgatacaatattgtataatttgcataattatattatccgttcaatccaaaagcatttaagtgcgatgtaaagtgatggttttttctagtttatgttaaaacaaatgattagtctcactctctagtcgatagaatattgcaacttgtttataaatttgattaggtgagctatgattagtagtgcataaatacattatctatgagacaaagaaacgtgataggttattgttttttcttgtttgcgtctggcatatgtatgtataaaaccaaatatcaagcagaacatatgcgattttcaaaatgtgggcggtgctgaaaacatatattagtttactccaacttgcagaatatttgagtatattaatgcaaaaacagtaaacgcaagagcaggtgcattactagctaagacagcttggttgagagatagagacgaaa

SEQ ID NO: 2859 - DNA, 3000 bp, Unknown
  misc_feature (1)..( 3000): cDNA_ID_2105199_gDNA_ID_1620610_Annot_ID_161887 3000 nt of promoter + ATG
ctttcactgacaaattttaaaaagaaaactaaaagtatcgatttgtaaagagtgaaaatcaacctattctattcatggcttcatgcaataaacatcttcatggatgttttatcagttgggtatcgtttattttttatctatttaagtaggcccaaattttgagtagaccaataataacccattaatggcccatagttctaaaaatgaaattaatcgatggttgcttttatgcatgttgatatgtataagtgtataaccatgatccaaatatactgctttctaaacgcatgccttcaacaatatattaccatgttcgaggctgctccatttgttatcttcttaaatccgatacttctttagaatacatttttatcagtttgaagcgcgttattaataacatgtatatagaaaatgtactgcactaaacaattgacattctgtttacaaatatttttaaatagaagacaattgacattttaactagaaaacgaaaagaatattgaaaacgaaaagtcttaagtgagtatacttttggtaactttctttttgaagtatatagtttgtgtggagtataatcacgtttaaaagaaacttttgggaatgtggtagttgagacttgagagattgagaactattctcaccgacccacaaagtgccaaagttattttggaatcaggtttaccaatgccaattatggagcttcataatgagtggcgtggcccttcaatttctacacacacaaaaaatagacgccgtgtcacttataaccaaatatctgtcgacattgtgacgttcactaatgtttgaactttattcctacttttattttttcgtttcttggtaagaattgatatgtgatgtacactttatttgttggttgagaattgattttcctaagccaatttttgttcttacatcaaatacaatgtatatatctattcgactattacaaaagtacttatgtatgagaggtttggactagtgtcccaccacaaaactcataaattagctttagccacatgctgagctaaaataattttattagggtaagaaaactagaccataatttttactcaaacaataatataaattagatcaactaatgtacctatactagttatatatctctgcaagatatcaaaggaacaaattgacatggctcgtgtacttgcaacgtctcatttcttgtttaaaatactccaaatatttaggaaacacaaaaaaaaggatatttaatgagttcaccttattttgcattcgtttattattggtgttttttttgttggtagggtattaattcagatccaccgacgcccttccacgatccagtgcaccgacgttcatattttttcttggctcaagaagaataaggtggtacattcaataataactaatgtttaaacacacacacacacaaaactatcggtgtgaaacagagataatggaagaacgacactattggcccagacgaataagaattaagatctatcggtctgaatgtgtgatgtgtgaaggcttgctagtgcaccaaagttctaaccttcttaaccttatcatgtaaaaatcacgtctctgatctatctgcatcataatattaatgtgtttttatcttgcatgccatttgacaaatcacctgttagatgtcataatatatacttcaatgttgttttacgaaaacaagttttccctaaatctttagtagtacgaataacgtgttggttatagtttcctcgtaaaacttgatcttccaaagacttatgaaccttcgactttttgttgccttaaaatagcaacaagtttccttaaattgcaggaaccactagagcttcagaaatttcatggaattgcaaacagttatataaatttccaactgataattgcaaccatttgaaggcaaataattatttgctcatcttaatttatcgtttttttcacatataactttgaattttttctatttttttggtttatatacttcgaaaatctaagatgaagaaacaatgtcatcaagataatgtaaaagaaaaagcttggaacaaaagcaatatgtgtttcacaattcacataacacttaagcatgatcatagttcggtcatgatctaattacatatcactttttttttcttttgtaaaatcgatgattctatatcaaaatatagggaatttttgaaaaaagttttttttttaaattatgcctataatatacttattgaaaagtaattttgagacaattttttttgtcacaaatctgtgatatttagatactatattatgactaaaataactcacaaattcatagtaatttcatcactatatttgtgacgaaaaggatcataacaaaatttgtcacatttagtgacgaacatccgatgataactaacactgtcaccaatgtcttgttacaaattagttacgaacttgtaacgaatatgaaaattgcaatttgtgatataagaatgagttaacattagtcacaaattaatatcaattgttttatgtattatacaaaagaccgtttttggtaatgataatatgttggccaaatgattttaaaatatattggccaagattaaaaccaaagatatgagtactttagaaaaatttgtacgtattaaaaaaaaaacaattgatgataaaataacacaaaactgttttagttttatttgcatatgataatatcagatttgtgtaaaaaaattttatacatctgaaacagaatttttcttcatgttcccctttttttgcaaaataattagtatcaataattattgattgtatgattaaccccatttttgaaaacagaattgtcactcttttcggaatatctaaaaaaaaggatgaaaagtcaatatcttttaccagatccaccaaactctctctacaactaatctcaaccgtccatctcactcccgcctttatctatttaacctcactccctcaccattctcttcctcctccttcatcacacagatccacacatcaagaaactattcaaaaatg

SEQ ID NO: 2860 - DNA, 3000 bp, Unknown
  misc_feature (1)..( 3000): cDNA_ID_3070247_gDNA_ID_1620610_Annot_ID_161884 3000 nt of promoter + ATG
caaataggttattgtctaatttgtaacatctttttgctgataaacactattatctgatgatagaaaattgtaactataatccgttttatggattgctgacaaacaaaatccgttttggcatagaaaataaagttattgtacgtattgaatggcaatatgcatatatgtatgtattagttaaactcaccttctcagccccctttatcacgaaatatccaccctgatcaaaggcacaatccccctttttgcagttttctttccctttctcgcttgttttgcaaaggatagatttcaccatgacaggaatgctaccaattagaatgtcctgctttttgacatccagtatcttcttctcgacatagttgtcttgtcctgtcttgaatttgtcgcttttaacaacagtattcttgaacacctagtcaatttatagagtgaagaagcagttagacaataaactacatttataagaataagatacatggacagcaaaacagaaacatcatcaaaagtttgacagtacaagagtcattgcacacaagcataaaacactcaaactaaagcacagtgaggcagtggggaagaactaaataaaaaaaaaagctgaagatgtttttcttttattgcatccaaactttaaaatgaaacaaactaaagcttatttcgtttgaatacccaccactacaaggaaaagtaatcacaattcaaattttaaacaagaaacatctaaagattgggagcagacaaaatcatcaatcttaaacacaaccaagcttgaaatacacctctacttcacacgaacatgtaactgtaataaatctcttttactagatattttgctcaggtaagaaatccagcgaatgcaaataaggaaccaaatccaattacagaaaacttgtaaagccaaaaagagtgaaaccagtttcagacaaatatgttccttaacccttagtaaattatttgatggcaagttaaattgagaaatctatgacaggaacctcagtgtatgtcaacatcttcatatatgtgtcagaaagagtctagtagaaacatcaagaaataagcttataccatgtgttctttatcattcatcaaatccagacaaggttacttaatttcgacaaagaatttctgttacctcaacttggacattgactttgatccttgcagagtatgtcatgttctgaagcctagcatgccatgggagaaactcaagctccttgtcatccgaaaagaaagtaggcttctccacagtgacttctccgaacttcaccgttgcgtatctccaatcattatccttcttctttacaacatcaaaagacggttccacaagcatctcaccaaaggattgaaacacattctgaagcccgtgttcaatgaagtagttgtaggagttgagctgatgacttataagtccatacttatcaaagaaagaagttgcagcttttttgcagaaactctgcagaaaaccttctcctagctcagatagattgatctccccagtagtagcctcgaactcttcaagatccttcacatcaatgtccatatctggcatacctcaaaacacactgtacgaacaaaaaccctaaacaaagacagagaaattgattaaaaagctgtgaaaatcatgaaccacgaaaatgcaatcatgcgaatacaaacacgaaatcaacaactttcccttagaaccgaatcattctccataacatattctccgatgcttaaaagcagaatcaaagcgtattacctaaaataggtaccttgattgcttaaagctggcacgatggagtaaaacggcggtgtcggaggagtgcagagtaaacgtcgccggaaaatcgctgagaatgcggagagattcgacgtagaaaacccttggcacactttttcagtggttaagcgaagcagtcaaagagaagtgaagaaattgacgtcactagtactagtagacaatattattaaattttgctctttggtatctatatttttatgtttaagttttattttatttttattttaaagtgaaaaggaaatatatttagaagttcacatgacataaaatttgtaacatctttttttttttccaaaatttgtaacatctacattttggtttttacatctaattcgatttggttgtttggtttaataaatttcatatataacttaattttgaccaaaacacaaagaaaaaaaacaacacataattcactaaaaaagctcagagcaatcccaatggtttaaaatcaattaatttttaattttggatcttaagcttattttaaattaaaatgttgtttttactaagttaagaaaagttaggaagaagtttaaccaatttctacttcaatggttaagaacgattagaattttaagaaacaacaaactatttcaacacaatgtctacccactcaaaacacaacacatatgcttttcttagttttaagaaaatatcttaataaagatgtttttgtttaaccaaaaaaaataaaataaagatgtttttttttttggtgagtgacggagaggcttaataaagatgtttatcttagctaaagtttattggtttcattaaatttaatcacttttatacctaaaaattagctaagatacaaagttggggttgctcctacagtttagaaataatcatcaaatagttaccaaatttgggacatcataattatgggtagtttgatttattaggttaaatctgatctaattatagaaatataatatataagtaaataaaaagttattatataagtgtaagtattgagctctgttttttgttttattatctctgagagtctgaagaagccatgcttctgtagcggtgccaaccaacttggaactgatctttcctgtgaaaaatcgtaatcatgacatcgacctactttctcgtctctttctttctacctttctttgcttcttcatctttctctctttctcctctcatatattctctctatgcaagcaacttcatcacgataacctcttatctcctcagcc

SEQ ID NO: 2861 - DNA, 3000 bp, Unknown
  misc_feature (1)..( 3000): cDNA_ID_1010811_gDNA_ID_1620610_Annot_ID_161881 3000 nt of promoter + ATG
tcatgactccattttatgattttattggttctgtttttttcttcataatgcgataactcataactccgttcaatcgctttgttcaaataagaacactatagcactactatatgttcttcatattcgtgttctttaggaacatgtgaatcaaaaacttcatatttctcgtatagtaatgatcgcaaaacatgttcttgaattagttataaaattctcataatttccttcagaacattaataaactactagatatatgagaaatgagaagggatgaggaacaaatttctatagattattatagatcttgcacaacaatgggacacaaagagtaaaaacttggaataaaaaggaaactaatcataattatcaagagatataatcaacttaatgcgaatgattcttttgatcctttcctccacacgcctgagtcacgaggcagcctcacaatgtaacgctaggaaacttgcaacgctcatttcctgtaacaagatagtaaccattacaaattacaatcataagaatattccagaatttcaccaaaaagttgaaattaaagagtatttacacgtctgtgtagagttttcttgtgagacaagttaagagaaacttaccagggttggtcgtggtctcacgagccaaaccattgaagtagcattgagagctttggttccggaactgagcccagtacgagctaaacgcatagcttgcatgccaagtaaccgtcaccggtgcatagcattctcctcctggagccaacgctgcacatgttgcattgcttcttccgcaagcaaagttaagcgcctgccctagctctgcctcatcggccccatcaaccgccacacaccatacattacctttaaacggaacattgttactcggtttaggcaacgaatcaaaaccagaaaacgatcttctaccgctgaaatcgatgtcgtagatcggtgtaccgtcagggttcaaaattccccaatgtctctctgttcccgaaccgggtttctggttttcattgaacaaagagaacaaaaacgtcggtataggtgcaccgcgcctagctggtgtaccgagtggcgggttagcagtcatcttcttgatcaaattccggttatacgtcgcggcattgacaatattagctccggtttcatggatatcaccgtcattaggccacccggtttcagagattgcgagactgatattcggataaccgagcttggtcatcgcaaagataaccgaatcgagcatctggtctagaagattggtgtaaaccaaaccggtttgaggatcggtataagtagaattcgattcaaacagagcaaaatccaaatggttattaaccggatcagtagaccaagggaagtaagggtaaacatcaaggaagaagaaagagtttgttccattgagaaacttcaacaacggtaacatcaccggaacagcgatatcttcccggaatgtaccactcgaaggaggaaaactcgaacgaagagcgtccatggcaagaggtgtcccaactttgatgttgtgaattccacgagctctaagagagttcactactttacgcatggcagggacaagattagcccatatttgcttgtcttgatcagaactgtagctgaggacctcgttgccaacgaggacgaatcggattcgggtttgcgggtgaaaaggaaggacattagtggcgacccagttatcagcagcggcttgatcagcacctattgagatgatctggttgttagggaccatgatggtgacgtaaagattggtcgtagagaggagctttagggtttctggatcggcgtcatagagcttgacgtggcctgctttaatggttttgatgaggttgattgattggtaaggaaaaggaagattgttgcctaattttccatagttgatcccaattctgcttgcaagtgctaacactgttctgttgttttgtggaccaatggcagagcaacatgaacctataaaaaaacataagtgagttataaaaagaaagattatggtttaagtaatcttaatgtatatataaggagacttacttgaaagggcaaggagagtgaagaggaacagagcaaaaggagtcattgttttttgtttttgttggagaaaaatgttgagaagagagagtggtgagtgtgatttgggataaaggagaagagagcttgttgaggagtatttaagaagagattaaggaagtgtgtttaaggattagtataatatcgttcatgcaagaaaagcttttagctcaaactattaattgcttcttgaactctcacagtgctttggtgtttcttttttaattagtgtcgttaatgaaaggttaaagaagactggttagttggttggttcaaaggcgaccaagaacgctttgtccaattgttcactcaaacttggtagaacgtattgctatttttttcttttccataattgagtgttaattaaataatatctcatcaacaaattatcatttacatgaaaaaagaagaaatgttgacaattctttgtttccccaacatattgatgtgtattttccagtttgagttatatatgtaaggttcgaatagttacgacggttgagacggacaaatctgtttgtgaattaaaacgcttttgtttatcatcattaaagtttgtagtagtgcaaatcggaaaaaagtaaaagaaatcggtttcggataaactataaaccatttttacataagaataaatttattatgctgtaaattgtcgtcctcttctataaaaatggtttattccgtttcgttttaaaatccattatctaatattttttttcttacttcaaaattttgcattgcatattatctttacatctacacctaaatttttacttaatttttttctattggtatcaaattttatttaaagtatagtataaaatatttgtatttaataaaatatattccaccgtggaaagatatatgaatgataacgttacagtgagttaatatcatttatctgaaccagaactcatcaagcgacatg

SEQ ID NO: 2862 - DNA, 3000 bp, Unknown
  misc_feature (1)..( 3000): cDNA_ID_2175214_gDNA_ID_1620610_Annot_ID_161872 3000 nt of promoter + ATG
taaaaaagagaaagtaatgataagaaagattaagaaattaaaaaagagtgaattttacagttcaaaaggagaagaatcttacgtgtgttttatgttaatgtgggaacattagatggtgaaagtgggtaggctgcttaggctggcctctgtaatcattggagtgagaataagagagaagaaagagagagagagagagagcatgtgcatggcagagacaggaaagttgtgggagagaaaacaaacaaaaggataaaattgtttttaattatcatgtttgattattcttggttaagagactattttaaaagatgatggtacttaccaaaacatggtgtcaaaaaagtcaattattgacttgagaaggttttagacttgaatttgatgtattatgagttgtttatgttaatgaagtttataatgtgtaactaaaaacattgagtatacacatatattttcataggtttgtgttatgtgtgacatataatgatgatacaaatgaatttgcatttttgccttttaagaatatttctgaagtagtctctgctccacttgaagttacattggcaagagtttgagatgcatagagctgaatatagtggctgagtatcaaaagtcttttttcgggttcttaggggacgcgttctagtacatgctgaagcgctttcttgattcctccttgttccagagacgttgtcaagtgtatctcttgcacctgtaatgttaatattttacttaaaatcaaaccaagaatctctctatctatggccatataaatgggtagcttctgagatttacctgtcttccagcacgggcaagaagaacaaacttcccatcagaaggcggtgtctgcgtgtgaacatgcgcatagaatcagaattttcacagagcagagtttattcttacgggaaagtaaagagaaacagaactcacatttgagagccaaagttgtaggtcttgtgaaaccactcttttctcaaatccttgccggttgattttcacagcttctattctgcaatatagaaatgaatattagttacacactggaaccaaaatgttatgcctgaaacatagattctataagtaatgcaattaacaatatccaactcatcatgggttcagaaaaagtatcagccagcaatagctattgacatgtatatattcaatcgcaaatcgaggagtgaacaaatctagtagagtagaggtgatcctagtcacttataataagcagatattatgcaaagagctgactaggactgcatagtaaatttaaattataaaatgatattgtctatatacccatcttcctttaaaagctcttcaagtattgtttctagccctggaagaggttcaattgtatccccattgttcgagcttagcgaaggagatccagtagaactgtcctgtaacaatattcaattatctattaaaaatcactaagacccacaagagacagaaaacacattcattcacattgttttaccttcaaaatcactttgtctaatgtttctagaagaggatcatcttctagttgtttgatggatagtgtaatccttgatttctctctgcattggaacaacttttgattaaaaactatatcatgagtcatggctaataaatttcagtaaccaaaataagcaactcacttgtcaatattcgtgactataacccgaacctcgtcaccatcgcgtagtacatccctaacatcttgaacgtaatcccatgatacttcggagacatgcactagtccagttaaatgataaagacctatacaccaccaccccacataactgacatcaatgtcataagctcaaaacaagaaaaagaaaccaagaaatttaggtaaaagcaaatataccatcatcaaaacgcaagtggataaaggcaccatagtcctcaacagaacctactcttccgttaaacacatccccaacattaacgttttgtgaatactttggccataatgctaacttctcagataaaatcaactttctattttcctcatcagcttgaacaacctaatataaagatttacctcaaattataaacaatatagagatcacaaaacaagccaaaggagaaaactttacctttacaggaagtttagaaccaaccaaagtcttagctatctcatgaatacttttctgaggctcttcataaagcaaaacacaaaccatcgatcaatgtaaaaatcgatactttaaggacataaacatagaaccttgtgaagaagagagagttttggttacctttacaagaacgggaaggacttaattgtggataaggaagaaaacccacaagagaatgaaaacgaataagtaagccaccaccattaaagccttgaacttcaccttcaaatgtatcaccacttttacaataagcttttgctgttttccaatcgcttggtcctgcagctgaagcttcgtcggaggtatcacggagaagagaattggaagcggagaggactgaggaagaggctgattgatcggagtttctatcggtatctgctgtggcggagcttgagaaggatttgactatgcagacgagagagtttctattggaagaagaagaagacgaggaaggaaggagtctaagtgggcaagagaggaaagtggattgttggtcgaagagatgagaggcgaatgaaacagaacctaaagtagtagcgccactaaaaaccgccattgttgcgcggtagagcaaaaaagccacggagattgaaggtaatgatggttaatggattttgccattttggataagaaagtgagagactggagatgaaggtgacgtggcatttgtcagctcacaggtgctatattttaaaacatataggatcaatttgtaaacattggataattagagggtttctttacaaaaacaattctaattcaagcaaagagatcaaatctttttcctcagtgtcgtcgtcttcttcgcaaagcctttcaaaaacccttcactactctttctcagagtctcaagcatcattttcccgagaaaact

SEQ ID NO: 2863 - DNA, 3000 bp, Unknown
  misc_feature (1)..( 3000): cDNA_ID_2175236_gDNA_ID_1620610_Annot_ID_161880 3000 nt of promoter + ATG
gatgcatcgtacatgcatgtattgttatatttttatataaatatcgttgaaattggtattgtgtcgtgtaaaggtggttataatgtataataattcaaaatttctcttcggtaatgtgatcatttcttttacttaaaaacatcctcttgttaaaagtgtaagctcgtatactcaatcaatagggcaatacttctattgtcgacaaaacaataactattttgggttttgggacacccaaaaaagggaaaagttcttacaggacatgcagacacgagaacagactgtcacatgcaatgctgatcgtcattctcattcatcaccaagtttctcacgtccacatatgtaaaagcagataatgcagtttcatcatttttttatatatatgagaagtgtaactataaccatatcgtataaaaaatctctatatatagatagacatagatttaggaaatatttctttcgattttcttccaaaatccagcagcgccgtcaagattcttaagaatgatttagtcacagctcatcgatgtattaaatgattataaaacaaaatcacacagctcatcgaatgcttttatgctcaagtgctttgtctactttacattacattcataaaacgaaaaaaaaaagataaagataacttcttcttatgaattctagagttttcagtttttggcatcttaaaaatattaagattctgaagttgtaagtcagaaatttttgaaaaagtgtaatcttgtcaacatttgagcatgttatctacacattcttgtatcaccaattctcgatgtagtcgaacttaagaagtagataagaatggcgtggacctcaaacatatattacaaactttaattttcaataaaactacaatattaggttggacgttttaaaatgtatactgtaaaaaaaacgaatgttagaaaattattgacgagatgtacaacaatatttttctaacaatgtattttgtaaacttctgattggcatgacacgctcgatcgcaaccctgctagcgactaatcaaaataaagacgtccattcttttctatttggctttccaaacaacaattaaccattttggaaaatgcattactaaactcacaactccgtcgatcaacaaaatcagaaactgcatctcttctatttgggattaccctcctctttgcaacaaaatgctcatgcaaacgtatttcgcagaaaattacccacgaaaatttctctcaattttgcttatactttctaaatttcgagaaataatatttttcttcatcttttgtaaatgcgcttctttctgttagcaataaactgtaattataataatttgtttgcaaactaaaacaaatgtactaaaatggcagactaaatttaataaccaaatagtgtttattattgtcatgtcatacaccgaatttacgccatgtagaagtaaaagatcaaattaaataacattactgctgaatttttcgttagtataattaaaaagagaacatgtataaggtagactgtatgtagtctatgtagatgttatataaatgattttttttttctttcaactatatatagattagctaggtcggttgtattacaaaattaaatagtagtaatattttattttaaaagaattgtgttgaaaattttgatcgatcgcctctcgctctttaataagccattgactctttaaaacaaaaaaaaacttgaacaaattccatttgtctattattttaataaatacggtgttaaactaaaatagtataaaataatatccaataaactgtatgtttgttgacagaaaagaatataatgattttaaaacttcaaagacccaagtttcttttgaccaaaatctattgccttcatttattataactcgcatactgttttactcatacagatcattaaaaaactataagcaattacataacttgcttacaatcattgaaatagacgcacatgtttgccggaatgatgaaaaccatattggtcacacccttcacctaacaaagggtgtgatcaccaaaaatcacatcacttgcttaatttttcataaaaaccgatatttctaatgatgttaattggcaaatatgataatatatgaaatatttactttgaaatatgagagtaaaaaaattgaaacaacatttcttttgttatctaattacattacgcaagttattttggttcaagttaccccaacattgcatgttatcatgttatcaatcaatacaataatcgatcaagttgcatagcataatagcatactccatttatggaactataattactcaactcgagcttcgaattatggtggaaagctgcagcaaagtattgcaatgaatgcggcatctatagctatgccagtcggtcaacacaatctataagctatagcactactatagtccttgtggtcctactcagccaccacaaaaggttcaaggcttcaagcttcaaaggttcgaccacattcattcacaatcatcatttaacacataaataatctccattatcacctccttaaattatgcttcaaaaactttcttaattaccgaccatactaccaaacacaaattatgattccaatttaatctccattattacaaccaccttccctcaataataacctcaaatcaattaaacccaaatttccattattatcatccatatctttaaaacactacttattacaaacaaacctaatccctttattcatacattattacaccttttatattttcataacaaaaacgcgtagtttctgtttttaacggaacgggacggaaataataatatggttagatttataatagtaatgatctgttgaataagctaagtaacgacacctcactcttcgcttgcttccattcatcatctctctctctctctctcttcccaaaaatcaaaaaacagaaaaattaccaaaccctaccaatctccttcttcctcctcctcctccttccttcttcatcctcctcctctctacgcgccgcgcgtgttctctaatca

SEQ ID NO: 2864 - DNA, 3000 bp, Unknown
  misc_feature (1)..( 3000): cDNA_ID_3070259_gDNA_ID_1620610_Annot_ID_161878 3000 nt of promoter + ATG
tgtattaatatttagcctactaactttctgacaaatttaggatcaattatgggattgacacattaaagtttatgtttttgtgaatataggaacatctcacagtacttacaaatttaagtacttctatctcttctctttttaccatattaacctttatattgttggaaaaaaaaatcaagcagaaacgtcgattttttctctccttatgctttcttcattcttccttcttcaagatcttgggtcttgagatgcgatgaagatgatttaggatttgctcatgattcacaattagattgcttttagttattgcgtacatgattgttttgaataaattttcagttattcacaatcaatgaatttgtgtctataattaaagccattgggttgcctaaacatcatcccttagggtttagatatcttgcatcaaatcttatttaattaattccattggattcatcgaaaaagagtcatagaaacgttgtgtgaatcaacggaggaaaaggaaacgatattgatggagtcaaaagtaatgattttgattgagtgtggagtccatgttaataaacaaatttgattatcacgacggagaggattgcagaaggtggagacagtgaggattgttgttctcacgacggagaagacgaattgatttctcatcaacacatttgagggcaaaatcgtcatttctcgaatcaagaagtacccaggcttataagtccaagtagaatgtgtttttcttcaaatttttggatccaaatatacccatatgtacaaaagccccgacaatgtatcagtgtttttatttttcatcatgtgcacaaaaaagaagagcaaatgctaatttatagtgagtaacaatgagatgaaaactaataatgataaatctggttacagatttaattcattattgtgagcaaaggtgcccacttgtagttaattttgtttaaacaggaataattagtgaatactataatgagtatattccctaaaaggtgaagggtttgtaatcttcttatgatggattagtaacagcagcatctcgtttgtatattaaaagtattttcgatagatcaagaaagattaagcacttgtcatccacccacaactcgatctaatttttttcatttaacatttctggatcatgtttttgagatttgatctattaatattagtgtttataagatgccagcgaagtagaaccaaatgtgaagattatacagtattagaaattactgaggtaatactgtttatatttgtgtaaacttgctatacaagtctctccaaacgaccaagcctatattaattaggacttgatcgacgtacctacgttccaatactataaaacctaataaaattaaaggaaggttttcatatcccagttaaaacattttacgtttgatcgaacatgaaaacaaaaaatcgcctcaaaaaccctatttatggattagagtctcgtgttttcgaagagttgcgttttttttttttttaattttctttggttcaaagaaaggaagagtttcgtttagaatttgaattttagcatgtacttactattcaataaaagaggtgagaattaatggagagaaacacgtgacctgaaacaggtatgatcgagagatgtcacaagtgtatttgtacttgaaaataaaataaaatggacagctaaaattgtgatttcttaaaattactagctacgaacctttctttttcattaaaccacaaagtacgttttctccttttcgtatatcttgttaagttcaaaaatccaaatgctttgatctaaaaaaaaaatattaattctaaactcttcaatcaattatggaaaaaaaaagaggctcaaacgaaattcgcaattcgaaactgtcacatgtgtattcgttatttcgatatagaaacctcaacttgaatataatagtttgtttgtttgcttgaagttaatctctctcttttttatcagctaaagctgcatttataaaaattctagtttaacttttaccatttgctataatttagagattttaacaagaaatctggcctagtccgcaaaacttatagaataaatcaaacattcttcaatattttacacatccacaatacccaatccaagaaatggattgcagttgcaccagagattacatgtctcgttttagtttgctagtcactcaaactcacaaagcataaattgtaatagaaaatagaactttatttaaatctgaagaaagatatatataaaaaaaaaaaaaaaagaagaagcaggctccagttttgatgggagaagaaaagagagctggcaacagctattcactgatagaccgatcactctcttctgtcccgcactcttttcttcttttgtttctttcttttcgacagctttcatttttcctccatttttaaatttgaattattttacagtcataaaagtacttcaaacgtatatgtaaataacgagcaacaaaacaattaactacaacaaaactagttctagctaagagaattagttagaaatttttattataatagttagtatatgtttattcataacacaattaattaacacacaaaatacatgtaatttcctctataccctcttcacatataattagagtagtgctttaatttaagattaattatcgatttacatcattaatgatcatctagtcttacacagagagtttcagtatctgcatgagattatataaaggaatgtattcatgtttttacttctttttattcatggttaaggatgatacattataattataaatccataatctatgaactcaactattctttataaaaaaggaattaaattctgaaaataaacaactgtagttggcttcccaaggctgctgcttcacctataaataccctatcctctttgaaaactcatctcacatcacaattcacatctcctcgaacaaacaaattataaacccattttccttcataaatttctaaaataaaaccccttaaactttcattcacatcatccaaccccca

SEQ ID NO: 2865 - DNA, 3000 bp, Unknown
  misc_feature (1)..( 3000): cDNA_ID_3070306_gDNA_ID_1620611_Annot_ID_161895 3000 nt of promoter + ATG
ctaatggcggtagactctgtactattttcaagattcaaaatcttgatctttttattgttctacttcagatttcactccatcactcggaaacactcctaagagcagcttctcagataggccaccacgtttccacaaccttatattccacgagaagaagccttcccgaggctcgtcttctccagcgccacttccaaggaggaagaagcttggtgagcttttcagagacagtataagagaagaacgagaagaaagcggttcatcgtcagctataagcactccttatctatcaggtgctaactcacgcgaattcaatgacaccgccatcgaaaaggaagagaagaagaagtctaactggcatcatcatcgttgtcttcctggtttctcttcatgtggtggaagtttcatggagaggaggaagaagatgagttctgaaactccagttgttgctgtgaaatgagatgtagagattatgaaatttggaaatgttttgtatatgaaagaaagagagggagagatacagagctctcagagtaaaaaagctctgctgaattttacagggcactctattatctttgatgataagagattgaatcaataggtgaagagataatgtaaaaaggaagaaaatgagatgcttgtgttttgataaattttgggacttggcttatgaaatttgtcaccactaaacatatgtatttaatagtttaatcaagcattaaaatagctgataattaattcgtgcactaaagaattttattcttaggtctcaaactctcaatagttaactcaatacttaatactgtacaatttattattccttttatcatattaaatcatgtattagggaaacaatttcatgataaaatttataaatattgaagaatgtagtatattatagaattcccaaaaatttatccaaccacacaaatttttttttatgtccattctgcccgtttttatttatttattaatattaaatattttctaccgtttttaagtttgagagagaaaataaagagtaaacaatgaaagtagaaaaacaagaaaaactacgactaaaagaactacgaatacgagataacacgataagaaaacaaaacgaagcaactaacaaaggtctcaagaggaaacaccggttccgaactgtaaagctctgtcatttttttgtctaggttttattttattttccccgattccgcagttaccattcaaaagcctcgatggaatggaaggattaaagaaaaacaaaataggaagtagaagctttaggtgaaagttaggtaataaagaatcttgcttgttgtatgcttcttgtcttcttaacttatttggcaattctgatgcatacattctacttgaacacacataaactaacaaaaataaccataacactaatttttaaagattctacaaccactaaagatcttagcttccattcaactccaagcttcgtcttttttttcttcttcctagatctcttacgcaactaatgtccatgcattccccctatatatacacgagctagcagaagtttaacttgaatatatcaaaaccgagttcaattcactaaaccaatgaaaatgcaagcagttcttgttatcttggttttctccggtttactttcggttaagacagcgttagcagcacgacatgtgatcggcgggagccaaggctgggaacaatccgttgattttgattcttggtcttctgatcaatctttcaaagtcggcgaccaaatcggtacgtttctctctaccctcaatttcataatcaaatcgaccggtttaatactaaccaatcttttttgtttcttgttagtttttaagtattcagaactacacagcgttgtggagctaggaagtgaaacagcatacaagagttgtgacctgggaacatcagttaattccttaagctctggaaacgacgtcgttaagctttctaaaaccggtactcgttacttcgcttgtggaaccgttgggcattgcgaacaaggcatgaagattaaagtcaacgttgtctcttctgactccaaatccgcttcctctccttcaggttcaggttcgggttcggattcagggtcgggttctggatctagttcaggtcatgggttacgtgcttccactggatacatgttcgttgttggatcgttggttattggtcttatttgggcttactaataattgtttagggcttttttgtaatgtatcgaatatatttggtggggagagaataaatatttttggaattattaattcgtacttgttgttgtattttatatagttcggatatttgcatttctgatctaattttctatatatatcttgtttttcatgttttctcaaccgctactccacttgattggttgagttggaatattctttttttatactttctcatatgaccaatcattttttttaattgtcatcaacattattaatttgaattagtttgttattttctttatctatataaaaaacattattaatttgtttcattccattgtacacaattttagcgtcgtatataaaaaataacatttcagcttcagcacatcaaataaacatttttatttattaaataaaacatttctaatctaaataagacttggatagtttctgttaatactttttttttgtcatcgtaaattttattaaaaacaaaattgtccatagaaattaagcagacaataaatgttgaaattttggatttagatttagcggttttgattgatataaatctacttttaatatttttttttgtcatgatcttatttttattttgaaacagaaaatattattttaatttaaggagtatttaattcgttcgagtttcttctcccaaaaaaaacattttaaaaaagacggagggagcgagagagagagaggacaagtgggttgctgaattgtgcagaaatcgtcgtcactgatcacttccgattccttttttttctccttaaatcgcaattttcactctcctttaccttcgccgagaaactcaatg

SEQ ID NO: 2866 - DNA, 3000 bp, Unknown
  misc_feature (1)..( 3000): cDNA_ID_3070290_gDNA_ID_1620611_Annot_ID_161917 3000 nt of promoter + ATG
ttaagtctttaagacttgtggtttacttggggaaaaattagatagaagaaagaggggtcaaaaaaatgaaaataagaaagagggcttatctgtaaaaaaaacaaaacatactgtgcttaaattgaaaatcacctaaaacaaaagcgcctccggtatatagacggtggatttgcagcgagcaagtaaagaataacttgaaccgggtctgatgtttgttgatgacccttctctacacaccttgaaacgcagacgactcgagatcaccgattccatggaagcttcttcttcagctcaggtctaacttcattcttcttcttcttctccctcattgatctatatcatctgattcctacttccatttcgattttcatttgatccgaaatttttctgtttcttcttcttctatatttgggggttcccgcaaagttttctagggtttttccatttcttgagtcgaattcaatatttatttgatggattttcgtaaaattaggctaaaattgctgatatgcgagagaaattagggcgagaggttcgtgttttcgagacttcgagtatctcacagagaccaagtcaagtttctagtgctggtaacttttttggatctctgattcttatattgcatttgatctgaatttgaacaagtcttgtgattgattgtttatgaaaattccacagacgatgaatctgatgatttctacgagttcacacctgcagatttttaccgccttttggctactaagaaagaaggtaacatgttctgaagaatctgtatggtttagtttacattcttcagccatttccatgaaaattttgcaaatctttgatcaaatccaactgtgtttgtcataatcggaatgtattgcttgctctaaagaaatcagtaccttggttgtttaattcttctaacatgtaatgttaaattacttatacaaaagataaatcgttgaagacaagaaaaatccgggaagcagaagaagctgctcgtcgatcaaagctcactaaggttctttttactattggtttcatgtttgggaactagttttatcccactgactatctatagattgatactgtctaggctgtaatccgggttcgttttcctgataatcacacattggaggcaacatttcatccatcagaaaagatccaaggcttgattgatcttgtcaaaagagtagttgcccacccagatgttcctttctacttgtgtatgtttccatcactcagatttcagattttacatttgtcaagagaagaaaacttgataacgtgccatctttttgtcagatacaactcctcccaagaaacagataaaagatttctcacaagacttctactcagctgggtttgttcctggagccattgtctacttttcaaacgatcaacctaaaggttagtttctgtcattaccttcacccaataccatagtctttctctggggaacttttttgcattgcgatatgtacgggattatagatttagtaagtgagatctttttgagggatggataactaaactgcacgaggaattgtccagaaactttcaaacttaggaatgaaatagtttgataagaagtttaggatcatgtgaatacatagggaatactaatcttagaaagctggttaaattaggtataatattgattccccttacatactaaagaatttgttgtgaagaggactgtgttctgaacttatctttaaaaaacccaatggtttttttgcagatgatggtggtagttcaactccttatcttaatgaagagattttgtcactgaaagatttagaggccatgaccaaagccgtggaaccggttgaatcgtcatcagagccagccacggttgactctagtgctgtacctgttgaacacgagcgtaaatccacagagaagaagaccacaaagcctaagtggtttaaaatgtgatttcactttgtttctcacataacaagaaacatgttacctttgaaaagtgacagttccagtgtgtcggcatcacttcacagtagcaatcttattgtgtcggtatgggcttttaatatcttggctcatttggatttcttgggcctaaaagttactttcattatagcgttttcttacctgtctcgttccaaagtagaagaaactaaatgaatgcattgcgctacgttatattagatgaatgaatttggtattataacaaacaatgacgatttattgcatgaattagtatataacactaattatgtcaattgggttaaagacattttgtgttaacactattttgtggtactcaccaaaaaaaaaaaaaaacactattttgtggtggctgataaaaaaaaaatgatagtagttgttgccttgttgggcaggtgaaatctaacggtcaaaaatgaatatgaaactcgtaaattattgggaaaaaaaacaacgtcgcatttattctttttgactttttcgtttccaaaaaatatctcagcatatctgatcattaccactttccattaaactaaccttacaataattcccttaatggtttcacgtaattataatattagtttcactactatccatttacaaacagtccctttatttttaatcatcagctttctaatttatctatataaaaattcgaactatcaaactccaccccataacaaaattctccaaactagtgaaaattttgtcgccaccgtcgcaggtagagagatctcttctcgtaatctttgttgatccgtttgatttctcgacgaaatctgatccatacaaattacttatcattcaattttcgtattgattctgtgttttattttcgcagttatgttatagcctaagttaagaatctttatcatcttcatgagactcgaattgttggaaaatgttataatttcacaagtaatctttgatttcatgattaaccaatcaatcaatcgtaacacaatgattccaatttcactaaacttcaattttacaggtttgttctgtattttggttagagtgttaaaaaactattggaagatg

SEQ ID NO: 2867 - DNA, 3000 bp, Unknown
  misc_feature (1)..( 3000): cDNA_ID_2175758_gDNA_ID_1620611_Annot_ID_161919 3000 nt of promoter + ATG
ctgtcacttttcaaaggtaacatgtttcttgttatgtgagaaacaaagtgaaatcacattttaaaccacttaggctttgtggtcttcttctctgtggatttacgctcgtgttcaacaggtacagcactagagtcaaccgtggctggctctgatgacgattcaaccggttccacggctttggtcatggcctctaaatctttcagtgacaaaatctcttcattaagataaggagttgaactaccaccatcatctgcaaaaaaaccattgggttttttaaagataagttcagaacacagtcctcttcacaacaaattctttagtatgtaaggggaatcaatattatacctaatttaaccagctttctaagattagtattccctatgtattcacatgatcctaaacttcttatcaaactatttcattcctaagtttgaaagtttctggacaattcctcgtgcagtttagttatccatccctcaaaaagatctcacttactaaatctataatcccgtacatatcgcaatgcaaaaaagttccccagagaaagactatggtattgggtgaaggtaatgacagaaactaacctttaggttgatcgtttgaaaagtagacaatggctccaggaacaaacccagctgagtagaagtcttgtgagaaatcttttatctgtttcttgggaggagttgtatctgacaaaaagatggcacgttatcaagttttcttctcttgacaaatgtaaaatctgaaatctgagtgatggaaacatacacaagtagaaaggaacatctgggtgggcaactactcttttgacaagatcaatcaagccttggatcttttctgatggatgaaatgttgcctccaatgtgtgattatcaggaaaacgaacccggattacagcctagacagtatcaatctatagatagtcagtgggataaaactagttcccaaacatgaaaccaatagtaaaaagaaccttagtgagctttgatcgacgagcagcttcttctgcttcccggatttttcttgtcttcaacgatttatcttttgtataagtaatttaacattacatgttagaagaattaaacaaccaaggtactgatttctttagagcaagcaatacattccgattatgacaaacacagttggatttgatcaaagatttgcaaaattttcatggaaatggctgaagaatgtaaactaaaccatacagattcttcagaacatgttaccttctttcttagtagccaaaaggcggtaaaaatctgcaggtgtgaactcgtagaaatcatcagattcatcgtctgtggaattttcataaacaatcaatcacaagacttgttcaaattcagatcaaatgcaatataagaatcagagatccaaaaaagttaccagcactagaaacttgacttggtctctgtgagatactcgaagtctcgaaaacacgaacctctcgccctaatttctctcgcatatcagcaattttagcctaattttacgaaaatccatcaaataaatattgaattcgactcaagaaatggaaaaaccctagaaaactttgcgggaacccccaaatatagaagaagaagaaacagaaaaatttcggatcaaatgaaaatcgaaatggaagtaggaatcagatgatatagatcaatgagggagaagaagaagaagaatgaagttagacctgagctgaagaagaagcttccatggaatcggtgatctcgagtcgtctgcgtttcaaggtgtgtagagaagggtcatcaacaaacatcagacccggttcaagttattctttacttgctcgctgcaaatccaccgtctatataccggaggcgcttttgttttaggtgattttcaatttaagcacagtatgttttgttttttttacagataagccctctttcttattttcatttttttgacccctctttcttctatctaatttttccccaagtaaaccacaagtcttaaagacttaaactattaaacaaaatgaaatgtatgaaataaactatttttttttgttgaaatgtcaaatttataaatcaacaaaataatttatatacaacttaatccatataacaaaaaaatcaaaaaaaaaattaaaataaaaaacattggcatctctcataatctaaaccaatattaaaaaatctcagagatttggagtctcaaaaaaatatagagaaattttgtgttcttcattttgtaagtgcaagatgtagtagataaatatctgaaatgccaaaataataaaaagataagtgagcaagttaaacaagtgaaatggtaaaatgatgaagtttggtcgtctaatcaacgatcaggtgaattttctagcaaatcaccattattcattcaaaccatatatgtaaggttttaagcataagcaacataaacagctcaagattcagtgcgattgttgaattttcgaaccttatgtctagttttgttatttcgaaactcatgatagattaatgaatttttgagaaatatttattacaaaagagaaaaatatttagttttgtcttattcatttgtaatatataaacattaaattattttgaaaaatacaaagaaataaatgtaatcattttgtacatggcatatcgacaagaaatgttattacataaatatgtgccatctaggttgtacaaaataaaagtatttacccacctgaaattaataaagtaccaaccattaaaaggaaaaaataaaacctttaaagaaaagtattgtgctacgaaaatgaaaatttattaatctgatagcctcttcccacctaagcttcttctttgcttattttaattttatctttttgttgtatccttcttgtctctattaacgctcatctttcaccttcaagctctaaatcgaagcaatcttcacactccacaaaccctaatttcaatgcaatcgcaattcaccatctcaatctctcttcatcttcctctatccatggatccataaatctctgtaacctcacaaaaggtgtttcca

SEQ ID NO: 2868 - DNA, 3000 bp, Unknown
  misc_feature (1)..( 3000): cDNA_ID_2175764_gDNA_ID_1620611_Annot_ID_161922 3000 nt of promoter + ATG
ccgatataataaccattaccgtcctttccaaggtttaccaaatatgaattgttattgtcttgtgcgtcttgttatgttctcaaccttatctttaggcaaaatcaaaatcaaacgattcctataactaacatcgctatctgttagtgttttttgtatcatcatagttggattcattttacaaaaacttaaggtgtcttaggaatataattaagatttgtttccaaaaactaaaatatttgaggagtttgaacagtataacgcatatatatatatacttctaggccaaagtaatgttccttagtggaaaaaaacaaaagttccttagtggattgccttagatatttatttcaatagtattaattgtattaaacacaactctctaaatttagtacatgttatggatatattttgtaagttagcatattattaatcctctaaatttacaagtttatctgttaaactagtcacatattatgctgaattgtatttacaaaaccttatttttagtgctttttttgaaaagtcttcccaagccaaatctattataatatctaagtacataaaatcttttaatatcagaaaaaactcattttccaagccacataaaaatgttcattatatctttgacatctaagatttatttgatttttacaataaatcttattatttttgacattaatatatttcaatttaaaaatcactattaataaccaaaaaatctagttaaaataatttgcattttttttttctaagaacagaaatacaattgccaacatcaataacaatttattggcaaaacaattaatatctatcaaccaatggcattataaacagaaagcaaataattagatttgctcaaacatgtcaatcaaataaatcgcgaaagggaatccacaagaccaagtgtgagtagaaaatcttcttactagaagaagaattcagcttggaccacccggcagcaaacacgctcgttccaggctaggccattcattattgtcgcagaccatgactggatgagagaccgagccattgcttactcagaagagctaaggaaagttaatgtagataatctcgtgcggccgtgctagtgtacaaagatgcggttcacgagtttgctaccctcaacatgtttcgtaggactcgacaagctcaggcttgtccagaagacattgcaatctgggccaagaaatacatctctctccatggccacgagttctcatactagtgttttgaaactccatgtggcaaaaaaggtcaaccaaaagtaaaccgtgtttttacgggagacaaagcaaaagaacacatgcagaccgaaaagattgatatcatcgttgcaatcatcgtatcatgtgatttgtctcttctatttagagttcaagcttctgttgtatatcatcgtatcgagtaacgtccattttgattaacccaaccaaaccaaatgcagaccgaaaagattgatctgtgtaccaaatcttaacttgaattttgtttgatatttatccttgatagtcctaactccttagtattccatcttcaaaatcctttaagtttctacgatcgattgattcgatgttaaacttaaaggattttaaaccattggctttgtgttaaccggaaattggattgcatatgcaactacgagtttaggggctaagttgttaattggattgcatatgcaactacagatatttttgattaagaatttttctgtataatcgcattaaaaaacgccactatatcattaatgcatgttaccaatcagagccaatagaaacgagtttaatgaaacatcatattagattgtcaatcattacttctccaagtccagttcttaataaacaagataaacgtttaaattttgtaaattttcctaaacctgaaaagagtttaattcagtttcggccatctatatgatttatttatttatttcattagtaaatttggactgtgttttgataatttataaaaagtttctattttcgttctttttttttccttttctaaaataccagttgtttcatcgttggtaacgttaggcccatagagtccaaaacagcccattaaactaaatataacccgactcgtaatcaaaacacccgaacccggatccggttaacgaaggatctccgatttattctctccctcctcggtttacgtgacgagcctaacctccgtcgcaccgtgcttcaaagttcgatctcttctttaaccgccggttcaattattccgggacatcgcctagttcttcatttaaaacggttagtttatcagtcattcaataatctacatcttttgaatcacaagcttcacggattctgagcaaaagtttaaaaaaaactcatcgatattaccaaattaagctcttagcttcgcattaatggcgagatccaaaaactataaattgtttcctttttccgccatatgtgttatttatttattgctcttccctttctgctaaattactgttactattttaagcttcttccatttttttttttgttcattgactagtttcatttgaatctcatttttttttctctgcgttatttcttgatttgtattgttttagttgtttcttctgtgtagtgattttagatctaagctaagtaatgtatagtggaaaagtttggaaacttctcacagttggactcaatattactgtttatagttcttcatttgtttgaatctattggatactaaaaaaagtttatgtactcttgttttaggagctatatgctttgtttgattctctgttttttcactttcctcttcagcctatgtttaccaaaaagttataatcatgtactagtagttgcttttatgttccataaaaagaaaagaaaatgcaacattcaagctccgagctagtataatctgccaccaaagctctctctcttttacctctgtgcttccagatctatcctcactttcttcaaaatacttcctcatagatcaaggaaacaagagcactttcactctagtactcttgaaagcttgaaa

SEQ ID NO: 2869 - DNA, 3000 bp, Unknown
  misc_feature (1)..( 3000): cDNA_ID_3070286_gDNA_ID_1620611_Annot_ID_161918 3000 nt of promoter + ATG
gtaagaaaagcttccatgcgagaatgcacataggtttgtcgtagaagtaggaatttgcctgtttgatctcagactgtgtgggtacgctaccgatgaagaacgggtacattaggacttgagccacaaccttgacaggatctagattttgaccaacttcaatggctttgcgggctacatagtctgctatattggcaccacagctcacaccgagaagcacacatctgaagtttcaaatttcgagaagtcacagaactcagtaagatttttggtcatatgaaagcaacgatctacaaaatttatctatactcagcaagtgttgttaagaaccaaaagcagaacatttatggaatgcaaactccttgaactacgtgaaagcagtgatcatttaaaaaatgagaaagaaaaaaaaaagacttctggtgtgacatgcatatgaaccacagttgacaacataccaagcacattttcaggaaactgaatcctaagcagaaggttttctcatcaaaaaacaagcttgataatccaatccaagaagattcctggaatccaaaggattgaatttacatatctagcatgtactaagacccagaaattaatgacgacgaaacaattccacatctcataccaatgggtaagaccgtaagaggagaattagcatgagaagtcctgaaagaaagcaagtgtggtttgaataatttcaagacatgataaggacctatcaagactattgaggttaaggagtaagctgaacttagcatcagtagatcacaaatcaaagatcgtaaaggacatcgtataacatatagagttgacactaaagcttagattttcaggcaggcatgaacacacacaaacacattcgtttctaacaaattcttggctctttcactagtttcactacctaaacaagacattgtttttacctcgagggatcagcatgatttgccagccaaggctccaccaaggaagcaccaaaagcatcaactatatgcttattaacttctgatttcttcacctcacctccaggtcgtcgagaatttcccatcgacttattacattcagccaaattcgcctgcttccccagccatttcaacaccttgaacccatcctcacacgcagcaggataccgattctcaggcgcaagcctgtacccgactgccaaaacaatgatgtcacagtgcttcgccatccttctacaaaagaaatcattagccactgagtcattacttccacttacccatccaccaccatggaactgcaacatcacaggaagttttctagagtttccacccgacgacgacggtgcgtatcctctatacacgtcggaggatcctgcctcaggggaggacgaaccagtggtgtaaccgtaactgttccttctagattctaccttatgagacaacaacgaattagacgaacctaagctatttctcctactaagaagatccgatccggcgatgttgttgagagttcgagccttaccggaataaacacaggcggaggtactcggttcaagcggcgtaagagcagattccggaagaaaaattcgtacagataaagaagttaacggatcgatatgaatatctttggttgcaacaccgtcggtgaataacggattcggagcagcgacggattcttcgggtcgggtcgtgacaccaaatggatccgaggaagattcatcaccggaagattgaatccggttttgtaaacggtgtttcaaaaggaacttgaagaagacactgtagagcttcacaccaacgcttggcattggaaacaccttttgtgaggttacagagatttatggatccatggatagaggaagatgaagagagattgagatggtgaattgcgattgcattgaaattagggtttgtggagtgtgaagattgcttcgatttagagcttgaaggtgaaagatgagcgttaatagagacaagaaggatacaacaaaaagataaaattaaaataagcaaagaagaagcttaggtgggaagaggctatcagattaataaattttcattttcgtagcacaatacttttctttaaaggttttattttttccttttaatggttggtactttattaatttcaggtgggtaaatacttttattttgtacaacctagatggcacatatttatgtaataacatttcttgtcgatatgccatgtacaaaatgattacatttatttctttgtatttttcaaaataatttaatgtttatatattacaaatgaataagacaaaactaaatatttttctcttttgtaataaatatttctcaaaaattcattaatctatcatgagtttcgaaataacaaaactagacataaggttcgaaaattcaacaatcgcactgaatcttgagctgtttatgttgcttatgcttaaaaccttacatatatggtttgaatgaataatggtgatttgctagaaaattcacctgatcgttgattagacgaccaaacttcatcattttaccatttcacttgtttaacttgctcacttatctttttattattttggcatttcagatatttatctactacatcttgcacttacaaaatgaagaacacaaaatttctctatatttttttgagactccaaatctctgagattttttaatattggtttagattatgagagatgccaatgttttttattttaattttttttttgatttttttgttatatggattaagttgtatataaattattttgttgatttataaatttgacatttcaacaaaaaaaaatagtttatttcatacatttcattttgtttaatagtttaagtctttaagacttgtggtttacttggggaaaaattagatagaagaaagaggggtcaaaaaaatgaaaataagaaagagggcttatctgtaaaaaaaacaaaacatactgtgcttaaattgaaaatcacctaaaacaaaagcgcctccggtatatagacggtggatttgcagcgagcaagtaaagaataacttgaaccgggtctgatg

SEQ ID NO: 2870 - DNA, 3000 bp, Unknown
  misc_feature (1)..( 3000): cDNA_ID_3070294_gDNA_ID_1620611_Annot_ID_161914 3000 nt of promoter + ATG
acgtcagcggaggcgctgatgacgtcatacccagatgggtttgggtttcgtggaccgttgttattgttactgccgttaccgttagtatcctttggatttggaatttgtgggtactgttttttcaggaaagatattccaaatttaccaaaaaggttaggtaaaaatatatttacagtttccatattcgagattttgttatctaatttgagcgtaaattaatatctccgaataaattatgttcatggatttggttgcatatatataaaaattgtccgggacaaatttttaaaaaaattatatcttagattccaaaataaagtctcaaaataattaacatatagtcaatcaaagtttttatatgctattagagttgtttaatagtaaaaaaacaaaaaaactttggttgactctgtcaagaataaaatgagatttgttctctaattttagcgtaaaataataaatctgaattaatcatatcccattatctctggacttggagctatatgatcagtactatcattgaatttagacacaaattggttataagggtgttcgtttaatatagtttggtattcggtttttacaaaataaatttgaaaatccgagacaaattggatattcaaaataattgacagatcgtaaggtttatttttattgaagatagaatacttttaattattattgtgagtcggtcttaggttgttgagacgaaagttaattataagaatgtttgtcacaacccattactaagtctaaagcatagaaaacttgggatgactaaacttggggtgacttgtacaatatcaaaaatcgagatcattgcctcggacaataataaattccacaaaagtacgagtgactagtgtccacgagactagtggttgaaaattaggacttgaattcattccctctagaagtttatacaaatttcagaccaactttttaattaacactttttttcatttattttttcttgagcaaaataagagaggaagtaagatagattaaaatttaaacaaccacaagataaacatgctttaagattctagttaagagatggataattgaacgaatccaaaccaattggaggggaatggtctgttagatttcacatgttagaggttcctccatgaagtctagagttagactctttcgaaatctcacaaaatgtagcttgaaggatgagtttgacatcaacaatctgttggtccaatagtaaatctcccagatggaggtgttgagttcaaagcatgttgggagggattttttctcctaaaaagatgaatttaacttggtgtaggtctcgccaggctgacctcgcccatatttacaaattacaatatcatcaaaacccgaaggagtaaacaaagagtggtgattaaagaatgaagtgtcattttaaatagctcccacttgtttttctctcgatctcaatctgacagaaactgatatattccactgatcttcatcgattcatcaaagttttagattttaattcagatttcatcttaagggagggtattacgagtataggaatgtgattatcatattaatgaaagttgaggttttaaaaatagcttaaccaaacaaatgtaatcttgccaaaaagatataaaatgagtccatcaacaaaatttatcggagttacaagatcatcagattccgaaaagcttttctgtttatgcgagcggtaatagtgttttttgatgtctccgtcgatttctttgaaggtggccaaaggcgaaacggagacactattgtgcaacaagttgttcatttgtttccaaacatggtaagctgtagcatgagcaactcctactaatttccaaagaattgtgggagcagtctctgtttttagcttagtccaagccagaattgaaatccaagtaataaagatataaggcgatatcgttaatcctcttctggtgttttctgtatgtaaaacggcgtctttcttttgattcgaaacggaggagtttgtgaagggtaacaagacggaatggttctttatatctgggaggaccaagatggggaaatgtggaaaaagaatgaatcgtagagacaatggaggatactggagggtagtatcatctctgccaagaagattcatgctggagaagcaggccttgtcggctacaaatactcactagagtactacattggaaaacaaccaaaatggcgtaaaagagggttggttgatgcatgaacactggcttaagtcttctgatgatattaataactacgagctggtaagagtatatatgtacgtttacttacttggtttccaagttattgagactcttgagttttggtttttattgtgacgacttctgttgttttgtttgagtagggcaattatgctatgtgcaagatctatctgagtccacacgcagcaaagaagaagaaaacacacgatgaagagatcgacgatttagttcaatttgtggaagcagccttagatgtttctttttatctacttttgctgtccaaagtcagaggtctcattgtctttatatagaatttcttgtatataacattttccactggttgtatagaaaaatcaattttagtcttttgtgcttattcactctaatcaaaatctctaatcaaggtgaaggaggaggtggaggaagaacattttcatcttgctctctaagaagatccaaaatctctgcagggttgttatcaacacgctcttcgtctctgtcttcctctccggatttagtttcgtttatgggcaaataatcaaattcgggtttaatcttccaaaccgttgtttccttttatattacatcatttccttttccttttttattattgggccgaagtagtttatattattaatgggctttaaacaagcccatattcaataattgtcggccaaaaaaaaccctctcttccaagttccaaaatcatttcataaaccctaacaaacccctaaatctttcctttctcaattctctccttcgaagcttttttcttgtgaggtcagaaaagaaa

SEQ ID NO: 2871 - DNA, 3000 bp, Unknown
  misc_feature (1)..( 3000): cDNA_ID_2175700_gDNA_ID_1620611_Annot_ID_161902 3000 nt of promoter + ATG
gcagctgaaccagaaatggaagagaggaaactggtaggtttatctttctctgttcgctggtgaacattgtattttctccctagactatgcaattaatactagatttagtttatgatcgatcaagttgacttagagaaccaattgttgtaccaagtgtgaagtgctactagttcttggtctgctactaagataataacatttagatatgctgtgaacacagtttgactcgttttgcagacacaaacctcagcttccagaccgatacaaagaattgacttttttttgaggttacattttacatggcggttaatgttggtttcactatttgcagatgggtttcaaatggatattcctactctctctcgctcttctccaagctgcttactacaggcgactaaaatggtcggttctcaagtcccgcaagctggttcttgacgtggttaactaaagcgccgctgaaaagcttttgcattggcctggccacacacagtcgtattttcaacaaaggatgttaaatagagaagagcctttctctgggtaataacgtatcatcatttttatgtgtcataaaaatctttgatgagaccagttctcacctgaaggtgaaaagacctcatcgttcttctttttccttcgattattactagagagttttatgaggataatcacgaaaacttgtttttttcgcctcataataatcacacatgattttgagattatatcatttgttatgtttttcctcttgtctcaataaaaaataactttgtactctgattttgttgtctattttcggcatttcttgcatctggctttggttgcatgaggagaatttatttcaggtataacaaaaacacaattaatggtactcatttttatttgtatggtatatatggatattataacagaaaagtagtaataataatcgacaaaatttcaacacattatactgaaaaacttttacaaatgattttctccaattgccctggtaaatatataattgcttattcttcttctctggaataaatatcacctaatgacctccaaatttataacctatgatcaaatgtaactataaatagagagttttactcttatggtcggtcttaccattacgaacttccttttgcattcccgatcaagctctcactggcttttgcagaacagctgagagataaacttgtgcatcagccttctctccaataacccatttaagcttcttatacccaaacctctcaatcatacgtgtaagttctttcttcttctcatcattagcacaatagaagttatccaaccagaacaatccacggggtttcaaaacccgatcaagatcgaacatcaagaactctagcttctccgctttaccctcaacatctaatccgctagaagcatgaataagatcaaacacattgtcaagaaaaggaaatctatggtctaagctcaagaacaacggaaagagccctctcgcagctataaactcactaaacggagcaccattattcaaagtgttagtgattacagtcacgttcttctcagccattctcgctgcgaaagtccctgatccaccgctaatatcgaacccgattcgaattttcccacttcctaaacccaacacatcatcaatcaagaaatcattcttccccttaaccttcacaaacctatctttctcaacccctaaatcgaaacaaccaacacattccttgctaagtttcttacctttcaagcaatcaaaactcttgcaaccaagtccactccaattaacactcttgttactaacagatctccataacgaatcaggagacttactcaaatcttgcttctgcaccgttttcgccaaacaccgtctccgcggcaacggctcacaagcacgaagaatcaacttctggccaagactccaatcatcaggacatctatcaaacaccttatatgacatatactgagaaagcaaatccgtagatttcccacaagaatgtccaacggaagacaccatttcagtgatcccggtacgcgaatctttccctaaaggaagctgatgacgctggaggaacaatttgagctcaggaacaatgttaggtcgagagatatcaatagattcgtaaccaagcatctgtttctccatctgagcaagcttgcgttgagacgaatcgatttctcggagaatcaaagagagatgttgagaaacgagtgagatattgttggagctgtggagaagtggcgagtttgcttgggaatgagaggagaacgcgtataaggcgaagagatttgtggtgacgacggagaagagcatgaggaggttcacggcggatgaacaaattgatgttcgtcggaatctggctgttccatcgccgatctttaaagatacagatcccatcttcaatgcagtgaaagagagaagaagcagagctcaagctaaggtttgaggtctcactatataacttggatcttcttcattggatctgcaagaaatttcagattccagcttgatttaacaaaaaaaaactaagagtacttcgatttgaagaatcattcagatctagcagaaagattcaacaatagaaattgcgaagaacagaaacaaaatcaaggttcatgagaattgcattaccgtgatttcagcagaagagacttggtgaagtttactggagagtgaaagaaatcgccgacatgactcgagagtcaacacgtgagtgactatatgattctatttttcatgggcttttttatttttaattgggcttagtttttaatcaagcccatataattacaaacaaaccttttgtctcgttaagaaggttcaaattaggggaaattaccaaaaaaaaaaataataatacaaaattggaaaccaccggcgtgatttctggttggggaaaaaccaccggcgcacatattttttcggtaatgagagattcttcagcgacgtgaaatcaaatcatcactgtttctcgttgcggtctatatgaatgagatgtctctttcaatagctctgcataaacacaaatg

SEQ ID NO: 2872 - DNA, 3000 bp, Unknown
  misc_feature (1)..( 3000): cDNA_ID_3070298_gDNA_ID_1620611_Annot_ID_161904 3000 nt of promoter + ATG
ttttgtagatttaagataagggtaacaattttatttttttaaaatgtatattgaacgattcattttgtaaaaagtttttaacaactccgatccgccgatccccgatacagatcatgttgatcaatcataccatgtcttacgacgtatcgccatatacatctatgtctatggtacgcgtggggggctgatggtacgtcaatatatatgtcagtcagtcagtctatatacatgacacatatatgtacatatgtgagatctatagaagaatattttctaaggattttatataaccacatccatcgattgtatgtatgttgcattgcattgtttttaataccatacacaaaactattatgactacaaacaaaaaaaaatatagaatggaagggatagaacaatcgttttgaatttaaatcaacatccacgtacatttaatttaaacaacgaaagcattaattgttttttttaccttgcatatgccatacaaaaattacggataatccggattataagtttataatacgatgaccaggaactattagattagcaagagcatggatggactcaacaagagtaaatataaaattatggtcacttaattaactttaaaaatattttttgttgattagcaaaatgtatggtccaacacataatatacagtattaaattttgacggccggcaactataggcgaagaaacacacacgttgttgaatagaagcaatgtgaatatatctttacccacatagatgcatacacataggtccatatgataagttaaatggtatgtttatttccccaattttcttttatttttagttgagatttttatattatatgaacgcatgggtcctacgtaaacacacaatatgctgtttcaccttattcgaaggctcttattggtcctcgtaatctccgaccaatcaaattgcactatgtgtcctccatttctcacttgaaaagctgttatgtcatgactcatcaaacattcatacttacatatgcatgtctacgttgagcacgaaaaaagaagaaggaattatgcgcatcattagcatgccgatatatgtgagtaaacgaataagaaatgttagcgatctaatgatatttgcagacataatatagttgttaaaaaaaagaaaaagactaatgtattaattaattgttaaataaaacaagcaaaaactgaaacgagtagagtttttattttttaatagattttatcaaaaaaaaaagactgcgtctgcatggagtaattaatactgcgttgaattataattttgtttaggtgttttgaatagttttttttaatctatattttcacaacaacttttgttaatatagtccagatggatgccacataacaaaaggtttttttctagtaacaaaacaggattagtaactaggcatacactgatacacattcggttcggttcaattcttcgggttttgggttattcgtttttagctttttagcatccataaggaaaccgaatgtttttcagttcagttagtcttctttctttgttttgtgttacaaattaagcgagcaagttagctctccagtttataatctctctttgttgtcactttttggtatgtaacttactaacttgtgttgttgtcatatgaagagaagaatgggggaccaaggatgaaggtaaggttcggttctttgagtattttggtttctttttgggtacttcaagtaaaaatatataaaccgtaaaaatatccaaacctttggaggctgctggtgatgctttaatttattccaaattgttgaaatattgttgaaaacatagtttaaaacaagtatttctaggtcttgtggtacataaagtgttccagggattttttctcgctgaagttcgatgttttgggaaaaagagagtacaaagcttggttcccgcagttaagggccatttgaccgtgagtcttagtattattttcctttgtgattgtggtagattgcttgtttgttctttttaaaatttctctctgactttttgtcggatatgcgagacatatgtttagtagatgaagcatagtttctgactcggtcgatggttaagttacttaacttaagtatgattccacttgatagtaaaatgtgattattccagctaatcacgcatatcacatcagaatgattaatggtccttagatcaaaaattatccacagttgtaattaacatctcattatcaagatcatatattaatagcacaagtgattagaagtgaagcttcctcctaagaagtttcaaaagttgtgattgccaaaactttttttaaagcaaaatcgtgttttcaaattttcactgtttgtttatatatataatatgaaatgattagaccattaagccagtttgaagtacaaacattgtcactagtatgataattcaaacatttttttaattatctccatattgattttttaaaatccaaccaagtctacttctggtgatgtatgatcctaaagtcatatgttttacgttgcattcggaagatttttcttctcaaagataataaagatccaccaagcttttaaacttttcaagtgttatctacttcgacattttctgggctcaagcagtacgttgttggcccattaaggcccaaataagtaaaactgtggtcgtgtgtctagcagccgctgtgtcatcgtggaactcccattttctctcttttacttgttcgttcccaaactcttctccctcgatcgtctccgtcgccgatctcgtttcttcattttccggtgagattctctctctatttctctgtatatctcgtattcgaaaccttcgttttcttctttgacatttgattgatcagagttatctatattcgtcggatctgtgtagactcaaattttctagggcttgttcgcttttgtttattcgtatacgtgttgtgaaatcgcattttcactgaatcagtattctgattcaatttctttgtttcttcagcgtgttgattggtacaaaggtttaatcaaatg

SEQ ID NO: 2873 - DNA, 3000 bp, Unknown
  misc_feature (1)..( 3000): cDNA_ID_2175732_gDNA_ID_1620611_Annot_ID_161911 3000 nt of promoter + ATG
tttaggtaaagagctcacacctatctctactctatagtgttatatagtgtcaaaatttaacgaaggcattaaaaaaataaaaacttatataccatacttaattccaaatcgaacaaaacacaaattgtacccgaatcaaacatattgaattgaaaccaaatcaaactgaaaccgaactgaactagtttagaaagttttactaaaacctaatcaacaaataccaaaccaaacgggaaattatgagaaaagtagaaaaaggcccaccaaaagagcgtccaccattacttgattgtgtatgatacatatataaattggtcttatttgtaatacaatcaagtgggcttagcccatccttttggtttgtttacttgtgtgtattgggtcgaattcttctagaaggcctctttttaaaaacggtttgtgtaaaattgtcaacaccattttggacttttgtgttatttccattactaatctctatagtttaggaatttctcgtgttataaaactcaagtacaaaacacaggaatcatatatatatatatatgaaagttggttaatataaatgacacattatcacacaacaaaatgacatatgtcattcgatgtttttttttaaattaataaaactaataaaattaaataaacaaattaaatgtattattaattctatttttaattgaattttccaaaataaaaataaaaaataaaattatgtaaacaaattaaatactactttcattatactctttttattatattaatttttttattatcaataatcatgactaatttttttattgtgttgtagttgtttgctacctaacctcttattagtttattagtttaattttgagtttttgataacattgacattcaagttttttcaaataataaaccttcaaaatattagacttaccaaataatataatacacaatcatttctcttatattgatatatgcaatgacagaagatctaaaagtattgactttaatgatactttaatttttgctttctttttattattttcatatgaatactcttgaaatcttatttagtttatatcaattctatatatttaatcataaacctataacaatgttgttggagtattatatcgggggaataaataaaaccataaatagtttatttataatcaagttgaagaattttcaaattatccaagacgcaatcatttctctaatattgatatatgcagtgacaaaagatccaaaagtgttgacttcaataacattcaatttttgctatcttttttatttttttgtatgaatactctttagatccttttcagttgatatcaatccaaactttaatcatgagtcgatcacaatgttgttgaagtacataaaacaagaaattgatttattaataatcgagttaggaaaattttaaaccacaaaagtaacatagttacacagaattgtatcaaaatattattattgttgttatatgtattcatgaagtgaaaaaatattaaaatcttataaataatcagctttatacacaaaatatataaattaatatatagagtcacaaatgaatctaaccataaaaattgtaactacatattatggatctaatttcattaacaatacaaaaataaataaatagtaaatataattagcataaataacaatcaatgtaattttttctttaacaattttcacaacaaatccacgcgtagcgtgggtacccatctagtttctagtaaaaaaagaaatagataacactcttgcccaacacaatcaataacagttcaactgaacaacatatgaggaaacaaatcatacttgccgttttgctatcgactacaaacttcatgtcgtttttcatttagctagtgaactaaccaagattctagagtgtaataaaatattaaaatctataggcaaactcacatgaccaattaaacaagttaacgattactgtccaattaaacgtcacaagttaattttctaccgttaaaatattgccacgtaggacgcgtacgttaattaactcgtaaaatccgcgcagacaaaatcacattgaccgttagatatagatttggcggctagttcttcaatcaatataaaccgtccgtcaaaaatcagaggtaggcttttgacggtgtagttttattttaaaaacataaaataaattagtgtaagaaacttttttctctctctctgagtcttcgacttcgtttttatctccagctttttttttctcacgcgaaaagctcctgttctttaaaggatttgatcacgagagtttcaggtttggatttcgtagtcaatttccagattctagggttttggttggtcaaaatcttctacttcgtcccgtgtttgtggattggttcacggatctttggagattccgaaattggaggcgatttttattctagggtttcggtgaaatttgtaccgttttttggattaattcttacgttgatcgcttctctcctggcgagctcgcgtttaaaggtttagatttcaagctccgtgttgtctattttgaagctaatttatctggtggaggttgaattttggtttgtgaagaatttgtgtggattcagctgttggagattcaaatggtaagattcgatctatttttgatttgtgggtttttcttaattcgaatgattagaaaaaatagagattcatttgaatttggcatcaagctagggtttgagttttggggtccaaaaacgaaattggacagctaaaggtttaatttttacggtcatatctctcacgtttttgagaatcggaaattcttatttcacattgtttagatctggggttcttgtgtcacaacaagtttcttggcccaatgttatctatcgaaatagggaaaagaatcgtcttagtggttttgaatgggactgtattagtttttgttgatttaagtgaaattatatatgattcaggtgtcttgcaaatgagttgtagaagctagtgagaattatatatattgtggtaagtcttgccaaaaca

SEQ ID NO: 2874 - DNA, 3000 bp, Unknown
  misc_feature (1)..( 3000): cDNA_ID_2175689_gDNA_ID_1620611_Annot_ID_161898 3000 nt of promoter + ATG
ctgttttcacaaaggtatagacttaattgtgccaatcccataattgatccatctaactatatcataaataattatactactaaacaaaaagaaaaaactatcacaataatattagacagttagtattctagataatattgttacaacatttcaatggcatatccttcttgagatattttcccaataagtacaaacttgtcaccaaataaataaagaaaaaaaaattatcccaaaaaggaaatacaattaaagaaaatacaaaccttagaaaattaggtgtttagtgttcgtgtgtaatagaaagttgagaattccataaagatgaccaatcctgaaaagactattatataatgcgtcaattactcattatcacttaattgtgttagtggtcacggaaagagaaatctgatgactatattactggattcattactagcttcatacatgctttatcaatataaaaatcaataattacaagtttgcttaacgcaagagtcggcagaacaaaacagatggcatatgtatcaatcaatctatgtattgtcaatcgtcgggaattattattttatgttctaaacttgaaaatttggaacaaaatttggcatccagtgacaatacaaactccaatacactttgatggttctcttaaactgaaatcaatgtgtaaattatatatatatgaaagttggccaactctctccaaaatgattgacacattatcactttagcatttgtcatgtgtctattaagtaattaatataagcttttcaacttctaatttatagattaatgatatatttattatttaattttatatatttaattatagtattactaaatttattttaatattatatgatttttcaataaaactattttaatagttttctcatactcgaaaattttattttgtaatccaaactcaaagtaactatgaatatataatagtcgtggattacttaatgatttgagtaagttattctcttaaattgatatttatattcatttaaattgatatttatacaataaatcattgagggtgaagaatacgtaaggagctccatcatcaaattcttagggttttagaatccaaaactactctctgttaagttggtttaatacaaacgttgtttatgaattatgtgtatgatgcattgttgataatgttgttagaaaaaatatttttaaaactaaaagtaattgcttattgtataagtgaataattagataaataaaaattatatttaaattaaacaatacgaaaaaattcgaaaaaaccgcggcgtagcgcggatgatcacctagtacattgaaaaaaaaaatcaattttattagaatgtcccacattgcttgaaattaagatctttgaatattatataaaggatgtggcaatccttaattattaaactagtttttgtgttaagttaggttatattcctaataaatatgtatattgacaattaccaaaaattatacccgaccatcaaatattttttaacttcataagtttgaaattacaatgaagttgatacgagattttaaacttcattttttattacatagtattggcatatctaacatcaactaaccaatggaattcacaaatgacttaatcatatggagtaaaatatctaaatcatatggagcccgcttttatggctatccaatagatattctaaagaggcatatgccttttggagactaaaagttttaattagtagttgtgattaacgtttcgaagtataagctgtgaatagtcaaagagtagctcaatttcagtcacctaatcatataccaatctttatttcatttgaaagatagaaaaattgaaaactgatataaaaataaaaataaaaaaatcataacatgtcactatacgcattcaggatcaaacattatcttaatatacacttatacgataactatatgataaattcttaagcaagcaaagatatttcataagtattcattacacatgcaaacaaaaatctatttctcggtggtgttatctgttattagactcatagaaaacaaattaaattaatgatttgggatgattttatttagttctttcgaatcagcccactaaacattgagattttgtggcaacaaaattttcttaaacctcaagattgatttcgatatcctttcatatacatcactttctttaatttgttatagtggttacgacctcgatagaatataacggtcaataattgtagtatatattttaccaaaaactaaaaaacatgacggtcaaagttacgatacgaatcgcattaaagaaaatacgtatgaattattgaatactgataataacatattaactacttagacctttcctgatcagatctaaattctcatatccattatactttataattattctgtaacaatccgaaatatttgatatttttctaaatttgtggaagtttatatagtaatacaactatttggatacgggatttcgcattatagtttgaataatagtttccaattatttggaccaaaaaaaaagtttccaatatcgtttacccggtataacttgttcagatcaaaatccaattaaaaccggatatttggttggttgaaccggatattaccaagttttgatttgaattttcggttatcttttaatacgtaatcactaaagactaaactaaaggatatttacataattagtgccacgtgacaccaaaaaagtcacgcacctggtcccatcatgatatgtcgcacgataactacgtggatagagagagccccaatacgacaccgtctcactcctccaacacgaaaactgagtgggcaccgtgtacgtgtgggacctacttctctttctccgacgaaacataaaaacaaaaaacaaaagagaagcaataagattagtctctttctcgctatcgatctcgtttgatcataatttctcaatcaaatttctttctctaaaaaggttttgctctttataaatttattttgattacttatattaatctatgaatg

SEQ ID NO: 2875 - DNA, 2042 bp, Unknown
  misc_feature (1)..( 2042): cDNA_ID_2049353_gDNA_ID_1620612_Annot_ID_161930 3000 nt of promoter + ATG
aagcttgcatctctcaagaactctgacaatcagtcaaagggattttctctgagccttatcagcaaacttgaggtaagatcatgtttctccaaactcaacactttcttctcgattttacaattccatcataaacaaaggtcttctctgttccttctccaggtcattgttgtcagtcttatttaatctctcaaatcgaacatttaggatatgtaataacatgattaagccattgtcctagaccaaatacagtttgcaacattgtagatgtaagtgcttttggttttgctcagcgtaacgatttgtctcttgctctactagtcaggaactagcgaactccttggatttagagacccggcaaaacttatcaggcttcatggatgctgttgagaaaatactcgtgcagcaaacccgtgaagaactcaagtccaatgaatcctcccaaaagtgagtaccaagaaccacctcaagagtttgtgcagtttctatctccttattgtttttgtcttgggttgttatctgcaactctttgttgtaattactttggaaattggaattgtatcaatactcttgcttatgtcctcaagtttcctttatatatcaatatccttaaacacattattatcttactctccgccatatataatcagagaactaatgaaataatctccaaataatctccaaatacttctccattctggttaatggaggaaaacaccaaccatatataacttacggagaagtaatctccaaataatctccaaatacttctccattctggttaatggaggaaaacaccaaccatatataacttagtgattacttctccgtaaggtgacaacaaaactcagaggtctctttaaatggaagaagctaaagttgttctttgagtgttttaactgttactttagtcaatttaaggaagtcaatatggcttagtaaatcaattaagaaaaccatttaaaatctaccaagtttagtctaaaagactgttgtctacacttagctaaaccaaaaaacagaaccagaaccagcaccaaataaacctaatgaaatttccattttaaattaaaccacgttcagattgttcttgtcttcacttgagattcttgtgcagtggaacctctttgccttgtagaaagtttttcaatcgtttgcttcaagacaggtttcaatctttctcttacaagagtgacctcgcgcagtttctgattcaaccggttcaagatcgcaggtaaaactctttgatgattttctttcactatttcaagcatatctctaccatataaattttctgcacatctgtagaacttccctccaagatctttcaggtccctctctccgttaataacttcctctgcattcttcgctgcacttgttagaaatcccaccaacatatctagctcgaacatctgatcttcccagttgtacatatctttttcgatatcggttaggttcttctgtgcctggatatcataactgttcacaacccaagtgttgtttagtactgtagacgagaccggtgtctgttcttccttgggaattagcttatagttaggtgtcgctcgttcagtctttctccttttcttcagaggtctctcaggttggtctgattcctttggaggcaacattcctctcttcccctttccctccaacttgatcttatccgactctgtgtcttgggggttatcatcaactttaaccctagttccagcctcatcttctccatgaccgtaggcaatgtctacgaaccgttgataaagattcttgtatttatcgatcaaacgttgaagagacttaacgaattggctgtaatcgattctatgagacttaaagtctttacacaagcaagtgtaaactctcaattccgaccgagttagtctctcctcgatagccttcaataactctgtcaacttctgtttcgcttctaaacggtccttcatctttctctccacatcgtctttaggtttataaactatccgtatacgaggtatcatctttggttcattaagaagaatagggttctcttccggcttctcatcatg

SEQ ID NO: 2876 - DNA, 3000 bp, Unknown
  misc_feature (1)..( 3000): cDNA_ID_3070333_gDNA_ID_1620612_Annot_ID_161951 3000 nt of promoter + ATG
ttttttcctcttttttctaagatacaagaaacttgttaatcaatcattatatatagtgttttttttttctaatcttgttagtatcaatgatatacgaatcatatttaaactgctagttgtaattagtagtttgtatttatgtcaccatgttcaatcttataatgtgtttagtagtagtttccttttgagctaaaaaggtttgcaaagattgtttgttatttggtccttacaattttagcttgatctcttcggagtactcagattggcaataacattagtttctttttaaaacatactcatttaaaccttttttttggataggttgtgccaaatgaatccgaaaaacaaaagagtttataaaacaagtaacaacaaatctagagattggtaataagaattataggatgattatagcacaaaacacgtggtggtacgcatgtgtgtatagatagatacgatcgataataatgctaacgacatttatttcggagaaagagagtaggaaccggcttttaaaggcaaaaggcaatttgtattctctagtctctccactctccaactctcattttcctcatttattatcttattttcttttactctctttttcttttattctaatgattgtaacaaactcatatcgcaatctttttttagaccttatgatttgtgaaacaagctcataatatctaaggacaacttcaacttgtatatcaacaaggtaacggtatggtgtggatctgtgacaccttgtatgaaataaaattgtaactaggattttcgaagtttaattctctacaagctaacaatctcaaaatgcacaatatcgcgtcttaatggtttgaaaatggacaaatttgggtaatattaaaaaatgatgtgtgagtgaagttaaggccaaagggaaggaaaagttggtcgtagacttttttccagtctcttctcttttgtcaatatacattgatcactacacgacaaaactaagctttttctccagtatttcagcctttatacagaaccgaatttatttagtcaaataagtatgctttttttctttaggtcaaaaagtcaaaaaagttatgctatacatatgatggaattactcttcttgtggagaatcgctttgcccctcgtctttagttatctacggaaaaaagtacagcttctatagtatcgatcactctatactaacacaattaggcatagaggctagcttttgtatccatacatgcaaaaacaacacctaaaatattattcttcttctttttgtgaaaacagtaattatattcgaatgctttacacatttactctaaatcattaactgtgaagataaaggaaaatttcaaaccttttctgagtttaatgtaaaataataattggtccaaatttggaagaagaaaatgacaaggtatggacaaaacaaaacttttggggtctggtccttcagattcctcatgggcggttgtgtgcttcttgtctttttttttctcgcccagatatctctggttttacctttgaaccaatttaaacctcacataaatttgagtacttttgagttttaagcgaagttattggggaccttacacgttctggtttcgatattttagaggcttttttattggctatccctagattaggttttcgacgattgttcattgtttttatttgttgggtatcttttcttatgaaaagttacacagacgcattactttgttatataagttatatatatatggtttatacatataaaacacaatattttcacacttaattcagtcctttcaatgagtcttttaagattttccaagtcatctcacgtgtactgtttttttattccgtttttaggcttttcctcttcatcacagaaatttaaagagcatggattccagtttataaaccaagtatttgcagctagctagaaaattttgtttcaagagaagtcaaagaagtacaccttttttttttatctccgtttttatacacttttaaataccagtttccccggttggtggcgagatattgactccacgcacagctactgcttttgaaatatcaaatatagctaatgagtcattggtgtatactaatatatgtgttttattatactatataaattgaaaacatttaattacaataaatatcgttttctttcatatccattcttctgaagatttgttattaaagaaagaaacttgattacaattagttgcttgtattttatatttttccgatgtgtctatatatgcgaaagtctaagggagagaaacgaaaatgatgtatatataatagaattatattaatttgcgttgttattattgtaagacaaaaggtcattttatacgtttcgtagatgactcctatgattagcaaggattgatgttaatcaatttattagaatttgccgtgtgctttattcttcattgactataacttaattaagatttatggttatgttaatgtattgagaatttgagatcatgttgacgtctaaatgtcagattagttaatgcatttattttttcgaaaataataataaattagctttaaaagaaaaaaatattgtttttacaacaaatgcattgtttgatagaaaaaaagacactttgatacacaccaaaaaaaaagaaagacactttgatactctaaactttacacatacaaacaaaactagtatatatacttcatatcgagtccaaataattattacctttttaatactaccaaaaagtagagtttcgttttcacatggagtagtatattcttatttatgatggatattgttttatcctctaagatgctatgtagatggacaatgaatacaaatacagccattgttgaaaaggccataaatgtttggatgtaccaaaatgcgagcctaataaaatcggtggttgaatgtcaattaaagaaccataaacctaatccatctctcttctcctttatatatacgcacacaacttatcaaagttgtcccatctaacaaaactcttgtacttaagcatg

SEQ ID NO: 2877 - DNA, 3000 bp, Unknown
  misc_feature (1)..( 3000): cDNA_ID_3070337_gDNA_ID_1620612_Annot_ID_161950 3000 nt of promoter + ATG
gagagagatcgatggtcttggcacacggtttcggaggcgaccagtcggtttgggataaaataataccggtcttgtcccaatccttcaaagttttggtctttgactggcttttctctggagccattaaagatcaaactctctatgacccttcaaagtataactccttagacgtcttctctgacgatctcattgctcttatggaggagttgaagtttggccctgtcgtgttcgtaggccattccatgtcgggggtgatcggttgtgctgcttctattaaaaggcccgacttgtttacaaatcttctccttattgctgcttctccaaggtacgcttcactcttagtataacacttacccttaatcataattggaagtaaaaatcaaagcatatgtataatctatttctgttctgtataacatcatttaggcctatatattgaatctatttataaaatatgataatatatctgtaaataagatgaagaccgatgatttagaatttataatttacgttcgaaagagaaatctaagcacatgcaatcaaaattataaggttatacagtctgaccgatcgtacaagattccttcgtgaatatgtgtttgaggaaaaagacaaaataaaaataatgatttacaataatatactatattagccaatatttaatagtttttatgtggttgatatctatatgtaatgaagtgtaactgttgccaagtgttgaacatgtggacatgatcagcttctagcttgttggatggatatgacatatgatcacatcttctcttacttctctgcagtctacgcatatatacgtagatgaatatatgtaaacatgctacatatgctatcaatatgtcaataagacattcatttcatacagatacatcgaaaattagaaaaaatgtgttatgattttattatcatatgatgaatcaatatatttattgtcatttttaaagttagaagtactaaaacttaacccatctttatatatcacgtggaccactaacatactatattctcctatatatagaaattatcgaatgggagttaactgtttgaagtatcatactttgactgattactttagatatttattatagttataggtgagaaagtcggccataatttaatgcaacaattgataatgtttgactatatatatcaatgcaacgtacttataatataaaagaaaatgattttttttttttgcgcaaagagaaaatgatatttagatgatcaaattagtaacgttactagattgaaatgcaaataggtatataaacagtgaggattacaaaggagggtttgagtcaaaagacattgacacgatcattaccagcattggctccaactacgaagcttgggcggttgatttctcctcattcgtggtcgactcgagagactctctctcggtccaaaggttcgagaagtcccttaagaagatgaagcccgagacagctcttgccttagctaagatagtgtttggtagcgacgagagagagattttgggacaagtgtcagtgccttgccatgtcatacaaccaggaaacgacgtcgtagtgcctgtctccgtcgcatacttcatgcaggagaagattaaggggaaatcgacagtggagatcatcgaggacgcgatcgggcattttccacagatgacatcacatttggagctgcttggcgtcatgaggcgcctccttgagttttaaggcttatataagagctttgcgtcgtttgatcgagtttcttcttgtctataatatcgtattactaatataacgaagtgggtctattagaatttttcatatatgtttgtgtaatgtgaatgtgttattatattcttagcacaatgattttcatttttagtgttttttttttaaacataggattgaaagtaatatgttataagtttctttatatcacactgtcaaattttttatttcttacgataattttgttgttgttgaataaaacattccaagaaaaagacaaatacataatgaaaaaggttatagtgttgtagacaattgatagtggactttgttttggccattttggcatgcttgtccaatgtccactaccaaattattttgaccttcttgtaaacatacacacttgaaaatcaacaaaagcttgatccattcttgaatgacgtcgtgtattaagttcttcgtttgaacgttcgttgtttgtccgatgttttataagccctatatattattacatagtcagagtttcgacctaagatttcctaagttaacaaaaataaaaataatactattaccaacattaagtaaaattggttgttcggaccatatatcactggtatttttattaaatcaatttgacaaaaacaaaatatttgaccaaaccaaacttgacaaagtatcattgcaatcagtcgttgacttctgtttttatttctacttagattaagcgtcttgtgggatgttttaaacaagatatatagaatgatacgacattgaccctgatacaataataattatttacataaacatatattatctgaagagcaaaaacattatctggatatctgaaagaaccatattgatataattggcctgttattacgaacctttttttttttgttaaagctgttattaagaaccttgattgaatatgattaacaaaatacttatttattgtccgtacgtttcagtttgaatggattattttggtgtaacttgatgttagatagttaataataaacatcggagaaatgtcaatgtagtaagtgctctcatttctttctttcgcttttgatgcaagaagaacacaaactatataactcatacaaaaataagattacgtatattctcctctatatcggtgtaccaaaggttttttaaaaagattgaagtaatcaaaactcaagtctagtctcggtggcaagagagatcagacctcttttcccgcttttaacattcttttttcttctttatcccgtcgcttatttttttttactagcgggaagatatg

SEQ ID NO: 2878 - DNA, 999 bp, Unknown
  misc_feature (1)..( 999): cDNA_ID_3070329_gDNA_ID_1620612_Annot_ID_161953 3000 nt of promoter + ATG
ctttatttcattttttgctctccaaattctttgaggtttgtggatactacttcagaaatttcaaaaccttatacctatagagaaaagatattttttaaactccattctacttttgatttctttatgtaatcttattcaaacatgttttatgtttctttaattatgtctgagtaatctccttcttgggtttaaagtttatcattagaaatttagatgaaatcgtaaatcgataatctgttagtatttatccctagagttcttctcctttgattattcttaaagctagttctagagtaacgaactaaaatttgattataagttaatatgtaaaatccgagatgcgtttattactggaattattgttaggagagccttaataactagatgactgccaacccggtttagatgcttaggtaaacttatcaaactgaattctaatgcttgcttaattctagtaattttagatggagacacaaaaccaatattgttaggcatagttagtcaattataacgagagtcgattaactatagattaagatttgtagttttagaacggtgcaataacaatcttgattaattgctagatctactattagtctatttttttgaaaatttctctaaatctaacattttaatcatctgaatttacttcaatcaaatctgctttcctgtctttttaagttttaatttacttaattttgatttatcttaatttcgaaacatttaacattttgtgttaacaaaagaaacttttgtagaattcaacatacatcagtaaaaacttaattttgatttatcttagatgtaatttgacacacatcagtaaaaaaaacaataatatctgattacaaatgtaaaaatttatgatatattgaataataataataaaaataataaaaagctttgaaaaagttttatcttttaaagagttgagcgatcaaattatcacagaccgctagttttttttgccactctcttcgtctctctcttgtagcaatg

SEQ ID NO: 2879 - DNA, 3000 bp, Unknown
  misc_feature (1)..( 3000): cDNA_ID_3070368_gDNA_ID_1620612_Annot_ID_161940 3000 nt of promoter + ATG
ataacagatgctcatatagtacttttttgcttaaatataatggtgctggtgatcttgtcgtatttgtaagagtcaaaacatccatgtgtaggtagctgaggattttcaccctattatatcaagaattaaggccaccactgcttcacttggtggcccgaaaggcgaaatcgcatatgcaagagagcatgagtctgtttggttcaaggggaaacggtttacgccatctatctgggctggtactgcaggggaagaccaaataaaacagctgaaacctgccttagactcgaaaggaaaaaaggttggagaagaatggtttacgaccccaaaggtggaaattgctttagtcaggttgtttcctcgttttattgaaccatccaaaagaaatttattcaataatactgggtatgtattgatatatcatgttatgcttttgttgcagataccatgaagctagtgagaatgcaaaagctcgggtgttggaactgttgcgcgagttatccgttaaattgcaaacaaaaataaatgttcttgtctttgcatctatgcttctggtcatttcaaaagcattattttcccatgcttggtaagtttgcgcttaatcaattctcattaagaaatttctgtagttttaatctaagtactgtgcacaactacagtgaagggagaaggcgaaagtgggtttttccaacgcttgtcggattcagtttagatgaggtaactgtgcttgctagtcgttgagtttgtagacagatgcgtgcaatttctaagaaatcacaaaacatgctgggctgtcttattcttatatatctcatgcacctattttgatatattttaatatagggcgcaaaaccattagatggtgccagtcgaatgaagctgacaggcctgtcaccttattggtttgatgtatcttctggaaccgctgttcacaataccgttgacatgcaatcactgtttcttctaactggacctaacggtggtggtaaatcgagtttgctcagatcaatatgcgcagctgctctacttggaatttccggtttaatggttccagctgaatcagcttgtattcctcactttgattccatcatgcttcacatgaaatcatatgacagccctgtagacggaaaaagttctttccaggtatatatataagcatacaaatctagaattcaccaaactgtttttttttctttaattgtaatgtttgatatcctctcaactggttctgtgccatcaggtagaaatgtcggaaatacgatctattgtaagccaggctacttcgagaagcctagtgcttatagatgagatatgccgagggacagagacagcaaaaggcacctgtatcgctggtagtgtggtagagagtcttgacacaagtggttgtttgggtattgtatctactcatctccatggaatcttcagtttacctcttacagcgaaaaacatcacatataaagcaatgggagccgaaaatgtcgaagggcaaaccaagccaacttggaaattgacagatggagtctgcagagagagtcttgcgtttgaaacagctaagagggaaggtgttcccgagtcagttatccaaagagctgaagctctttacctctcggtctatgcaaaagacgcatcagctgaagttgtcaaacccgaccaaatcataacttcatccaacaatgaccagcagatccaaaaaccagtcagctctgagagaagtttggagaaggacttagcaaaagctatcgtcaaaatctgtgggaaaaagatgattgagcctgaagcaatagaatgtctttcaattggtgctcgtgagcttccacctccatctacagttggttcttcatgcgtgtatgtgatgcggagacccgataagagattgtacattggacaggtacatacttaccatattaatattataaaacttctcttagaatagacagaaaacgaaagttattgattctgaggatttctgttacgaaactgcagaccgatgatcttgaaggacgaatacgtgcgcatcgagcaaaggaaggactgcaagggtcaagttttctataccttatggttcaaggtaagagcatggcttgtcagttagagactctattgattaatcaactccatgaacaaggctactctctggctaacctagccgatggaaagcaccgtaatttcggaacgtcctcaagcttgagtacatcagacgtagtcagcatcttatagtttgaaacattagctgtgtttgtagttgatcatctctatgtgcaattgaacaagtcagtttgctagaactagagtagattactaagaaaccatgccgtttttcattttgagattttgcaaaacggcatgcagttcgggtaagtcggatgccgcaattaccaattttgggtcagtctgtgtaattgtcgtttcataaatccgattaacgtgtactttgaacaaaactcagcagtaaacttctttattcatcaataagtaatgctagaaattttaaccaataagaatatgaccatataactaaataactgataaaccggacattggaccagacaatgatagcaattgcaagataaccgggtttagaatagacatggtttatctaaaactacgtcgtttttagttatttctcttcttccccagaaatcaaaatttgaggtgtcttctacagatcaatattgatctccaacactctctggttcccagatcttcttcaaccttataccctagtttcgcaatttcattctcattttctccgctcttcatctctttcgatcaaccaatgtaagtttgtgacccttatatcccatcaaatcaatcgagtcttctgataccgttcctgtagtgattcgatcataattcatacagaaaccattagatggttatacgtgttggatgtttagagagctattagcagattgcattgggagattccgtagcttgtttatatctcttttgattactaaactctgcagttttataatttatgaaatttgcagttacgacatg

SEQ ID NO: 2880 - DNA, 3000 bp, Unknown
  misc_feature (1)..( 3000): cDNA_ID_3070360_gDNA_ID_1620612_Annot_ID_161943 3000 nt of promoter + ATG
actgagatgaagatgaagaagacccatttgcccatggaagaggaacagattcactagcagcagccttagcagccaaaggacgctggcgaacgaatgggtttgttgattcttttgaagcatttgaagagaagagttgccttctactttcatggaccttcatattctgcaacaccagacaagtaaatcatagctcagtcacgactgcatactcaagctttatcgaaaagaaatcgacggaacaaagaaaaaacctcggttctcatggtaagaacatccttaaactctttggtagtatccatcaaacgatactttagatcgtcaacaacagttgctgagtgagtacttttgtccctgtctctagagttattcccttcatcattctgagaactgcggaacaattgaaggtcgaccagagcagaatttagagcagagatctcttgcttgatgactaccgtcagctcttgtatctcctgagtaggatcatcaaacactgatgtcctctttgcaactgatttgcaacaaaaacgacaaagttaacaattatgcacaaaatacagcatcttccataccaattacacattctcgagtactaagataagcacttgagaaattcacaccactaaataaatcggttctcgatctaagcaccattctaattcctaagctaaagccattacaggttaactaatccagattcacaagatctcaccaaatcaaatgagctaaacactaaaacaacttacgtttcgcaagcttcgatagcttctgcgacgtttgattaatagctaaaccaatatgagaagctctcttgttgaactcggatttgttgataagatcctctcttctcgcaccatcgttccgattattaccatacggcacattattcgccgccggagccggagcaatcgatctccttagagtctccacaattttgaagaattcgtcactccgatctcgatacgacgattgcccatgccttgccgacattattcttcctccaattccttggatctggactctctcagaagctaaaatcaagcaaaaaacgttgagattcaaacgaaaatggatgccaaggtgtgcttaatcttagagatgaagaaagaaaaaacgaaatcggaagaaaagagctaaaaaccgatcaacgcgttggcatgatatttatcattttgtcctttgtgtttctaaaatgttacattttgaccttttactttttattgtttaaatggtaaatttagatcgggaaaaatgtcaaaatttttttgcaaactttcaaatttgggacataaaaacatgaattttcaaaatgttaataaaatcttaaattttggtttgactttataataaaatagtaaatttcgttgattgaatcattataggcatatcgataaatttccgttaataaaaagacgacagagttaatttttcgtttgggaaataaataaatcttatatacatatatgatgtcattaaagagaaaaaccatcacaacgtagggtatcagaaagcttatgaggtatctttctaaatacatataaggtatcgttctaaacccaaacattatgaaaagttaactcggtcatcttttaattaacaaaaatttaacgacatgcctaaaatgactcggtcaacaaaacttaaccattttattataaagtcaaaccaaactttgagatttaaatgacatttagaaagttcatgtttttttgccccaaatttgaaagttctcgttacgagcttttacatattttagaacttgagctgatccgattagtctgatcggtggaacctaaacccggttagataattcgattccataagattttgtatttccaattttataactcgttgaaagttcaaactcaaaaatagaactttagaaatccaatctcaaaaatataattttagaaatctaataataattgaactctcacataaattgctttgaggaattgagcctcttcatcatatttttttttatataactaataaaatttaattcgtaatatactaccagaccatttttttagattgttacacattttaaataagtattaaagtgatataatttatttttttagtatttttatatatagcctctggtatgtataatttattactgtaattataaatttagaagtgtcaaagttaacattctatttaactcattctctatcatatttatattaactctaacatgttctactaattattccgcaaactctttttatttttgaaacaaacaaataataataatcttctatttaagttataatacatgttttgatagattaaaccgcaaaaaatatataatcgtaaaagttgtataaattgcatatctctgtgagtgactctgtctatgaattttcgccattagatttgattaccacaaaattttcataaaaaatttacaattcaaatcagcaatgatctcacctccagattttcgttctccagaagatatctttctctaataacccaacactaaatcgtttgcagaaatattagtcacatactcacatcaaaacataaaggagagaatcctaagcaaataatagaatttttgtccttaccagcaccattacaacaaaaaaaattagtaaccaatttgtaaaatatatttgaaatactaaaagcttttcatttttccactaatattttgacccctattaaatacctctatctactgacagaaccagtaacatccacctttaactttgaaactctcatgtcaatcaattcccaccaatagaaatgaagcaaacttatctattaattttcacttagcccctcatcttttcaaatattacaatttaccctaataaagaaacaaacaaaaaaaaaccttttttattgaatgtttcgagaaagttgaatcgttaccgccaaaggcaaaaaaaaaaaaatttgcagagacaacagaggagagaggacatgagctttcttccttcttcgtcaaatccactattctagggttttcgatttctctcttcagccatg

SEQ ID NO: 2881 - DNA, 3000 bp, Unknown
  misc_feature (1)..( 3000): cDNA_ID_2049313_gDNA_ID_1620612_Annot_ID_161944 3000 nt of promoter + ATG
cttatgatggtatactttttcacttgggttcttttcgcatgtagcatcgtctctggtaccaccctcttcatcctcagaacaaacgaaatcactatcagagctctctacatcagaagaatctgaactttcccccacgtaatcagatgagtcagaatcattagcatcttcatccatatcactctcaccagaatctctatcttcgccactaacttcctctcttgaatcagtccctaattcctctaaagggtcttcctcatcatcagaactagaacttagacttacaacctcatcagacacataagtcttctcctcacccctcaaattagcatcatccagaagaatatcacaaacctcagaaccagcattgacatcctcgacatgctgattctctcccgcgatagttccaaggaaaacaacatcatcatcatcatccggagataaagggttctctttaccactcactttagcatcatcctcatcaaaatcacaaaccctaggagaaatcaccgaagcagaaccaacattgtcatcatcctctacatgatcattctctctctgaacagttccaacgaaaacaacatcatcatcatcatctatagggttaaaattagaagctttctcttcacatcccaaattacgatcatcagcatcaaaatcacaaaccctatcaccaaaatcaaacgatttcgattgtaaattcccagaagtagaaccaacattctcatcatctcgcttaccttcaggatattcagttctaacaaatacaacatcgtcgtcatcatccttcctccgccgtcgtttcttcttcctcggagaaggtgaacaagcatcacgcatgttaactctcctcttctcagtcctcgaatttacacaacccagagactgatcttcttcttctccagaaatcccctttgatttattgagaatcgagttcaagtaagattcagtcctcgaacgagttcttctagcaacacaactagtcatatccatggctgaagagagaaatcgaaaaccctagaatagtggatttgacgaagaaggaagaaagctcatgtcctctctcctctgttgtctctgcaaatttttttttttttgcctttggcggtaacgattcaactttctcgaaacattcaataaaaaaggtttttttttgtttgtttctttattagggtaaattgtaatatttgaaaagatgaggggctaagtgaaaattaatagataagtttgcttcatttctattggtgggaattgattgacatgagagtttcaaagttaaaggtggatgttactggttctgtcagtagatagaggtatttaataggggtcaaaatattagtggaaaaatgaaaagcttttagtatttcaaatatattttacaaattggttactaattttttttgttgtaatggtgctggtaaggacaaaaattctattatttgcttaggattctctcctttatgttttgatgtgagtatgtgactaatatttctgcaaacgatttagtgttgggttattagagaaagatatcttctggagaacgaaaatctggaggtgagatcattgctgatttgaattgtaaattttttatgaaaattttgtggtaatcaaatctaatggcgaaaattcatagacagagtcactcacagagatatgcaatttatacaacttttacgattatatattttttgcggtttaatctatcaaaacatgtattataacttaaatagaagattattattatttgtttgtttcaaaaataaaaagagtttgcggaataattagtagaacatgttagagttaatataaatatgatagagaatgagttaaatagaatgttaactttgacacttctaaatttataattacagtaataaattatacataccagaggctatatataaaaatactaaaaaaataaattatatcactttaatacttatttaaaatgtgtaacaatctaaaaaaatggtctggtagtatattacgaattaaattttattagttatataaaaaaaaatatgatgaagaggctcaattcctcaaagcaatttatgtgagagttcaattattattagatttctaaaattatatttttgagattggatttctaaagttctatttttgagtttgaactttcaacgagttataaaattggaaatacaaaatcttatggaatcgaattatctaaccgggtttaggttccaccgatcagactaatcggatcagctcaagttctaaaatatgtaaaagctcgtaacgagaactttcaaatttggggcaaaaaaacatgaactttctaaatgtcatttaaatctcaaagtttggtttgactttataataaaatggttaagttttgttgaccgagtcattttaggcatgtcgttaaatttttgttaattaaaagatgaccgagttaacttttcataatgtttgggtttagaacgataccttatatgtatttagaaagatacctcataagctttctgataccctacgttgtgatggtttttctctttaatgacatcatatatgtatataagatttatttatttcccaaacgaaaaattaactctgtcgtctttttattaacggaaatttatcgatatgcctataatgattcaatcaacgaaatttactattttattataaagtcaaaccaaaatttaagattttattaacattttgaaaattcatgtttttatgtcccaaatttgaaagtttgcaaaaaaattttgacatttttcccgatctaaatttaccatttaaacaataaaaagtaaaaggtcaaaatgtaacattttagaaacacaaaggacaaaatgataaatatcatgccaacgcgttgatcggtttttagctcttttcttccgatttcgttttttctttcttcatctctaagattaagcacaccttggcatccattttcgtttgaatctcaacgttttttgcttgattttagcttctgagagagtccagatccaaggaattggaggaagaata

SEQ ID NO: 2882 - DNA, 3000 bp, Unknown
  misc_feature (1)..( 3000): cDNA_ID_3070341_gDNA_ID_1620612_Annot_ID_161949 3000 nt of promoter + ATG
cacgtccaccgcatttcatgagcagcggcagcagcggagactacgactcaaactactcggatcaatcagttcttcctccaccatcaccagggcttgcattaggcttaggcatatatcaaggcactttcaattacgaggagctatctagagccaccaatggattctctgaggccaatttgttaggacaaggcggtttcggatacgtgttcaaaggtatgttacgtaatgggaaagaagttgctgtgaaacaattgaaagaagggagttctcaaggagaaagagagtttcaagcagaggttgggatcattagccgagtacatcatagacatttggttgctcttgtcggttattgcatcgccgatgctcaaagattgcttgtctatgagtttgttcccaacaacactctcgagtttcacctccatggttagaaaaaataaaaaataaactctcttattgtttcttgcatccttcaatgttttcaattagtaaattcttgggaatcgaatttgtgacaggaaagggacggcctacgatggaatggagttcaagattgaagattgctgttggttctgccaaaggattgtcttatcttcatgaaaattgtaagtctataagatcatgtgtaataaatataggtcatggtataattccatatttgtttctcaaaataaataaatatatagctaggtcatgtttgtttactcgctaggcatttatatatatgcaggcaatcctaaaattattcaccgtgatatcaaggcgtcaaacatattgatagatttcaaatttgaagcaaaggtatgatttattcttccttttatttgttatttggtacgatattgtcatgaagtatctttgtatcatgtgtctctcttctatttcttaggttgctgattttggtcttgccaagattgcttctgatacaaatactcatgtatctacacgtgtgatgggaacttttgggtaaagataatcttgaagctaccaaatatctacatttatgcagttttgttaaaagtttatgtgaatctttacatattatgaaacttttggattttaggtatttggctccggaatatgcttcaagcggaaaactcacggaaaagtctgacgttttctcatttggcgttgtacttctggagctaataactggacgtcgccctattgatgtaaacaatgtccatgcagataacagcttggttgattgggtaagtaatataattacatgcaaataatctaaccttcacataatgtttacgatgtgatttttgaatgaagaaaaacctatgtgtgaataatttggaacaggcacgacctttgcttaaccaagtatctgaattaggaaactttgaggttgtggttgataaaaaactgaataatgagtatgacaaagaagagatggctcgcatggttgcttgtgccgcagcttgtgttcggtccacagctccacgtagacctcgcatggatcaggtaaattaatcattcttttcttttctctaaaggcatttacgctttccggttttcaaactgtatacggagttagaaacctagaaccaagatattttcatttgtcagttcagtttagtttttggcttcggaacaatataacttacaaagattgatttatatttgggtcgttttggttgccgctccgaattggtttcggttaataccgtgttcgatctcagttggtttggtatgtatgcctagccttatattttgcttatttgatcagccctagcaatgggacaaacatgttttcttagctacaccttttttcaatttgctaaatagtagtcattttaaaatgttactaatgctaatcgaatgagtgattggtgtaaaaataacgagcaggttgcacgtgtgctagaaggaaacatatcaccatcagatctaaaccaaggaatcacaccgggacacagcaatgtgtatggctcatctggaggaagcacagattatgactcgagccaagacaatgaaggcatgaacaagtttaggaaagtgggacttgagactcaagatttatatagtaacccaattagtgaatatgatttgtacccgtcctggtcgagcactgacggtcagaccacacagggaaaggcgaccggcaatattaaaagacccggtcaaggttatggttaaagatgcaagaaattacatgtttttttttttttgaattcttctttttaactgtaaagatttgaggaaatgttttaactctattgaactacgatctatatatgatacacttatatgattttgtatatatattttttttcattctttggtatctttccatagaagatgtgatgctaataataatactcacattgaggaaaaaacaaagattgaggtttggtttgtgccgttttcttttcaatcatcaattaaacaaaaagaaattttcacaaaagtggacgaaaaaagatttgctctcaccgtttgtcaaagtgagaactggttttcacgttttgtcttttcattcaatttcggaccaaattaccttgggaaaacttaataatggcacaaaccaaaccgtgcagcagttcgtatcggttaagttgacggcgtaaaccaaaccctacagcagttggtttcggtttagttgatgcggttcagttttgaaaaagacaaaaaaaaaaaaaactgaaacgaagaaaccgagaaaacgaaaaagagaataacggagagattgagagagaatcagaaagcgaaacgaaattcagtatccattgcttcaaaattcgacataacttcgaattgttgggtagttgaattgtgccactgaactcccacatccgatgaagtgaaacttactgtttttcccggcgaagccaagagaaagttactgtttttcccggcgaagccaagagaaagttactgtttttcccggcgaaaccaagagaaagttactgtttttcccggcgaagccaagagaaagttactgttttttccggcgaaatttgaacctccggcgaaatagcatctttagctatg

SEQ ID NO: 2883 - DNA, 3000 bp, Unknown
  misc_feature (1)..( 3000): cDNA_ID_3070364_gDNA_ID_1620612_Annot_ID_161941 3000 nt of promoter + ATG
ggcagcatatgatcgacaacttcaacaaaccagacagtggatctaaagttctactggcatcaacaaaagcatgttctgagggtatcagtcttgttggcgcttcaagagttgtgattcttgatgttgtttggaacccttctgttgaaagccaagccataagtcgagctttcagaattggtcaaaagcgtgctgtgttcatttaccatctcatggtcaaagacacatctgagtggaacaagtactgtaagcaaagtgagaaacatcgcatatccgaactggtcttctcttctaccaatgagaaggacaagccgattaacaacgaagttgtttccaaagatagaatcctcgacgagatggttcggcacgagaagctgaaacacatatttgagaagatactttatcacccaaagaaatctgacatgaataccagcttcttctgattgaaatatcatttctctctgttaatcccactctgagactctaggtgtttatattacttaacttccagctttggaacagatcactctagtaatatgtaattctgtgattcaatttcttctagttaatgaagttgtgtattttccaaggctatgctaatcgaagggaacaacctttagtttgaaagattcttttgcaggaagtaaaacttgagagatttacaagacataacaaacaacaggtacttactacaagatgggaaggaccaacataactaaaaccgcggctgcgactctggtcaacactcttgaagatccaggctgcaacctcgttgaatctcctgtatcaatcattacagggaactcgcaaagttcatcagatggatcttcatctgtgatcaaacccaaccccaagaaatcgcagtcccatgttttctgatcgtgcatctgataatacatattaaaggcatatgaaacatttcctgtagcagtgagatggttacaagaggatccatacccgagtgctgtgcaatcagacaaactacaagcatagtcgatattatcaggcaagtcatcgaggttatatgcattagggtcaagaatacaccaagttttgggcagatacttcacatcttccacaggaaccaaaggcttgtcatttcctttacctgacaagtcaagctcatatttcggtctcccatcaaactcaaagatcccccagtgcctctcaaaagtccccggtgctatactcttggcgtcctcatcaacaaggctgaaaaggtaaacatccataatcactcctttcctcgcaggcgttccatttccagacatagcatgctttaccattccctgattgaatctctttgcactctttacattagcgttcttgtctccatccgtaggccacccgacctctcctacaatgatcttcatccccaagaagctatatctctccatagcacaaatcaaagtgtcgagattcgcatcaaacacattggtgtagaccaaatttccatctctcaaagacttgttagtcccatcaaagaaggcaaaatccaaaggaaagtaagcatttccatagagactaagaaaagggtatatgttaaccgtgaaaggcgaatcatgtgaatacaagaaattgattatctcaatcgttgcatcccttagctcaggtctaaagtctccagctgatggaacagggttcgcttcaggggaaaaatagatgtctgcgttgaaaggaacagtgactttcacatttttcagatcagcttcctctagtgctcgttggatgttgataagagctggtaatgtgaactcaacgtaagttccattatatgtctgaaggaaaggctcgtttccaacagctatgtacttgatgttgactccaccgttgtaagaataagcagtaacgttttcttcaacccatgaagctgctacagatgtatcttgagccatttctttaagaaaccggtttggtattcctatcatgacttcaatgtctgagccaattagagcgtctaagatgttttggtcggcttcaaatagtttcagcttagtgaaactattgtccattagcatcttcacaaccttttctggtggaagctggtgactcgccattattccccagttaactcctacattactcgtgttgcttgaggcaatggaaacttgtgagatgataagaaagtaacaaagaataatctgatgattataaaagtggtttgttgttaactttgatctctctcctgccatttttttctctgtttatgagtcttttcttctcttttctttatggagtctttgttaagggagaagatgaaatgtgattggatatttgtgatttgtacttagttcagttaaagaagcagacacaacatgcaaaatagccattggtgaaacactttgtgcatgcctatctgataaatccattgactcaccacaaattcttatgtaattctagatgtttcgtatttgttgtgccaaacaaacacacacactcacacactgcactgagtctagacatttagtggttttgttttcttattattaatactcattagagtattaagtttgtatagaattcagaaacaactgatagtcattttaagatttctaattacaaaacttttgatcctctttgaaaagcagagaaattacaatctttacaaacaaaactgagagattagagatgtgttcatagagatgggttctttgttagacattccaaaaagatacaaaactagccgatgattaattttggtaaattaatgaacaagaatgtaatttgaaacattatagggagcaaatgagaaattactctttttaaaaggctaaaatcctaattacctttaaactaagaagacaagaagagaagagaaaacatgttttccattagaggactgtgagattgtgaattgcatagtcgtcgtcttctggcgggaaaagaagccctagaaaaagggtgaaaggtgaaaactctacttcttcttcttcttcttcttcagagtgtgagagagatgcattggattgctaccagaaacgccgtcgtttcattcccaaaatg

SEQ ID NO: 2884 - DNA, 3000 bp, Unknown
  misc_feature (1)..( 3000): cDNA_ID_2025284_gDNA_ID_1620612_Annot_ID_161938 3000 nt of promoter + ATG
acaaatttgagaattgctttgtgaacaaaatctgattaaaatacttagaaaataaaaatctgttgaaccatttgaattttcaccatagttctatttgtgtttttcgactcttccgatcagtcatgtgatttatattttataggcatcaaatgtctttggaaagacacgggaactatattctagagattaggtcttaacgtatttcgtttcacttcttagaaattgtcctaatcttcgaagtgccccaatagttccaccgtaacagcttgagagattcaaaacccatacgatcagtttacgcattatttaagtaattatgatttgatgatgtaccttattttggcatttaaaagattcattcataggtaatctatattaaaaagaaaatctattacctttgactagcaagtggatcggtcagtcgatcggtcaagcttggcatgaaataccctaaatccgaccctagttctagaaaattagtctaatgtttgtagtgctaattaactaactactatgttttgtcgcatcaaaaatttggagttgacgttagttttgtcatggacttaacaaaagaaatttcaaccgtccaattgatattttgataaataagttgcaatatgtatacacgtaaacttaacattcagtatcctatttattggatgttactgaaaatgttatatgtattttagaaacaaaaaccaaccgatagttttggttttaggttcatctgaaatacgtacccaacatgaaaccagagacataatacatagtttgtgattttcataaaacgctattaatgacatataataactcatctttcacgtagatatttcttgttatattagtattttgcagtatttttttgtttgatttctactatggaaaaagatggaaacgctagacattcatttttttggattgatcacaatatctagaaagaaatgagaagagacattacaaatatctaagaggagagaattataagaccacctgtcccatggtgacgtacaaacaccatcaactttttcatattatttggtttgtttctatagtttattgtaataactccttatgtggaatccaacgaatcttatacgacaacaacaaagattagtgtaagatcgcatgtataaatatccttgacacttggagaaaccttagtggttcaataatgtgtataaccttaaaataatccagcaccatgatattcttttacttttaattatgctttctaagaaaatgttcattaaggaagttaaataattataataatcataatatatgtccctgcattaaacctctagatcatatacgtggcaacaaaacacaagttgtaaataactttagcttaaccctatcaaaaagataaaaatttagattaaaaggattattctattggatttgatgccttgttaaaccatgttacctaatgccttaacattatttctttaatcttgcataaaataatggatcaaaatgaatagccctgtaatatcctcgtttcgtgtatatgagaatgatgaagcttgggtggcttaataattataacatttaaatttgatttagtttcttaaacttttcaatagaattctaactgaaatcaaataaattatgctttggatctgtttagtttttgatttaggctgaattcgtttatatatatatatatatatatatatatatacaaatataatttctgtttgatttaatttatttttcttttttttggtttaacatattaaaaacaaaaaccctaaaactaatgagtttaaaacttgtgtagtaagtgaacggttatcttggtctgtcgaggttatgtaggaaagatactctttgggaagaccttttcagaaattttgatgtgggatcgatagctcgtaaaattcttctgattcattccaccatatgcgtaagaagtatttgcttatagcctatagggagacgatcagatagtgcttcaagggaaaattttcattggacccttcactgtttcatttgaagatgaaaattttgttataggttatgaagaatatttttctataaggatatatattgataggtttttgaaactgattgtgatgaagtagccacaactcaccattgttacgtctccttggaattaatccaaaaaatttcaacctaccatgacactagtttacaatgtgttaacttttctaatttctcgggttttattaatttctatacttgtaattcccatacagagactattaagcttagattcttagaattgtttttaaaaaaattaaacttgtaaacttttgtctttcagatttggttagcaactaaggactcaaaatgtagttggagaaaagaagaaaagttttggtttaatgtatcaatgcatgttttcatccatgattaaaactcaaaagaaatataccaacaagaggggtaatttagtaatttgtgtatgatgatgcctttggagatcaagagttgaatggacagaggaaatgatacatacgaaagacttatgaaaacgaccagtgaaaaggggtaacgagagcacccaagttctcgtaattcttttgtgtttacattaaattctaattattgctaattaagagcttgtagaactatttttgtagtttaaggggaaaaaggtatgtatattgcacggaattttcttttagttagtggttagatgatatttatgattctaaaaggtacacaactctaaaaatgtaaaaagattgtcttgtcactagtctatatctctatagaaaacaaacaaacaaaaaaagtggtggagccaaggagctagagtgagtgtatatataaataatgaaaggggaagaggaaaaacagaacaaaacacaacacaaagacaaaacagaggaacacttaggtttcacaagacagagagacaaaaagagattggtgggactgttagagaaggagaagacactacttctcttatttagctttcactaaagaaaaaaaaactaagaagaaataatgagtttgtggggagggatg

SEQ ID NO: 2885 - DNA, 3000 bp, Unknown
  misc_feature (1)..( 3000): cDNA_ID_3070429_gDNA_ID_1620613_Annot_ID_161961 3000 nt of promoter + ATG
tctgccggctctggaaactctccatcctcttcgtattctattttttccttggcaataaagtaagtgtttcctttcaaagacgctccacgttgataagactctatttcccaacggggagcgatatcaagaaccctccatgaattagagctaaaatcgtagatttcgtactcaagaaatctgtgcttcatgttaaagttgtaatattccagaaacctcaagattttgtgtttacggttattgtcgtatccgatagcatacctgtcgaataggcggtaattagtgttaccggattcgatccacctgatttgacccaaataaggattccataccacgagcctaatgttgtcctctttggtcacgcacaacaataacccgtcgcattgaaaaactttagatatcttgacttgattaaaaaaatgacctaactcctttatagatggatccacgaattcggtacctccatcttcgtttaaggttccgttgagatcaaacctcattgaacaaagcttatacttcttcattatgaaccgaaactgatcccttgtttcttctgctttacatagaattcgatctttgaataaagtgttccaccgtttgcaagtggatcgtactgctcctagagaagttctcggaaccctagacaatatctcctctaacaaatcctgcgaaagatcactcatcatcgtcattgtttcaaatataaattagagttctcttattttgcttgcacactcttttctatgtcttcttattatataaaacttttacatatcttcttattatataatgcttagtttttaaagttagtaactcataagattttgatatgtgtaaaagataaatatatttaaattaaaatgaaaattatacaataaattacaaatcctaaaaataaaatgattgcaattactttctttaaaaaggtttataaaattaacaaataggcatttaaattaaatagtatagtaaataactaatcttgaaaatatctagtattaaaaaaataaaagtatacaaaaaagatgaaagcatataatcttattatataattgttgatgtttaaaaattagtaactaattaacatgattgttatatgtgtcaatcatttgatgagatattgatacacgtaatgagattttgatacatgtaaaaaacttcccccaattatattttgacacatatttacacaaaaattaaacttacaaatttgtttacataaaaacatatttattaaagtatataattaaagtataattcaattaaacaataaattttatataaagggaaaatataaaaaataattactattactattttcaaaaaaatattattaaaaggcaatagaatataaattttttatattttaagtaaaaaatcttattatatagtgtttattgaattatccaagatctctatgatcgtgaaatttattaagttatcaaagatttttatatcatcatgtttataattttctatttcatttttttttctaaattatttattttgatttttactttcatatttgaattatataagattttatcatatatcatcgtgcttataattttagattgttacatgtgtcatgatatatataaaactttatattatatatttccaatttgattttctagttagaaatatgtgatgatttcaaataaatgattgtttttgaacttcttttttcagttagtaggtaagatcaacgtagaaatgttattgtggaatcagtagtaagtattatatcatcaacttgagcttacaatcatttcattagagttgatcggtaggttaaactgaggcttagtttctgatttcagcaattttatgaggatttaatatatctaatttatgggttccataccacgagctggcgagcctagtcttgtcctcgttggtcacgcataacaataacccatcgcattgaaagacacattagatatcttaacatgattcagaaaatcatctaactcctttatagttggatccacgaaatcgtcacctcctccttcgttatattttccattgagatctgaacctcattgaacaaagcttatactttttcgtcataaaccccagaaactgatgtcttgcttctccattacataaagtattttctttggataaagcgttccatcgtttgcatgtggttctcaccgctccgagacaagttatgggagccctagagagtatcttctctaccaagtaattcgaaatatcagagatcgtagtcattgttccgaatagaaagaaatgagggttttctaacttgcccactctcttttatatatagagagacatacaaattaggttacccaagtatatttgtcacacaaatatacgtatatgtaggtgtcaaacacggatgtgaacaaattgttgctacttgtatgtggtttataattctcccttatgtcgtgtaaacaaaaccctagatctaggagctcatttagcaagttttgactctattaatttgcctattctttcacaatttcatgtgtagatccctaaccttgctttagctttccgacttttcttaattaatacgcttagaatttaaaccttcttttccatgtatgcagtagtgtcatgctacttgaaagattgtttattttacttgaagtgtaaagagtaattactcgtcccgttcagtttccgatcttctctccgactaagtcttgccggggcttctgcttccctttttttgtaacccgctagaagctgtattggcccattaccaagcccaagttgctggattattaaaataataaaaattaatcatcctgcctaatcacggtttaaattgtgtgctagtcaaagaaaaagtatgattcttctgaagagaaattacataattaccaaagaaaaaaatgatttttttttaggggttttaattagttagaaaaaaggaggctcctttggaagaacaagtattacaacagtcgtcgtcgtcaagcggcgtcagagaaagtctctctctgtgtctaactgaaaaaaatg

SEQ ID NO: 2886 - DNA, 375 bp, Unknown
  misc_feature (1)..( 375): cDNA_ID_3070398_gDNA_ID_1620613_Annot_ID_161988 3000 nt of promoter + ATG
gattatagcttcaggatatgattctctgtttgtgaagaggttaatgaatgagttcaacggtttcgtgtgcttttataaagatggcgtcttttgatgatcttgttgttgtttttcctgattattgagttgactgaattttttagcttcaggaaatggtaaaaatcttagtctgaaatttcgatccttgatatgtagatttcgttcatgtcttgtcgattacttgtttttttgttcttgtgattaatgaaatttgggaccatatcttaaagttcttagctttttgttctcttatggactaaggttttgctctatgtgtcaggtgttgtgaaatttactttgtatgatatatagaaacttgattataatagaagtatg

SEQ ID NO: 2887 - DNA, 3000 bp, Unknown
  misc_feature (1)..( 3000): cDNA_ID_2029104_gDNA_ID_1620613_Annot_ID_161986 3000 nt of promoter + ATG
ttggcttatgtttttcttgtagcatgtcctggagagagggaagcccgatgaaaggagacagatcattgagaagttgacagggaatgttgttcagatgagtcagcacaaatacgcatctaacgttgtagagaagtgtttggaacacgctgatagtaccgaaagagagttcctgattgaagagataatgggcaaatccgaggaagacaatcacttgctagtaagaacaaaatcctaaagatagctctttgaatcctcctggacttattttaacactcttttgttctgcaggcgatgatgaaggatcagtttgcaaattacgtggtccagaaagtcttggagatcagtaaagatcagcaaagggagattctggtgcagaggatgaaaattcatctccaaagtttgcggaaatacacatacgggaaacacatagtagcccgattcgaacaactgtttggtgaaggtacttttctctaaaactaaaacttgagttgtcaatatgactctgctaaagaaatctgaacgttctaatatgttattgttacagagagtgaagtctcagaagagggaacagaaggttagacagaagattttcttttgggttgcagatttgtacaatgtttgacttagacaaatatgtatttgaaaatgcttatgtatatatgcttgtatctatgaatggaagtgtgatggtattacaatatgtatatggtgtggacatgatctgtgattaataatttgatttgcttcttacttctttgttttgacgagaagaacacagagaattagcctcaagaattaaaaaaaactcatcttctacttctcatgggaatcataacactcccaggtgccaaaaaaacatctcatgtccaagccaccacattccctaaatcataacttagaaatgtgatgacaggctttagctttaaagaaacaataataacttaggttacaatttcgtcattatatgagtggtttggtgttggcggcaagcaaaatatctttccaggcttcatagaagacccaagtaatgcctgaagatggcatgactttcaaacaacttgctccccatcctctgtagagtcccatcactccttctttcttcactacttctgctattgctgcagccatgtttggtgggcattctcccttcagagctccaaccatcaaccgcttccgcgctacttccaaggggaagcttatggtgctcgccgttagacctgaccccagtcacaactcaatgagtcttaaacatgatttaagtaaggaaatactgtaaagggagtggtttcttcaattacttaccagctaaagctccaagaacaagcatctctggacggcttaaagcctttttgttcttggatttgcagtatgaggtcttcattttgtcatacatgaagtaataacatgtgctgtaaggaagcatcccgaccaatgttggtcctaagccagcgtaaaatccacggattccatcggctctaaaaattcttggaattgcaaggcttaagcttggataaatctcagggctcacagtcaatctatcctggtaaagatcagagaacatcactctctttcaactctagactaaaaaaattcaatagcgttataaaacagactttgattgactaagacattaccttgaggacttcgagaggatggcaaacaagtgtactggcaataccagcagatgcaccagccacagcaacaggagagatccacgatatggacggactgaaactaaaatcaccgatttcaatcttggcgtcctcaatcttcttcaacttcacttgagctgatgtcattgcacgttttacccactcgaatgtccctaactcaattgcttgcgttggaatgattcgaatcatattgatttcattgccagcccaaagaccttgccacccttgcttctgtacaacttccagaaaactacctggaatgcttctcgatccaacaccaacaatcattcttgtcctgccagatttcacaccgcacaatgcaatttttagttaaattttagacatcaaagtgtattattgaggagatcacaagggactatacagaccttatagtctcaagtggagcaagaacagctttggtcatagctccagctaaagccccactaagaaactcacgggcttccctagacttgaagaaatcctgaatcaaacataacagagagaaaatatcacacaatggttctataaaatcattcaatcaagtagcagacccttatctcatgcatatccaaacaacataataccattaccaaaacataatccagaatgttaaaactccacaaattcaaatatactcataaaagcagagagagactggaccagaaagaacaaaaagaaaaggaactgactttaacaggaatagtgaagtcaggaaagtgaggttggagacgaagatgagaatccgatgaagctgaagaaacagattccttgtccataaccacaagcccttcttttggaacaaccattgccattttctctcactctctgtctccgtttgttctttcaaagattttatcagagagacagaacaagagattcaaaaaagggcaacagagaatattcaattaaaacataattagaaaacaaagaaaaaaacaaacttccatcagattgtgaacagagagacctagaagagtataaactaataatttatgggaagaaagatttaagctttttagggtttatgtgtttctcccaatttttattttattttaacaattttctagtaatttatttacaaccccacttatggaatcaaaacgctcgtttttggccctttatttctccaaaatatctttataactcgtaaccgggcgtttggggttgacgattcgatccggttcaccaattttctcaggtttttaaataaccgattttaactggtccaatcagccggtcctgggttagcggccgagccctatccgattagtttactttctcccactccgagagctttctttctcactcttcaagctcgacgaagatg

SEQ ID NO: 2888 - DNA, 3000 bp, Unknown
  misc_feature (1)..( 3000): cDNA_ID_3070402_gDNA_ID_1620613_Annot_ID_161983 3000 nt of promoter + ATG
gttatttagcgaaaaaaaaaaaagaaaaagaaaagttcattgggatcgaaaagaggtaagattgttcttgaagaatcgattctatagagcgtgttagcttcaatgctaacttgggagaccccagttatgcttgcaagcaacaccgcctcaaccaaaaagctagccttcattaccacctttctcatcattgtgttatgtccggtcacaatggtcatgtctcagccgcaggcggatgttttgccactgccagcctcagacgcagattgcctcttgagatttaaagatactttggttaatgcatcgttcattagcagttgggatccttccatctccccgtgtaagcgaaactcagagaattggttcggtgttctctgtgttaccggtaatgtttggggcctacaactcgaaggaatgggcttaaccgggaagcttgaccttgaaccattagctgcaatcaagaatctacgaaccttgagcttcatgaacaacaaatttaacggttcaatgccatctgtcaagaattttggtgcgttgaaatcattgtacttgtctaacaaccggtttacaggggagatacccgcggatgcgtttgatggtatgcatcatttgaagaagcttctgttggctaacaacgcgtttcgagggagtatcccttcttctttagcttatttgccaatgcttttagagttgaggctaaatgggaatcagtttcatggggaaataccttattttaaacaaaaggaccttaagttggctagcttcgaaaacaatgacctcgagggacctataccggaaagccttagcaacatggatcctgtctccttttcaggtaattaaacaaacagttcaagtacatctgcaaatgtttggtaaactataggagttcttatgtaaaaacagaatctttcttgctttgttgacattgcagggaacaagaacttgtgtggtcctccactaagcccatgttcgagtgattcaggatcttctccggatctcccttctagtcccacggaaaagaacaagaaccaatctttcttcatcattgcaattgttctgattgtcattgggataatactgatgatcatttcgcttgtggtctgtatccttcataccagaagacgcaagagtttgtcggcttatccatccgcgggtcaggacaggacagagaaatacaactacgatcaatctacggacaaggataaagctgcagattctgtaacgagttacactagtagaagaggagcagtaccggatcagaataaactcttgtttttgcaagatgacattcaaagatttgaccttcaagatcttcttagagcctctgctgaagttcttgggagcggaagctttggctcttcttataaaactgggataaatagcggacagatgctggtcgtgaagaggtataaacatatgaacaatgttggaagagatgagtttcatgagcatatgagacggttagggagattgaaacatccgaatctgttgcctattgtggcttactattaccgcagagaagagaagctcttgatcgctgagttcatgccaaatcgtagcttggcaagccatcttcacggtatgtaacattcaacttttttggtcgattaaaattgtaactttatcagttttgactaaaaaaatgctctgtttcagcgaatcattctgtggatcaaccgggattggattggccaacaaggctaaagattatacaaggagtggctaagggtttaggttacttgttcaacgagctaacaaccctaacaatccctcacggtcatctcaagtcatcgaacgttgtattggacgaatcatttgagccactcctaaccgattatgcactaagaccagtgatgaactcagagcagtctcacaatctaatgatctcttataaatcaccagagtatagcttaaagggacatctaactaaaaagacagatgtttggtgcctgggggtattgatcttggagcttttaacaggtaggtttccggagaattatctaagccaagggtacgatgctaacatgagcctcgtaacttgggtgagcaacatggttaaggagaagaaaacaggtgacgtgtttgacaaggaaatgactgggaagaaaaactgcaaagcagagatgctaaaccttttgaaaatcgggttgagttgttgcgaagaagatgaagaaaggaggatggagatgagagatgctgtggagaagatagagaggttaaaagaaggagagtttgacaatgatttcgcatcgacgacacataatgtctttgcttctcggttgatagacgacgatgactttggtttcgccatgaatcgatgatgaaactgatcagtcttctccagaacaatggaaaaagctaaacaatttgtaatctttgatgccaaataaaaagaagaactttctttttcttctttgttatgtaactttttccattcttataaatcattctcttcgtgtaattgtaaatccattttgcagagttttgaaaattttactcatttcttattttcaagtacaagaatcaaatccatgcaaaaagtaatgaatccatgcgtagtgacaacatagcttgagatcgaaatactcaaattgcattgtatgtggatgaaaagtttccaacttcaaaaaaagtttggaacttttttctcgagaattgtattttagggctaaaaattgaatttttggggataaactaattactatggcggagaattcgcggctacgagagctacggagacacagatgatgaaagagagaaagagagagagagagagagagaatgtgaggttaaaattatccattgttgttcttcagtgcaccactgaatcgaagttttctaatttggagaaagaggatttctcaaaacccctaatttaggaagaccgcagatttctttagtattgagaatgagattctccgagaagatggattagtgaatcgagaggttgatatcgttaaatgcggggattttgcaatctagggttcttaagcattgtaatcg

SEQ ID NO: 2889 - DNA, 3000 bp, Unknown
  misc_feature (1)..( 3000): cDNA_ID_2176007_gDNA_ID_1620613_Annot_ID_161978 3000 nt of promoter + ATG
gcaaagaatgcacgtgaaagtttgaatcaactaagagttagtcttaaccgctctttgatgctgccaaaaattgataatgacgaggaagagataacggttgatgaggatgattttaaggaactgcatctgcagatcaagtccttgcgtggttcatttaaccagaaactaaagaagttccctgtcaacagagactcggtcaactcatcctttgtaacagcattcggtgaatcagagctaatggatgatgatgagatatgttcagaagaagtagaagttgaggagaatgattttggtgaatctttggaagaacatgacagtgctgcaacagtatgtaaatcaagtgagaaatccaggatagaggaatttgtatcggaaaacagcatatcaatcagtccctgccgtcaatccttaatcttgcaagaacccatccagtcagagtcacctaaattcagagattctctacggaagagcatagctctttcttcgtcatgtctcaggaatcagaatagcttggcgaagagcataaaatccacgtgttttgcagagagccaacatatcagatcatctttacgcggaagcaagatattcacaggttctacagaatctctagctgcaagtctgcggagaggcttggatattattgacaatcccatgaaccctgcatcaaaccgatgctcagtttctttgtcttctgataacttgaccatgcaacctcccacagatgatcgattacctctgtcgccactctgtccaacctgcagaatttgcagctctaagttaccaagtgtagttgagggagtaagtatatgatatagcagatacaatatgttttaatagatttagtttttacagttatcctgaagctaacgttgctggatttattgttaatcaggatggatatcatatggaaggggttcttgagaagcagcaagagcttgaaaaattgtgctcagagcaagcagccaagattgaacagctaacgcgcctggtaacccaatttctatgtcttatgcctactgaaacttggatcagtacatatggttaagcagtctggttatatcatatcttcttaaggtagggcaacacaaacttcaaactgaggatgaaacagaaaaacttatgggagcaagtaatggagaacgacttccttctgcaaatgaaaaccaggttggttcttactttaatttactatgtgactactatagtgaagaaaatatgatagattgtaacataaatcccaactccatggttctgtagcttctcagctgtataactgaaacatatgacgtaaaacaaatctcggatgatgactccaagaagacagactttgatattggcgagaaggaggcattactcaaagaaattgaggatctgaaaaaaaaattgcagacgcctgtaaccatgtccaccaatgaactgagatcatctctgttggctcgttcgtttcaactccgtagcaagaatgctgaaaaagatatcgaggaagaaagacttaggtgcacagaaatggaaagcgagtggatatcattgactgacgaattcagagtagagattgaaactcaacgtacacgcgcagagaaagctgaagcccagcttaaacaagagaaactatcttctgaggagctagaagatgcacttcgcagagctgttcttggtcatgccaggtttgttgaacactacacagagctacaagagaagtacaacgacttatgctcaaagcataaagcaacagtggaatggataacagagttgaagaaggcagtagcaaaggctggtaaaaagggttgcggttctcgttttgctaaatcacttgcttctgagctctcagcacttagagtagaaagagaacgagaaagagatctgttgaagaaggaaaacataagcctcaagattcaactaaggaatactgctgaagctgttcatactgctggagaagttcttgttagactcagagaagccgaacaatcagcatcagctgctgaggtaaacaaatttttcatgttttaatcgatgaactgttggattgagactgtgacattgttttctgagtgactgtttggttgcaggaaaagttcaatgaagtagaagaagaaaacgagaagctaaagaagaaaatggaaaagttgaagaggagacacaagttggaagtggtaacaatcaaaaagagtctaaagcaaaacacgttgccagaatctgcattgcagccactgcatcagaggaactcggctattgaggaagaaggaatgtagaaacatcattataccaaagtgcataacttgaagacccttcttggatctgattggtatattatacacatctttattctgcttatttttcactttattgcttctaataaaattcaaatgtccttattccacaaggcatttttagttttttcccaattgaattatttgttctgctgtatttgatttgaatctcgtgtttgtggcgtgcaaactggtctctgtataactttaactttggtatttcattttaattttcttacatttaaaattgttatctttctttccaaactcaaattcttcttacaagatatatatattgttgatcatgtaatacaagagaaattctaatcaaaatagagtagactttaattatgggaatcctattttgccaaatcgacaatcttactctgtttttttttttttgtcaaggatcttactctgtttaaagttaactttttgttgtatatgtcaatttagttcaccaaaaaaaaaaaaaaaaactcatgttttgttatgcagtggtaaaagttttggaaagtttatgtgtttatatatagaatatttcttgtttatgaataattttctataattaagaaaataaatctctacattatcgaaagcaaaatatacggacatataagaaaggaaactagaatcataataccgaattataatcgaagttgttccattgtgtcatcgaagttgtgcttttagggaaaaacaagaatacagacagctctagaaaccaagaaca

SEQ ID NO: 2890 - DNA, 3000 bp, Unknown
  misc_feature (1)..( 3000): cDNA_ID_2176003_gDNA_ID_1620613_Annot_ID_161977 3000 nt of promoter + ATG
tggaaggagaggatgtcctggatcaaatctagcttatatgattgtaggaagtgcaataggaatgatggtgcagtgctttgactggagaatcgaaggagagaaggtcaacatgaaagaggctgttaaagggaccatccttaccatggctcatcctcttaagttaactcctgtcactcgacaaccacccttgacttggatatgacactgaatttgcagacaataaaaatagatttctctctattttttgtttatgggtttcccggtattagtctggtttggcatttgtagaggaggatgttggggcaatgatgttgatcttgtttctcgaacagaccctctgtcgtttttacatttaaatggttaaattattttgtaattcagacttgagtgcacttcccaatagacttgctaattgagcgtttctatcttgtgtcacatatgtcatatgtcagagactttaaaacattacatctgttgttgtaaaatctgtttttttttatcttcacatgcacatttcttagttacaagactcattaagatccacgtgtggaaccttaggtgtcggtacgtggggaattttttgatttttgaagattctttttcacttactgaatgattattatgatcacgaatgtcaaggaacagttttgacccgaaacgtttcttgttgaaaaaatagttatatactttcttctttccattttttcatagattattgataagaggatactctgtttcatctgcctcattagtttgagcaacaatggcagcaatgttgactgttgagtttcaaaactgcttgatctttatcctcctctgcatccttttactcctatgttaccctctctttttcaagaaaccaaaggtctcacaagatggatttggtttgcctccaagccctctatctctgccaatcattggtcatcttcacctgcttttctctaatctaactcacaagtccttacagaaactctcctccaagtatggacctctcctctatctccgcatcttcaatgtcccgataatctttgtttcctcggcctcagtggcatatgagatcttcaggggacatgatgtgaacatctcttttcgagggaaccctcctatcgaggagtcccttttggtcggatcttttggatttttcaccgctccttatggagactattggaaattcatgaagaaggtcatggtcacgaaactgctcggaccgcaggcactacaaaggtctcgaggcatccgtgcagatgcgctagaacggttttacatgaacctgcttgataaggcgatgaagaaggaaagtgttgagattggtaaggaaacaatgaagctcatttacgacagcatctgcaagatgattatggggaggaatttttctgaggagaatggtgaggcggagagagtcagaggcttggtgaccgaatcgactgccttgacgaagaagatttttatggcaaacgtgttgcacaagccccttaagaagctcggaatctcattgttcaaaaaggagataatggatgtttccaacagtttcgatgaactgctagaaagatttcttgtggaacacgaagagaaacttaacgaagatcaagatatggacatgatgggcgtgttgttggcagcttgccgagacaaaaatgcagagtgtaaaatcactaggaaccacattaagtcgttgttcgtggtaattgtgtcttttagtaggcagattcgtccataatccaaaatatattgtcctgtctaagaaactttttccaactgcaggatcttgttgttgcaggcaccgacacttcgagacatgcaacacagtggacaatggcagagataattaacaagcctaaggttcttgaaaaggtaagagaagaaatttattcagttgtaggaagaacaaggttggttcaagaaacagatttaccgagcctaccttatttgcaagctactgtcaaggaaggactgagattgcaccctcccgggcctctctttgcaaggacagcccgagaagggtttagtgtcggaggattttatgtaccagagaacacaccacttgttgttaatgcttatgctatgatgagagatcctggttcttgggaagatcccaatgagtttaagccagagaggtttctaggttcaggaaaagaagacgagagagagcacggacttaagtacattccttttggtagcggaaggagaggctgtcctggaataaatctagcttacattcttgttggaaccgcgattggagtgatggtacagtgctttgactggaaaatcaaaggaaataaggttaacatggaagaagctcgtggatcactggtattaaccatggctcatccacttaagtgcattccggttgctcgaacccagattcccagttgctaacactaagctcgggaaacgtaaaccaagtagtttgctttcttctgttagtcatgtttatcgtatcttttaatctgcagagtccgatttggtgacttattgttatctggaagatgggaatttgctttcctatgatgtgttcaacttcatttgttatgtttgaaagtctcacactttcaaataaaatagcagtagaaaatgacatgacacgatttgggactaatcaataaaagtctcctaattgtatcatttatcaccaaatcatgaacagtttgaaaataattattaaattgttcatgatgactaacctacatttaaatagtaatcaacaacaacattaaacttttttgagaatttttctataattgttttttcttgaactgcatcaactattatctctcacctaataacaataattgtttttaaaaaatacagaagaaaaaatcctataacggtcgtgtgaagtagatccgaatccaatgatcaatttgaaactttgaatagaaagaaagacaaaaggaaaggcaaacgaattttataattactctttttccctctctttcaaattttgaatctttcgtcgtctcccattttctcgatctcgcaagctgtgtcatttgagaagcc

SEQ ID NO: 2891 - DNA, 3000 bp, Unknown
  misc_feature (1)..( 3000): cDNA_ID_2113679_gDNA_ID_1620613_Annot_ID_161969 3000 nt of promoter + ATG
ctctccatgaagcagttcacattatctcagctaaattcctaactaaactacatatcatgtccaattataaggctacattccatgacacatgaaaatagagcagcaactatcatcaattaacatagtttcttactctttagttcttcttccatgagaagcttttgacactccagaaacttgtcgtccctgccagatctgtggatcaagattgttatagttacattagcaaggctccaacttctctaaataaaaaagaatgtctgggaaaatcaagacggtaaggtgaagtacatgcctgattgaaatgatttcattcctcaacttctcaaccatctccagagaactctgattttcacctctcaaatgttccatcaactcctctgaggctgcaaatagcaaaagagagaaaagacagacacactaagaacgtattcacagacttaaaaggtctcttgttataattctcgattccaagtgtttgtaattgcaatgtgaaatcaaacctaactagagatatctaaaattcaagtatggaacaaaggaactcaaactcaaagaacgaatctttcgaaattggtacctgaaacaaaggtaaggaatttctcttcttgttccttattaatctcatcgtattcggaatatttcttcttctgaaaaaaaaggagatcgaaatcaaaatcgaacccagaaaagcgaaattccggagaaaccctcagaaattgacaagaaaattaaacggaagatgttgcagaaaacctggagtttggtgtatttgtcgtagagcttggcgtagagagcttccattttctgctcactgtagaagagtgaagaatcaaatcaaattgattacccgacccggaaagaagcaaaatcgacgagcttacaaattcgattcaagagagcaaaacacactcgctttggtttccagatttgaaggagaatgacgaaactgatgaattcaaaagagaccaactttataaaattcccaaaccgacgacgcctatgacactgagaagtggattttaattctagggcaacggtttttttcttcttctcaaagcactatttttcttctatctttttatttaattttaagttcttaattataagaatatgaaaaccaagttatccattggattcacacatttttttttttgatgaaaagatctattttggtccacacttgtgaccataattgtacatgccatgaaggtcacgagagtttcgctgggaacttagtacaaatttcctctgttataaacaatcctgattgattattgactacggattcctcttgtttcatcaacctaccaaaaaaaacaatgatatcaccgttgacgctcaaaactccttcatcttcatcctcttatgtctcttctcacttctctgttgctatctcttcttcaagaaacctaaggatggctttatagcgaataagataatgagatttttggggaacacggagaagaggagccaaaggacatcaagatggagacatgatggacgtattgttaatgcttatgatgatagatcctgaatcttggtgatgtcctaatgagtttaagccagagaggtttttagcttcttttggatcagggcaagacgatgcacttcagtacattcttttcggaagcggaaggagatgctgtctgggagtaaatctgagttacatctttgtaggaactgcgattggaatgatgttgcaatgctttgactggaaaaccaaaggagacaaggttgacatggaagaggccattcgaggattgaacctgaccatggctcatccccttaagtgcattcctgttgctagaaacctaaaccctttggcttgctcgaaccttaaaccctgtaactttgaatttgcaaaaaagttgttggtgagaggaagctctgctccgctttgtatgttcccgtgtccaagtctcccggtttaagtggctaccttttggtttagtttggtttattgtgtgaaattgtaaataattgtgtagtgttcttcggtttaaggcatatatcggtttcattgttcactgacttcactgacttcattcacttcaaatcttgtgtttatgatcttaaaaatgcagcggtttttaaggttgattttgttttctccgattcgattctctgtataatgcgatcccactcatatgtgactaattgggtttttgcccatataaaggaagcaaaattcaggtgatgaaggaaaaagatgaagatgtcggctttgaagtgaagaaattggagatttaacaaattcagaagtttgagggaaatttacagcattggaatccctctagacactgctggttaggattgggaatggaggaattaacagctgcaagatcaagaaatcccctaagcagctgaatcgtgtgaccagaaaggggctgattgttgtgaattgtgatcgtctgcttttcttttacttgagattcttgaatctgatttctgatagcgttcgagcgagagagagattttcatgtctcggaagctgatttctacaagagtttatggtcaagacatggacttcccaacatcacttattttgcttggccggacacaagaaggtgggttgggatttagagttagaccactttgacatgtttacttctttgagattgagctaccctattttggtatgtcttgcaactcctccattattcttgtttgttccaatgttttggtctcttaatcctatcctaggaatttgctgtacttgctctggagtcaaccataaatccagtagggaatgattgaatcacatccagtaacatgtttttagtcaaaacatctatctgagattcttagtagatataagaagtttgacaaaaatgaaatgcttatttatagaagagtgatgaactatcttggtcccacactagtaaccacgatgaaaaatacattatttgtatctaatatatacagaggatggtcgattcttgattaacgaatctcatgtctcatcttcctctttcactttgagcaattatggcagca

SEQ ID NO: 2892 - DNA, 3000 bp, Unknown
  misc_feature (1)..( 3000): cDNA_ID_3070421_gDNA_ID_1620613_Annot_ID_161971 3000 nt of promoter + ATG
ctccgactcttcccatcattggtcatcttcaccttcttctctctgttctagtccacagatctttacagacactctccaccaagtatgggtctattctctatcttcgcgtcttcagtttccctgtagccctcgtctcctcagcatctattgcttatgagatcttcagggaacacgacgtgaacatctcgtctcgtggtttccctcctaccgatgattccctttttgctggatctttcagcttcacctctgctccctatggagattactggaagttcatgaagaagctcctggtcacgaacttgcttggaccccaggcactcgagcggtcacgaggattccgtgcagatgagctagatctgttttacgagaacctgttggataaagcgatgaagaaggagagcgtggatatctgtgtggaggcgttgaagctcagtaacaacagcatctgcaagatgatcatggggaggagttgttcagaggagaatggtgaggcagagagagttagggctttggctacccagttagatggcttgacgaagaagatcttattggcgaacatgttgcgtgcggggtttaaaaagcttgttgtctcactgtttagaaaggaaatgatggatgtttccagcagatttgatgagctgctcgaaaggatccttgtggaacatgaagataaactggacatgcatcatcaaggtacagacttagtggacgcgttgttggcagcttgtcgggacaaaaatgcagagtataagatctctaggaaccatatcaagtcgtttttcgcggtaaatgttcctcccataaggtggtttcattgagaatgcataacttttttgcctaagaaaaaacgttttgcaactgcaggatctcttatttgcaagcactgacacctttgtgcaaacaacacagtggacagtggcggagatcattaataaccctaatgttcttgagagattgagaggagaaatcgattccgtggtcgggaaagcaaggttgattcaagaaactgatttgccaaacctcccttatttgcaagcggtggtcaaggaagggctaagactgcatccgccggggcctctctttgcaaggttctcccaagaagggtgtaggatcggagggttctatgtaccggagaaaacaacattaatgattaatgcttatgctgtgatgagagattctgattcttgggaagatcctgatgagtttaaaccagagaggtttctagcttcgtcaagatcagagcaggaaaaggagagaagagagcaagcaattaagtacattgctttcggaagcggacgaagaagctgtcctggagaaaatctagcatatatctttttaggaactgcaattggagtgatggtacagggatttgagtggagaatcaaagaagagaaagttaacatggaagaggctaatgtaggactgagcttgaccatggcttatcctcttaaggtcactcctgttcctcgaaccctagtccccttaactcagaatccactgaaccggagttcatgaatctttggtaagtaattaggtagccttgtttttacgttaccgtgtctgagtttactggtttagtttggctaatgtgtgaaaccgtaaacaattgtgttgttattcggatttatttgtggattggttcatatatggggttatcttgaaagcagcaaactttagcttcttcatgttacttggttcaatggatttgaaggatgccagttggagtagcatagaaataaacattatattgcaatcacatgagtttcttttgcgaaccattcatgtttcagggaagggagggaaaacttaagatcttgcagtagatttgagaaatgttttggtctttatatttgtcctctccacctatgatatgctactcatgtgtggtttctgtgactttgattgaatttatgacccgaaaggaagaaaatttcagttgtgtagggtttttgtaatttagatattaaagctctttacggagatttctgcagtaattattcttcttttaatgcgctttcaagtagtgatgtttgcggcttcttggctccctggatttacaacgttttcctggcaaactcatcaaatttcttcaaaccaatgctcgcatattcatcagaacaagctcctcgacatcaacgcactctcacaactcacaagctccaagctagccttcaatatcttcattcaaccataatctcacttggtaaatatctctctttcagtaattcctctttctttttcatgggtactacattacaaaaatcagacaaaactttcacggattcctctttctttttcatgggaactacattacaaaaatctgacaaaactgatagaatattaaattcacttgtcgtaagatgtgagttattagcaaaatttcacggagttccaataaagaaaaacatttcttgatctagtaaacaaaacatggccatacattagattcattgattcttgataagagaaattgtatctaatggcaaagatatcttgatgattttaaatgctattttcttaagaaaattttcaaatatgatatgaaaccaaagatcacatacaatctaattttagtggttaaaaaaacaaaatcaaattaaccaatttaaacaacaatttataatgattgtggtcctcagtttacaaacttttccaaattgagtaaggctattacattttggtaacaaagggggcacggcacctcaactttccaagaaatttgtatttttatgtgctattcaaacactacattacggattcctctttctttttcatgggaactacattacaaaaatccgacaaaactgatagaattattaaattcacttgtcgtaagatgtgagttattaccaaaatttcacggagttccaataaagaaaaacatttcttgatctagtaaacaaaacatggccatacattagattcattgattcttggtaagagaaattgtacatttatatgtcatttgcctcgtcttcactttgagtaacaatggcagca

SEQ ID NO: 2893 - DNA, 3000 bp, Unknown
  misc_feature (1)..( 3000): cDNA_ID_3070417_gDNA_ID_1620613_Annot_ID_161972 3000 nt of promoter + ATG
cttgataagagaaattgtatctaatggcaaagatatcttgatgattttaaatgctattttcttaagaaaattttcaaatatgatatgaaaccaaagatcacatacaatctaattttagtggttaaaaaaacaaaatcaaattaaccaatttaaacaacaatttataatgattgtggtcctcagtttacaaacttttccaaattgagtaaggctattacattttggtaacaaagggggcacggcacctcaactttccaagaaatttgtatttttatgtgctattcaaacactacattacggattcctctttctttttcatgggaactacattacaaaaatccgacaaaactgatagaattattaaattcacttgtcgtaagatgtgagttattaccaaaatttcacggagttccaataaagaaaaacatttcttgatctagtaaacaaaacatggccatacattagattcattgattcttggtaagagaaattgtacatttatatgtcatttgcctcgtcttcactttgagtaacaatggcagcaatgatcaacgttgaatttcaaaactgtttcatcttcatgctcttatgtctcttctcactcctctgttactctctgctcttcaggaaaccaagctcaagacaaaactcctatgactgtgatctgcctccaagccctccttctatgccaatcatcggccatcttcaccttatcctctcttctcttgtccacaagtcttttcaaaaaatctcctccaagtacggacctctcctccatctccgcatcttcaacgtccccatagtcctcgtctcctctgcgtcagtggcctacgatatcttcagggtgcacgatgtaaacgtctcttctcgcggtccccctccattcgaggagtcactcttgttcggatcttccagcttcatcagcgctcccctccctatggagattactggaagttcatgaagaagctaatggtcacaaagctgcttggaccgcatgcactcgagaggtcacgaaaaatccgtgcagatgaactataccggttatacacaaacctgcttgacaaggcgatgaagaaggagagtgttgagatcggtaaggaaacaatgaagctcactaacaataccatttgcaagatgatcatggggaggagttgttcggaagagaacggtgaggcaaaaatagtcaggggtttgattgccgagtcatttactttgtcgaagaaatttttcttggcagcaactttgcgcaggttgctggaaaagctcgggatctcgttgttccagaaggagataatgggtgtttcccgtggattcgacgagctactagagaggattctgagggagcatgaagagaaaccggacgagcatcatgatacagacatgatggacgcattgttggctgcttataatgacgaaaaagccgagtataagatcactagaaaccagatcaaggcgtttatagtggtatatcattctatgatcacttttggttctttgagattaaccacacctaacagttcacaccaatacttgtccttgaataataagatacgttatacaattgcaggatatgttcatagcgggcactgacatctcagcgctaacgacacaggggacaatggctgagatcattaacaaccctaacgttcttgtgagaattagagaaaaaatcgattctgttgtagggaaatcaaggttgattcaagaaacggatctaccaaagctcccttactcacaagcggtagtcaaagaagggctgagattgcacccgcctacgcctctcatggtaagggagttccaagaagggtgtaaggtcaaaggtttctacataccagcgagcacaacccttgttgttaatggttatgctgtgatgagagatccaaatgtctgggaagagcctgaggagtttaagccggagaggtttctagcttcttcaagattaagggaagaagaagagataagagagcaagccctcaagtacattgcatttggtagcggaaggagaggatgtcctggaacaaatatagcgtatatctttgtaggaacggcgattggaatgatggtgcaatgctttgactggaaaatcaaaggagacaaggttgacatgaaagaggccattggaggactgaacctgacattggctcatccccttaagtgcactcctgttgctcgatccccaaaacctttttaagttcaaattattaaaaccgatgttcgatgtttgatgttggtgactggactatagtgttgtaagatgaatgaagttataataataacgaagcttgctttttgttgttctgttagtactcgttcattcattctctattaagacactcaaaatctcataccactctttatttttctcaaacctcacactctctattattttctacgttgcttgatattgtaacttcttactcttgtattgtatgttatggggatgattgctctcgtttattctctctcaatctatgttctacagagagtctgcagcccacttttgttgacaaaaggagaaaccaacacatcttattttcaataataaacactatttaatttttcaacaaaaaaacactcctttgactaagaattagtgaattaccacatgtgatgcaattctagaatacgtggtaacagagattatttacactatgttttatctacctttccggctttgagcaacaattgcaacaacgatgatgaccgttgagttccaaaactggttccttttcatatattaaggagagaatcatatctttgattattttattcgaaatcttatacaagctggtgcactacgtgtctctcatgtctcaacccatgatcagttagcagacgcattgacgaaaccactaccacgtaccagttttcaagctgcatgttccaagattggagtgacaagagtccctccatcttgagggagcgtattaaggagagaatcatatctttgattattccaatcatacctttgatttctcatatcattcgattactacaatc

SEQ ID NO: 2894 - DNA, 3000 bp, Unknown
  misc_feature (1)..( 3000): cDNA_ID_3070409_gDNA_ID_1620613_Annot_ID_161974 3000 nt of promoter + ATG
cttttttttgactttatatggcttctcatcaaaattacttaaacatgtctttgtaaccaaatcgttgccaatataactactttcaggtgctaatgatttttctctggaatttcattgactcttcaaactttgaaaatggttagggaatcctcaaatttgtgggagaaatataatacaatcgttgcaaagaatcatatagcaagattctttatttctctacatattttgtagtttacactttacataaccacacagacttacctggtttaggaagaatatacttctttttgaggttttgcttcgctgattagattgtttatcatgttgtgtagtaaacaggttttcaaagaggaaaaagaagaaggttatgaggaacattacttatactgtgagtcaatcttgaatccttctgtttagttgcattattagcttgagaggttatgaactctatatttattattattatcgcttagatcacgagtgtctcttatctgagtttatcttatttcaaaaacaaggttctagttctccaatatttcaccttttttccaaagaaaagcattttttaaaacggatccctgattatgtttcatacttcttcttcactttggagcaacaatggcaacacttatcagcgttgactttcagcactgtttcatgtacataatcctcctatgcctcttctcacttctctgttactctctcttcttcaggaaaccaaagggcacacgagttggctgtgatctgcctccgagccctccgtctcttcctatcattggtcatcttcaccatctcctctcttctctaactcacaagtctttacaaaaactctcctccaagtatggacctttcctccatctccggatctttagtgttcccatcatccttgtctcatctgcttcagtggcatatgagatctttaaggcccacgatgtgaacgtctcatctcgtggtgctgctgcgatcgatgagtccctcttgtttggatcttctagcttcatttacgctccctatggagattactggaagttcatgaagaagatcttcgccactaagctgctccgaccacaggtgctggagaattcacgtggtgttcgtgctgaagagttaaagcggttttacaggagaattctcgataaggcgaggaagaatgagaacatcgagatcagtaaggaatcggcgatgctcatgaacaacatcttatgcaggatgagcatgggaaggagtttttcagaggaaaatggtgaggcagagagagtcaggggcctggtgggtgaatcatatgccttggtgaagaagattttcttcgcagctacattgcgcagactgcttgagaagcttcggatcccactattcaggaaggagataatgggtgtgtccgacagatttgatgagctgctagagaggattattgtggaacacaaagacaaacttgaaaaggagcatcaagttatggatatgatggatgtgttgttggcagcttatcgagacaaaaacgcagagtataagatcactaggaatcatatcaagtcgttttttgtggtaaattttcctcattttaccgatttcgtttgagtatccatatgaaaattacttaaaaatgttccatgtcttcgcctgcaggaccttttcgttgggggcactgatacctcggtccaaacaacacaatggactatggctgagatcattaataaccctaacattcttcagacactgagaaaagaaatcgattcagttgtagggaaatcaaggttgattcacgaaacggatataccaaaccttccttatttgcaagcagtggttaaggaaggactaagattgcatcctccagggcccctcttgataaggacttttcaagaaagatgtgagatgaaagggttctacataccggagaagacaacactcgttatcaacgcttatgctgtgatgagagatcccgactcttgggaagatcctgacgagtttaagccagagaggtttctaagttattcaagatcagggcaagaagacgagaaagagcaaacacttaagtacctttcttttggtggcggaaggagaggatgtcctggagtaaatctaggttatatatttgttggaactgcaataggaatgatggtgcagtgctttgactggaaaatcgaaggagataaggtcaacatggaagagacttatggaggaatgaacctaaccatggttaacccgcttaagtgcactccagttcctcgaacccaacctttttcttttacttctaatctcgagattcttagttcctgacactcagcttgggaacacatatgaagtttgttttcttctgtactatacatattcatcaaagacggttaattacatttggtgtctttatgatttcctgcccttttcacaaaatttacgtacctttgttctttcgttttatatgtcgttgatcaaattctctaggttgattgtttccctatccgaatccatttcgtccctagagctgcttggttctagtatctgctttgtattgttttcaggctaaagttagtgtcaacaaaagctggattcctctgacgagcttggtcgctgcaaaaacgttttcaggtggcgtagctactgaattagtgaattctctcagccttgcaagctcacaagccccaagccaagtatccttcaaattctttattcattcataatctcacatggtaaatttctatgttcttgtcagtagttcagacttgtctttctttgacagctgttctcttggaccttttttctctatttttaggatccgaagaaagtgattgaaatctatgtcccacttactgtacttgcaaaccatgttatctttgcttatacatgtcttagtatatttgacgtgtcgcaagatctgagtatattaacaaaaacatttcaattattaataggtaatcaaagcataaccatacattagatttcccttattgataagagagtattatatgtgtcatttgcctctttttcatttgagcatcactggcagca

SEQ ID NO: 2895 - DNA, 3000 bp, Unknown
  misc_feature (1)..( 3000): cDNA_ID_3070413_gDNA_ID_1620613_Annot_ID_161973 3000 nt of promoter + ATG
ttggtgactggactatagtgttgtaagatgaatgaagttataataataacgaagcttgctttttgttgttctgttagtactcgttcattcattctctattaagacactcaaaatctcataccactctttatttttctcaaacctcacactctctattattttctacgttgcttgatattgtaacttcttactcttgtattgtatgttatggggatgattgctctcgtttattctctctcaatctatgttctacagagagtctgcagcccacttttgttgacaaaaggagaaaccaacacatcttattttcaataataaacactatttaatttttcaacaaaaaaacactcctttgactaagaattagtgaattaccacatgtgatgcaattctagaatacgtggtaacagagattatttacactatgttttatctacctttccggctttgagcaacaattgcaacaacgatgatgaccgttgagttccaaaactggttccttttcatatattaaggagagaatcatatctttgattattttattcgaaatcttatacaagctggtgcactacgtgtctctcatgtctcaacccatgatcagttagcagacgcattgacgaaaccactaccacgtaccagttttcaagctgcatgttccaagattggagtgacaagagtccctccatcttgagggagcgtattaaggagagaatcatatctttgattattccaatcatacctttgatttctcatatcattcgattactacaatcatggacttatttatgtatagtacatattctgatttatgtctattgtaataccctagctagcatctcctctgtatataagttctcactctgttttaataaaaagatatcacttctacaaactcttatatcatactcctctgcttcttgtcactcttttgttactctctcttcttcaagaaacaaaaggactcacaagtgcttccgagccctccggctcttccgatcattggccatctccaccatgtactcttttcttcagcttacaagtctttacaaaaactctcatccaagtacggacctctcctatatctccgtatcttcaacttccctgtagtcctcgtctcctcggcctcagtggcatatgagatcttcaaggcccatgacctgagcatctcctctcgcgagaaccctccaatcgacgagtccctcttgcttggatcttccgtctttgtcagggccccttatggagatcattttaggtttatgaagaagctcttggttacaaagcttttaggaccacatgcactcgagaggtcacgaggcatccgtgcagatgagctagagcggctttacagaagtctttttgataaagctgtgaagaaggagagtgttgagattggtaaggaagcaacgaagctcagtatcaacagcatatctgcaagatgagcatggggaggagtttttcagaggagagtggtgaggctgagagactaaggggattggttactgatttagatggcttgacaaagaattttttgttggcaaacatattccgctggccgcttgagaagctcggaatctcactgttcaaaaaggagatagtgtgtgtttcaaatatctttgacaagttgctggagaagattcttgtggaacatgaagagcatcgaggaatccacttgacaatggctcatcctcttaagtgcactccagttgctcgatccttaaaccctttaatatcttatctgtaaaatcgatgtttgaatcaaagttggtgtctggactaataataaggacgattgcgctctgttgttctgtaacttactagttcattcatcttattcaggttcccggtttattagctttatatttggtttactgtggtatgattttttctctcgtttatatttgttgaattgtgttaaccaatggactcccgaagctttggtttagtttcccgattaagcattttaggtttggttttccttaagaaaccgtaaacactgtttattgtgttttgtcttgtttaggaattagaacggttgaatttcagatttcgagattcaaatgcgattattgaaggtgatgtccagaaagcaaacaaatttcgtcggtgtagggtttggtttgtagaagttttgtgtcaaaatgtattttttttttttttttttttttaccaatttcgagtgacggaggaggaaaataagatttgggcttcgaagttcagtgaactaagtgtgattttgggagaaaatggagtaaattatccctgcaagaaatccatcggtgagtaaactactatgttgatgaatcgcattgtgttagtgatgattgcatctcttgagtcaatcaagattgattatttattgagatatgttcgtcttttctttgccttttttttgactttatatggcttctcatcaaaattacttaaacatgtctttgtaaccaaatcgttgccaatataactactttcaggtgctaatgatttttctctggaatttcattgactcttcaaactttgaaaatggttagggaatcctcaaatttgtgggagaaatataatacaatcgttgcaaagaatcatatagcaagattctttatttctctacatattttgtagtttacactttacataaccacacagacttacctggtttaggaagaatatacttctttttgaggttttgcttcgctgattagattgtttatcatgttgtgtagtaaacaggttttcaaagaggaaaaagaagaaggttatgaggaacattacttatactgtgagtcaatcttgaatccttctgtttagttgcattattagcttgagaggttatgaactctatatttattattattatcgcttagatcacgagtgtctcttatctgagtttatcttatttcaaaaacaaggttctagttctccaatatttcaccttttttccaaagaaaagcattttttaaaacggatccctgattatgtttcatacttcttcttcactttggagcaaca

SEQ ID NO: 2896 - DNA, 3000 bp, Unknown
  misc_feature (1)..( 3000): cDNA_ID_2175968_gDNA_ID_1620613_Annot_ID_161967 3000 nt of promoter + ATG
tttatcttcatgttccacaaggatcctttcgagcagctcatcaaatctgctggaaacatccatcatttcctttctaaacagtgagacaacaagctttttaaaccccgcacgcaacatgttcgccaataagatcttcttcgtcaagccatctaactgggtagccaaagccctaactctctctgcctcaccattctcctctgaacaactcctccccatgatcatcttgcagatgctgttgttactgagcttcaacgcctccacacagatatccacgctctccttcttcatcgctttatccaacaggttctcgtaaaacagatctagctcatctgcacggaatcctcgtgaccgctcgagtgcctggggtccaagcaagttcgtgaccaggagcttcttcatgaacttccagtaatctccatagggagcagaggtgaagctgaaagatccagcaaaaagggaatcatcggtaggagggaaaccacgagacgagatgttcacgtcgtgttccctgaagatctcataagcaatagatgctgaggagacgagggctacagggaaactgaagacgcgaagatagagaatagacccatacttggtggagagtgtctgtaaagatctgtggactagaacagagagaagaaggtgaagatgaccaatgatgggaagagtcggagggctcggaggtaaatcatagtgaagtcgaggttcctttggtttcctgaagaagagagagtaacagagaagtgagaagaggcttaagaggacaaaaaagaagcagttttgaaagtcaacgatgttcattgctgccataattgctcaaagtgaaagaggaagatgagacatgagattcgttaatcaagaatcgaccatcctctgtatatattagatacaaataatgtatttttcatcgtggttactagtgtgggaccaagatagttcatcactcttctataaataagcatttcatttttgtcaaacttcttatatctactaagaatctcagatagatgttttgactaaaaacatgttactggatgtgattcaatcattccctactggatttatggttgactccagagcaagtacagcaaattcctaggataggattaagagaccaaaacattggaacaaacaagaataatggaggagttgcaagacataccaaaatagggtagctcaatctcaaagaagtaaacatgtcaaagtggtctaactctaaatcccaacccaccttcttgtgtccggccaagcaaaataagtgatgttgggaagtccatgtcttgaccataaactcttgtagaaatcagcttccgagacatgaaaatctctctctcgctcgaacgctatcagaaatcagattcaagaatctcaagtaaaagaaaagcagacgatcacaattcacaacaatcagcccctttctggtcacacgattcagctgcttaggggatttcttgatcttgcagctgttaattcctccattcccaatcctaaccagcagtgtctagagggattccaatgctgtaaatttccctcaaacttctgaatttgttaaatctccaatttcttcacttcaaagccgacatcttcatctttttccttcatcacctgaattttgcttcctttatatgggcaaaaacccaattagtcacatatgagtgggatcgcattatacagagaatcgaatcggagaaaacaaaatcaaccttaaaaaccgctgcatttttaagatcataaacacaagatttgaagtgaatgaagtcagtgaagtcagtgaacaatgaaaccgatatatgccttaaaccgaagaacactacacaattatttacaatttcacacaataaaccaaactaaaccaaaaggtagccacttaaaccgggagacttggacacgggaacatacaaagcggagcagagcttcctctcaccaacaacttttttgcaaattcaaagttacagggtttaaggttcgagcaagccaaagggtttaggtttctagcaacaggaatgcacttaaggggatgagccatggtcaggttcaatcctcgaatggcctcttccatgtcaaccttgtctcctttggttttccagtcaaagcattgcaacatcattccaatcgcagttcctacaaagatgtaactcagatttactcccagacagcatctccttccgcttccgaaaagaatgtactgaagtgcatcgtcttgccctgatccaaaagaagctaaaaacctctctggcttaaactcattaggacatcaccaagattcaggatctatcatcataagcattaacaatacgtccatcatgtctccatcttgatgtcctttggctcctcttctccgtgttccccaaaaatctcattatcttattcgctataaagccatccttaggtttcttgaagaagagatagcaacagagaagtgagaagagacataagaggatgaagatgaaggagttttgagcgtcaacggtgatatcattgttttttttggtaggttgatgaaacaagaggaatccgtagtcaataatcaatcaggattgtttataacagaggaaatttgtactaagttcccagcgaaactctcgtgaccttcatggcatgtacaattatggtcacaagtgtggaccaaaatagatcttttcatcaaaaaaaaaaatgtgtgaatccaatggataacttggttttcatattcttataattaagaacttaaaattaaataaaaagatagaagaaaaatagtgctttgagaagaagaaaaaaaccgttgccctagaattaaaatccacttctcagtgtcataggcgtcgtcggtttgggaattttataaagttggtctcttttgaattcatcagtttcgtcattctccttcaaatctggaaaccaaagcgagtgtgttttgctctcttgaatcgaatttgtaagctcgtcgattttgcttctttccgggtcgggtaatcaatttgatttgattcttcactcttctacagtgagcagaaaatg

SEQ ID NO: 2897 - DNA, 3000 bp, Unknown
  misc_feature (1)..( 3000): cDNA_ID_3593850_gDNA_ID_1620613_Annot_ID_161965 3000 nt of promoter + ATG
caaccggtaatttgtttttcctgcatgatctatttactttgattcaaaagatcttttgagatcatcagccaccagaaaagcaccaatgctgattttgtttccctgattattttaccataacaggtttatccttcagcctaacttttataaataacccaaatggtgaagaatctgagctgctttacaagcctgcatcactcggaacatttcaaagagtggcaccggaatggatgagagaagttataaagttcagcacaagtatgtgtcccatcttctttgaaagagtctctcgagtcattaagctcaattgttgatcggtaccgtatgtacatctccctccccttatcttgtgtagtcatctctgatggcttcttagtgtgatgtttctcaataggtttgaaaagctagggaagttatcattgtatctatagaaatgtgtctctctttaactttggaattagtttcaaagatagtgtgtccttgtgatgaatcatattgtaacaagatcttgatttatcctttgctctcgataccctctcctcttgtagacctcataaatctctgatctattgagcattttacatgattcaacattttacatatttttgtaacaaattttatcattggaaagattaaatagccgttacataaggtaggtgaattttcaattcaaatgcatcaaaatagccgctataacctaagtgataacgttcggaaaatgctttaggataattcctttttattgcttttgaaaacgacgacgtttcttgtgtcgtacacgttttataacccagacccacgtctctctctctcaaagaagagaagaagaactctctctctatctctatctctatctctcttctccttcttcttcagtttcgatcattcttgaatctgattcttctcgagaaaaaagcgtttcaatttcagaaatttcgactacgattgttgctttgttcaattagaagaggcgaaaaaggatggcgacggttaatgggtacacagggaatactccggcggcgactacaccggcagccaccggatcaaagcaatctgctcctccgactaagaccgtcgatagccactccgttctaaaaaggttatttcttttttacatttttccgatcttggaatattctcgcgtccatttaaaggaattagtctttagcctcttaatgattagaatcgctgcgattgtttatagagttgttcatgtttctttaggtagattagattaggttttggctctacccatatccatttcttgtggtctacatgctttctagatcatttttagagaaaacgatggatccaaaactgattgtgacttctcttgttctcttctgaaatgatgggttctctctttgtctaccaactgtttgttataatgtctctaagagaatgatacatcaaactttgtatgtactacagatctcaagtactttcttttatgtaccctttcttgatcaaagcaaacaaattcatggttttgctaattcattgtttttccttaattgcaggctgcaatctgaactaatgggattgatggtaagctatcttttctctgcataactgaacctgttgatatggttggatgcttatatagaggcctttgggtttatgtattgcagatgggagctgatccggggatatctgcgtttccagaggaagacaacatattttgctggaaaggaacaattacaggaagcaaagatactgtgttcgaaggaactgagtacagactctcactcactttctctaacgattatccttttaagtctcccaaagttaagtttgagacatgctgcttccaccccaatgtggatctctatggcaatatttgcttggacattcttcaggtacataacaatcacttgctctttctacttgtgttactgtaaatcccatggaatcacatatcagagaagcagtacttaaaacagaatctgttttcacatcttttgtaggataaatggtcatctgcttatgatgtgaggacgatattactctcaattcaaagccttctcggaggtaaactctatggctgatataactgttgaggttacttatgaagaatttctctgttggtttgatccagtatctgatttttcctgttttgttttaattgatcagaaccgaacatcagctcaccattgaacaatcaagcggctcagctttggagcaatcaagaaggtaaaattgcaatagttatcagattacacatctctggacgtctccatttttcgattcataatgatattcgtcttcttgaacttgtaatgttatacagagtacaggaagatggttgagaagctctacaagcctttaaacgcatgattctcaaaaatcactgtaactgattttaaaatctcaactgtattggatcatatctcttttacttttataatctcaatttgagccaatattagcaatcaaactctacctttattacagttccacaatcaccacctatatctcttccgtaactgagatttgagaagttcataatagtaactctgaaatgttgtagtaagtatctgaaagtataatacaaaaaaaagtttctgaactattgaaaaatccagaaaccaaagttccccacgagagaagtaagactcaaacatgtgaaacgttggcaccggacaaagtactgaagactaatgaaatgttttgaaattgacatttatggccttctttttaaatccccaagcccataattcgtgcttaactctttattacaaatgggctttgagggtatatattatttcggcccaatataaaaacgtcgccgcttcattcataccctggccgtacatcccagaaaccttgaaagttaaaaacccgccggagtctctcactctcacaaacttttgagaagcattttcgcttcaattcaataaaaggcgaaaaatctctcactgcactttatctcgagagctcagatctccgatctagagcctttcgcttctcctcttctgttcatataacaactgaataatg

SEQ ID NO: 2898 - DNA, 3000 bp, Unknown
  misc_feature (1)..( 3000): cDNA_ID_2106933_gDNA_ID_1620614_Annot_ID_161999 3000 nt of promoter + ATG
ggagtcaacacaagtatggctgcgtaaaccaaatccaaaagttataatggcaaaaatctgtcataacaaatccgagttttaaggtaaaaacagagccaaaacatagtgattagcttctttccgaatatgagaacgaaccttctcaaacaagggctcttgacttttaatgtctacgttggatacacatcgttttaatgtatatttatggtgaataattcatgttgtcgtcaatatcgttataaatgcatggtataatttttggtacgcattgtctgctccattgtgtgtagaataactattcggagctaatcttaattttgaaaatgcgcggataaaagaccgtaattttacatggcttttctcttgatagaacttatagtaatacgacaaatttaaacatgactaattttgttgaaatatatttctttcgtttgtaaaattatgagtttaaactcacattgcagatagactaaagacttgactatcaaaaaatcaaaaactaagatcagaaatagaaaacacataggcaaagttcctaatttgcaaaaaaacaaagacaataccaataatctatatatgcaaacgaaacgaatatgatgatgaatacgtatcatttatgctatgtagtattgttcttgataattacgaatggtttaacaatataattatgtagataacgtttaatggacaattgtatatatgtcgagtacttttctcaacctagctatacgccttcaattgagacgtcttatttgtcttcattacaacaaaacaacaaaagacatgcgtgcttacgttacggtcactcaaaattttatacattttttgttaattgtatttaatcttattaattattatggttaccattactctgttcactttgcactacttgtttagcatattttgtaataactaaatttattttactcattaccttcaatgtatttcaatattctagtcaccaaaatgtaaatttcccgggttcagtgatcaataaaacagtacaattagtctataactatttgtttatgtttagctaattgaaatgtgtttaacactaaaagcatttcattcaaatagaggataaaacaaccatattacaaatttaattaatgtgatgcgaagctaaggcaaacaaagctgtaacaatcacatacttagatgtccccataaaggacgagaaataaataaaaacgaaataattagtatgaacattttgatttatatctttttctcttatcacaatttggattcaaatccgatgtatgtgtattgtagaaaataagctattaatatgttcgcctccatctattgctctacatgtaaattttgttttaagtttctaaatcataaaaaaaaattaggtattaataattacagaacttctccttaattaagtttagatttttaattataagtcctggtatatattttcctattagcttggaagttggaggagaaaacatggttcagttgattagatttaataccaattaattagtagacttttcctaatttactgacacttttgtatgttatgcaaacaatgcacacaaataaaggacataattaagtaccttgtgtccccgtggtaatcatgatttagaatctaaggaggcataatctgagatctgaagcaaccatatgggacatatatgatatatgccattaaacatcaagtatactaaatctctcaagcttccgaaacataggagttaaattaggaagcagacgaacttatcatgactactttttttgggtaatccattgcaagaccgaatcaaagtccacgctgctttatttttttttcctttttttttgcggtctatatagattcaataaggaatatcaacacattgattcaaaattatttgtgctactacaagctatgtgtaataagttttaagccatgtgaacacactaatttaactaaaccagttcatctaaattgatttggattactacatatgtgttcttgtgacatatcatacatgacaggaagttaggtctataatcttgaatggaaagttatgttcaatttcggatcaaccacaaacttcctagatcaattctagatctttctataattctatggatccaaggtgggataatatcgtaaatagtaatgaaatgaaaatagaaagtcaaggtcatcacatggtattgccttttagtgacatgcacataaagggccacattgttagctcaacatggaacacttctcttaaatcccacttcaacttcaacaccagctttgggaacattcagctttttcatctatttctccattaaaatgtccaaaatcctcgtccattattcagcataactatattatatacaattctttcaattattaatcttttactagttttacaaaataaattttgatttatatccatacaaatagtttttaaaagttaataatatatgataaagctatataagttttcctttaaattagtgagtactttttattataaatattcatttctaatctatgttactctatgtagatgagataaagaaaaatataattttatttaaacaaattttgtttgaggttttatcaaagattcaaatctctttctctcccattacatcattgtctaggtttattgatctcttccctctctcccttgtggtccttgacctctttaaatctctcttatcactttctcattttctttatatctcgaagtgtctctattacccgaaacactttcttacaattttctcttctcttctcttttcgttgctcttctttttctttctttcacacctcttcaacacaaatataaaacctgtagaataaacacaaaccttctacataacttctctcacttttttttttttaaaactctcttcttaataacaaacccttctctctcaatctcttctctattatctaatctagaaaagagagaaagcatacaacataaaggttattttcttgcggcattgtagtgttacacctaatcacaaagtaaaaacaagaaaatg

SEQ ID NO: 2899 - DNA, 3000 bp, Unknown
  misc_feature (1)..( 3000): cDNA_ID_2175827_gDNA_ID_1620614_Annot_ID_162004 3000 nt of promoter + ATG
gattagacttcgtaaagtcaaactcaccagccttagtaaccacgacagctgacgaataagtatccacaactgagactgggacgacatgtgaaacttttcggacgacctgtttgggtggtatagctctgtaggtgacattagaaaagtttggtgtagaattatgtggagcggtacgcttaacagacgaagatggaatcctctcgatatctggagctgatgggcatctgtgatagagatgtccaaattctttgcagtagtcacattttggaggaagacgagggtattctaccgaaattctaacttcatttccatcatcatcctccaccaacaccgattgtggaagagttttcttgagaaggatctcgaccttgatccgggtatgaactgctaaaggatgaagctgatgtttttcagtgtgtaaagggtcaccaattcctgaagcaataatacttagaccaggcatagagtataattgaggtggaaagtctttgaggattatccaaatcggtaacgagactaatttaagaggagttaaggttactgttggagagcaagcggtaacagtaaacagacagttacccgcctgccaacacccaacctcaaggacccaattgcgagtggcctcagaagggatataaataagcaccgtcccactcggaagacaacgaatgttaatgcgcccatctttcccccaaattggatttaggtccacaaatattttgcccgcaggtggaggattaccatgaaaatgagcaacgatatgatctttccaagtatcagttgctttaagaataacagatgctggagctctaacctttggagttccatcttcggtgaaggttggttgagaagcttttttcaggtttcgaagattggcactaaatctagcagcccaaataagttgagtatcatcaatcataggagtggtatcttctgcaagcttttcaattgctgggagcggatctatagttacttgagatgactcaattccatccacaacgggtacagaaagagcaatggaggaagataggccatttagttggttctggatagcagaggttgcagaaccagttgtcggaataagaggagttaatacatggtcgtcatcttcactcgcaggaggaatttcgtgagccgaggatggatctagatctagaattggagattggtgagtaacattcacaacaagagcattacgagtcggaatcggatccggtgggtctggagaaggaagaaccgaattagaaatcaaagaagacattacagaaaagaagaggggggagaaagaggatattctcgacggcggcgtgaggccacaccgtcggcagcaaagttaggataataatcgccttattatcgtcttgacttttttgcctcaagtatacagatttagcttagatgagtctacacatgctgatataagaatgggcattgttaagttttcgcttttgactaccttgtagcatcaaccagagccgtcatgatcactttcagagggtcaatttatgattccggctttcatctttgcctttgtcttagaattcgaacctgggatgggatcatcatagaacatgcagtcaattggcttgctaaaaaaacttaatgacttgagttagctacgaaagaaaatgtcagctcttaagctactgaaagggaagtaaaaacctagatgattgggaacgggtcaaacttacaaattgaaggctcttggtagcaagtaagaataatacaaggatatcatcttatcgttcctgattacttatcagtctgataacttaagtacccatatagttttttttctttttccttttttgaataaaatttaaatttattcgaaaaaacgtttttacaacaagtgcaacatttagttaataatatcaatacacaaatttcctatgagctttctattcctcttggcttttattttgtgtcaaaccaaacttccatgcatccatcatagttcatgtctccttgttcccgaatagaagagattcggttccggacttgtttgtcgatgtttcgaagtagttgagatggcggtaatggtgtgtcatcaagaagatttttattcgtcccaatgaggcgtctaagagcgtagcttggatagcgatccatgttgttgtgaacttgtgtctgaggatcttctttacaagtaatacaaatttcaggatacaatatacaaaccagaaagaatcagcaacttgctatatgtatcaatcatttggagaaagtgtattgtaatattattcaagaaaaggaatgggaagcaacaaatagatgaacttatgtagtagattcatggaaaaccataaacaactcggcagtgaaagacggagagtgttcttaccttataattttgttatctctgtaattctatccttaaggtataatagcaatccatggatcaattaagatgtctcattagacagtggtgttcaaaatttgtgctgtccaagcaagccgtctagttttggaatatactatacatttgttctgtagcatcaaacctggaggtagaaaaatatttcaatccactaaaaccaaccacgggaaaaaaatatgtcaaggacattaatctctattatattctacatattatgaattattaacagctaaaatcacatacacagtatgcattaagtaaaatatactaaaatttgatatgaaaatattttctatgaaatgatgacttttgttttaaatagtttgtataaatttatagaaacaactactgatttctcacagcctctcaaaatttaatttgcgtttcattttttttttcagtttgaaagacaaataattttaataaatgaattattacaacattataatttttggttaaaaaacaagtacatctaaccaaccctaaggtcgtttgttatctctcactttttgctttcgaaaacacaaaactctctactttctgatttactaaaggcgaaagctttcgttaaacagaaattttcagaattcaacttttgttaccctcatgctatcgat

SEQ ID NO: 2900 - DNA, 3000 bp, Unknown
  misc_feature (1)..( 3000): cDNA_ID_2175831_gDNA_ID_1620614_Annot_ID_162005 3000 nt of promoter + ATG
agatacccatcaattccaaaaattgtctaatgaggatgctctatgttccacataaaaatttatatttgaaaaatgtttttctatttccttatagaaaaaacaaataaaacaaataaaatttgttttattttaacatctaattttatatagaaataaacggcaaacaagctcttcttcaaaaataatatataaactagattttatcccgcggtataccgcggtgacaatttatctttttaaagttagtataattttttttttgcaaattgtatctatctataatatatttttattttatagtttacaattgttattaagtatcgtcctgccaaacccatcccgccaaacccgtcccgtaaaaaaccatttatttatattaatgttgatcttatttatgatatgtttataaatcattttctaaatatttttgtcgatgcgggacgttgaacccacacattttttgctaattggttaatatatgttcaattttaaaattttgaatcataaaatatgacggaaaaaattaagattttttaaactctatatattatataatgatgttaaaaaattgtaatatatcaaactttttataagtttaaatattaataatgttttataaattttaaatatataaataataatatttaaaaaattaatatttttggttataaggtaatgacataataactctaaaagcaaggatttagaagatttaaatctttaattaaatattttcattaataaataattaatgtcagtgacatgacattgtaaataagttcaaatacaaaatttatttatttaaacaaaaaacgtttagtaagaataatatttatttaacaaaaaactttgttttaaaatattgttaacaaatatgtttatgctaattttaagggactcatttgaagtttggtgggattaaatttgattgataatatgattgacaatttaaatcaaaaatttaaagtaaaattaattattttggaaaaaagatttaatgctaatggcattagattgtaaataagtataaatccataatttatttgctaaaatggctgcaaaaatgtatatatagatgttatttttgtgtgttaaagtttatttttgtatgcttcccctatactttgaaagcgtttctgatctaaattgaaaaacaatttaagaagaagtattctcaacatcactacaagaacactttaagatgggtatatatcagattatgcttgattttggttttccatttgaaccaacattctaggatctccatcctccagtcatgtaggtggaatttctaactttctattaaatatcatcgttagtgtagtagttaatctactatttcgaaataattgaagagatgcattttcacacaaattttttaatgcaaattaagaaaaagtagtactatatatttaaagtattttctttaaaaacatacaattttcaggaacaagactacaagagaataaaatttagtttttagtatttcacaaaagaatttctaaatttgaagtacatcacaatatttttatcaactaatggtttaatttatttataaaacacatcataatttctaaacataaaacataaaattctttaagaaatatattaacaattatatatatatatatatatatatataatttaaatgtaaattttgactatacattcaaaattaatattgaaaatataactcacgcatcgtgtagacaactttctagtagtatatatatattttttgttcacatcaatgcatcacccacaaagttttcttctgaaatcattcatgccaaaggatatacgaagcagatcacatatgccttctgaaaacataaaatcagagaaaacacaaaacaagagtatgttgaaattggataattatccattattaacaacttgaactccaagctatcataagagtataagactttgtcaccaagtcttgtatagtttattcattaacttccctatatatatctctcatattctcatttatagcttaacgtcataataataagaagatttgctccaacacttcatttctctcgtctcttcctcgtgtcccatttcatctttttctttgctaaatattttcacttttataacactatataatatttaatagagtatttatatgttatactcttccgagttcgctggcatgtgttaaaatgggccttcgttttcttttatccgccttcattgttgggccctatttgcgcaaaattgatacatcgatggggatggactcttgacgctgtcgatcatcactattcactaggactagtaacaactaacaacaagtcattgcttcctgcagaattcatttcccacgatcaatttaatttggctggacaaagtacagcgtttttttcatgttccctgtacgtaactaaaaagtaagagcatgcacatagttggtactcatagagtatcatcaacaattttttattattaattttaatgcttgtttattgtttgagattttttatgatactcataataatctctttccagtggtaagaccagtattggtatcatcaaaaaataaaatttatttgtaaaatcgaaattacatgctagcatcggctactggagcgatagtcgagagcaaataatttttttttctctcattttccacaaaaacgcgttttttcgactaattacaagtcgccacgtcattagagacaggtatcagaaatatcattccagtgatacttctcaagtccaaatcagttgctttgtctattaatttaatatttttaggcttatgatacccacaaaaaatctcctatgtacatggtcttattcaacgtaaagactttttaagtcgttgcgtttaacgtgaagaacgcctcgtagggtcaagctgtgttggaattatctttgtggagtagagtctattattatgtatataaagaaatgggcatgaaaacattttacgtaccatcacaatttccagattttattcaagaaaattaaattagcttaagaaggatg

SEQ ID NO: 2901 - DNA, 3000 bp, Unknown
  misc_feature (1)..( 3000): cDNA_ID_3070446_gDNA_ID_1620614_Annot_ID_162013 3000 nt of promoter + ATG
ataattaattaaattagttattgagataatcaataaatgggttactatattcagctaccttatcacaagcgaagaaccttccatatatgttaaggaacaatcaatctcattcattcatttatcagtaaatacacatattgattttgtaacaaattcctttcacaatacacttaacaattgtcttgagtggacgacattgaattgaaacacgagtacaccacacatgcttcgtcagcttcgacaaaataatcaaaatagatcaaaatacaataacatgacccaaccagaatacaaatcaaacaatataatacatgaaaaacaacaataatcttaatatttcacttcagaagcctaaccttttctgaacattctcaaaccccaaaagcatccaattattataaatctttcaatgcttccaccaccttcaatctataaatctcttatagtttcttcttaaattcacaaagaaacacaagcctttcatattaaagaagaaaaaaaagcaaataaaatattttcagtttcatcatctgtatatgtaacacacaaacacactcatagctagctctagatttttcttatctaatttccagtagaaggaggtgaattacagtcgcaaacaacctcggtttctatttctctccgatggaaactgcgatggcagccacaggcggcgcacgttagcgctgccacggtaccttcctctcctcggcttgccatgaactcacggcagccgtcaacagcgtaacctcccaccgccgcagcgtggttcttctgacattctccgtacctcacagttctcactgtcagagacgaagccgtcgacgagcttctagaaggttcctctggcgaggctctcctcaacaccacctgacgcttcctcatgctttctcacttcaattctcgtctcagctctttcttcttcttgacttttttttatgaaatctaaacttgtaataatgtatatatattaaagaggaagagaaaaatgtataataaagtttttgttcttttactttaatttctacggctcgaaatagttagggagtgaaagatcaaaacaattacaagaggacctcggttgttaaccctaaccctagatgtgatatttatagcatttctgatagcaatcgacaaccaaaccttagatatttttcttgcaactgcatatatatatatatatatatatgtgtgtgtgtgtagatgtacatgtcatggtatagattgatgcatcatcacaaccaatcagacctactaagctaatctaccagaattttgtttttgatgggtatatcatatatgtatatctgtcttttgtaattaaatgaccacaactatgcattgaattataattacaagttttgttttcttgttaccaacctaaatatggtggatgttttctttttggctcatgttatacaaaattcagattatgtttaaagtatcgtaatttttgtttttggaatactaagacactttaatattgcaataatgcgtactagtacttgtctcatccggttagaagaaattgaataagtttatgctgaatcgaaattggaatctactgatctccagttaagaaagagattatatttgtcatcgttctgatttttgatccgaatggacggaccaaaatgtcataactccagagatacaaaaacaaaacattcacgagacatggagccaccactttgtgagttaggcacccgtctttagttgataatatcacccttatacattgtatttggatcttccaaacttctgctagattccactttcgcagaatacgtactcttacattccaacaaatatatattgtgcgctaactagtaaccataaccataagccatagaataaaatgaagtggatgaagaattacaacctgcaacagtaaatatattacgacaaaaattaaattatgtgtggaagtttgtggatgcaacttttgttcgatttattttgcgagaaaaccctaaaatgatgagaaagcttttctttaagaccaaacaaagtgattggttttaaaaggaaggaaacagctaagcttgtctttttaagacctaatatgtactgtggtggccccctttaacattcatcctctttaatcctctttttatttccttctttcattctattttatttcataattagacaggtggttacgaaaattatttatacgtatcataaagaatcgaacttggtatcgagatcgaatatatatgcatagaccaaaaagtgattatgtcggctatgtgatatcttgacccacttctatagtatacccgaggaattgtacggatttaaataaaaaaaatcaattttcgttgtaatctaagtaccaatcaatatatttaagattgtatgatgaatagtcatgaacaaaaatagaagtgtgtataaatgtatatacatttggacctaacaacgtgggactgataagttgggctaccaaacctattttgtacatcatgaggacaacgcaatccttcacgatcgcttgctcctttgcagttacgtatcgatttttttgaattacacatgcatacattcattcgtttttcggttagacatcaaattttcttattcatgtgttccgtcaatcctttgatatttttataagaaatacattgatattttctccttccaaattagatataaacataaatcatgagatggtatataacaataattgcataaccaaacgttgttggtactttataatatatatttaaaaaaaaaaaaaaactgttgtagtttcattgttccacactaaacgttgtttcatgagattaacatcggctgaaaaaaaaaaaaagtttctctcccaggcacgagtttcgaggtaactaaatgaagcaaatgttttcaaaaaaacgggatcttacccactttttttagctattcttggaaactcccacttctccctcgccgacatccccctcatctcccgttattccggcgtctcatctccgtccttttgctcacctatctatgatgatg

SEQ ID NO: 2902 - DNA, 3000 bp, Unknown
  misc_feature (1)..( 3000): cDNA_ID_2175817_gDNA_ID_1620614_Annot_ID_162001 3000 nt of promoter + ATG
gggtcgacaaacaaatacggaaccaactatcatccattcgagcaagcggtgataggtggtatgactaaggtctctaaatttggtttacggcgaaaaattaattgatcaaaaaatttttggtttagtgttttaagatctttttcaaaaaaacgttgtatttgatgtataaacgctatttctttttgaaattaatttaatattatttttgtttgaaaagaagaagaaacataattcaaacaatccctatctttaatgttccaacatcttaataaatacataattaaaactctacgatcaatactacacttctgacgattattaaatcgcatcgtcgtacactattattacaaagaccgttctatctacattaatattctttatatatttttttttttcattttttgagattgttggagtatatatccttagattttcttgtatataaaaatagataattataatgggataaacgaaacatcgttgaagccgtgaagtggcattggtctacaccagagcaacacaaaaagacaaccacttcacatggtctgctcttacattcataaccgaatctaagtcacttttagttggttgtaattttgtaactattattccaacacctctttttttactttttagattgttttataatagaaatattttaattcctaaattaataatgaaagtaaatgtaatatgagtcagtacaatatgtgaaaaacttaaaaagttgacagaatttagcatttgattaaaagtgtatgaagaagaagaaaaaagaagatctttttgtatctatagatttagtgcataacttttctcagattttcgatatatacaagaatttaacataagaaaaatcaagacaaatggacctggttataatcggttatctgttgtaaatattatatttcatattcttctccacttcataattcttattggagttccttcaccaaatgtttgatgttccattaaattaatctaccactctaataagaggtatcgtactacaaattacacttcataaacaagagaagaacataaatttgaatttttttaaaaaaacatatgcgttataacaccaaacagtaacggactagctgatccttgaatttatattagttgcaaaaatttatatatcgaaattgaaacatgaatttttaaaattattagaaaatgtatgatgttgtctaaatgtgacattacaaatacatgatgttgtttaaaaattattataaaacaaccaaagtttggcgtcattctggtaaacgcacttaatgaatttatatacagttaaagattttaacatcaaattttaaaatgacaacttaactaaaatttgtatcctaatatttttactagagaaactcacacatatttttcaaacaaatgattagttatatatccttcgataataggtattgtgtaaaactgtgtggtttgcacaagtgatccctcgatattctttctgctaaagatcgacttcccacagtttcgatatctcgggtttgggtgcaatagcatatgcttgtttagtatgcagataatcgtatgagagagtcagagagatcatctatttttcatgatatggtctgagctaatcgatcatttgttatttatactcgataacgttctaatttgtatgatttttcagccttgatctatcacaaaatggagataatgaaatggtagtcataagaaaggtaatgatccccttgacatgcttattataacacaaaaagtaatcgctactgattagcttaccctatgatttgaatcatataactttatactaattgtctaagtgtgatgatataatgtatatgatgtcatttataacttattagtaaaaatataaagttcttcatcattgtcataaggagttaattggatatacatcaaaaaatttcctaaatttttagaaattattaatcaagttataatagaaattattaaataaaatatatgatgttttctaaatgtgacgatacaaaatacatgatgttgttcaaaacttattagacagaaaccaaagtacatcatcattgtgatgaagactttaatggatttatacatttcaaagttttaaacattacttatttaaatgaaaaattgagctaaaatttgtatacttatatgttgaccatagaaatacttctatataattttagacaagttgtctatacatatatatatatatatatatatatatatatatgtatttacacaaaaatcaagttttcttaatgtaacaatataaaaatataaaatatctaatgttgtttaaaaattatttagaccaaaaaaaaaaaaaactgtaatcaaactttcattggattatatctaactctaaacatgaatttttatacaatgacatgttcaataaaattcccatttcatagtttgaccagaaaaaatgcttgcagatttgttaaaatctctacttatgcaaaaccattgaatcacaccagattttgatttgtagtactttaaaaatattaattgaacacaacataactttaacaaaaaagatctttataaaaaaaaaactttctaaaatgacattaattaacacaaattagtcaattcaaacaatccaataaaatcaaagtaaacccttaattgttttttttttccattttacaaaatgttaaacattaattacatcaactagcaacacgaatctctcaatctctcatgtctcaatgagtctttgaccactagtcttcatcactctctctccctcctatatataccaatcacacccttctccaaccacactctcattctctctctcttctcaccacttcaaaacaagacactcgtaaaagagttcttgaacttcacaaaacaattgtcagattttcaagaaaaactttataaaacaaaaaacatttcattctttctctctctctctctcactgctcaatgatctcgttttctcactaaaccaactcgtttcttcttactttctttaactcggatctacaaaaaaccatg

SEQ ID NO: 2903 - DNA, 3000 bp, Unknown
  misc_feature (1)..( 3000): cDNA_ID_2175927_gDNA_ID_1620615_Annot_ID_162042 3000 nt of promoter + ATG
aattttctgtttcgacgtggaatattataacgttacggccgagttatgcaataagatttcgtattttggccgagttatgagataccatatgttattatgatatatcaaaccagccaccaaattgttggttatattagtagcgtcaagatgtgcaatttgaaaacagaaaataacttttattttcagcaagtgtcgattgacaaaacatggtctgtcaaaacctctaggaagtatgttgttggatatagtatgatgttggacaaagtaggatgttggataaagtttataggatatgcgctagtttcacggttccactagttggaatgtggttatgatatgttaattacttgattttcacaactgttggctcaagaaaagcactttcagggttttgccgagttataacaaagtgatggctgagttattcctatattgtggctgagttatgttagaatgcagagaaaaatattctccgctattgaccagatacgacgtcggtttgttacagagtctccgttattgaccagatacgtcgtcgtagtgacacacttataaatccccaaaacgaaaccctaatttataaaattccaatttctgatttcagatccggagcttcttcttgcttttcgtttccgaatttcccagctaaaaattaaagaaatgagtagcaattccgagaactcgattgcgagtacgcaatccgtcagccgttggggacgtgggttaccatcgaagtgtcattgcggattagacgtggtcatctatacatcgacgtacgcaaagaaccctggaagaccatacttccgttgtcctacgcgtaaagatgtaagtatataattgatttgagggttttattggtttcgatgttaattgcggatgtgattgaatatgcaggaccatttgtttaaatgggtcgaagatggtacatacgaagtggttgtagacagttggccgaaattgtccgtcatggacagtgagttaagcgcggccaagtccgaggttgctgtcgagctagaagcgttacaggcgatggtgaaagaactgaaggaaaaagtaatgaggagcgaaagggaaaaccagatatggaaattgatgatcaaactttgctgcttttgtcttgcctttactatcattgtcattgtttttggtatcttaatgttcccaaaaatcaacgaacagaggctttttcttggctactagtttgttttatgtttgtatgaattgctagctactggaatccattatgtgtttgatgtttttctcagcgtatagggttaattcgtttttttggttcaaagtagtagcttgcaatgaaatggaactttgtgttcggccaagctaatccaatatcgttgactgagttatactggtaatgttgtggctgagttaatcatacgctgtggctgagttaatatatgttgtgtcttcggaaatataggttacggctgagttattataatgttgtggatgagttaattatacgttatgactgagttaatcatacgctatgactgagttatgataaaatttaacaagtaacctcaagcgataacaactgactttactgagaaggcgatcgtagataacatactgagttcataggaatgagataaagggacgataagtaagagacacaaaagcattcaagacatgaaaccaacatcatctgggccaaattcagtaaacatgtccaccaaatcattccaaactgttgtcgtcatccacctcggcttatctaaaccacgcgcccatctcgtttcagcgcccgcatattgtcccggtacaacgttctagccaccaaattaaactgcgtccacaccgtcagcgtgtgccttgaatcccaggtgtgcatacgctaaaaagagagcaaatagtaagaatttggtctacggtttacagaaagtgctttatataaaaactcgatgcttatcgtgaggaggaaaaaccatcttgccttgaaaacaacgggaatcatctggtacgtcggccacgcatggtgaaagttgcgctggagtatatcaccaatcgcgacagctagttggtgattgaatttgaaccacgtaacagtggttttgtcgacccatgtacccaatccaaggtttagaactgggagatctgcacgatcaggagcagtgagcacgacttcgacatctcttagaaactgtccgtcgatgtgaggcaccatgtcgttaagatgtgaggatgagacgtctaaatgatgagttcaagtaactgatatatagaaaagaaaagacaggtagaggaatgcgaaaagttccgtgtctgttcgtttggcgggaaaaatttccgtactacggctgagtttggcggcaaaatatattgttacggttgagttatacccaagacatgtaactattatacggctgagttgtcaagaattattaaaaaggacaggtaaaggaatgcgaaaggttccgtgtttggcgggaaaatattccgtgctacggctgtgtttggcagcaaaatatattcgttacggctgagttacactcaagacatgtaactattatacggctaagttgtcaagaattattaaaaaggacaagtaaaggaatgcgaaaggttccgtgtttggcgggaaaatattccgtgctacgactgtgtttggcggcaaaatatattcgttacggctgagttacactcaagacatgtaacaatgttacggctgagttgtcaagaattattaaaaaagacaagtcaaggaatatgaaaggttgcgtgttacggctgagtttggcgataaatcgtccttgttatggctgatttaaacaacattacggctgagttgtcaataaaaacatgaagttcaattcgatttactgactaaccgaggtacggttatctccggcccaattaccagcggtttaatacgcctataaaatcggcttctcccataaacaccagaaggctaaactctcacaaacagaagctaacgagttcaaaatatttctttaattttcaacgactcagaatttcacc

SEQ ID NO: 2904 - DNA, 3000 bp, Unknown
  misc_feature (1)..( 3000): cDNA_ID_1818849_gDNA_ID_1620616_Annot_ID_46893 3000 nt of promoter + ATG
gactaaaaaaaatcactcaacatgctagagcgtcttaagaaaccatacctatttctcccagaaaaggcacggtagacttcagcctcttcatcttctgtgagaggaataaaaggttcacgaggcaccttcattatatcaacaacacaacaaacatagtgttaacaacaacaataaacatagaaacacactaacgatctcaacgctaagattacaatatactctaataagtagaagaactttgactctgtgtgcataagtaataactgcagcttaataaccaataaagccaacaagtattgtactatcttcagtctacactaacaaacagtaggcgataacatcatatgcattttagagaaacaatccaaacaaagcaatgtcattaattatatccaattcaagaaagattagtataaatctcatcacctcaacacgcttttccacagtctttgggcgagactgacgcagcagtgacaacttcttctcattcaacacaatctcaaaacccaaagcttccaactttgaattcctcttctccgcactttgcataagctttctataagcttcgaggctcgaagcatcattatcgacatctctatctaacgacaacgaatccagcatcatactagtatcctcaactctaaagttctcccctttcttaacatcagtaacaccagaagaaaacgaaggctgaagattcttcttctcctcatcatcatcacaatcaataacttcaattgcttgaacacttgaatcatcagaaacaacttcctccttttcaacctcatcacccaaatcaacaaagtctttacctttattaacgaatctcaaagcttccaaagctgatctctttgcatcatcatacttacgaacaaagaaatttgcgtccttttcgcagtaatcattagattttgcctttccatatctaagaattcctctactaggagcatgaatctctcgtctaagaggagctttagcatcagggtaccttgaaatcctcgaaattgttgggtttgaagacgctggcttaccagaatcttcagacatagcgaatgagaatcttcgtttcttggaagcttggaaatacggtgaatttcgtaaagggttggttgattgttgattaatgaaattgaaggattcgtcgctgcgtttacgattgatcgctacggcacccattagggtacgaatttggatgaaccactaaaccctagagattgagtaatcaatgagatgagaaccattcgagagacacctagaacatgaaattagggttctgtagaagaaaagaaagctcaaagatgaatgatttgattttttctctttccttttaaatttgggggttttctccaaaaataatatttgaaagaaaaaaaattgtggttttatacttaactaaactataaaatttatgaaaatcaaattaaaattttttcataacaattaaagtatggtgggatcatgatataaatattctccttaccaaaataaataaataaataaatatatatataaatattcttggtactactcttcagtctttggtggtatacgatattggatgttgaagctatcacactcatctatggacatgtcaatcggaaaagaaataatgtggcagatgcactatcccaacaagcctttgttatataggttctttgtatcaaacatatacaacaccaccatatgtttacaatttaatgcaactagtacttgttaacaaaaaaaaaagaattttgattaatggttatggttttctttgtttttgaagtggcttttggtttaaattttttcacaattttgtttaatagccacaacttttagaaagttattacatttcagtaattgagttaactgtatctcaagaaaattatatctttcggaaaattatgtagacgctaactaacctttacaaagacgcctatgagactgcaaaaattcttgtcatatttattgatcaaactaacgtagagtttgaccaagagaaaaagaagtaaaaaacaacaacaatagatatggatgttaacgttgatttttaaatgatggagatttgtttgcacttttttagatggagatggatcttatttttgccacttggaggttttttaaaaaatgaaaaactaaacatgttttacagtaaaacctctacaaattaatttttgataaattaataaatacaaggagataatattatattagtttcaagtcgtgtgaatgtaaaatttaacataatttgataaaataataagttaacaattttttaaaaccctatataaaaaatatgattttaataacatcataaattaataaccacaaaaatataatatatatacgataatatatataatctatagtttaaatattttttgaactattgaatgtttgttagagtttgtcttgaactattattacatcaaacaatgattttgtctctaattttcattaaattatgttgtgttttaaaactatcatattgtagtatcgtttataacttcctaatacaattagtcataagtttttataagtatacaacttcttaatctgcattattttcatttcaatagtctactacatttaaaaatctgatagttgaggttattaatcataaacttagatgtatgtatatctattatataaatgaattcagttatagtcattgtgatttattgtcaaatgagttttttgaaatattaaattttcaattctaatactacacaaatttcaacatccaagtcattaatttgatgtatattgaattgtgtcaactcgtattctttaaaaaattaaataattaaaaaaagatctatatagattaataaatatcaatttaaagataaactaatatcactataaattcagaaaatatcatggtcccaacataggttgtattatacactgaagaagataaatatgggggtattaatatacattcttccaaaacttttcaaaagatgacttaatgaaaacgcttatgttttgcctataaatttggtggtgaaaatg

SEQ ID NO: 2905 - DNA, 3000 bp, Unknown
  misc_feature (1)..( 3000): cDNA_ID_3070480_gDNA_ID_1620616_Annot_ID_162052 3000 nt of promoter + ATG
ggttaaccatggcgaagatgtgtttggctgacgggaagcttgctaaaagatatctccctctctttgcacaggtctgtctgcatttgctgattcatgtgtccattttatcattttgattatttctggaaaggaaacttttcgttccaggaacttgattcattggatggtagtctcctttgtctcttcaattttttttaacctatgtgaacccgttgatgccttactcttgcaggaacttgaaaagagtgattgtgcagccttgcgtaacaatcttgtagtagcgatgacagacttttgtgttcactatacagccatgattgagtggtatttcattcacagaacattaatttttcaaatgttaaacatgattgcgacattctaatggtttgtttacctggatagttacataccgaagattactaaacgtcttcgggatccttgtgaagttgttagaaggcaaaccttcatacttctctcaaggttactacaggtattgctattctccacagattctttatcttctgtttttaaaaagtattgaattgacaatgaataagcaggcttgttttcttgattcagagagactacgtgaaatggagaggagttctcttccttcgattccttctatcgctagtggatgaatctgaaaagatacgtcgacttgcagactttttatttggaagcatccttaaaggtatgagaactcacgtgagcaaccatgaaatgcattctttcattcccatgttattgaaaattcttacagagagacatgatctctaggatttttgattattgttacgccccatgttgcttatagtaaaggcgccacttctagcttacaacagtttcgtggaagctatttatgtcttaaacgactgccatgcccacactggccatagtaatccagattctaaacaatcaagaacaaaggatcaagttttttctatcaggtacttgtgttaaagttatatagtctatgctcatacgcaaacttgacattttggtgtgaatgatcttagtgattatctttgtttcatttgttctgtagagggaatgatgaaagggctaggtctaaaagaatgcagatctacgttactttgcttaaacaaatggccccagaacaccttttggccacattcgccaagttatgtgcagagatcctcgcagctgcttctgatggaatgctcaacatagaagatgtcactggtcaatcagttctacaggtaacttccaaaatggctacagagccttttttcttcttgtgattgccgatttttaactcgttttgtctcggtgtaggatgcgtttcagatcttggcgtgcaaagagatccgtttatcagtttccagaggagcatcgtcggagacagcagatatagaggaagaaggtggagatgcagcaactgcaaaaggaagggccataacgcacgctgttagaaaaggtttgattcagaacacgattccaatcttcattgagctcaagaggctattggagagcaagaacagtcctctcacaggttcgctcatggactgcctccgtgtcctcctcaaagactacaagaacgagatcgaagaaatgcttgtcgctgacaaacagcttcagaaagagcttgtttacgatatgcagaagcacgaggctgcaaaggcaaggtccatggctaaccaaggggttgcctgcgggacaagtcatagaaacggtgaacctgaagcatcagcagcaagcgaggagaatgttagagattcgggattggaatcaagagtggtttctgcggctgctgatgtggtggcggctaaggcagctaggtcggtgttgagagaagtgaacggtggagctgcaacgccgcctctgagcgcaatgagtgttccgaagctaaggtcgagccgtggagttagccagagtggtcgaccatcagctgatgtgttggagtctctgagaagaagaccaactttcatgtctgatgatgagagttagaacttaaaaatgagactgtagaaaatagcttttgctgtaaatgcatgacttcgatttttctttttgggagattagatcgagactctattaaagtctaaatcgtatttataaaccgcataagacactaaaacctggtgtgtgtgtgtgtgtgcgcgcatttgtttgcttgctcatgtttgtccttgtgtgataaatccatccctgccctcaaattgatttatgtgttgtatgtgttgattttagtgataacatctcaaagtgattaaatattttcaaaaatgctatttgatgtctataacggctttaaaacttttgcaagttcattagagctatctctagcacatatatggcgcttagagatgttacgaatatgtaagactgattacatatctctttggcttaataaatataagtatttgtgttgaactctttatcttcttcttgaagatgtcttatgggaaacatgttaaatggatagtaaatgagagattcgaaaatatagtgtgagcttccttctttggtttatgcattctccatgtggggggcaaggtttttgaagatttatacttttgtggcaaatctcttgtttgaatactccatgggagtctctcatcaaaactatgctgcaaaatatttgaaaatttataaatctattgtctttgagaaagtgttacaaaatttatgacctcaataatattgcatgaaaactttcatacatcatttggtatatgtatgtttaagaaaaggtaaaaccgtaattataaagagaaagaaaatacaatatcttaatacatatcaatctaattactcattaaccatattaagaaaatatgtgtctttattttttccttttaacataaagcttaaaaagaagatttgtagccagaaaaattaattgtgttcatttcccttttaaaagaatttttcggcgcaacaaaatcgtgaaattgatataaataaactcgagattattaatataaccctttttcacttcacttctctttctctctaaaccctaaaagaagaacg

SEQ ID NO: 2906 - DNA, 3000 bp, Unknown
  misc_feature (1)..( 3000): cDNA_ID_1814718_gDNA_ID_1620616_Annot_ID_162051 3000 nt of promoter + ATG
tgaatggcagtgagtaaccaagacaagctgtggccttcttatacgttgatgaatcctctggcacttaaatctgtctttctttaattatttttttcagctggtaagcgattctggttataattttaaagctgtcaggagatggactacgcagagaaagttgggatatgctcttattgactgtgacatggtaattttgtcgaagaacctgaatttgaagattctcttgttaatattacgcatgtagtccaatttatttatgtttaacttagtctgtgccctctgcagatatttgttcccatccacaggggtgtgcattggaccttggcagtaattaacaacagggaaagcaagctcttgtatcttgattcactgaatggagttgatcctatgattctgaatgctctggtatgatttaatttctaactcttattcgctttatttagtctattaataactgacatgttggatgcattaaaagatattagatgctgataaatctttatcatcatttcttgattctgaaatctgtttggagacattatggagatgccagaagctgttattgctttttaaatcggacactactgtgaaagtgttctaaccatatatactagtcgttatagctaatgccagatctgatattctgcttcaggcaaaatacatgggtgatgaagcaaatgaaaaaagtggaaaaaagattgatgctaattcgtgggacatggaatttgtggaagaccttccccaacaaaagaatgggtatgtaactatgcttgaacttgctatgatccatgatcatgtgaaaggaactatcttgttaaagagataacctctgtagaatcagatacttgtcttctgatgtgggaatatgggtttttaagacaaaggatagatctggtttgagattgattaggagaaattcacctgatataaattttgataatggaatcaacaagggtataacttaactgttcttatgctctttagcactctggttaagctctctgctaactctatattgtttctttgttgcaatcttttatattctcaggtatgactgtggaatgtttatgcttaagtacatcgattttttcagcagaggcctggggctatgtttcagccaggtaagctatcagaatccaaatctctgaatgcctcaagaaactgtagttgagaataaaaactggttgtcttgaaacaatatggaattagtatatccccctagcagtttatgtaacttgtaggatttaggcatttagcgtaataacattgtattactttgcaggaacacatgccatacttccgactcagaacagctaaagagattctgaggctacgagctgattgaagttgcttgtgctaatgttttttcggctattaggaatactatttttggttgccattgttgatttgttcaaactttaaatcccactccttttaggcagtgaagcactcggctttaaaagcagaggtaaaaactgagtcaagcccagagctcttagctcgttccgttattgtatttttttccttcttcttgttttaaaatgtagatgaagcgttttggatctctatgttggttagtctagctgaagatatatgagatgttgaaaaccttatttatttctctccggtcttgaccagtgcgaacgcaatttaaagtttccatctagtatcggttcgatatattttcctctgttcaatagccaaaattccatgaataatctcttgaaagcaaatgttttcgatatacaaatgttctgcacaatttccccaatacatacacgaatatgttacaaatatacaacaaactgctgtttgtgagtacaaatgttgacaaggacacagaaaaaacaaaatcccaaatgtaacattgacatattaaaacccactcccaaaaacaaaaacaaattccccaattcataaaacacgagaggaaggaagacttgtgtgtatctcctaacaaaaactgactggaaggcaaactaacttccactgcctttcctagcgcggaactctcttccggctaagtatctcctgttctttcagacggtgttggaaccgagcaagacgggcttgaagacttacaagaccagctgctttacgggacaacacaaagctcagctgtgtaacatagttgtcaatcatgctccctggccgatccaccttcgctagtaatttcatttcctacaaaaaaaaacatgaaataatgttaaaacaatcacaagacatatgagccataacctcgtgaactatttccattgtatcctcgatctcttttctgtgtgctgtaattaaggtctcttcttcctgccagagtttaaacaaaataattaccatattacaggttttctaaggttattcgtgagcgatattcataaaattccctcacgctcatagcataatttagaagtatagaagggtcaaatggctctttacctcaagcaatgcatcaatgttttcatcaagagaaggctccgttgtttcatactgccttgaagatgtatcgcttgtgttctgactgctagccatattttgttgtctagaatttgtcatggcagggacatcagtcttgagaataagatgagtgaatcctttgactagtggagccgccaaaagaagattttaaaatgttaagcataaatcatattccttaaatgttaagtgaatcctttgactagtatagtatagtgtctggtttttcattagactttctgagatgagaggtatttctattaaaacttaagttgaaggttttaaaatgaatcagccaaaactgcagggtttgtttcattaaaatcccaaaattgtttcgtatacatcatattacccactgaggactctgctctttgtggaaatgctaaattagccccaaacctttttctaagtcccactttgaattctaataagaacgaacagatcgcgggaaatccaaaatgatttgaaaccttttcacctgaatttctgtgaaatccaaaattctctctctatcagtagagaatcgcc

SEQ ID NO: 2907 - DNA, 3000 bp, Unknown; identical to SEQ ID NO: 2905
  misc_feature (1)..( 3000): cDNA_ID_3070480_gDNA_ID_1620616_Annot_ID_46896 3000 nt of promoter + ATG

SEQ ID NO: 2908 - DNA, 3000 bp, Unknown
  misc_feature (1)..( 3000): cDNA_ID_1818903_gDNA_ID_1620617_Annot_ID_46897 3000 nt of promoter + ATG
gtttctgaggagaaaggaattgggcagtgttcttcctgaagaaaggggattccttgggagagaaacaacaaccaagagctgatctgggtgtgcagagatgagaagtcttaagtagaagtgagtggtttctaacggaagagaaacgataaggaagagtcatgtctgaaaagaagaagaagaagaagaattagtgaatcaagaggagaaaatgaggaggaggtagagagatgagaatctacatagatgagaaatgggccatggatgatgagaatgaagttggtgatgatattgatgatgatgaaaatggatttgcataatgggattttgatttcaggagaggcgagaaagggtaagtgatggtggcacaggggaatgtgaggtggaggtgagaggattgcgtttggatgcttctttgtgttaggagtgagacttttgaatttgtgtggttcttgtggaatgtagtgagaggctcttttggttgggcctcacaacctcacaaatgcccacttgtaaaaaagaagaataaaaatgatttgggaattttgttctttgtttggatgtagtcaaagaagagaattagatgcactgtttaaatttttcttcaattttaataatgatttaacaaaatggcattatctcttatgttaaagtaaatcaatcttcaatttttattacatatacaaattgtcaacagtaatactaaatattacaaatcaaatcaaacattttagttcttaaaaaaacatggagctgagtgtgttcgtggggtaactcgatttcatcatgtggtttatgaggtaggtgaggctggttagttaggtgatggacaccatcttctcttaccattatggcttttgttttccttttatgtcaaaaaaactttaatacattttccatcaaacatttaatagatttatccagcttggttttcaaatattcgaatatgtttagtttcattcagtttggttagtataaaatttgtgtgtttcgattaaaaaatgtttggtcgacatgcattaaaaatagttcaaaacatttctaagatatgatctttggaccaatttggtcgatatgcatcatgataagatcgattgtggaagattgggatgatcgatcatatagacatatatgtatatagttttttatttacctgggagatcatatattgatcaacaacttcagtttaaatttgtatttcagaaaaaaaaaaaaaaagacttatttagaacttgtattttgaaaatcatcatgatataactacacaaaataaaaccagaggtggattttctttcggttttaccaagatattttgagttttcggcccataattttcttgagtaagagaggagatcattttaattcaatcatttcccatcatggatattttaatatataattttgtggtaaatttttttttggaagacccctaatacacaaatataactgcatatacgctcgagaaaataaacatactcattcacatcaattataaattatagtaattcaagtgttagtttgagggcatagtgtttagttaactatatgtcatttattaacttggttttcatagatttcaccttcgattcaattagttttgataatttagcatcctatttgtagccaacaataaaacaataaaaaacttattttttcgtttgacatagtgttaatgttgggacgaattatgtacacgatcaaatatcaaccgaaagacattcatcatgatgattaatttttctccttttttaaaattcaatgatttttttttgtgtgtggatatgactgaagaaaatttcttattggtattatcaactttttatacaattttagttcttttcttctttataaatctttattctataaacaaaataataaaaattcaacgttgataaagatttcctaccaagtagtccaatacatatgatagcttcttccgtatatttaggaaaaatattggtaagaagagtaacaaagtattatttgaataagtggtatacttatttgcgattttcaacgattttatttttatgttgcaatactatttggatatagttagatatgatctttagttgatcaagaaaccttgtgattaatgtgtatgtattggggataacaatctgtttatttctctataagatattcaagttgttttgagttttagagttataaatgataaacgcacctctactctgagtactctttcatgttactagcattagaaaactaaaaatgcggagttcactaccatattatgtactcatttctttttttaagatgatgttgcgttatttttagattgaaaaaccttttaaacttttcttttaaattaaaaattcaacaatttgtttattctttcagaaaagataaattgtttatctccctgtttttctaaacaatgtaagagcatcttcaatggtgactaaattgggttctctcagctgtttttctggaaaaagatgattaaaaataaatcaaaatcatgtattattgagaaagttgtctctcttgagagagtttttgaggaggatgagagacgacgacgtggccgttctgatgtttttcaattatacaaattgaaggttagctatattgaggaaaaaaacaaaaaaggtaactgcgaaagcccattaactttaagttgttttgcatcggcccaaatataaatcctaaagaaaaagttacatatgtttaaaaattaaaacgcagcgttttaagagtcagctatttcagaaaaaaataggattagcaaaatcagaactctgcgagcgtctataagaaaaaaccctagaaagaagtcgattatccagaaacagtgtcttcttctctttttgttgttacttcctttggtttcttcaatggaaaaagaagagctcaacaaattgaatcatctctctctcgtctccaatgtctgcaacgaattggaaacgcatctaggatctgcagaaaaagttttggctgagttcattatcgatctaggtcgtcactctgagacagtcgatg

SEQ ID NO: 2909 - DNA, 3000 bp, Unknown
  misc_feature (1)..( 3000): cDNA_ID_4359839_gDNA_ID_1620617_Annot_ID_46898 3000 nt of promoter + ATG
ccttaatcgctaagcctttgaatttctgatcatcaccttcctctttcttcttctccgacttaggcttcggaggataaataccgtggattgtagttaacaacgaccggacgaagtaatccggcatctctgcacctgccttccttaagattcttatcgaattcatcgactgtctcagagtgacgacctagatcgataatgaactcagccaaaactttttctgcagatcctagatgcgtttccaattcgttgcagacattggagacgagagagagatgattcaatttgttgagctcttctttttccattgaagaaaccaaaggaagtaacaacaaaaagagaagaagacactgtttctggataatcgacttctttctagggttttttcttatagacgctcgcagagttctgattttgctaatcctatttttttctgaaatagctgactcttaaaacgctgcgttttaatttttaaacatatgtaactttttctttaggatttatatttgggccgatgcaaaacaacttaaagttaatgggctttcgcagttaccttttttgtttttttcctcaatatagctaaccttcaatttgtataattgaaaaacatcagaacggccacgtcgtcgtctctcatcctcctcaaaaactctctcaagagagacaactttctcaataatacatgattttgatttatttttaatcatctttttccagaaaaacagctgagagaacccaatttagtcaccattgaagatgctcttacattgtttagaaaaacagggagataaacaatttatcttttctgaaagaataaacaaattgttgaatttttaatttaaaagaaaagtttaaaaggtttttcaatctaaaaataacgcaacatcatcttaaaaaaagaaatgagtacataatatggtagtgaactccgcatttttagttttctaatgctagtaacatgaaagagtactcagagtagaggtgcgtttatcatttataactctaaaactcaaaacaacttgaatatcttatagagaaataaacagattgttatccccaatacatacacattaatcacaaggtttcttgatcaactaaagatcatatctaactatatccaaatagtattgcaacataaaaataaaatcgttgaaaatcgcaaataagtataccacttattcaaataatactttgttactcttcttaccaatatttttcctaaatatacggaagaagctatcatatgtattggactacttggtaggaaatctttatcaacgttgaatttttattattttgtttatagaataaagatttataaagaagaaaagaactaaaattgtataaaaagttgataataccaataagaaattttcttcagtcatatccacacacaaaaaaaaatcattgaattttaaaaaaggagaaaaattaatcatcatgatgaatgtctttcggttgatatttgatcgtgtacataattcgtcccaacattaacactatgtcaaacgaaaaaataagttttttattgttttattgttggctacaaataggatgctaaattatcaaaactaattgaatcgaaggtgaaatctatgaaaaccaagttaataaatgacatatagttaactaaacactatgccctcaaactaacacttgaattactataatttataattgatgtgaatgagtatgtttattttctcgagcgtatatgcagttatatttgtgtattaggggtcttccaaaaaaaaatttaccacaaaattatatattaaaatatccatgatgggaaatgattgaattaaaatgatctcctctcttactcaagaaaattatgggccgaaaactcaaaatatcttggtaaaaccgaaagaaaatccacctctggttttattttgtgtagttatatcatgatgattttcaaaatacaagttctaaataagtctttttttttttttttctgaaatacaaatttaaactgaagttgttgatcaatatatgatctcccaggtaaataaaaaactatatacatatatgtctatatgatcgatcatcccaatcttccacaatcgatcttatcatgatgcatatcgaccaaattggtccaaagatcatatcttagaaatgttttgaactatttttaatgcatgtcgaccaaacattttttaatcgaaacacacaaattttatactaaccaaactgaatgaaactaaacatattcgaatatttgaaaaccaagctggataaatctattaaatgtttgatggaaaatgtattaaagtttttttgacataaaaggaaaacaaaagccataatggtaagagaagatggtgtccatcacctaactaaccagcctcacctacctcataaaccacatgatgaaatcgagttaccccacgaacacactcagctccatgtttttttaagaactaaaatgtttgatttgatttgtaatatttagtattactgttgacaatttgtatatgtaataaaaattgaagattgatttactttaacataagagataatgccattttgttaaatcattattaaaattgaagaaaaatttaaacagtgcatctaattctcttctttgactacatccaaacaaagaacaaaattcccaaatcatttttattcttcttttttacaagtgggcatttgtgaggttgtgaggcccaaccaaaagagcctctcactacattccacaagaaccacacaaattcaaaagtctcactcctaacacaaagaagcatccaaacgcaatcctctcacctccacctcacattcccctgtgccaccatcacttaccctttctcgcctctcctgaaatcaaaatcccattatgcaaatccattttcatcatcatcaatatcatcaccaacttcattctcatcatccatggcccatttctcatctatgtagattctcatctctctacctcctcctcattttctcctcttgattcactaattcttcttcttcttcttcttttcagac

SEQ ID NO: 2910 - DNA, 3000 bp, Unknown; identical to SEQ ID NO: 2780
  misc_feature (1)..( 3000): cDNA_ID_1807441_gDNA_ID_1620617_Annot_ID_46899 3000 nt of promoter + ATG

SEQ ID NO: 2911 - DNA, 3000 bp, Unknown
  misc_feature (1)..( 3000): cDNA_ID_1818895_gDNA_ID_1620617_Annot_ID_46900 3000 nt of promoter + ATG
tcctagattttcgaataggctttacacatgtaggaatttcaatacatttcgtgggcttaatccttaaggaaacaaaaatctatcttcccgggttagttttgcttgtagtaggcattttagtttatccccatactcttatatcctttttgaatataactatgatttaacctgcggtttatcgcaggttaatcagtttatttgattcttatactaaatatttgaataaatttgatatcctaaacttataaatataaattttttaatcaaacataactaaataataattgagatttttttgggttgttatttagtgataagaggaatgtgttaaaatgtgtttaaatttttgtttggttgttatttacttatttttgttgaacggtttagatttaagaaaattaattttattgaacggtttaaattgaatcggatcatataaagtttaggagattgttaagactaaattatccttaatgattttgaatagcaaagaacaaaatccaaaattgaaatcaaaattaaggccaaattagacaaaattttaatttgtacttcctttttaataataagaggatgcagaaaaacaaaactattttttgcggctttctccatcataattcgattatagatcctactatattatttgggaattacattttaaatgtaaccttaatttttgtaattaattacatgacaatgccattaaaaaaatttaataaaaaacaaatcctttaatgacgttaaggttaccaaaattatttaacgacaatattcatttcttaattatagggcttagtggatctaaagacggatcattaaagatttcctaaactgaagcaaaatataccgaatattcaaatatctatctgttaccaaattataaacaaataagttcgtaaaataatttaatattttttatacgaaatcaattaaatcttaatcacataaaaattagcacaaaaaaatattcaacaattaaaaaattatcaaatttctgtgttatataagttttgatactatattcgaataaagtgtaatataccttttcaatttgcattctttaactaatatatttgttaatcttatatttatcaaaaccgactatcgtttcttatctctatagcatttttgcaagactgttttggtggatttgggtaaaagtgcattcgagtcatatggtacattcccctattaaataaatatggtgcactcctatgttattagataaaatgtttagattataattcagagtcatatcataagtaaaattaatattaataaaataaatggctttttcgcaagacggatttggagggacgggtttttgaatcaacattaataaaaaagtaaaataaaattaatccaccgtttcaatacgggttacatcttgaatttttttttaagaccactaatattaaacatatcaaatcatcttaatttagaaaatgttatataaaaccaaaaatgttatgtggtatgtataatgttactatatataaaattaaactataaaatataaatgtattagagaatgatacaatttgcaaaacttttatatataataaataattcttaaattttaaaaattactacttaaaaaaaatcacgggacgggtaaagaaattaccgaacgagttttattttggaattgggttatatggtggatgtatttgaatcaatatttataaaattttaaaatattattaatatgttgttttaataagggttaaaacttcagttttttaacaattgtctcatggattcgtggtatactgttacttaataacaattatacactgtaaaatataactattttataaaaataaaatttgcaagttttaatatctattacctttaaaaaataaatcgtctcgcgatataccgcgggttaaaatctagtattgttgtattactctacgatgtggtgttttggttatatataaaattctatagattcgaatggaaaagaaaaactacatatataaggatttcaatttaaaaacttatcgtcaaccattgacataaaaatctctaaaccttcaattttcaacccacagattgatttcctactaaatatctcaaaaggtgctgcaaattaaataattttactggtaacaacttgttgtcctactaatcttatggttaagtctaaaccacatgtaaccctttttatataagggagagtcttgtaacagaacaagttaagttgagagtgaaagacattgattgatggattaatatattatagttttttttgaatgatgaaacataagttttcttcgttttacacatgaaaaagcttagttaattttgcagttggttaaaaggaaaaagtcgttgattggctttctcttaacacttgtagggttttttttacctcaaagtctctaaattaaataattaacacatagcagcctctaaaaagttagtgtattttgatataatagattaaccatcaccatgtcaattcaaatacaagtgtatgtcttcaaatttcattaatttattttcttctcatctataaaaacagcatcagattttctttttcaaaatggttaagattttattcacccaaaacaaaaactttttttaaaagtttttaacaaaaaaaaatcaaatcaatacccaaaaaaatattagaaaattgattgctagtaatagaatcctatattataatttgactagagttttaaccaaaattcaatactgacacatatcatttaataatactaccaaaacaaaacacatgtgaatccatccataatatataccataatttgattaatacaacaatgattttgtctacatttagccattttattaaatgctagttgctatattagctattttttccttaatatcataaaaacaatttttttggtcgcacgtattaacattttttttcctatataattcatgaatgattaaacccaagatcctcactcgttggtccttagtcttcgacctcctttaatctctccatctctttctcttaagatg

SEQ ID NO: 2912 - DNA, 3000 bp, Unknown
  misc_feature (1)..( 3000): cDNA_ID_1818875_gDNA_ID_1620617_Annot_ID_46907 3000 nt of promoter + ATG
caacgtttctcattggcatttgattgaatacaatctctgcagaatctaactgagaattggagacaagaccataaagcatagtagtccatgaaacaatacttctcccaggcattttatcaaacaccttacgtccactatctggtttcccacacttaaagtaaagatccatgagagtgttttggaagaagacatcattaaaaaacccagctttaatagctaaaccatgaacttgggtacctaaacgaatcgacgaagaagcgagacaagctttgataacaaaagggaaagtgaatttatcaaactgggattgatgagagatcatcataaggataaagagaagaagagcttcacgaggtttgtgattaacagagagagatcttatcataaggttccaggtaaaagtagaaggagattgaagttgattaaagacgagagaagcgtattgggtttctccgaaggaagaagaaacacttatgagctgacgaactagtaactgatcgttggtgagattgtgtttgatgattttggtgtgaatttgtttcaattgagagaaatttgaacaagttcggagaaagtaagaagcttcgggagatcggaatggtggaggagagaggaggtttggtggtgaagacggcgacggagccgccatggattaacgataaatcaccaaattctcacattcactctttcctcgattgatcgtgtgtggatgatgatgaagctgcatataaaccgaactaaaccgaagtttggctgatttggttcggattcggtttattgtgtagcaagaggaagcataaccagattgattcgactaggaaccactaaaccaaacgaaatacagaaatttcgaaccaaaccggatcgattctacgtgtattaaacgtcgtcgtttttgttagctaaaaagaagaaatagtaaatatccattagaagaagaagacgaagcagaggaatctagggtttatgctacattgaagcaaagatggttacgagcagcgatcaaatccaaaatggttctgaagagcaatcaaaaagatcagagatttacacatacgaagcaccatggcagatctacgcaatgaactggagcattcgtcgagacaagaagtatcggctcgcaatcacaagcctcatcgagcaatatccgaatcgcgtcgaaattgttcagcttgatgaatcaaatggtgagattcgttcagatccaaatctctgcttcgaacatccttacccaccaacgaaaaccagtttcatacccgataaagaatgtcaaagacccgatcttttagctacttctagtgatttccttcgtttatggcgaatctctgatgatgaatctcgtgttgagcttaagtcttgtcttagtagtgataagaatagtgagtttagtggtccaatcacttcatttgattggaatgaagctgagcctagacgaattggtacttctagtattgataccacttgtactatttgggatatagagcgtgaagttgttgatacccagcttattgctcatgataaagaggtttatgacattgcttggggtggtgttggtgtctttgcctctgtctcagaggatggttccgttagagtgtttgatctccgtgataaggagcattcgacgattatctacgagagtggtgagcctagtactcctttggtgcgacttagttggaacaagcaggatccgaggtatatggctactgttatcatgggcagtgctaaaattgttgtgttggatattcggtttccggctcttcctgtcgtggagcttcagcgacatcaggctagtgtcaatgctatagcttgggctcctcatagctcttcccatatctgctccgctggagatgattctcaggcgttgatttgggatatatcttccatgggacagcatgttgaaggtggtctggatccgattctagcttacacagccggcgctgaggttgagcagcttcagtggtcatcttctcagcctgattgggttgccattgccttctctaacaagctgcagattctccgggtctgattatgttttacagatttctgttggatacttggatgtaaaaactcgttgctattgttgattaatgatcttttgatctctgactctaagcctcattgagtttctttcatagtatggtctgtgtaggaactatgtaccttcaaaattgtgaataactagctttagcattggatttgattagacgtatggaagttagttttaacagagagcatgtggcataacggggaacttgaagtagattatgactaacaccagcatttatgtttctctgccctcgagctgatggagttgcaggattttgaaggagtgtgtgtatagaggtagttcttaacagaataatatttctctgcctcaccatcgtatggaatgtgtagctttctatggtagttgttataagctttgtctccattgtccatgtcatttttgcaatgatacttaaaacactttatgggtatgtagatttgtgaaattaggcattagtaacatcgtacagatgatgtattcttcattacttcaatacaggcatatagattctctgtccaacttaaaaggcatacaagttccgtggtttaaaaaatcagctttcctaaatcctttggccaatactctctcagccagtcctaagaacctctgctctaaaaagtctgagctttgaaaggcagacaaatggagagcagccttatcctccttttataactgtgaccacacacacaaatgaagaagcccaaatgaaaggcccaaaaatctaaaaaaataggtgaaggagggactttgtgaatatgtgatcatagaaacatgaggagacaagagagtgctaaaatcacaaccatagaaacaagtaagaaagctatccagaatctaatcttatttgcctccaagtcatcaattctttatcctatattactagtctctgcttcaccaatcctttttgctctcctgtctgctacaaaccttaacttggattctttctggtcacc

SEQ ID NO: 2913 - DNA, 3000 bp, Unknown; identical to SEQ ID NO: 2692
  misc_feature (1)..( 3000): cDNA_ID_1818871_gDNA_ID_1620617_Annot_ID_46908 3000 nt of promoter + ATG

SEQ ID NO: 2914 - DNA, 3000 bp, Unknown; identical to SEQ ID NO: 2692
  misc_feature (1)..( 3000): cDNA_ID_1818871_gDNA_ID_1620617_Annot_ID_162077 3000 nt of promoter + ATG

SEQ ID NO: 2915 - DNA, 3000 bp, Unknown; identical to SEQ ID NO: 2690
  misc_feature (1)..( 3000): cDNA_ID_2167656_gDNA_ID_1620617_Annot_ID_162075 3000 nt of promoter + ATG

SEQ ID NO: 2916 - DNA, 3000 bp, Unknown; identical to SEQ ID NO: 2912
  misc_feature (1)..( 3000): cDNA_ID_1818875_gDNA_ID_1620617_Annot_ID_162073 3000 nt of promoter + ATG

SEQ ID NO: 2917 - DNA, 3000 bp, Unknown
  misc_feature (1)..( 3000): cDNA_ID_3069731_gDNA_ID_1620617_Annot_ID_162061 3000 nt of promoter + ATG
aacggtggattaattttattttacttttttattaatgttgattcaaaaacccgtccctccaaatccgtcttgcgaaaaagccatttattttattaatattaattttacttatgatatgactctgaattataatctaaacattttatctaataacataggagtgcaccatatttatttaataggggaatgtaccatatgactcgaatgcacttttacccaaatccaccaaaacagtcttgcaaaaatgctatagagataagaaacgatagtcggttttgataaatataagattaacaaatatattagttaaagaatgcaaattgaaaaggtatattacactttattcgaatatagtatcaaaacttatataacacagaaatttgataattttttaattgttgaatatttttttgtgctaatttttatgtgattaagatttaattgatttcgtataaaaaatattaaattattttacgaacttatttgtttataatttggtaacagatagatatttgaatattcggtatattttgcttcagtttaggaaatctttaatgatccgtctttagatccactaagccctataattaagaaatgaatattgtcgttaaataattttggtaaccttaacgtcattaaaggatttgttttttattaaatttttttaatggcattgtcatgtaattaattacaaaaattaaggttacatttaaaatgtaattcccaaataatatagtaggatctataatcgaattatgatggagaaagccgcaaaaaatagttttgtttttctgcatcctcttattattaaaaaggaagtacaaattaaaattttgtctaatttggccttaattttgatttcaattttggattttgttctttgctattcaaaatcattaaggataatttagtcttaacaatctcctaaactttatatgatccgattcaatttaaaccgttcaataaaattaattttcttaaatctaaaccgttcaacaaaaataagtaaataacaaccaaacaaaaatttaaacacattttaacacattcctcttatcactaaataacaacccaaaaaaatctcaattattatttagttatgtttgattaaaaaatttatatttataagtttaggatatcaaatttattcaaatatttagtataagaatcaaataaactgattaacctgcgataaaccgcaggttaaatcatagttatattcaaaaaggatataagagtatggggataaactaaaatgcctactacaagcaaaactaacccgggaagatagatttttgtttccttaaggattaagcccacgaaatgtattgaaattcctacatgtgtaaagcctattcgaaaatctaggatcaaattatgggaaataaaagatagtcacaagcaataccacacgcaacttgatatcaatgatataacatacacacgttattccccattgtttttgcattgtatgcaacataaaattatttgacaaaaaaacacacacataaaattacctcaataacatatatttcctgaatatgataagaatgtaacttcttctttttgggtcaaaaatgataagaatgtttgttacatctcggacttaagaccctaattaactaagggatgaagtttcatgaattgttttaatggctggtgtagctcgtgattgcgggagtaacaaggcttctcattctttgaagggatgcaagtggacgccaatcctagcaaatacaccaaatatttatattactgcatgttgaggattatgattgtatggtaactctactgcgtgtcgatgcatgcatcagcttgaagaatttctcttcttgataccttttgatccaagtatgcaaacgatgaaaaggatatgacgcttgccaaaattacggctggtcaaaattaggagcatgggctaacgactttatgaacgatcataatatgggctgaataaatgcccactactagcaaaactaagcccacaaaataggttttttgtttccttaaggactaagcccactaaatgcatactgaaattccactgtgtaggactattcgaaaatctaggaatcaaaagtcatgtcaactaaaaaacactcacaagcaaatgccacacgcaacttgatagcaatgatatatatatatatatatattttttttccgactgaatgattccattatattaggcgaaagtggaatgcatttttgaaatacaacaacgataagagtcgaaactctgtcagaaattaagtcggagaaagacaacaatatcttctgaaacctaagcccaaaagagagaaacaaactgtaagcaaaaagttacaaaaaagtaagcataaaaataacctaaaagctaaatctgaaactcaaaacatcataacctgcaatcaatcccatagtaacgattagcgtcgagctgaaaccaagaaacatgagccccaagaagaaccaactcagcggacaaactccaaaagaaaggaaatcccgaaaaagaacgaatataaaggctcaacaagcaacaacccaatagaacagataacaatgatatataacacgatattctagatttctagattttttttgcattagtgcgcaacataatattaaacctaatcaacaaaaatatgccaaattcctaaaaatgataagaatgtctcttaaatctcgaagttaagaccctaattaacttcattaacgcttcttaatctataaatatatagttcttcaaaaatctttcaacgcattaattattcaaaaagtaaacacatggaagccgtgtagttcacgcgccggtcaaatcgaaaccgtagaaaaaagcaaagaaaagaagacaaaaacggacttgacttatagagaaagacttaaacaatggcgaagacgaagacgatgagcaacaacaacaacaacacactagtaacaacagtagcatcagcttgaaagagagaactaaaacctagaaatcgagagagattggtggaagatttttcaccagatttc

SEQ ID NO: 2918 - DNA, 3000 bp, Unknown
  misc_feature (1)..( 3000): cDNA_ID_1818895_gDNA_ID_1620617_Annot_ID_162059 3000 nt of promoter + ATG
attcatttcttaattatagggcttagtggatctaaagacggatcattaaagatttcctaaactgaagcaaaatataccgaatattcaaatatctatctgttaccaaattataaacaaataagttcgtaaaataatttaatattttttatacgaaatcaattaaatcttaatcacataaaaattagcacaaaaaaatattcaacaattaaaaaattatcaaatttctgtgttatataagttttgatactatattcgaataaagtgtaatataccttttcaatttgcattctttaactaatatatttgttaatcttatatttatcaaaaccgactatcgtttcttatctctatagcatttttgcaagactgttttggtggatttgggtaaaagtgcattcgagtcatatggtacattcccctattaaataaatatggtgcactcctatgttattagataaaatgtttagattataattcagagtcatatcataagtaaaattaatattaataaaataaatggctttttcgcaagacggatttggagggacgggtttttgaatcaacattaataaaaaagtaaaataaaattaatccaccgtttcaatacgggttacatcttgaatttttttttaagaccactaatattaaacatatcaaatcatcttaatttagaaaatgttatataaaaccaaaaatgttatgtggtatgtataatgttactatatataaaattaaactataaaatataaatgtattagagaatgatacaatttgcaaaacttttatatataataaataattcttaaattttaaaaattactacttaaaaaaaatcacgggacgggtaaagaaattaccgaacgagttttattttggaattgggttatatggtggatgtatttgaatcaatatttataaaattttaaaatattattaatatgttgttttaataagggttaaaacttcagttttttaacaattgtctcatggattcgtggtatactgttacttaataacaattatacactgtaaaatataactattttataaaaataaaatttgcaagttttaatatctattacctttaaaaaataaatcgtctcgcgatataccgcgggttaaaatctagtattgttgtattactctacgatgtggtgttttggttatatataaaattctatagattcgaatggaaaagaaaaactacatatataaggatttcaatttaaaaacttatcgtcaaccattgacataaaaatctctaaaccttcaattttcaacccacagattgatttcctactaaatatctcaaaaggtgctgcaaattaaataattttactggtaacaacttgttgtcctactaatcttatggttaagtctaaaccacatgtaaccctttttatataagggagagtcttgtaacagaacaagttaagttgagagtgaaagacattgattgatggattaatatattatagttttttttgaatgatgaaacataagttttcttcgttttacacatgaaaaagcttagttaattttgcagttggttaaaaggaaaaagtcgttgattggctttctcttaacacttgtagggttttttttacctcaaagtctctaaattaaataattaacacatagcagcctctaaaaagttagtgtattttgatataatagattaaccatcaccatgtcaattcaaatacaagtgtatgtcttcaaatttcattaatttattttcttctcatctataaaaacagcatcagattttctttttcaaaatggttaagattttattcacccaaaacaaaaactttttttaaaagtttttaacaaaaaaaaatcaaatcaatacccaaaaaaatattagaaaattgattgctagtaatagaatcctatattataatttgactagagttttaaccaaaattcaatactgacacatatcatttaataatactaccaaaacaaaacacatgtgaatccatccataatatataccataatttgattaatacaacaatgattttgtctacatttagccattttattaaatgctagttgctatattagctattttttccttaatatcataaaaacaatttttttggtcgcacgtattaacattttttttcctatataattcatgaatgattaaacccaagatcctcactcgttggtccttagtcttcgacctcctttaatctctccatctctttctcttaagatggcaaaagacaaagatataacggagacgcttctcactgcggcggaagaacgttctgatcttcctttcttatccgtcgacgatattcctccgatcaccaccgtcggtggcttcgttagggaattcaacgtggaaaccaaaaagctatggtacttggccggtcccgccattttcacatccgtgaaccaatattctctcggcgctattactcaggtcttcgccggtcacatcagcaccatcgctcttgccgctgtctccgtcgaaaactccgtcgttgccggcttctcattcggcatcatggtaaattatatccacgccttttattttgtggtttgcatttattatccaaaatgcgttttttttctttctttgactaagtttcattattaacttaaaacacacaaagatccaaaagttgggagatgtccaaatcattcaaaatgtttttgtctacatttctataaacaattttctatattttaatttatatcaaaagaccattaaattaaaaaaataatttaacatatatacattaaaaatgtaaattcaaacgcccaaaaaaattgaagaaatgaattcatgattatcaatttgtagtcactagtcaaagtacaatttatttatcaaatggaccattttctcaagtttaaaaattaatatattttttgccttttgtaaaagtttcactttatttttttttgtaagatttaagaagttttgttttgatcattgtaatgaatgtgattatgaacgtccgcaactagcttggaatg

SEQ ID NO: 2919 - DNA, 3000 bp, Unknown; identical to SEQ ID NO: 2780
  misc_feature (1)..( 3000): cDNA_ID_1807441_gDNA_ID_1620617_Annot_ID_162058 3000 nt of promoter + ATG

SEQ ID NO: 2920 - DNA, 3000 bp, Unknown; identical to SEQ ID NO: 2909
  misc_feature (1)..( 3000): cDNA_ID_4359839_gDNA_ID_1620617_Annot_ID_162057 3000 nt of promoter + ATG

SEQ ID NO: 2921 - DNA, 3000 bp, Unknown; identical to SEQ ID NO: 2908
  misc_feature (1)..( 3000): cDNA_ID_1818903_gDNA_ID_1620617_Annot_ID_162056 3000 nt of promoter + ATG

SEQ ID NO: 2922 - DNA, 3000 bp, Unknown; identical to SEQ ID NO: 2688
  misc_feature (1)..( 3000): cDNA_ID_3409127_gDNA_ID_1620617_Annot_ID_162083 3000 nt of promoter + ATG

SEQ ID NO: 2923 - DNA, 3000 bp, Unknown
  misc_feature (1)..( 3000): cDNA_ID_2992438_gDNA_ID_1620617_Annot_ID_162082 3000 nt of promoter + ATG
acagtgagttgatctcttttcacaattcttcatgttaaactgatgaagagaaatttcagtattttaatttcctactttctagattgggcctataccagctgatgatggtattagcaaagagattatcactaaacttacaaccaccatgaagacaaatggaacattttacacagactcgaatggccgtgacttcatcaagcgggtattagatgcaaaattcatgtgaagtagtttatttttatttttgtaacaaggggtattttgtttttattgtaacatactttgttacattttcttgcagattcgggacttcagaacagattgggacttgcaagtgtaccaaccggttgctgggaactattatcctgtaaggcatcaaacccatctgagattccttctcgtggtgtactaaggtcttgtactagactgagctgcactatatctggccttttgtctaatatatatattttcttccagctaaatctcgggatatacatgcaagataaaacctcagagctatccgtgttggtggatcgagctgtaggtggatccagcttagagaacggccagatcgagttgatgcttcatcggtttgtcaactaactttctctatataaccaagacaagcatatgttgttttgcttgtatttcacctttttttcattcatgtaggagaatgcagcatgatgacattagaggtgttggtgagattcttaatgaaacagtctgtctccctgaaggatgcaaaggattaacggtaagcttaagttctcatctcatttttagctgtccaagttgcaacgtatcagcttttaagggaacatgtgacagagcttgtttccaaggtggtattaaatcgttatagttggtcttataaccgttatggtaactctgaattgttttgcagatacaagggaagttttatgtacagatagataaacctggagatggggcaaaatggcgtcgaacatttggtcaagaaatttattctccactacttatagcattcacagaacaggttgctcttaaaaaaaaaaaaatacttacttccctccagttctataagatagtgaagtgagataaggtactttttttgtaggaaggagatagttggattaattcacataagacgacattctcagcgtttgaaccgtcatattcattaccaaaaaacgtcgcattactcaccctccaggttagttggattgtgtactgtatacatgtcaaagacggttttttattagtttgaccacactcacactatgattaattctgacattttcaggagttggaaaatggggaagttcttctaaggcttgctcacttattcgaggttcttacttgtcctctctatgcgtttccaccgttaataatgtgttatagctatgtgctttttggttgtggaaatgtagtttaacactaggccgattaaactagcaaataattagagatatagaaaaacttgtattactcagaaaacccaaatcttgcagtgtcaggaaaccagacaattagttgtatagagttagttcataaaaccaaaccgtaacgtttagggtgtatttttcacctaaaaatcaaactgttttcatgtttatactcgtaaaaagctgactatgcggttgatcatcgtgctatgtcatttggttttccttaatagttccacatgtgaaataagatgagacctaaagtaatatagaagggagatggtcaagtccactaattggttttaaattgagaacccatgaacttcgacagtgttgcttttttggttcactaagcaacgggtaaaatctaatgtggaatttgataattattttctatctcttctcttaatggtttcatcgaagttgagtccttctgagttactgtcttgttaaccttgtgaaggttggggaggatagtgagtactcagttatggcaaaagtagagctcaagaaactattccacaacaaaaaggttcgccaaaaaaagacgacccttctcttatttgtctcactgtatgttaacaaaaacaactgccgttctgtttttaatatgttttgaacagataagggaagtaaaggagacaagtctttccgggaaccaagagaaggcggagatggagaagagacggctaatctggaaagtagaaggctcggccggggaggaagtgaagagaggagaggcggtggacgcagagaagctagtggttgagcttgttccgatggaaattcgaaccttgttgatcaagtttgatgatcaaattgaaatggttggtgataaagagcagcaacataggttatgaaataatacacgttgttgttgtctttttaagtttaatcggagaagagaaaaaagtttgaatttagtgtctgatgcgagtttaaaattcgggtgattgcaacagtcacgagtgcgatcccggtagagtatcgcaatttctgcattaacatttacgtttgctaaggggtgggcattttaaccgaaccgaaccgatccgaaccaaccgaactcaaaccgacccaaactaaacccggattaacactaaaattattcggttaggcttcttctcaacccaaatagttcggtttaaaaacctttcctatcacgacaataaattttgtttggtgtttacataaccgaattaatcgtaccgaatccgaacttaaaccgaaattcccaccgttaacctggctatactgaaactatatatatacgtatatatatatatatatatacatgcgatgttgacaaatgaacacaaaagtagataaactcaaaccggtagttattacattaactgtgtaataaagattcggtatatcccacccgcgaagaaaaggaatcatatcacgggttaacgaatccgggtcgggtacacggagcaatcataaagaagaaacaaaaactacgacgacaacttttttttggccttggttaaaaaattttcataagtgaacacagaagaagcggtggctctgagccggcgaaatctcctttctcatccctaaaattttc

SEQ ID NO: 2924 - DNA, 3000 bp, Unknown; identical to SEQ ID NO: 2689
  misc_feature (1)..( 3000): cDNA_ID_1818857_gDNA_ID_1620617_Annot_ID_162081 3000 nt of promoter + ATG

SEQ ID NO: 2925 - DNA, 3000 bp, Unknown; identical to SEQ ID NO: 2691
  misc_feature (1)..( 3000): cDNA_ID_1019757_gDNA_ID_1620617_Annot_ID_162080 3000 nt of promoter + ATG

SEQ ID NO: 2926 - DNA, 3000 bp, Unknown; identical to SEQ ID NO: 2691
  misc_feature (1)..( 3000): cDNA_ID_1818861_gDNA_ID_1620617_Annot_ID_46911 3000 nt of promoter + ATG

SEQ ID NO: 2927 - DNA, 3000 bp, Unknown; identical to SEQ ID NO: 2689
  misc_feature (1)..( 3000): cDNA_ID_1818857_gDNA_ID_1620617_Annot_ID_46912 3000 nt of promoter + ATG

SEQ ID NO: 2928 - DNA, 3000 bp, Unknown
  misc_feature (1)..( 3000): cDNA_ID_2992438_gDNA_ID_1620617_Annot_ID_46914 3000 nt of promoter + ATG
ttttaaccgaaccgaaccgatccgaaccaaccgaactcaaaccgacccaaactaaacccggattaacactaaaattattcggttaggcttcttctcaacccaaatagttcggtttaaaaacctttcctatcacgacaataaattttgtttggtgtttacataaccgaattaatcgtaccgaatccgaacttaaaccgaaattcccaccgttaacctggctatactgaaactatatatatacgtatatatatatatatatatacatgcgatgttgacaaatgaacacaaaagtagataaactcaaaccggtagttattacattaactgtgtaataaagattcggtatatcccacccgcgaagaaaaggaatcatatcacgggttaacgaatccgggtcgggtacacggagcaatcataaagaagaaacaaaaactacgacgacaacttttttttggccttggttaaaaaattttcataagtgaacacagaagaagcggtggctctgagccggcgaaatctcctttctcatccctaaaattttcatgtccatcttgcctcctccgattatccaaggtcacaattcgtcttctccttcttcagattcctctctaaaccctagctctgagcatggcaacaactcttcttcttctctctctcctcttccctcctctcctccttcccggatctcttcttccaccggaactcgattctccggacattctgaatcctctcacaatttctccggtggctctaggggtaatggaattgattgattaactcagctgcttgattttgccctaaattttagggtttttacattaaaagttcgttaattttgttgagttttgatttgggtttttagggtctctttgaaaaatcttagctttttctctaattttttattctttctgttaaactgtagaaccgagtgttgcagctgaggagggacatagccgtggatcttccaaagaggtaaactttagatgcttctcagtaaatgatgagactttaagtccttttttgttgaatggtccgttacttttgtttctacgctgcagatgacacaaaatggagcagggaaggagagtttttccccacctaatgcagataagcgtgaccattttcgatatgatggtcgaaggaataggtctagagggagaggtactggagctgctggttcttcttcttctcaattgcagcataattccggaccttttaattctcctagaggcggtgtttcgcatcataatccaactggtagaagagctaatatgataagtgggaatcatttactgaattttcagtatgatccgatttcgcaaccgcaatctaggggtcctcctccgcctcaaagaaggcaacaatataaggggaggccttttaacaaggatttgtttcttaaggccaattataagtttgttgtgttggacactggagatcattctcctgattcaatggatcctgataaaatgctgcagtgggatgatattatttgtgtaaggtattctactccgtctcctgtccagtgtccgatttgcttggagtatcctctatgtccgcagattacttcctgtgggcatattttctgtttcccgtgtattctacagtacctgttgactggtgttgataaccacaaggtggactgcttcaagaggtgtcctttgtgctttgtgatgatttctccaagagagttatacactgtttatattgagaacgtcaagcagtattctgttggagatcccatcgagtttgtacttttgactcgcaagaaagattcttttgctcctacccggaaaaatgagcatgacttggctgttcctaatggtgaaaatgagatatatgatccgttctcaaagttcactttcacccaagatgttgatctctctgtcagacaagcagtttcagagttagacagttggattgcaagagcagatcctcagctcgttgaagacttggagaagcatctttatgtaaatgccgctttagagcgtttggagcagagaaaattgtactggaatgagcataagctctctatttacagcaaagtgtgcacaacggctagaaatcagactcaatcattgtcacctcctgatgtttctcgagttggttatcaagcacccatggggggccatggagcgccagatagcggctccaatgatcaagataaatcaactgaagattcttcagcggataagtcagatggagaatctcaatcaagtttggaaaagggttgtgataatgatcttggtcatcctctagaagatcaagacgcaccgtcatcttcctcatgcaatggaagtaaaggtttcctgtctcaccaaattgacaccaaagacctgaaggacaacgacgcgtacaacttttatcaggtaatcagtttctgatgcatactgttgtgttttcataaagtactaatgagctgcatgatgattgttttattgctatgggctggtcaatctctataatctgaaataaatgttattatctgttttcgataatctaggtgggtttattaaataattgtggtggttctatccatatatgcttaatttgtcttacctttgtgctcttgttgtgtacctatacagtctgttgatggtcagcacattatccttcacactttgaatgtgaagtgccttctgcatcactatggaagctatgactttcttccaccaaggtaagattccaggtcgtttatgcatcacaattctcatttttcaaagactatggaataagttccaatgggatcttcttcgttatctaatcatttctgcatgtatttgggatgctgattcaaagtgtgatatatggcacttttcgttgattaatcaagaaccgttcgtataaagatccaactcttatttagtatgaaaatcagaacggacaatacattcaagtaaaaacggttcagtacaagatgttatcatctctagtttgttgttctaatagacttctgattttgatccattaaacggcagattgagtggaaagatactggaa

SEQ ID NO: 2929 - DNA, 3000 bp, Unknown; identical to SEQ ID NO: 2688
  misc_feature (1)..( 3000): cDNA_ID_3409127_gDNA_ID_1620617_Annot_ID_46915 3000 nt of promoter + ATG

SEQ ID NO: 2930 - DNA, 3000 bp, Unknown
  misc_feature (1)..( 3000): cDNA_ID_1819051_gDNA_ID_1620618_Annot_ID_46916 3000 nt of promoter + ATG
ttacaacaacctctacgaattcatatcatttatttccttgtctagattcatataccaccaataattagctaggaccatttgttatagtagctttttggatatcttgaccattttgttataatgtttttgtatatatatatataaatacataagaaaatattatacaaaacacttaattcagttcttttatgtataaggaccgtagtgttatatctctaatatttatataaatcgtagatgaacacggagtaacattttttgataaacatgtttaggagatatctgtactttgcaattaaattatgatgaatgatttattggtagtgactaaattatagaggtccccaatggaaaaaagaagcagcgaaccagtcacaccgtcgttgtaatctacaactaaaaaaatgcttgatttatttttccttatcaatatgttttcaaaatgaaaacgtgtacatataaaaaaaatggtcctaagagacatattaattttgattggtccacctggaaaaccggcaagggatggccatggccacgtgggatttgtggtccatgctgggatcaacgttcctcaatgtgccacgtgttttgatcatccagcgtgacagcctgtgttttcaacttttcatcaccaagcttcaaaatcttttttactctttttatttttatgcttaaaaataatttagaaattgatatggtcgaagagtaataataacttctcttgtcaaaagggagtaattatataatatgaaaatggatttttgtcaatacataaatttttattttctaaattaactgttttgtttttttcaacatgatttctctgttttctatttgattcaacggcgcatttttttaaaatgaaaattgtttgtagctcaatattaaagatattatcgtcaaaaattgttagacaaaaaaaaaaaaaacccagcccacaatcattatatgatatatggccactgataatacaactatctgtaactgatttaaacttaaaaattattctacaataagggttttgattcgtcggcccaaatttaccatatgggccttaagaagcctggttaaaatatatggccactggataatacaactatctttctttctttttttctttagtaatatatggcatcagtattagtgtcaatgatttatagatgtgaataaagtgaaatttttggaaagctaattgataactttgatgaccaatatataacaaataagtttgtctattgcagtactttaattcattgcttgcgtaagaagtgagtgggatcacaatttaaagaacgtcacttgattcaactactactaaaataaaacaatcagaaaaaaaaaatattaacagaggaaaataaaatatcctggagtagttgaatcatcttgctaagcacctaattttgataaaacttgcggtggcacagtaagtttgggcacctaaacaactaattgattggctaatcacaatatacacgttttttttttcacatgtggttttatattgaacccaccgaattctcttgatccttctaacaaaatttaatctcaaccacaaaaataaaataataatatatataagaaactgtaatgtacaattgtgattagcaatgggtcatctcatctaattatccagataatattgtctatatttttccaattaatttggtcgtatgtaactaaataatgcattaggttgagctaaataaagtattagataaccttacctactaacaattttcaatgatttttttcagtttctatatttctgctttgtatttttgtgtaaaattgggtttacagaccaggggatttcgaacagggtgatgtgttggacacaaaatttattccattcatgtgcgagttattattcattgaagtatattaaacttttgttttattttacttttttctattaattttaattaaaaatttgatgtgaaagaaaaaaacggtattttattgtgaatagtaaaagtcatgagcaaaatcatcaacttaggagtgttgaaaaaaggctaaagaagagtaaattagaggagagtcaaagattgtgtgtcactagtgttaatgctagtaaacatcagctcttttttttcttctctcttaatttttcaaacatttgatttctataaaccttcttaataatttcttccgtaaaataatatgattagtttttttttttgtaaacaagtgcccacttgcttgaccttcccaaccaaaaaaaacgtaacaatttccatcatcttctccataaagttcttacctttaagtgtgtttaatggagatttatcctctactcatctctctctctctattctgttccatttattaagctttcttcacgctttttaagataattaacagtcacgggttctaaaagctaaagggttttgcttcgaattcaagtgtctcccttcactttctctctctctattgctgctctgtttctgctgtcaattccctaagaaagtcctgatttttagggtgatcgagagaagttgaagaatcatgtttattgagtttccttttttgatccatagggtcatctaattttgctaattttattgtcatctccttcaggtaatttgcgatttctctttactctgtttttgacttgtacttagattccttttctttaacagtaataaacttcataaagatttcatttttcttcttatgggtatttggaatgatgaatgtagattaggttgattgttttgaggatgatgtggataatctttttctggatattattacaatttagggtcttgagattgtttgtaataagctccgtactttggtcccttattttcaattcagtctttaagatttcggtaacccttttatatttgatgcaatctccctataataataccttcttcaattgctgttttgccatttgcatattatttaactttctttgttggatcagtctgattctttcttaccaattattgtcttaatccttgattaagaaaaaacaaaaaaacaaaagac

SEQ ID NO: 2931 - DNA, 3000 bp, Unknown
  misc_feature (1)..( 3000): cDNA_ID_1819048_gDNA_ID_1620618_Annot_ID_46917 3000 nt of promoter + ATG
cttatgctggctctacattagtagacatcgcatcttcttcatcatctgctgtggtgtcagcatcgtccaagaaaggtgagaggtctgattttgagaagaaacttggtgagtttttcaagcatcaaatcgagtcggattcttcatcggcatatggggatgggttcaggcaaggtaaccaagcagttcttaagcatggtctgaggcgaaccctcgaccatattcgcttgaccggtacatttcctaaatggatttaaactataaaaagagagaaaacaagctttgttatagttttttagagtatagacttgagaagaaaagaaaaagaaaaatgtataggttacaacaatacacacatttaagtgtcataaagtttccactttttaagtaaaaaatcaagagtcaagaaacaagaccaaaaattcttggcttggtttttatctttttttgccaaacgttttgcttgttatttcttagatagcaaattattctgttttcaaaatctaaattactacaatcactagtttgacttcatcatatctggaccagtggataaaagtatgaaagataaggaaaatccgaaaatggatagacttgtatatccacaattccacattatatcataatatgtactgtatattatggctcttctattcgctgagaggacgaaggtcaaatatgtagaatgtagaagtatcctcatattgacctgtctaactagattaatattatagtatgcatgcttgccatctgttaattaaaatacagacattgtgaaaaaatacactccatgctctctatctttctatcgtttgtaaaatgatattttgttgatcaaaactactatggtctacaagatcgtgtaaaacaacattcaagtaacttagtattatgggaagatgagttctctcgatcgagatgttcagtcaattctctagagtataaaaaacgaaaacgtctcaagtcaattgtcaatcattaatttccaaatataaatattagacattatcaacaaatgatgataaagagatacaaaaaacattgtgaagatgtgggatatgaggataaacatagagagataggatgatatattcacacgtgtttcccacttcctcatccaacttgtcgcggcgcctcgtcgccggttctttcttctctctttggtttttttttctaaaacattttctctatcaagcgtttatgtttcaacaaattttatttaagctaatgttttttcttataaccaaatcaaaattttattcatcgatatagaaattaatggttttttgctaatattgaaatctaattttaaagtatatattaaaaagtttttgttaaaaaaaaatgaggatactcatgttggagagggagagcaaacggattcttgatgtttttacgatcgattaaagtgaagacgttttagtggacatgatatatttctttggtatgacatattttaaaagtcacctctaagaattcaattttttctagatattatcgtcattcgtcaacattatatcgtatgatgttaacaaaattaatggttggtagagtactcgtcatttagaattagggctaatgaattgatcgttcataatgtcttgtcgagggcaaaaacgacgtaacgtgacaaaacgtattaacctttgtttctttttcttttttttttgttatttcagaattcatgaaccagagaatttcattaatccactagctaatcttgaaattattctattgccttttgaaaaagttgtaaagtataatttgaaggttgcaaaattttaattttggtttttagtgtttgagaaacaaatcaaaactgcaacattatatacagaactatcttcccttttttttttaactaacttgaaatttatgcaaaacagttcaccaaggtgtcattaaaagatgtcattaaattcgaaagtcggttcatgaaagatgtcgtcatcatcgtaacatgatgccaccacgcagtcagcactaagcaggctatttggctttggcaccttcattcaaaaataaaataaattttaaattcctggttcagtaaaaatgtggaccgttgttttgggggcagccaatcgcacgaatatggtggctacgccacaaagttacaaatgtacaactttgtcgggcttttccagattcattaacatcaataggcaagtaaactacaaaatgcaagttgcttaatcaataatgttgtaaagcttttacagcatcttttataccataaaatgtcaacatcatggagtttactccaattaagttctcgtacactttgatttgaataatcagtacaaaacataaccaaaccggattagatgtggttttaactattgcatacatttccggccaatggattaggattactgaaagaacattaaaaacatatatgtatgacgacgaaaacaatttcttagggcttaggttatatatatttcgcagaaatgtataccaaaatgttggagaatcgtgaaaaagaatatacctaataaaccgtactaaaaaggctgaacatctgagattcagcagagcatcaaaagataaaagagaatatgctcattaatcataggtcgactgttttctccaccctccaactttaatttttgaaatctcttgtttttatgtgcccttgataattattaatcaccttaacattaacaacttgttaatgcctgttaatccaaaagtaaagcaatcaaagaactatattataagattaataatgtaatgattcgaaacattacaataaagtataacgtaacaagcttagatatggtgggtaaaatatacgaagtaaaataaatggtcccaagtatatgaatgaatacatgtatttacagatatctctctcccctatctccttatgatttgtcattttcctcacccataatcctataaaataatcaagaacctccgagggagagagacatacacacagacagagtaagacatatataacatatatagagagagaagacctaaacaaagagacat

SEQ ID NO: 2932 - DNA, 3000 bp, Unknown
  misc_feature (1)..( 3000): cDNA_ID_1819044_gDNA_ID_1620618_Annot_ID_46918 3000 nt of promoter + ATG
gttgaagccaattccgaaattagttttagttttaacttaaatgatttttagtttataaattaaacaagtataacatatgcttaatgattgtttcggcgggcttacataaatgattgatagaacatgttatgcgtgggagtagtcgttgtaagttcaccgtccaagtctccttttaattaattcacgagaaatcaactacgaccgtgtaaataaaatacttagtttggtaggtcaagaatcacttctggaaaatgagactaaagaaaagagtcacttgtggaaaatactatcaagtggacaaaaccaaattcctcatagtgaaaaagagatatattacactgttcctgccgcatttgtttggtacgtatctaatatttttgtttactcacgtggtactataacgcttattgccaatataacgattaggacaatttgatttctactaattttatttgatacgtatcaaatatcttctgtcttagctggtcatcaaattgtgtgaaatagtaatttaatactaactcgttactgattactgatgtagattcatcttcgtaacgatcgcccgatccatattccaatatttgcattttgttttacgtaatgcactctttctcatctgtagctccttgagtaaaacttaaaacttaaccatgaaggcatctgtaaattgacgcttgtctgaatttctcaacaccaaactctctttcgtgtctagaggttctttggttttcccacctgcttttcgattatggtaatggtcaacttgacgcgtaccaagttttctgatctttttgaagatatttcaaatatggtttgctatttcgattttcgacaataacagtaaaaccccattaagaccataaatcttaaaaattttcataaccgttttacaatattcatttatgtagccaaattaaatttgtcacgtaaatgtgacaattaatattggtccacatcattttgctttcatgacaagaccggccatttagtgacctactgtatgttctacaacaattattggaaaatggaaattaaatatcccaacaaaaaaaataagagcagaaacagagattcactttgcgaaaaagtcgcacgcacacatataaaagacaggactagaggaacagaggaagaagaagagtcactgtgatcaccaccaccgtacgatcaaattcaaactatgtcaacggctctgattaactctattacctacttcctctccgaacatccatacatcgtcggattccgttggagtaacagccaatcatggggctccacgtggtctttcctcttcacatcaatctccctctatatcgccgtctcatcctccctccacatcctcctctccgccgtacgccgaagtaaccgttccgttcctttaggtcacatccccgaaatccacagccttctcatgtcgatcctctccgccaccattttcgccggaatcctcctctccgctgccgcagagatccgtgacacacggtggttatggcggcggagcaaaaccgccactcctctccaatggcttctctgtttccctctcgggactcgtccctctggtcgtgtcttcttttggtcatacgtgttttacctcacgcgctttctccacatgttccgtacgattttcgccgttttacgtagccggaggctcgccgtgtctcagctcttttgtaactccgtcatggccttcacgtctttcctctggctagaattctcgcagtcgtaccagattctagcgattctatcgacgactctggtttactcggtggtttacggttatagattctggaccgggtttggtttacccggttcggctttcccttcgtttgtggtgaattgtcagttggttctcgtgggctgtaatctcgtgtctcacgctggggttcttacgatgcacctctttaaaggtggatgcaatgggattggcgcgtggggtttaaactcggttctcaacggtgcgattttgttgctttttcttaacttttatgtgagaatgcattcgccaatgcgacgccatattaataaaatgaatagccaacgtaacgcttaagaattaattgatcctttttactagtttttactttttactcaataaaacaaatctaatcttcttttttgtctttcacttttaaaactgaagtataatctaatttgttttctaataactaaaatgttctgcgtctaggtctgtacatcttctcaaaccgggacaattttttttttataaaccatcgatctctgactttgcatgagatattttacatttgaactattggctcttagttaacgcaatctagttcttgtttttcattcttttaaatctagttttgtgttttttaagtggaaagaaattatgtcgattatttataaatatatctttaaaaatatttatttatttcataagaggtttttgatccaaagactcaaacttggggtaactttatgacgtagatataccacaatacccaccaaaatgtggtgatagaggaaacaaaggtttacatggtggatcatggacgaggatgatcaaaagcttatactctttaccaagtgaaaatgcattttggataagaggaaaaattattaaaagcgagaaaacataatatggtttgagactgatgtgttagattgtaagagctgcaattgtatctctctacttggggacacacttttgattttctatttaccgtttgaatgccgtataaggaaatgtacaggtcaaacgaatatggtcgagtgttcgccttagaccattgtataaggaaatgaactatgtcgactatatttaatatttgggcctagtataatattactacacttaatcaaagttaaggcatttataactgtagaacaagatgggcctaaggccacggttttctacttaactaggcacacatatgacatatcccatagtaaaaaagcttacataataaggcccacatctgaaatctgattctccactgtaaaaataaaatcctcttaagctctcgatcgatg

SEQ ID NO: 2933 - DNA, 3000 bp, Unknown
  misc_feature (1)..( 3000): cDNA_ID_1807583_gDNA_ID_1620618_Annot_ID_46924 3000 nt of promoter + ATG
acaacacctcctcctataccaccgattgtaccaatgaggttcaacattccgaaaccagctcctctcgcaccatccttataactatctgcaataaacgattgaagcgcgggtataacaattgccaatccaaaaccattcactgctctccataaagcaacctatatcacaagaccattcaaaaacttataacttcaaaatcaaagtccttaaagaaacagatcaaaaagtacctgaatgaagtagctgctggctccaactgcagcagttgataaagcccaacagaaagtacctattgcaagaacaatgggacgatcataggtaatgacaagaactcctgctaatggtgatgcaagtccttgaacaaagtttctaacgaatgttaagtagcctaaatctgatggtcctgcgttaaatgcttcactcacttctttataaaccgaaggcaatagattctcgtctgcacgttccatgatcgcagctaagtttataagaatcaatgatatcgaaacccccaaaaacgttcctgttctgttcaaaaacagaataaacaaaagaaagttttgagttttgtaagattcagaaccagagacaatgaaacggttaaccatttttttatgattactactaaattcaaagataaagtaatcgattaaacagatccacgagccaatcttagaaccctaaaaagtttgaacagattctgattcgaatcaaataaaacccaaaaggagaaaagtcaaaaaggagctaactttatcttcatgctgttagtacggtgatggcgagggaacagagacctgaagaatttaaaagcgacggagatgataccggtacgagttcgagcatgacccatcaaaatccaaaacttgaactcccgagtaaccggagccggagtttggttgctttctataaatatcggatctaaagttccgacacgaatagttttctcgtacgatttaacaaccgccgaatttaatattaattacagtaacatgttggatattctttttgttactgacgtcatatttctttggatgattctttctggataagtcatgaagtggccattaagccatttaattatgtagattaacgtatttattggatttaaaaagatcattaagcacgtaacgtagcttgtttggtggatcgttacatggtaagtgtcgggaacgtgattacatttatctttattcatttttgggatgtgaatggattggtaacgtataatttaagttatatgttaatcttggtaattttcaatttagagctgaaaattattgttagaaataacattattagaaaagtcttcttctttagctcctccatgttaccaggaggaaaatatcagaaatattgctgagtctgaaattaagggcccatgggcctcggacacatatactagacaaatcatgtttcattcaatttaataacgaagtgcccaaattcgttaatattaatgccgagatcttcggctgtctgacaattttcataatgtctacatgcagaatgagctagtgatacaataatattgtgattataagaaatatgtaatgtaatgtagcaaacaaatcgaaacgtttacaaaagcacatataatttttctttttaaaacgcaatactaaccaatattgaccgatgcattgaacaatagtgagaatagttggattatgacttaaatggacgccgcacgattaattagaataatcaacaaattaaattaaaagtaagtactaagtaagattaaatgtacgtgaccacgccgtacaaattgaaaatttatgttaaagattcccccacgtgaatgatctgatccaaagtcactctgacagattggattttttttggcgtcaccgattttatttttcattttaaactttagtagtttttggatttgtgactataaatgagaagacgtggtttaataaaataaaataataaacacaattattaggaacttttttttgtttcatttgattgtctgcaataataacaaatgacattttatgaaattacttttattaatttaaggttgtgaaaatttaacaaatatgtaaataggatttgttaaagtactatattaattagttggctaaaaaaataataatggcatgagtccagctgggtgattctgcttcctggctttgctcacgcctaactggaaccgcacgtgctccgaccacaatagccaaattgctgtttgttatcttatttccatcctttttaatattactaaaaaatgttttagctagcttccctaattatgtggatacatttttttaattcacatcaatgaatttgggaaaatcaaataaacatgtaatttttggaataatttgttcgtcattttctaaaatccaatatgaccgttttaaaactctttagatgctatactaggttaaaaattatgttaggaaaatgagatcagtttcgaattacgttttgacaactccaagaaataacatcaaatttggtgtaaagcttttgtgagttgtattaatgcgttacaatatgaaaatgtgcaatatgtcgtcataaaaaacaatgcaaaatcgttagtatatccagtttttatactgattcttaattcttacaacgctttttgtttttgtttttaagatacaaatttaaattaaagaaaatacgaaaaaaaagaagaaggaaagatccgaattcattgaacagtggacgggagggaaacaacggggaagggaccacagctcgtgcgttacataaataggacacgtggaagctgacttccagaaataaatcgatcacacgtgtagaaacagaccacacgtgtggagacaaatgaatatttgaatttatttatacttaatgaatgaaagttacagccaatccgcttcagactcacacacacacccaaaacaaaaaaaaaaacaaaaaaactaaaaagaaagcttcgtctctctctctctatccctcgtgcgccagtctgacaaagacttagagatagattcagagattcagagctcttca

SEQ ID NO: 2934 - DNA, 3000 bp, Unknown
  misc_feature (1)..( 3000): cDNA_ID_3438222_gDNA_ID_1620618_Annot_ID_162123 3000 nt of promoter + ATG
ctaccttcctctctgctgctttaactgcagatgtacttatcatttattttcttactttaccatttaaataatatatcaaaacactgtagtttgcttagcattgttaaacaagactactcacttggtacttggtcgtggaatattatacggtatgcaatgaatttgcataataatctagattcggagcagtatcattaattaattttgttaggttaaaacgttttgttattaaaaatcgcttagaactgaacaaaaaccaacacatatttagaatattcattgcaacatctttgtagacaaactaaaggagcaaattcacatgtaaatctaaagaacaaaagaataaagcatagattaatcatacacacataataagaccgggaccaaattttcctcttttgccaagttcccaaattctctataaatacttcttgtctccatttcacaacagcaacgtggactctttctttgttttggctgactcttctttcaccgtttccttagagaacttattcatctcataaacaccacacacaacacacacttctctttctccttctctctatatattttaatatcaactttctagggtttccaagttcatatatagtgatgggtttctcaatgttcttctcccccgaaaacgacgtcagccatcattcctctccatatgcttctgttgactgcactctctcacttggaactccctccactcgcctctgcaacgaggatgatgaacgtagattctcgtctcatacctccgacaccataggctgggacttcttgaacggttccaagaaaggcggtggaggcggcggacataacctcctcgctcgccgttgcgccaactgcgacaccacttctactcctctttggagaaacggtccaagaggtcccaaggtatttaatatgtaacctttacatcaaatattttatcatttcttgatgtgggactaatatttctctctgtacaacaaaacaaatattgataataactttatatgatttttaatttggtcagtcgttgtgtaatgcgtgtggaatccgattcaagaaagaagagagacgtgcatcgaccgccagaaactcgacctccggcggaggatcaactgcagctggagttccaactttggatcatcaagcaagtgcaaattattattataacaataataaccaatatgcttcatcgtcgccttggcaccatcagcataatacgcagagagttccatattactcgccggccaataacgaatactcatacgttgatgatgtcagagttgttgatcatgacgtcacaaccgacccgttcttgtcttggaggcttaacgtcgccgaccggaccggccttgtccacgattttacgatgtgatgagtgatcatttcatagatattccccttataagtcttagccttggataccttttaacaaaaaagaaaagtcttagccttcgttaaattctttattttactttcctttaaatataaatatttaatgtctttttttggtctctgtgtaagtgtttttcttaaatttataattcgtatgatggatgctacttgtgttttccttgcatgacttttaaaatgttctctcgggtaatgaactaataattcgtgactttataacctttacatgatgtgtgtcctactttgaccacgattcagtgatatactatacatatacagaatacatattcattcctttaatttctttttaaagcatctttgggtttttgtacggagaatgtgaatattttgggatgcagatactatcttcacaaatacttatatcttaaacgtttaatttgtgagtttcttttccaaattgaaataatcaaatacttggaccgaatttgaaaattaagccaacaaatatctgcagggtggccaagctgaatgtttgtcgtgttttgcccaaattgtcttggaaatttgaccatcaattaggtcttcgtgtgctgctctgcttaaaactgttgctgccaactgcatgtgaagaatatttatctttttcataacgtgtttagttattgtattaaaaaaacgttagtttttatttgattgtttccggaaacacaatccaagataataaagtgttttgaaactctataacaacagaaagcgagagtaacaatttttttttgagtcatttatgagagtcaagacgaaaaaagagtcactaaactactaaatttgtcttccaattagaataataatgaaatgtttttctattttttcacgaataaaattaaatgtcttcagaatttctactttccactttcaaccgctcctgaccgggaatgagcatataagttgcgattttatttgggcctaagcccattcgatataaattccattcaaagtcaaatgaaattccaaattgaaacgattttttaaaaattggaatatagaccaccgccagattctatacctataaaactctattttaccaagacctacatatacatcatacaaatatacattacttatccgctacgcaagaagaaactgtaacatacggatttaagtaggatgtttaggtcatccaccgggtatctccccaactgtaattagatccaacaaacgctatcttgtcatcattcattgaaaagctaattaagtcattttctcaaaatcatgcataatgacaaacaaacaaaaaaaattaccaaagcaactatcaaatggtggtaatctagtgatttcggtctatttaatatcataaatggaattttgaagggatttgactgtactatgacacttttagtttctagaattgttgtgttcttgtactggttaagaggctaattaaaaaaaaaacagaaaagcatagattaacaacccaacacctaacattttaacaaattccaaatccaagtgccaattctccaagttacatttgaaaagatcgaatggaaaaaatgtttatataatgttgcatcccatttgggcttctcttcaaacatctctcaacaacaacaacaaaacaaaacttgcaca

SEQ ID NO: 2935 - DNA, 3000 bp, Unknown
  misc_feature (1)..( 3000): cDNA_ID_1818992_gDNA_ID_1620618_Annot_ID_162119 3000 nt of promoter + ATG
ctagagtagctagctcctggagaagtaatacgagtatcgaaggtctctgatttttgatatgatggcgtttggactcgattcgagcctgcagtttcgattgatatatactctgttgttgtatcatttcgtacagtagttttttttagacttttgcattctgatgggatctttcaaatttaataagtcagtttcagtttatgcattgatcattgtttgatatcatacaactctgtggtgttactacttcaaattagttctatttgatgattttatatataaatttcaagtttgatttatatctaatttggttttattaaactcttgcaaccgtgggctttccgtcttcaggatgcttcaagtggggtggaatattggagcgaccatattagaaatgattctcggtagcccatggagttgatccaaataggcaaggtttgtgctaatagatctgtaagctcaaaatggtagagctctcattatgagaggttggtggttcgaatccatccagatctgtcgactttctatcctcttttacctttatcatgtcattgtataacacaatatttcaaatctatgtgtgttgaatatgatctgccgatgttattgctaaaaccagggcagccgtaaaagggcctctgtaaaatttagcatctgccacggaggaaggtggaattgatcatttttaaagcaacggcgtctaaacatggactgacatcctaagtcctaactagttgtgttatttggactacaagcaataagcaaggagcataattcacttaacagtaataaaaaaacatactaatgaaagatgactgcaaaactctgttaatcattgttgggttatgatatttatcaaggctaactcattcaccatctctatgtattcgtcatttcttagttgataaagaatatttttataatataaaaaaaaagttaaggtaattaatttcatattttttaaaggaactttaaaaattcatgtactttcttaaacaaacaatgtcatattgaatatatggtttaaatatgttatatatagaggtggacaatccggtttacttggtttggtttttaggttttagaaagagtgaaaaccagtgttacattttcgttttgctataatgctagtttttttttttttttttttttttttaaaacctagtattaataatttctaataataatttgtgtgatacagactattcaatattataaatacctttcattcatatagataacattatgcatataaagttttgttaaattccagttgattgaggtcggcaacatttgaatactaatattttttatgtggtaacaagtaacaacaacaatttaacaacaactgataagatgttctttcgattatatgaagaaaacgtcgactccaaatacagagaaactatcaatataaaataacattattctcagtgtatacctatttgatagaagaccaatatatatcttggtagaagagatgatatgaaagtatcagattaagaaaagatttggtgtcggattaacgtcacatggtgttattttaaattgtatgccatttaataatcgtccattgtcaatgctgttaatataatacaaaaccaaatatatgttaactaacatagtccaggaaccgtttaatttgattaaaccaaatcatacgcacatgattgcgatgataaaccgaatctttaatattataaaaatcaatagatcgagtaaaacgttacattttaattattattattagctgatgctgtcctttatggacttttcttcttcgtttttttgttcttctacctaaaaccatgaaagagtggtttgcacataaatacataatgaatatagtatgaaaaaactgttacatttttttaattattttgaagctaattagtgaactcaataagttttctaatcataatttacctgttctctatcgtgacacaataaacaaagacagataagagttagttaaacgtgaaagaaggttagaattttggaaaatgaccaaatttgttattacttcaccaaattcggatcttgtcctcttgtcataaaatcatttcagatctgagttatttggtccaacgccaatactgaaaattaatgttattaaagtaaatcatatttattattttcaaccaatggggcctttcacaataacaaacaaagggccagctttaaagttttattgaaattttacatgccacataaattggttaaaatacattttcttcacgtttctcgctttttaagtccctttgaagtgggaatgatactcgcgtgacgaccaaactccatcgagcctctctctctctctctgtgatcagtttaatctactgaaagaaagaaagaaagaaagaaagatccgtattattaggtaagaatgagattcccttttacgtttcgattttgattcgtttgtgtttgattctcgatcgttttgcttcgatttagcttccttctgtttttacaagtctctcttgattagaaatgtttaggtttcaatgtttcatgatcatatttagaaaaaagtttcatggtgaccaaaaaagaaagaaaattttgatggctgagagatgtcagagtcttgttttgtttttttgataaattctctgtttgtgtgcttttaaaaagtcaaatataagaaattctttgaatcatttaaagccgtatttatgtccttttgacaagtcgatttaatgctttctagaagagagtttatcagatgttaagaagattcaaagttggattataacgaaaatttgtatacctcattagagatttttcaagtggtaaatactaatagaattcatgatcccgttttagatgtaagatttggttgtgtttatcagttttctattaatagccgatattattaaaaccttttgcttaatcttggatctgatttaatttgctttaaattggacttgaaagaaatctgaatttgatttgatcgtttctaggcttcgaagctgtctcaagattgttgtttaattaaac

SEQ ID NO: 2936 - DNA, 3000 bp, Unknown
  misc_feature (1)..( 3000): cDNA_ID_1818996_gDNA_ID_1620618_Annot_ID_162117 3000 nt of promoter + ATG
ggcaaggagatattggaattggtatctaattcccctgaagaagcagaactccgctttcaagacatcaaagctgctgcgggaatcgacccgaaatgcgtagacgatgttgtgaaaatggagggtaagaagactcatggtgaaggagtgtggaaagagctcattctaagaccaactcctgcagtgagacgtgttcttttaactgctcttgggattcatttcttccaacacgcctccggaatcgaagcagtgcttttatacggtccgaggatctttaagaaagcaggaatcacgactaaagacaagcttttcttggttactatcggtgtcggaatcatgaaaacgacgtttattttcactgcgactttattgttagacaaggtaggtcgaaggaagcttttgttgaccagcgttggaggaatggtcattgcgttgacaatgttgggatttgggcttacaatggcccaaaatgctggcgggaaattagcgtgggctttagtactgagcatagttgcggcttatagtttcgtggcgtttttctctattgggctcggcccaataacttgggtctacagttctgaggttttcccgttgaagcttagggcacaaggagcgagtctcggcgttgcggtgaacagagtaatgaacgccaccgtgtcgatgtcgtttttgtcgttgactagtgcgataaccaccggtggagctttctttatgttcgccggagttgcggcagtggcgtggaatttcttcttcttcctcttgccggagacgaaaggaaaatcacttgaagaaatcgaagcgctttttcaaagagacggtgataaagtacgcggcgaaaacggtgcagcttagcatgatgaatataatgttatcattaaatgaaacgacagcgtttggggtttctcactcattacacgacgtcgtttagttgtacttttgtgtggcttttatcaaattataaatcaacggtcaagattgacgcacgctttagtatttttttcattaacaatttaagatcaacggctaatacatcgccaattactagctaataatggcccagtagtgtgaactgtgaagagagtgaactgatttttttttttttaaagttctctctcagatttaacaaaatcgagccgacactttcccaattgaactgaatctactgaaatcgattcacgagagctcagatttggtgttagcatcactcactaagcaagattattgagttgtaattagtatttgagatcaagatgaaggaggacgatgcattgccgacgacgacgacgactggtacggcgacgggaacagctatggcgaattcgaagaaggaaagctctgactcggtcttgtttggaagaggtcgatataagttctgggcgtttgctgcgattttgcttttggctttttggtcgatgtttactggcaccgtcactctccggttatctaccgggaatctgaaccggttatcggaagatctagggattccgaactacgataatctcgacgttctggttgtttactctctctgtttctatttcggttgatttggtgtgtaatttgattgtagtctggtttttgaggttttggaatttgtggtattttttaggaaatggaggagagagagaaagtggtgaagcatatgtgggatgtgtatactaatagtcgtcggatcaaattgcctagattttggcaagaggcttttgttgctgcttatgaagaactcactagtgatgtgcctggggttagagaagctgctattggtgaaatcgccaagatgtcggcgcggtcgatcactcttgatccacctccttctagatcaaggtgatgattcttgctttaaatttcgatttgttttcactatattagtcacttagaatcagtaggtagaggtatagatagatggtagtcgatcttgcctctgtgctggagtaaatagtaatgttcaatctggtatctggagtttagatcttgagtgtacctagcttaggttgttcagtttgatggtcaagttcttctgtgtctggagatatgccattaagatttagtgttactctttaagttattacctgttaaagttagtttgtgtatactctatctttgtttgtgattggtgaccagctatatggatccatgcttgatatccaaacatataaagacctgtatgaactttcgatacacatagtaccttataatggtcaaggtctaatttttctggagactgggtatgtagatctagtgtaagatactggtatgcataatagcatgtggttgagtagattatgtcttcttaaaattatgttatgagatttcagataggtatagctttcggttttgtttcttgcatttaatgctaaacctcttttgtgaaagttggttgatcaagtttggtagagcttccatcacccaccttagcttcttgatcaggattcatcttttaatttcttctcttaaattgttcatagacttaacctgagtgttaaactcttttttcttttctttatcggtttgttctcagagtgcaagggatttgggaagaaacttgaagagaattctacacaagccagcagctagtagctgataatgatattggtaacatatgtctactacttgctgaagccaaaagatgaactaccaaatggatagatttcattttgggactaaaattcaattttcgaaatcaaattgctctttttacattctatcgttggtaattatatagagctacttttataaatatatgtagaagcaaatggaaccttatgactttacacgaaaaagcaatggatcccttatgatatatttcttcttctgatatcttcaaaacttgggactcttgaatctgtgttgttattggcaaccttttgccactgtagattaccaaattaagatttgttgactaaactaaaatacgcggtttgtttactcttgtagtataaaaaagctttaccacactcgcacgtgagagtgaaaaaaaaaaaaacacaaacgtaaagaaacacaaaa

SEQ ID NO: 2937 - DNA, 3000 bp, Unknown
  misc_feature (1)..( 3000): cDNA_ID_1819004_gDNA_ID_1620618_Annot_ID_162115 3000 nt of promoter + ATG
cttaatagctcaagagcatttcgattgaacatcttattttgttgcttgaagacttgttgaaaactatgatctagtatgcaggtttatttataagctgctcctgcatttttctttcctcataaattagcttgtaaaagcttgacggtttgttgttggaatctctagaattccatagtcaacaattttcaggttcatatagttcactgctttgttctacacacttgtgcttcatgatgaattcaagtttctttcagttttatgttgtttttacatatccttctacttgcaactaaagggtcaagctggttctgttggtatagctaaactctgtttcttggtacgaagatggtttcgcgtatagtggaatcttgatctcgttggaactcaatttgacttggcttcccctaattttgacttgcacgaaagataagagtgacaaattttcaacaatgattttgataggtttctgatcaggtaagtatttgagttgcaacatctttcagagaatttgcaaatcctaaggttgcaaaatgttaatcatcttgcgtagttgtttgcttattttgtatcaatagctctaaatttaattaaaaagattccaaagttcaaacgaaaattacgggaatcacataagtaatactatactatatagtctacattatatgtaatgtttttaattttctgtaacactgatgtctctataatattttaatacaaattgtggaacatttttgttgaaaagtatgctttcttcatactagtaagtcaaatataaacttttgacgaaataatccaataacatcacctactcgtccggaaacagaacagtacaaagttggtgaataaaatctatggatattttatatagtgagctttttgagaaacgtgatctactttgatgtactaaagttaacttttaacaatgaaaacaaaaattgaaaaattaacaacgttaaatcagaaacgtaaataaactgaatcatcatttcaacagttgattccacaagctattaaaattttaaatattagaaagtattttaaagatgcttgaaacttagcagacagtttggtttaaaagagtaaaagtggtaatgagctgatgttggcggctaaatctctaaaatcagtaaagcatatcgcgaaccaaaagccaaagcaccaaatgaaactgagttaggttcgttgtacacacgatgttttccaataaataatcctccacaaaattcaaacaccggatgtatctcgaaaacattagatgttctatatacaaacatatagaatcatggtattgagttcgtgattttttttttgtaacatgatgtaattagtaattcatcctaatatatgtaatcatctttatattttgataatacattcgtgattcgttcgatgacattaccacacgaggttacgactgcgcacatatggtgtattatgagtccaccatacgataaattattaaaagtgtggtagagagacttttcttatggttgataaattattattttcaatatcgtcaaaattacttattcattttctctttatttggaccaatttagatttagactcgattagtttttctatagatgtaggttcttcctctcaagatgtagcgataggttttagggttaaactttgtcgtggatataggaagaaactgcatgtagtttttgatgggttacacttttagttacaacacgaaagtttatcggaaatactagttggctcatggctgccttacgttagacaattaattacaaacatctctttttttctttgtcaataattgtttcttattgtaggcatactattggagaaacatgaggtacgaacttcccaaatcagttttttttttttgggaaaaagttgaaattatgcaaaacactgaaaaaggaaagaacaagtaattaaaatgcaaaaaaaaatttttaattaaaatgcatgaacatataaacaaataacatgttataggttcaaatctcatccactgatccacaaaccgtaatcaccatcaaaatattcatgcaagtcaacttgaggatatttacatactataattaagaaaataccacaaatttccaaatcaagtttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaatc

SEQ ID NO: 2938 - DNA, 3000 bp, Unknown
  misc_feature (1)..( 3000): cDNA_ID_3070548_gDNA_ID_1620618_Annot_ID_162113 3000 nt of promoter + ATG
tgttcataccttcacaacgtcatcatcaacagttatgatcacttatcagccagatttttcaaactcgagctttgtattttagcggcaatttgtttttggtaacaaaggaacccatgcacttgtcagcgtaaagcaaacacgtgtccaaaccattaagccacgtggtcattgtccgactctacaacctctctctgtttcttctctcattcctttatatgatactacgatttaatacgctttgcattgaataacaaaaaaaaaaacagagcacaatgactagatttgcggtattgccactctctgttcttcttctcgttctcttgttcctctgcactgagtcgttggctaagtcggaggagtctgaagaatacgacgtcgctgtgccttcatgttgcgggttttcgtctcctcttctgattaagaaagatcaatggaaaccaatcttcgagacgaagtttggacagatctcaaccgttcaaatcggcaatggatgcggtggaatgggaccttacaagatacattccataacgttggagccaaacacaattttgctccctcttcttcttcattccgacatggtcttcttcgttgactctggtacataataaactgtttaaatttcttcggtttggtttacagatcagtttcggtttaggtcaaaattggattgtgatttgtataggaagtgggattctgaattgggttgacgaggaagcgaagagtaccgagatcagactaggagacgtttacaggctacgtcccggttcggttttctacttacagagcaaaccggtggatatcttccttggaaccaaacttaagctttacgcaatcttctccaacaacgatgagtgtttacatgtataagtttgatatgattctttcttttttcactttcttgacatctttttcttcttcttattgtatctgtattccatggatgcaggatccttgctttggtgcctattcgagtatcacagatctaatgtttggttttgatgagacaattctccagtcagcttttggggtatgtcttaatctgccgatgaataagttacgaattgtctatatcttacttgggaagcaagataggaattgtgtatatcttacttcccaacttactctagtagaggatattttgggttgtattaagtgatatattaaattcaatggttttaattaggttcctgaggggattatagagctgatgaggaaccgtacgaagccaccattgatcgtgagtgagacgctttgcacaccaggtgtggccaacacttggcagctccaaccgcgattactaaagctctttgctggaagtgcagacttggtggataacaagaagaagaaagagaagaaagagaagaaggagaaggtgaagaaagcgaagacattcaatgttttcgaatctgaaccggatttcgagagcccctacggtcgtactataacgattaacaggaaggatctgaaagttttaaaaggctcaatggttggagtttccatggtgaatctcactcaaggatcgatgatgggaccgcactggaatccatgggcttgcgagatttcgattgtattgaaaggagcaggaatggttagggttcttaggtcttcgatatcatcaaacacatcatcagagtgtaagaacgtgaggtttaaagtagaggaaggagatattttcgcagttccacggttacatccaatggctcaaatgtctttcaacaatgactcgttagtgttcgttgggtttactacttcagctaagaataacgagccgcagttcttagccggggaggactcggctttgcggatgcttgaccggcaagtattggctgcatcgcttaatgtgagtagtgtgacgattgatggattgttgggagctcagaaggaagctgttatcttggaatgtcattcttgtgcggaaggagagatagagaagcttaaggtggagatagagaggaagaaaatagatgatgagaggaagaggagacatgatgaaaggaagaaagaagaagaagaggcgaagagagaagaggaagagaggaggaaacgtgaagaagaagaagagaagaagcggtggccacctcaacaaccaccacaagaagaagaacttagggaacggcaactaccgatggagaaagaatgggaaatggaaggtgaagaggagagttaagccggaggagtaaaagagaaggccaacgtacgtcaagagtgtgtttggtttgttgttagtggttagaactttggttctgacctctcttgtaactttttttttccatagtcttgtttatttgttaatgtacttttgcattgtttttgttgttgccatgtttaaagttgtattgtgtttgtataatgttttgttttgtttaaatctttgtagatggtaaatgagaaataagtaaatatttccgagagactgttgagtgacgacgttacttcttgttattgataactctgtggtttattatacacttgtagtagtagtcgtacttgctaacttatgtcatttggtttacaattgtataatgtatttgtaaccctcttgctatagcttcggcatattaaagttttgaatggtgataacggaggagtcgtagataatgcaatcaacttcccatgctctgttctcttgttgttgcaagagatattggaataaaaggcaaatttatctcaaacacagattgggccatatcttgaaaaggcaaattcataaaactctcaaaaagtagatttatcccaaacacgaattgggccaactattggaccggatgcgctgaataatgggccttatcagatttggaccggcctgtttttatatgacatttacaaaaataccctcacaggaggtcccgtgttggctataaaaaaatagaataatccgtaattgccctaaaatagtttggtttctgcatccacccctttcttcgaatctcgacggctgaaacagattctaaatttatctccggtgagaaagagatagagagcgttgattccggcgaaaag

SEQ ID NO: 2939 - DNA, 3000 bp, Unknown
  misc_feature (1)..( 3000): cDNA_ID_1807560_gDNA_ID_1620618_Annot_ID_162108 3000 nt of promoter + ATG
actataaagtcggagatgatggcgatgactatgatcacttgttttatccggtgccggaaaatagttacatcgatgaagcggaatggatgagtctatacatataaattactagcttaatgtaatattatatcaagttagtatcgtgaattagggaagcatatttctaagtaaatttactagattatataactgttgcatttctaatgtacaaatatattgacgatgagtttctcgctaatgtaatttggctatctttatgaaagcaacaatataaaattgcttaagtagttaaaaaaaattagctactttgttgaattaaatttctaagaaaaatatatatgaattcgttaggatttaattataataagtaaactgtaatttggtttcactaacgaaaaaaaaagtgcggccataaaagcagtatcggctgcaagattcgaaaaacctttacttttaaaattgtagaagacaaaggactagatgacatgcacatgaagataagatgagcaaatttgttaaaactttttatctccatggataagagtttgcccgatttatacaaaagagaagttcggataaaatataactaattctggtaaaacattttgagtcaacttttatagatcggttgacaactaatgtgtaagcttatattatggtttatacataatatattcatcacgtaatcattattacttattagtgatctgatcgcataatataaaatgagagtattagtcatcaaaagttaccacgtatcatgcgtttctcaaaatgttagaaaaaacacatcgttttctaatcaacggaaaaatcaaagtgtctttggacaagatcagatgttcttttgattaaaacctcttccagtaattgtaaactgtacaagtgcattttctgaaaatcaaagttttcttggacatgactagagattctttgattagagtcttctggattttgattgacgttaagatatttttgatttagacatatactaaatcctaattaattaaaattatagatcgaaaacattatggtctcgtaaagtttagaaactatggacccacgaagaagtgtttggcgaataagcgaaggatttaatttagttttgggtatatagaaaacgaagtgtaaagaaaacgtaacgttatggctctttctaaattgggtttgttttaagtactcgtaaccactttcaacacattcactgtatatagtgtgttgtattatattgtttgagtcgtcatatgatgagattgtatatatataaagaaaagtcttggaccttttgatatggtgatccatcacatcaactacgtaatggtaatactaatgctctacgatagatgctatatttacctaagaaaaccgattttttaagaatgcactgaattttgctatcaatcagttaactattgataagtcatatttagatttttattttgtttcatttgtaaacagaaaatcacaagacgttggagacatcttggcttgctcctggcacctataaaaaaatgtatgtttgcaataatattagggacttattaaagtaggcccaatgggcttaagattccaccaaattagcttgacaaacactaagggcctgtctcggatattagttgtttttaattagcaattgaataaactgatgcacgttgactctctttttttcgtcgtcatgtttgatttttttttttttttgtcgtcatgtttgattagttcttaaatcttaacgataagttaaattatcgatttaatatcaacaactgtagcaaattttaatattctacgttaaaaaacttactactattttttttttttttttcagtaaaatgacacaaacatgcaaacctagaaaatagctttgacttggttagtttcttgttaaagaaaaagattacaaacaattaacataatatattatgcactacaacgggaaacaaaattaagaaaaaagactctttatctacaaaaaaaaatcatataaatgtaaaaagggttttatcattgacaatttgacagttatcaatttacatcaaaatatattttaaatgtttttaatattcatgtacttaattagatcgctaataatgataataaattgaatatcctttttgattgtaataaatgagtagatgagtcacaccaactgtagctaccgtgtcaaaaccttatccagtaacacgtgtacagctggacctctcattgtcgcacgtgtcagatcatcaaaccctaaaattaaaatcccaaagaaaaaaaaaactttcctctttcttcgcattcttctcctcctatcggactttgccacaccagatcggaaaatcccaatcctcttttcctttgttttttttgctatcttcaatcaaaaactctccgacagattcaatgaagcagcaaaagagataaaaccctaacaaaagtaaacaatcggagttttaatcttcttcttcttcggagccggagttttgtctgatctgtcggagaggacgtgtcggcatctattaaaatcctagctggacttccacatcactttactcaattagaagctggtctgttttctctgtttttattctaactttttctctcgtttaatttctcatatgcaaacaaacacctttgcatgtaactgattctgttgtacttgaattgaattctttaatcaattatgcaaacagagcttgttttggagatgatgattcacaagtatgagattgtctttctgcttaagaattcgttgagtgttggtttctgaagtttgaattgtgtgtgtgtgtgtgatttaaaatactgatgcatggttcgaagcttagagattttagattgctataaatgaaagcaaaagaacagtgcccttactcttgttctgttttaaagtcattgattgttataattgaaagcaaaagattttagttttgatgttttatgattactatttatcgttaagatttttgatttttgtttatagttttgagtaacacaagtaagtagtaagcttataaaaca

SEQ ID NO: 2940 - DNA, 3000 bp, Unknown
  misc_feature (1)..( 3000): cDNA_ID_1819024_gDNA_ID_1620618_Annot_ID_162107 3000 nt of promoter + ATG
ccaatcaaaaatataaaggaattatggctggtgacggcgacggttatgggagaacaaaaaatctaattggtctgaagaaatgagtcaggtttcatgaactgaagttgaggacacgtgtacgaatacaagaggtggtctacattattaactcgtaataagtcgccacgtggataaccccatgttcttccctggtcacttttccttctctttggcgtggctgtctttttcacctcctgtttttaataattttcacctccgggtaaaaagaaaacacaaaaaagagagagcagcatagatatatttgcaaatagtaattaactaattactatatctaaacagttgcaaatacataacattaatacaactgtcaaaattacttcaaccctaattctcatgatgtgtgttatccaaattaaaataccatcaatccttaataaattagcaatgactcatacataagttccaaaaatagggtattatcacatgccagactttttaggtggtactttcagtatcaatattttggttccaataaggacatgtggattttcttttacaaaattgtttttaaaacactttcttcaacagtacaaaaattgtatattgagaaggtaattggaggaaagagagagatagagatgtaagggtgggattggaagaacatggaaagtagtagagacatggcagtgtttttaaagcagacacaaacacttacgagaagaaagagggagacaaaaggctttggcttccattgtctacttctctatattcttatttaaaccaattttaaaatatttataaaacttatttaacattagaaacgtacgtttggttgtgttttattcgccacgtttcgttgttgtattcctttcatatgactcccatcgtgttcctttgtctcccctttttctctctttacatcatctcatagaaaacaacttttagaaataaaaaaacgtggcacattatattcaataacgaattcaaatccccaattcaacttatgagtacgaaccttgtagtcaccatccacatgattcctctagagaccgtaagattaatcgggttgaagagttaattgtaatttgttttcaatatatatagttgtatgatcaatcacccattctatcgttttattatatggatgcgtttgtgcagtttagaagcatcagtgattcacttttgtataacaatatgtatatatatatatatatagttttgaatttataggatctgattctactgtgaaactttcattgtagatttttgcttaattaatcatgattttgctagctttattctagatttgaatttattagtacacaattgatatatttttcataaaaagactgaccgatgaatgtgatattaagctcaagaaataaataaatgggtctatgggaaccaaaataagatgcacatagctaaaatatccctcacaaaatgataatagcaatattccataaattgaaaaatctagctagatgataactaatccgtaactcttaactccaaaattatacaccgtttatctaataaaagttaaaaagataagcctttaaaagcagacattatccttaagacaaataaacaagtatcttacccagtttaggggttcattggtccaatattttattaaagagtccacatctacaagcaagtatcatcatgaacatgaacttaaacccatttaaggataataactataactaatcaatgatttacttgggagttcgaaggtgtctgctacactccttccaagcctccacccacattaaagtttctatcctctttatctttttttatccccaagaatatcctctgtggcaacaagctactaatttagtcatttatttgctcattggctgcttgacaaaaaaaaaaaaaaaaaaaaaatttgctcattggctacccattttttcctctaatttgcacgttccgtaatagaatatactcattaagatatgcttttcttggatgttcataatgtccatcagtccatgtatatatatcattgaattgatcatttctcaaatccatatggattcttagaaaatataacctcttacaattactcatcaatttataacctatcacacaattctgtcgatattcaacctctacattaattagtatgcgagttaaaaaaaaaaaaaaaaaaaaaaattagtatgcgagtttaataacaagaaattaaaatttatgccttttttttatctaaagtatatatatatatttaatgtttttctatgatttttctttcggtagtaattaacgttatcaactgaaccttaagtctatgataaattctggcttatttttacggcactagctaattttctaacgaataaactaagaaaattaacaattgatctctaactacgaatttagagaagagtctaaaaagtaattaaggggcttgattgggtcgtggaggacattgagaccggtgaatgtcctctccattggacatcacattctcatttaccaaatagtctctgattattggtctcccctccccaattgtcatactactatatagttttctagactcgcaaatcttattaactacgatagattgatttatgtcattttattttggtaatgaaaaattcactttagtgtgttcacgtgccaaagctttcgacttttcatgttcctatcaatgacgtgttgaaagaatacgtctttgtttagtgttgttttgtattacgcatgaaacagtattaaagttggtgacaaagaaatattttcttctcttttaatttcactgtccttttaattaatattcctaagtactaaatcacgtccagtggtaattccgtaatttaaaataacaagaagcccacatcaggaaaatgacatttcataacccaaaaaaaaaaatcatttcttgacacctactctccttataaatcataggtcttcctcttccccaacaacacttctcacatttcataaaaagtgagacaaattaaagacagagagagatccaagaac

SEQ ID NO: 2941 - DNA, 3000 bp, Unknown
  misc_feature (1)..( 3000): cDNA_ID_1819028_gDNA_ID_1620618_Annot_ID_162104 3000 nt of promoter + ATG
cattatgattgataattttcatgcaactccttttctctagatcgtaggtaggaggatattaggttaatttgactacgctagagatttaaattagtacgctttcgaacaagtcaaaagacaccatcgggttagccactaagaaagcaatcatcatatacatcaattaattataatactacttatatacctgtactatatacactcatgcataaaaagtaaaaacgattctctctttatcaaatttagattctggatcgttaaaaagtagtaaaaaatgagaaaacttttacaagataaatttgatgagtcaccctcatcatattatagttagaggctaataatttataaataatgtcaaaacaattttctctatgtacatattattacggagcgattacatatatcattcacaactttagtcattttgttaaccctaatataatgtgatatcaaaacggaatattaataacgttatacattacaatttttgtaataaattttgattttaatcactaatcagttacttgttgccattatattgatcggggatcccttattgataggcccaatatgaatgagctcagttatattttgggttttttctcatagcataaatggcccaatgaaagcctattaagtgatcgaaggtcagacgttggactccttgtatgaaaccaacagactaggcccaaattatcaactcaaaattgaccgtaacatatacggcgccgtttttgtagacctgagtgtgataaagtgagctgttaaatcttcacttaaccccatttttaatcacgaaattagagtggtgattaaaaatacaactaaagttgtttcaagtgattgttttcatttatttaaattttaaattaatccaactttatcgttgacggaaaatttgggagagaatattctcgatggggaaaggaggaggttgtgttccgagcaagaagaagaagccggccaccaccggcgatggtcccggaatcgatgatgataacgacgctactaatgctccgatccaaattgacgatgatcaaaccaccattgacggcgatcgaacaacggcgacgaatactggaggaacaacaacaccagcgattactactacggctgctaagatctcgtcaccgctcaagatcttcgtcgtgttctattcgatgtacggacatgtggagagcttagcgaagaggatgaaaaagggagtggatagcgtcgaaggagtggaggcgacgttgtacagagttccggagacgctttcgcaggaggttgttgagcagatgaaggcgccggttaaggatttggagattccggagattacggcggcggaattgacggcggctgatggatttctgtttggatttccgactaggtatggttgtatggctgcgcagatgaaggcgttttttgattcgacgggatcattgtggaaggagcagagtcttgctggtaagcctgctggattctttgtgagcactggcactcaaggaggtggccaagagaccactgcgtaagcttttgcttctttcttatactctttagtaccatttgcattggttctaaagtatattagttgaatttggagtacaagtattgaattgctataatcacagagtcactatgtgaaataaatgcaaccttgaatttgatgtatataggtggttgctaaaacctgaaaggttgttgtggtcaggactttgtctagtactttagaggaaacttgtcagagatggctatcattctggtgaattgcttgcttgatctttaattgctttcttaactacaccattgaccatttcaagtccaatctggtcaccattgaatagtaccctggtctctcttttggtacgataggcttgcacttatgctacgcttatgttagctctagtaaggggagatctttagaacatgtaaaactggattattttagattctcactttctcatcacccaaagtaccaattctataggcatgagtgttgcctccgataatttgcatgtgtttaagctctgagatagattcctcaatgtatgtggactctctttagtcatcatttgcacttagatatttgtctgttttacttcagctgattcactcggttgctgtgatagtttgcgaatatagagaagcataacaatgcggaatcttaaagcttttgcgtatttctccaagtgtgcaatgtggatatttttattgccatcgtttccacattaaagctcagaaacacttgctgatttccatctcgtgtgtgttctgttgcagatggacagcaatcacacagcttgtgcaccatgggatgctatttgtaccaataggctacacatttggagctggaatgttcaagatggactcgatacgtggaggctctccttatggagcaggtgtgttcgctggtgatgggtcaagagaagcaacagaaacagaattggctcttgctgaacatcaaggaaactacatggctgcaatagtcaaaagacttgctcaaccttaaaacaaaaacaaaaattgcttcctctatttgtctcttttcattcaattcctcctcctgctaaataatcataaaaaaaaaaatcttcctttcttttctcaattccatcgaaatttctttcttttctttatgagtgttttcagtttcgccattaatggttagtgtgtacatgtttctttatattatttgtctcttatttattccttgttgtaaaataaaaacaaaatttcattacgtgttctttcattggagttgttgattggatattttatcaaaaacttataatttcacaaatcgttaaagtgtaggaaaaaaaaataattagttgcgtcagccattaggattccttggaacacgtaaagtttactaacataaaactgtgatatctgtacttttttatatctatctgctgctgcatctgtgttctgttcgtccttgaagcagtcaaattcttctctgaactccaaacatcgccatgtcccgagattctctcttcgttgaggtcactaatg

SEQ ID NO: 2942 - DNA, 3000 bp, Unknown; identical to SEQ ID NO: 2931
  misc_feature (1)..( 3000): cDNA_ID_3070562_gDNA_ID_1620618_Annot_ID_162093 3000 nt of promoter + ATG

SEQ ID NO: 2943 - DNA, 3000 bp, Unknown; identical to SEQ ID NO: 2941
  misc_feature (1)..( 3000): cDNA_ID_1819028_gDNA_ID_1620618_Annot_ID_46926 3000 nt of promoter + ATG

SEQ ID NO: 2944 - DNA, 3000 bp, Unknown; identical to SEQ ID NO: 2940
  misc_feature (1)..( 3000): cDNA_ID_1819024_gDNA_ID_1620618_Annot_ID_46928 3000 nt of promoter + ATG

SEQ ID NO: 2945 - DNA, 3000 bp, Unknown; identical to SEQ ID NO: 2939
  misc_feature (1)..( 3000): cDNA_ID_1807560_gDNA_ID_1620618_Annot_ID_46929 3000 nt of promoter + ATG

SEQ ID NO: 2946 - DNA, 3000 bp, Unknown; identical to SEQ ID NO: 2938
  misc_feature (1)..( 3000): cDNA_ID_3070548_gDNA_ID_1620618_Annot_ID_46933 3000 nt of promoter + ATG

SEQ ID NO: 2947 - DNA, 3000 bp, Unknown; identical to SEQ ID NO: 2937
  misc_feature (1)..( 3000): cDNA_ID_1819004_gDNA_ID_1620618_Annot_ID_46935 3000 nt of promoter + ATG

SEQ ID NO: 2948 - DNA, 3000 bp, Unknown; identical to SEQ ID NO: 2936
  misc_feature (1)..( 3000): cDNA_ID_1818996_gDNA_ID_1620618_Annot_ID_46937 3000 nt of promoter + ATG

SEQ ID NO: 2949 - DNA, 3000 bp, Unknown; identical to SEQ ID NO: 2935
  misc_feature (1)..( 3000): cDNA_ID_1818992_gDNA_ID_1620618_Annot_ID_46938 3000 nt of promoter + ATG

SEQ ID NO: 2950 - DNA, 3000 bp, Unknown
  misc_feature (1)..( 3000): cDNA_ID_1818988_gDNA_ID_1620618_Annot_ID_46939 3000 nt of promoter + ATG
tgttctctatcgtgacacaataaacaaagacagataagagttagttaaacgtgaaagaaggttagaattttggaaaatgaccaaatttgttattacttcaccaaattcggatcttgtcctcttgtcataaaatcatttcagatctgagttatttggtccaacgccaatactgaaaattaatgttattaaagtaaatcatatttattattttcaaccaatggggcctttcacaataacaaacaaagggccagctttaaagttttattgaaattttacatgccacataaattggttaaaatacattttcttcacgtttctcgctttttaagtccctttgaagtgggaatgatactcgcgtgacgaccaaactccatcgagcctctctctctctctctgtgatcagtttaatctactgaaagaaagaaagaaagaaagaaagatccgtattattaggtaagaatgagattcccttttacgtttcgattttgattcgtttgtgtttgattctcgatcgttttgcttcgatttagcttccttctgtttttacaagtctctcttgattagaaatgtttaggtttcaatgtttcatgatcatatttagaaaaaagtttcatggtgaccaaaaaagaaagaaaattttgatggctgagagatgtcagagtcttgttttgtttttttgataaattctctgtttgtgtgcttttaaaaagtcaaatataagaaattctttgaatcatttaaagccgtatttatgtccttttgacaagtcgatttaatgctttctagaagagagtttatcagatgttaagaagattcaaagttggattataacgaaaatttgtatacctcattagagatttttcaagtggtaaatactaatagaattcatgatcccgttttagatgtaagatttggttgtgtttatcagttttctattaatagccgatattattaaaaccttttgcttaatcttggatctgatttaatttgctttaaattggacttgaaagaaatctgaatttgatttgatcgtttctaggcttcgaagctgtctcaagattgttgtttaattaaacatgttcagaagaaggaatgctcaccaactcgacaatgatgattctcaacaagataacaaggtacaataagctgcttctttttcacactatatgaaaacattaacatatattttggaaagtatttaaaacacttgtacaaatttcaggttagagaattgaaatccgcgataggaccattatcgggacatagtttagttttctgctctgatgcttccttgaggagatttctagatgctcgtaattgggatgtggaaaaagccaagaaaatgatccaagagactcttaaatggagatcaacttataaacctcaagagatccgttgggtaaatatttgactttattatatacttcattttaatcttcttgttactttgtatttttttcttactttttttttaatcatcttcttctgattctcttcagaatcaagtagcacatgaaggtgagaccggaaaagcttcaagagctagttttcatgatcgacaaggtagagtagtgcttataatgagaccagccatgcaggtaactaagcccattgtcacctttatgaatatttttcttgagttttttttaaaaatgatatctcacttaataaaaatgaaacagaactcaacatcacaagaaggtaatatcaggcatttggtgtatcttcttgaaaatgcaatcataaatcttcccaagggacaaaaacaaatgtcttggctcattgatttcactggttggtctatggctgttaatcctcctatgaaaacaacacgcgaaatcattcacattctacagaactattaccctgagagactcggtatcgcctttctctacaatccaccaagactcttccaagcagtctacagggtacacaaaaaaaacattcgtcattattacaaaaccatcaaaatggtctctcttctctttttctttaaaaaggtttactatatacctactatattctttcatgtaggctgctaagtacttcttggacccacgtacagctgaaaaggtgaaatttgtgtacccaaaagacaaagcaagtgatgaactgatgacgacacattttgacgttgagaatctccccaaggaattcggaggtgaagcaacactagagtatgatcatgaagatttctcacgacaaatgtatgaagacgatctcaaaaccgcaaaatactggggactagaggggaagcactatccgaaaacaaacggtttctctccatccgatgttgttcctgagccggcgatagaaatcgcatcagcagctagctgagagttgaacgatatatacacacaagagcaagaagagaagaagaataaaagggttattctcattcatagaagaaaagccaatagaatgtgctggttaacttgatgatcaataaagtttcaaatagtctttgcctctttttcttattagtgagccaaacactttgtaacgtttttaattagcagagactatcctgtatgtgtgagagaatattgttaccatgtgtaatactactagttttgtgttattagttgaagatatgagattatccttttagttctattgtttctcaagttaaatacagttatgatgaaatcagagaagttattgtcgtctagtgaggtgatgatcaaatcttagactttaaatataatattaaactttaaatataatattgaacttaaagagaacaaaaggtcccgtagctcagttggttagagcgttggtcttatgagccgaaggtcgcgggttcgagccccgccgggaccatttgtccttaattcatttaaatttttaaattttacgattttttccttttttttcataatttatcaacgcacgttgtgaaaaaaataaaaaatcaatcatctctgttgtaattggattttgtaacatgatgaatgcgtggtgattcccagaagaagaacccagaaatcgatcgaagat

SEQ ID NO: 2951 - DNA, 3000 bp, Unknown; identical to SEQ ID NO: 2934
  misc_feature (1)..( 3000): cDNA_ID_3438222_gDNA_ID_1620618_Annot_ID_46941 3000 nt of promoter + ATG

SEQ ID NO: 2952 - DNA, 3000 bp, Unknown
  misc_feature (1)..( 3000): cDNA_ID_1818967_gDNA_ID_1620618_Annot_ID_46947 3000 nt of promoter + ATG
tactttcatctaacctatacatctactgaatctaaacaggtctaccacctactctaaacgcgtgccttaccaaaacttggaaaattttcaattttgattatcatgtgggtgaaaaacatcaaaaaattatgttgatgtattatctaaagtcattcacaattaatcaagaagtgtacttgttgtgagactgagagtagctttcacttgtcaatgagtaggtacctattcatttggccaataacaaaatgacaacaaaaatttacctaaaacttaaataatttagtgatttggtcagtaagcctaattaaaccctcaagcagtttacatcacaatcaagcttgaagcttttatttgatttggccaatgaaggagtttataaccctaaaacagttcacatcacaacaaaaccatttgactcgttttctgattaatttggccaatgacgagtcatcttgggcttcacatatggacattgatgttgtgtccatattacgacacacctttatcattttccatttcaaaaaaagaaaacaaaaacacccatgctattttttaaaacacacttaagaaacaaaaatcaaattaaatctttaacccatgatatctactaccaacaactaacaatattttacatcaagtgtgtcgtcaatagtagcactattatctaatttagatctagataaagccagataacactcttttgaactttccatgcttgaatatttcttctataatatcatcattaagaaatcttctcccattctttggcttcttttagaaaagatactctattagattttttagcgagtgaaagaagaataaaagatggaccagtcaacaaatggagacgaacaagtctttatacattgttgataatttgcgtttgcgaaggatgtggtcacaagaaaagaaagtattccgtccctctctctagctaatggcgtgtgatgtgactactacactctctcttctatacatgtttattttttccagaaatgtctgtttgaatataaactttttaagtgaaattgttgggcacaacagaaaactttaacaccaaaaaaaacgcgacataacatgttgcattgttgattagtttctttctactagagattagcattctcagactccgaacggtgactgcgttttacagtgcggaaaaaatgcggtacggtttaaatattaacgaaaatacataaatacatatgtataaatagagattttaatactgttatagcactgttgcggtacggttttgggtgcggttttgatcaccatttacagttttttttattcagattagatttctgtaggtaattttgattaaaatcttttggtgataacgcagtcttttcgtctggactggacccacgcgaggacccaaaatttgaccaatatgcgatccaataaacaaaaaaatggtaatttaaaatgaaataatccacatgtatgatgtcaaatgtattattttacattcacaattaaatacaggtcagcgaagtaattgttttgacaataaaaatggtaagaattacttggaacgtcatctaacatcattttaattaatactaacatcatcattttaagtaaacaatttttttagaataatagacagaaattaaggtggagttcatctttttgataattagcattaatccctactctaccatgtttataattgaaatcattatttcatattttgataattagaattaatccctactctaccatgtgtataattaaaatcacaatttcatgaaaaagatcaactaacttaaccaaaactatagtcaatgtcttttactgaaaaattcaagaataaaacaatcttagttacgtcactatcaatctccattagaaagaatggtttaaaatcattagtttttaacaaactctaatcatgattattaaaaaaaccaaagaagcaaggaagacttttattcaaaagattaaattttcttccatttaaaaaaggaataaaaagagatgtcaaaataattactacaaaaaacattagaatttgttggatatgtaattgacctaagaccataacgagcactcagacctcgtcctttcaatttagtctgcgcttgacacggcactcttaaaaataaacacggtgacgtagacgccgtcaccgtccaatctcatcgtcccttttttaattagcagctcaacgatttaaaatcgactgtcatttacaaaggctgtcatttcaacactcttcagtccttcttccttataatcctctcatcttctttttctccaggtttttaccaaccagttttttttttttcaaccctcgagatctttctttgcacgaacaaacctcgaaaaactcattctttatcttgacccatctgaaaaagtttctctttttttgtcggaataccatagagtttcattattttcgttttagggttctttttttgtaataaataattggaagcagaggagctatgctcaagttctcagatgaaattctcgcttttgatcatcagttcttgtttctctttctgatttacgctggatttgcaagggaaacactctgactttgtcaggactcttctgtgaaattctgcaagtttatgacttttctagtgctttttaactgtttgtgagtttgaagaaaacaaatttcaattgagttgctttggaatccgttgacataatagggtaagtcaattttcttactactaatatttatcccattaatgcttgagaattgttcctaatagaactctttttgctgtttgttaaatttgcagaatttagaaacttctcgtttagatgaggatcgattacacagaacggatgcctcaatcctataaggtttgttgttttatcaaatatgtcttatgatggagttttggtgtcttaaggtttgttactgtaatgactgacatgttgtgttgttctgtttcagatgcactcttccattgtgcttagaattgaagaggctagttgatagaatcatgagaatctttcctgatatagaag

SEQ ID NO: 2953 - DNA, 3000 bp, Unknown
  misc_feature (1)..( 3000): cDNA_ID_1016101_gDNA_ID_1620618_Annot_ID_46949 3000 nt of promoter + ATG
gagatgtggtgtggtctgagtttatgactgagtaatctaaagatccttgctgatgtaatggaaaagaccgaaaatccgccatgattgactgcttcgagtcaccttctggaggacctgtgaagtaagcctgaaactagattccaatatttaaccagtcaataaatgcggtaattaaactcttggttagttcttgggatgaaaactgactattattcacctgttttgcggataaatcatcgatatgacactcaagttctggatttatgacagagagtttcatcgacaagaactcgacttgttgttgcagagattggacatagttgatgatctcatcaagcataccagcttttccagtaactttgttgcatccaggaacaatatcttgtagacatttcatcttcttgcttatcttttctcttcttgcctgccaaaatcccacaaatataaaaccactcaaatctctaatgaaagtaatttctctgaaacctatttaacaacaacactttagttaattaccctctctgctaagctatgtctgtcggtggcttcacctcgtctagccctaacatgaatgtaatctggtttctgaatttctgaagatgtctctgtgttactcatgtttgatttccctttcatgcttggctctgtttcatcctctgctttgatcttcttcttctctctcttttctgtcttaccctaaaaccaatagttaaaacgatcagaaacaatgtttcaaacaaaatctaaactctaatactcaatactttcttgagctacaaacctctggttttctcttgttctgcaaggtaatggctctgctgtgtccattattcttcactggctccatatggaagctacttgtcctagaaatgcagccatcagtagtatcataatccggtccgaattcgggaaaatgtctgaaactctgcagctcatcattgttgtttcccaagtaactctcaactcttttgagctcttctctcccatctgagccaagtatctgaagaaactcaggtgaaaccatttgttgctgttgcagccacttaagcctatcaagtacagacaagtccatgaagagaaggtaaaaaaaaaactttaaaaggctcttatcttttctttgagggggttaaagcaaaagagaaaaagagagagttaagttatatatgtgtggaagaaaagtaatccattagatataattattcttagctttaaatagaaagcaacattgacccacacacatgagattcgaaatctagtgagagagggacaaaattgataaaagtggaggaggttggggacaaagaaggtgagatgagaagttgtggggtctaattgacataacctaccatgtggtcatgtccttatgaacatgagatgaggagtctcttaagttagtctcttttgtgtcttttctctgtgtttttttttttccttttggcctttcaagtttttgagaggatctttttgtttggcaacaataatcaaactttgtaaaacttaaggttcatgagggtattatcatataaatatcctcttttgtaaaatcaaatcattgagtttttggtaagacaaccttctaattgtaccaatttgttttgttagagagagagagagagagggtctttcttaggcttgaaggtggagaatgtggggaatgtgaattatgaatcttaacttgcaaatgaatagaaacaatggtttgaatcatgagtgatatcatttcaatgtcttgttgtgaatctatacgtgatccttgtgacgtatgattactacccttcatcaatccatagattacaccaataatttaagtggatttcatatattagagagatggcaactcgatgaatatatgacatattataatatcacatattataattcataactgatagggacacaaaataagcgacctaaagaagaaaatgggtttgaagataagtgataggaaggtaggcgacaccattgcttttgatctaagtgtttggtccctatactttctttttttccctattaattatatatctatacattatctataatgcgtgacataattcaagagaatcaatactatttcgattttttttttttgaagaacttgaaaaaatatatccaaaattagaccgatttcaataacacaccgtacaggttgctttgaggtttccatttcattggttctttgggaaacatcaataacaagctgcttatgagatgagaagagtaaatgcttcaaatgccaaaatacttaacgttgagagtatctgttgttttttgcaatttccacaaaaaagttttagaaagtttttgattcaatgggtttcaggatgtattcttttgtaaagaagtttgtgtcaatgcattcatgttgcaattaggcattttgtcgaatcacgaaaacggaaggaacactcgtattcgtcacatcaaagtataaggccctagatcgtgtgtatcacgtctctaatttgcttacttacaaaactgtgttgtttgctcttttcactaatgatggatctatgtgataacaggaatcacattccacgtcaattatttctgtttacttcaaaagaatgtcacacctatgcaacagtgagacaagatctgaggaagagagttagagaacatgaaatttaagaaagagtgcttcaatatcttgttgtgtacaaatcaatagttctgtttgataatatcaacttgacagcttttgtcaaaatgatgagtaaaaaatcaggatctttgggacaaatacggctgaaccggccggtttagctaagtcgaaattaccggcctaatcgttaaaccataaaaaccgcaactttcagaaacactctgcttcgtcgagcggattcgacttgtctggctcaggggtcgccacaactctcccgcaagttcacacatacactcggtgctcaaaaagtttgtcctttttgcatctctcagttctgaaatatctggttctcttgtccttgaaaattttacgaggttgttctctgtgaataatcg

SEQ ID NO: 2954 - DNA, 3000 bp, Unknown
  misc_feature (1)..( 3000): cDNA_ID_1818959_gDNA_ID_1620618_Annot_ID_46950 3000 nt of promoter + ATG
ctcagatcgtagcttattggtcaagattgatattattcaattgcagaactacccaaatttgggacaacatccaaaaaattatagttgaaaacaacccaatagagatatcgtccagtaaacttatctctagttactcaaaatataaagatatatttctgtttaatacgcatagtttttctagacaatgtgcttatgaattatgatctagaaaatcagatataatagctagtagtaactatttaaatacaccgatgatggaaacgaataagtgaatacaccgatgacggaataagtgaatcttgtaagtagggcaagcatggttatcaccgccatcattatgttcgaagcataatatttaatcatgtttttatttgcgaagttatttttactaatatagctattcaaactataagagactatagtattgatcaaagtgtgaattcgtcttttatatatttttttatcatctagggttcatgcatgctttacaaggcacggagttttaagcaagcacgcgtatacacacccacacgtttacatatctatatacatgtttgaagcgcgaataaatccagctaattttatttgaatgaaattttactaaacagaaaacgaatttgaatttatatttggctctaaaccaaaaaggtaagggtacacaattgaaattcattttaaaactaaaattaactgattaaattccgaatctaacttgtagaaaaagttggtgttgtcattaactaatgatttaatatgcttgcactcgttcatatcacaatgaattattttgtcgtaatagccctagtgcaggtaaattttcactatcataattaacaaaatagatatatatcaattgatttcatagttaatgagtaccaaaaaaaaatcgaatacatacatgtacattaattgatgctatacaacttaatatgggaagccaactacccatatatgaacaaatattaattatcttctaaatttcaatttcgactttaagaggggcaacgtagagtgataatcatatgagttgtcaacaaattaataaatggttcaaatcattaatcatgcatgccacgatatatctcgttatcgattgtggacaccaaatcgttacactagcgaatcggtatttattctattttattagggtgataataatacgtataaggaataaatatgttgtatatgcaccatacttgcgtcgtacttaattataagtgtaatgaaattataaatttcgacttgcaatggactatatatgcttgtgagaagaaaaaaacaaaaaaaaaggatactcaatatgatctggaacggtttaggctgtcctattcgtgacttaattagtgtccctttttaatttgattttttcttataaaaatgatctggaggaatggtgccaaatttggattaatacttatatgctcaaatcttgattaaactacaccaacagtgtcattttcaggctattattggaaacgtcagaacagttttacaaaatgccaatgattcacctgtttttactaggagtttttgtagattacatatgtttaatcaagttatttggataatcaaatatattgtcaatattgtaatttatgatttaaattactagtttcaagcaaggactacttttttttttgtcaaagagcgaggactacttttgtcaaataatactgttggcttttagctaaagttttacaatcatagcttaatacacatgtaaatgtattcataactagtggttaaaaactgctagcgaatttataattactcgttttgtcaccaaatatctttcattggatacatatatacacatcaattagaaaatgctaatgctagaatttgaacaaaaaggaaagaaatgggaaatagtagtacaagtaagagtgcgttacacttgtaactgattcattggccgaggcaactccacagtttcttactcttaccattttcactacatttgtttccctcttgggaacctttattttcttcttcttacatttattatcactcttttattattctttttgtttttgtccgtatattttagtttggttttttatagccttgcaaaaaacgacactggtatatctatactttttatctagatgactagaccaggtccgaataatccaagttttgtactactatagtataatattaaaactatgagattcctgcgtatctgtaatttaatttttataaattcattctaacgttataattatcaaagagagaattattttcctattttttcatggaaagtgatgaagatagtgtgctgcaatagtcggacccaccggagacgaagaagtgacaacaacgagtattgtgtatttcctattttaccctttccttttcgtttcgcgcgtcttcaccggcttaccggctacacctgtcctcctatatatcggtttcatcatttcattataaaattaatagcacaaataaaataaaacaagtcttattaaaatactaaaaattgttactgtatttaattagttgccgccgcgccggccgttacgattgcagcagcacgactgttttcagaactctttttttttattaacaatcaatcaaaattttttatttgttttagtattatatggagacaacaagcaataagttaaacagaaaaatcctaacgttcttatttttttactattaaataataattttgacatattacaaaattatgaattaacctaaaataaatagaattaattctctttttgtacgatgtagagagatgggaatattatatacccttttgaaataaagacgactcgaattagatttcaaattaaagctgaagaggtcctttttcgtcattttggagtttctttttgagacatttttcctcttttgattttcgctttttccgtccgcttgacttctgctgtttcagactctcaacaacggagagagccggagagattgaagaagaaaggagaaatatttgcgaacccccaagaatcgtttttgttgattgactctctc

SEQ ID NO: 2955 - DNA, 3000 bp, Unknown
  misc_feature (1)..( 3000): cDNA_ID_1818948_gDNA_ID_1620618_Annot_ID_46953 3000 nt of promoter + ATG
tagaagacttctatgtagttcgttgtatagccttattctgtgttatgcttaaagattttgttgggtccatacagtgctgctggaccgcatacaacagttaatggaaaagatgtggtgaattttgcctcagctaattatcttgggctcattggccacgagaagttgctggtaacgtgaagctactttgttttcaatacaatctctcttctgtttgaatagttttatttaagatttgtcttatgccaggaatcatgtacttctgcattagaaaaatatggggtcggttcttgtgggcctcgtggattctatggtacaattggtaagaagacaataattttctaaatagatactttggttcatccattggctcgcttggaaagggttcttactgtttgattacttctcttgactagatgtccaccttgactgcgaaaccagaatatccaaatttttgggtactcctgattcaatcctttactcttatggactttccacaatgttcagcacaattccttgtttctgtaagaaaggcgatgtcattgttgcgtaagtacacaatttcttataacatcgttctacttattagattacgttagtagaaatcccaggattacattgaacatctttgtttgaaacttttttatctcgatattaaactcattcttgtcttttctattttcttagtgatgagggtgttcactggggaatacaaaatggacttcagctttcaagaagtacaattgtgtacttcaagcacaatgacatggaatcccttcgaattacccttgagaaaatcatgacaaagtacaagcgctcaaagaacttgaggcgttatattgtagctgaagctgtatatcaagtacctggcagttttctttcttctcctgcttccatattttgaaaattctccctgaactgtgatgcttacccatttgcctttgggtatgttaaaatctacagaattcaggtcaaattgcgcctctggatgagattgtaaaactaaaagagaagtatcggtttcgtgttatattggatgaaagcaactcttttggtgtgcttggccgttctgggagaggtcttgcagagcatcatagtgtccctgtaagtatgattgacacacattttagtagtgttctcatttgccaaacctgatgctaaaaatttcacggcggtttatctttaaacagattgagaagatagatgttgtgactgctgcaatgggccatgcattagccacagaaggtggattttgcactgggaatgcccgcatcatcgattaccaggtaaacatcgatcatgctgattaactaattacaaacaaaattaaaaaactaccgataatagaaacttttctctgggacgctcaaatgcacagagacttagcagttcaggatatgtgttctctgcttctttaccaccataccttgcaagtgctgctatcaccgccattgatgtcattgatcaaaaccctgatatgttagttaagctgaagcaaaatgttgctctgttatggaaaggtttgatcttcaagttttaatctaatctagcaacaattagagtttgatttagtttgttatcttcctctaattgaaaaagaaatgctgggaacaacgcaggattgtcagatatcaaggggatgtcattaacaagcaaccgggaatcacctattgttttcttaaaattagagaaatctagcggttcagctaaagatgatttgcttctacttgagaaaatggctgaccgtgtaagttcattgtttctttgcaaaaccaaatctagaccctgtccccgtttcttgacatgactagatgcatgcaggctctgaaggaagactcattgttggttgtgagttctaaaagatcatttcttgataaatgccggttacctgtgggaatcaaactctacgtctcagcgggacattcggaatccgatcttcttaaagcgtcggagtcactgaagagacttgcttcagagcttctactcaagtcctgaaacaccgaaactcttttttcttcaagaacaacaacactgaagggaactctttgaacacatccgtgtgagatagtagacaacagaatccgcagagtcagtagcttgaagatgttcatagcagattcctaaactggttctccactttcagtgatgggcttgtggttgatctgaagctcaattgacgaaggaggattatcgaagacaatggcttcttgttcttacatttatttcatttgatcatctgagttctttttttttttttcctactcatacccttcaatgatcaagtagcttagtgttgttgccgaaattcaaaaactttcaatttatgggaaacaaaaaagttcatgtgctgacatcagcctcttaaggctttctgagtttcttgcggtaaaagaaagtgtttttgcctctctcaaatctcaatagtattgacacgtgtcagtataacactcgtgcataattgacacgtgtcagtataacactcgtgggcggtataatgtgaacgaaagagcgagggacaggtaatctctcttcctctgtttctaagtttgtataattagaactgcataacgaaaaacaaaaacaaaacagtgaccaaaaaaagaagaagaatcaatggttggggaaagagagaatatgaggtggagctttacctcgacgttaatggagttgagaatccaatggaacgattttgagagattttcggagcaatctcactctccttttatctttctccttcctctcatttcctctttgcagaggtaatttatcttttaattgtctctctgttttgttctgttttcttaacttcatgttcatcgttatcgttgttcgaatttgatttgtaattagggaatgtgaatttcttacaggaatttggcaaagggcattggctaaaaataataagacactcgttagagtgctcgtccctcgtgcccttacctgcctaattccaactatctggcaaaatcatgactttgatccaaggtatagtaaacaaaaatg

SEQ ID NO: 2956 - DNA, 3000 bp, Unknown
  misc_feature (1)..( 3000): cDNA_ID_1818934_gDNA_ID_1620618_Annot_ID_46957 3000 nt of promoter + ATG
tagaaaattagaacttgacattattgtccaaagtgggttaaataaatgaatagcattttattaagaaaacattgtatttaaaaacatattaaaaaaatctaatttaaaagtttttaaaaatatatgtcggctgtttgtgtgaatagcatgattatggaatatattttttgtcgaaaaagtagtatttgtcatctagttgtaaagatatatttctgatttttcaaacttttttagatctacattttttttttaataagatttatattcgttaaaaaagagatgataaataaatttattttgaagatgacaaagaaaaaaaaaaattgaagacaaattaacttttattatgtctattttgaagatttttattataaaaaaataaactattttgaagatttttattatgtctctgaccaatggcagagtagggcaaatgccatgggttcattacaaaattcaaaaaaaaaaaaaaaggaaaaaggcccacttttatattaaaaaaatatactaagaggttttaaaattttttttgaattttaccaaaggcccacaaaaaattgagacgggcctaaaataaataataacgtcctgtttagaaaattagaactcgacattattgtccaaagtgggtcaaataaatgaatagcattttattaagaaaacattgtatttaaaaacatgttaaaaaattctaatttaaaagtttttaaaagtatatgtcggctgttttttgaatagcatgattatggaatttatattttttgtcgaaaaagtagtatttgtcatctagttgtaaagatgtatttctgatttttcaaacttttttagatatatatttgttttttgtttctaataagatttatatttgttaaaaagagatgataagtaaatctattttgaagatgacaaaaaaaaacaaaaaacaaaaaaaaatctattttgaagacaaatttttatcatgggtagttaatcttgattttggttaatggagttttggatttttgggtgggagaagagtaaagaggtaaatgctattgaaagatttattaaaggttatttgtcaatgtccatatatacattttttgtacactagcctttagatatttcgagacctacattgaagttggtttagggaaagttgggtaaatctctagataaatttgatatgatcaaattgcgttgaacactagttttaagaaaactaaaattttcaatatggacttgcgatgttgaatcaatgaatctttgtctagaaaaagctgaaatctgtttgagtttggtgaatcaaaaagattactcgatcgagatgctaagatggttcctgaagagttgaaaattattagctttgatggagaaaaagaagttattggagtagttgggaggatcatcaaatcttttttggatggaaaaggcaaagtgaatgccggtttccgtgagaatgtgttgtatcttgtgaatgtctgcctgcgcattgtgtgtctagtcacttaccaaaaatttgagccttatgaagactttggcagtgcaacgactgttgttgcgtccaccatcacgtcgattataactgtgtggttgttgtacaacaagtttgagatggggatatacgacaagatagaagtatttgctgcttggtatttatttattttgtccaaccgctatgaagaaattgtgatgtcggatgacttcgttcatgtattgctgtttttttggattgttaaggtaatattaacatggtctatcttcttctactaactagtttagagatattaacattgttttgtttgttgtaggtgcataatgaagttgcattgctatggaggtttccaaaacttaactatgctaaaatcaattatattctttgtagatcgcatgaaaaaggttagatagaaatcgaatgattggtacaatcttaaataatgatatgaaatctaacttaattttggatctatcattagtagttagcgattgtaaacattcaacttgtttttttattattattatttaaatttagcattcaaatttttgattagaatttttaaaagttgttttaaatttttgattttgtttattattgggaattttaaaacctattttgtgttttttttttttgaaaattttatttgttggattctaaatttacataatgataaaaattctaaccggattttggatctaatattagtcgttagcgattccaaacattcaacttatattttctattattatgtaaatttaccattcaagtttttaattaggaatttttaaataattaaatgtccgtctttaataggctcctaatccatctttttatttatatatatatatatatatatatatatatatttttaagttaaatatcaatattttatgaataaaactgtattttctcagtaaatcgaattaatagaacaattaggagaagattaacgtattaggctccgtcttcttcttcttcttctcccttgtaacgttttctggtatgggccgctcacgatttctctctcaaaatatctttgcctttgtacttatctgatccataataatctctggataacgacgaattgacgattctgagactttatttttgtttggttttttgctagtttactaattcgttaagtgtttgatgataatgactcttgaaaaaagtttactttatcttcttctcttcttctgcttttggtagtcgtctagtaattaagattgatagctaagtaaagccaagatttctctggcttgtttttcaagaggaataacgtaagcgagcaaaaagctccacttattgtcgggaagcaagcttcgattctttaaattcctccaaacaaaaaaacacaacgtggaaacttttctataaacccttttcaaattctgtggattagaccagaagaaagaagaaaatttactataaacccttttcgattccactaattgttttcacaaaactctgttctgtactctgttttttgttaggtcattttttagcaaagaagaagaagagga

SEQ ID NO: 2957 - DNA, 3000 bp, Unknown
  misc_feature (1)..( 3000): cDNA_ID_3093431_gDNA_ID_1620618_Annot_ID_46964 3000 nt of promoter + ATG
gcctgagacagaactcattggaaaaactgataaaggacacagagtttcgtttgtcacgaagcctctgtttgataaagcgtgtcttcttgatggtgatgatctgaagaggaatcctggaattggggattttgttgaggttcagatagagaaatcaacgagggcatcgttgtttggggaagctctcgcgattagtaaaatgtccttgtttcacgatgttggtgtcgtcgatgctgttgttgcgtcttgtgcaagttaagttgaacttccgttttctttgtttcgaaagcctttatactttttcttctgtatactttcttcatagttaaaccaaataagttatttacagatgaattttattacttttttgaaaacacaaattgtaactgaaatggatagagaaacatttttgggcatacatgtattcctcccctggttcaacgacatgtttcttcgataaagttgacaaaaaaaaggtagagaaacagtgttgaaaatgtcagcgatgaacagaaagagagatcgtcgtcaatggcgatggttagtgatgatttgactatgacaagtcaataaacactatgctctatgcgatggtaattttatatatatctgttagaaagaaaaaaaaggttcatagctcgaggcatttattaaaaaaaaaaaaaaggtgtaacggcagaaagtagtataaattgaattatttcagtttattttgatggtaatataaatctataaattcaaacaatgttttgttaaatatgtttatacatatatgttaggcagaaagcattccaattaattagttgtggaccgaccttttaattaacatttgtactacctccgctttttatcagagacatatattcgattaattaatttggatattaagtctaaagtttaaagaagggaaagaaaaaaactccaatcacatgtcgtaggaatcacactccccaataataaagttggattagtatttctcaagaacaaagttggtattcacatatctaaatttgtaagatgaaatatacgagtacaaccagaacctaatataatatataggttttggattagtactgtatttctactgatatcgataatcatagtttaataatttagtgtcattggcaaataaaatatttaatacactgattatcataatttatgtgactgacatgtttattataataagatcatggattaatcagtgaacttatgttcatcattgtttccaagtctaaaagcagatctcgatatatatttatatttttcaatgcgcttgatgatatttaattcgacctatagtatcaatcttgggttttactttgtttttaatcatatgctttaccaataagcaatgtttgttcagggaagtggatcctattattgagatttaaacatattgaggcatgcacaagtataataattattcgttattggtgttaagtaactcattttatctgtcaatctataacgaaattatactcatttttttcttctataaatggataaaccaaaaatgaatagaaaataaattaataaataaaaattggttgggggtgagaagtagctatctaatatctaaaaatgagacgagacaaaacggcctaagcgtggcgcaatagccgctcccaatttctgtcccctcatttattcctcactattgttttgaaaattctgttttgttgcaatcttagaattaaatactattaacgtcgacttgaagctacaaattttggaaatttggatccgatgtttataactcatggatcaaataaatgaaagatgcatatgaatctgattttctaatgattttgaaatatgaataatcaaatatttatatatatacatctaataagtaggaaaataatttcataataataatcattgtctaaataatcagacctatataaaaatagaatattatcaagtaaatttatacaaaaatataccattaaaatactctgtatatagaaatatgtgaaactgtatttgatcactgtctatcgttagtcgttccaaaagatcctattgatttaggagtatttagtagtaaatacctttataatgatggacaacttaattaccgtgtgatacagtcaatgaataattaaataagagagcactaaaattaattatgtgtttctattaaaagagaatgttacaataataatcttatttaacaaaaaaaaaaaatattacaagagaatatcattttctattctaaaattagcttatgagaggaattagatatttaattccataaaaattgattttgtagctatatcaaatttcttataaagatggaatgggtaatcagaaaaatatcaatacattgatacatatgtcattatgctgttgaccaaaaaatgtcattatgcttattaagttgttgacatactaaaaattcaagattatactagtaattaactacttaagatgaatttaacgaaaataaaactattttagattttttagcttggtaattaagttgtttttagtgggtttttaagtttaagtatatatgcaatacatatttggattgtatatagtgagatacgggtaaaagtggattttatatcattaattcctctgtttctcccccattgaaaatgacatcaccatggctttaagctctacaaatacaaatatttattctctcactttctctgcctgcatggtttttgagaattgagaaaacccttttaaaattctctatcgatctcatcacaaattttgctatatccacaattcatgtgcttaggcatatagttattcccaagaaaccggtttaactgtttacgtatgcaacctccggcaagcgcaggacttttccggtcgccggaaaatctcccttggccttataattacatggattatttggtcgctggtttcttggttttgacggccggaatacttctccgtccatggctctggttacgtctacgaaactcgaaaacgaaagatggagatgaagaagaagataatgaggagaagaagaaggga

SEQ ID NO: 2958 - DNA, 3000 bp, Unknown
  misc_feature (1)..( 3000): cDNA_ID_1821441_gDNA_ID_1620618_Annot_ID_162157 3000 nt of promoter + ATG
gcaagagttttgtttaacaacgttcattataacttacctccttggtcaatcagtattcttccagactgtagaaatgcagtcttcaatactgcaaaggtaagtgtatatggttgaaactcagaattatggttcctcaaattctctgtgttttttctgattcttgtggatttctcttgtttaatttaaggttggagttcaaacatcccagatggaaatgttgcctacagacacaaagaatttccagtgggagagttatttggaagatctttcttctctagatgacagctccacattcaccactcacggactcttggagcagataaatgtcacgcgtgacacaagcgattatctttggtacatgacgaggtaaaagaaaaacccgtctgctaccttatacaatgtaaactttccctagcttcaaagtgattctcgacacgtgctaacaaacatgtggaattggtatgtagtgttgatatcggtgacagtgaatcattcttgcatggaggagagctaccaactctcattattcaatctacaggccatgccgtgcatatatttgtcaatggacagctttcaggtatgatacttccactagtttggcctgttaatttgttctattagagaatttctgatgcaaacttataatatatgaattgcaggttctgcctttggaacaaggcaaaacaggagatttacttatcagggaaagatcaatctgcattctggaactaacagaattgcgttgctgagtgttgctgttggattaccagttagtagtcttttctctcttccgtgtaaacgatgtttttcgtttttctcttatcctgacccctttcctctttttcgtttttgaagaatgtgggtggacactttgagtcatggaatactggaatcttgggtccggtggcattgcatgggttgagtcaagggaaaatggatttgtcatggcagaaatggacataccaggtgttttatctatcctattttctcgtgatttctctcttttgatcccttttttctgtattaagttgtttaactctgttttcatcaggtgggactgaaaggtgaagctatgaatcttgcatttccaaccaacactccctctattggatggatggatgcgtccttaactgtacaaaagcctcagcctttgacatggcacaaggtttgattgaatccaacacaactcaacaaagctttttttctaattaagaatctgaactaacgagtatattttgttttatttcagacttattttgatgcgcccgaaggaaatgagccgcttgctttggacatggaaggaatgggaaaaggtcagatttgggtgaacggtgagagcatcggaagatactggacagcatttgcgactggtgactgcagtcattgtagctacactggaacatataaaccgaacaaatgccaaaccggctgtggtcaacctacacaaaggtggtaccatgtgccgagagcttggttaaagccgagccaaaatctgttggtcatattcgaggagcttggtggaaacccatcaactgtctctttggtcaaaagatcagtatcaggagtttgtgctgaagtttctgaataccacccgaatatcaagaactggcaaatcgaaagctacggaaagggacagacatttcatagacccaaggttcatttgaaatgtagtccaggtcaagcaattgcatccatcaaatttgcaagctttggaactcctttaggaacctgcgggagttaccaacaaggagagtgtcacgcagctacctcatacgctatcttagagagggtaaaagatataatctttacacagctaaaactggaatcagactcttcttctttttttttctaaccacggtgtgttttgatatatgcagaagtgtgtagggaaagcgagatgcgcagtgacgatatccaacagcaatttcgggaaagacccgtgtccaaatgtgctgaaacggttgactgttgaagcagtttgtgccccagagacatctgtaagcacttggagaccttaaagacaaccattgagccctttgtctacaaaatgtataaccaaacaatacagagagagttgaagaaaagaaattgtaagctgtgtttaaaatatgtgtgtgtgtgtgttagtttgaacagagacatttgtgggttagagtagtttcagatagataagagagaagagtctgtagagttgtgatgagtctcgggcaattccgtggctcattaaaaacgttcaggccaccggtcaccaccgaccattttaaccggttatggagaccgggattggtgggtctgaatgaagtcagtttaaggtttggttttgatttgtctttgtaatcaactaaagagggttcaggtttaggagaaaggagatcctatggtgacccatttctttcaaacctattgtcgtttcactttctaatttagttctattttccctttttctttttatctaacaaaatatttatgtttcataaactattttttcttcgtaaattataaaagctttttctccgaagttaaattggagaaaatctttaatattaaaaaaatcgagagaaataccctagaatagctattttttttttgtcggcagaatagctatttttccaatatatattttacaataaagtaaaaaataactgaattattccccttaaactaaattatgaaacctttatgacttgaaaccaaattttgacttttaagaagcgataaaattatgctatacgaggttaattatgcaacattatcccaaaaagtttgtttcgaaaatacgaccatgataatctcaataaccgtttaatatctataactaggctataagaatcctatttctattcgaatattctttaaaatccaactttatctcttcttttgcaaaaaaaaaaaaaacttcaatttaagttctatataaaacgttgtcacccatacgtttaatcagaaaacagaaagaaacatactcaaaactttttaagcagcgacgatcatagatcaaat

SEQ ID NO: 2959 - DNA, 3000 bp, Unknown
  misc_feature (1)..( 3000): cDNA_ID_2993752_gDNA_ID_1620618_Annot_ID_162156 3000 nt of promoter + ATG
tcatacgagacacgtgcaccgaagctttttcccacgtgccaaagagtttcgtcttcgttcacacagaaccaagatgggtggtaacgaaggtaggaccctaaagcaccagcctacaacacatagatgaaatagtatatgcgtttacatggatttgatgaattgttgtgtttagtatataagtatattgtttagaattatcaaaaagtatactttataaaaagagtggtggtaacatatttagtttctgcaccaatataaaaagaaatatggtgatgtctaaagaaaaaagagagaaaacttagccaccaacaaaatattagaagaagatttcaccatgtgaatggaagggtaatgttttttttctttctttattttgaaatgaagggaaggaagttgttataaacaaattttcgaaaaggttaatgatttaaatctactataacctttttgatcctttagtttggaacaaaagaaagtttcagagttagcgatattttagtggaaactagttgttgattctccaactaaaattcaaccaccattagcataaaacatggttattttggcgaagtagtttactttgcaacatctatctgtattttactatataaaataatacttaacatatacaaataaatagaaattaacattagaaccaatagttatatagtttagctgtttaggtaaagcttagtaagagtggatgcaatcctttcccgttttctctccgcatttcacgccgtcgaagccttattagggtttaatacaaatccataatctctcgtttccttattattaaaacatcccatgtggacaccaggactaaaaatcttgacaatcagctttatttgatgactgaagtatcaaatttaaataaattaactagttaactagttatataatgagacttattttgaccacttaggtccactaatagacaaattaaattatcttatattggttattgtcccatcgtatgaaaatcaaggatggtgttttctaccagggaaatagttacatatatagtacatgatcaaacttgaataaactacacgataatgatcattatttgttgaaatcaaataactttaacaaacaaacaaaaaaactaaaatcaaataagaatattagtagcatagtactttcattataacctttatgaaattttagtaaatagtataagaatttctcaatatgcatcgattttgatttaataatgagtaaatgaaacgaatagaaacaacattttgatttgattaaacaaatagataaaaacaagactcataaattaaaatttggaagtttccgacaattagaaaagctgattgatatcgcatctgattgcaaatctgaccagaactcgaaaatattgaaaacatattttaggaataataaaagagatgatagcttaagtggaagttgaatgtcggaccgtacgtaccgggatagttctaatagacacttctcatttattctttttccttcaattatcccaactgttacacagttatattccataaatacccctagtcaaaatgtgaattcacgagtcaaacccataaatgcagactactgtcggtgtcggtgggtgaaactagcgtaaaatgatttagggtaaaactggaatttcactatatgcaacaaaagagcattcattcacatgtttatgtcttttgtgtgatttatatcttctttcttttgacagttacaaacttacagctaatcctttgattaaggaagcatctcttaattaatctcaagtgggctgataaatttgaactttcatcagatccaagaacccaaaattatatccaaccgatcttcaaagaaacttaccaaataaattgtaaaatagtagtatatgacatatccaccaaatctacaaagttcaaaggctactaaaaccaaattccaccgaagaagaccatataataactataggccaaacaaaactacaaaatcaatttctggaacaatgtgaatttaataagtatggtaaagtctgtacacatatctaaatgacaggtacactgtgattttggaagtggaagacacttgtacaatgtgaatccattttgacgactgtccacaagactcctcactaataaaccaaagtacttcacgtactctatctttttatatcagtttaaatgaccaaatcaaatttcaacatctactaatcactaactcaaacccataacaatattcagccataaacacataatatgttttaagttagtgactagactgacgcactaaatcaatcaaccaaacaaaaaaaagaaaacgaaactgaaataaaatatagcgtgattagctgctttaattcaatcaacgtgccacttttttcaccctaatatcataatcaactcttactttattttatttctttacatcttcccgtttttttatatttccgttatatgatataaaaacaataaataaaaatgcgtaaaaattggtgggaaagcgtcggtagctcacggccacgcagtgatgatgcgagtaagagacacttgtgaagtgcaataaaacccccttcttcttcctctctttctccttcgtcttcttcttcttcttcttccttccttctctctccttattaagaaagaccaacacagacacggaagaagtagcttggttcttctctttgtgaaggtgaatgcgggagatggggactggagattctgcttcgagactgattctctggttctgcttagggtttttgattctaggtgttggatttgtgcaatgtggagttacttatgaccggaaagcacttctcattaatggacagagacgaatcctcttctctggctccatacattaccctcgaagcactcctgatgtaagatttaacaaaagccctaaacttttctcttttttcttcttttgggtttaacaaaaagaccctatgtttctttcctttatgttctgttttatacaatttatcaaaaaggttttagctttattaattttaactgttgttcttgttgttag

SEQ ID NO: 2960 - DNA, 3000 bp, Unknown; identical to SEQ ID NO: 2957
  misc_feature (1)..( 3000): cDNA_ID_3093431_gDNA_ID_1620618_Annot_ID_162151 3000 nt of promoter + ATG

SEQ ID NO: 2961 - DNA, 3000 bp, Unknown
  misc_feature (1)..( 3000): cDNA_ID_2109164_gDNA_ID_1620618_Annot_ID_162145 3000 nt of promoter + ATG
aagttaaatatcaatattttatgaataaaactgtattttctcagtaaatcgaattaatagaacaattaggagaagattaacgtattaggctccgtcttcttcttcttcttctcccttgtaacgttttctggtatgggccgctcacgatttctctctcaaaatatctttgcctttgtacttatctgatccataataatctctggataacgacgaattgacgattctgagactttatttttgtttggttttttgctagtttactaattcgttaagtgtttgatgataatgactcttgaaaaaagtttactttatcttcttctcttcttctgcttttggtagtcgtctagtaattaagattgatagctaagtaaagccaagatttctctggcttgtttttcaagaggaataacgtaagcgagcaaaaagctccacttattgtcgggaagcaagcttcgattctttaaattcctccaaacaaaaaaacacaacgtggaaacttttctataaacccttttcaaattctgtggattagaccagaagaaagaagaaaatttactataaacccttttcgattccactaattgttttcacaaaactctgttctgtactctgttttttgttaggtcattttttagcaaagaagaagaagaggaatggcgatgctagttgatcctccaaatgggataagacaagaagggaaacattactacacgatgtggcaaacattattcgaaatcgacactaagtatgttccgattaagccgattggaagaggagcttatggtgtggtttgttcttcaatcaacagcgaaaccaatgagagagttgctattaagaagatccacaatgtgtttgagaatcgcatcgatgctttgagaacattgagagagcttaagcttttaaggcatgtgagacacgaaaacgttatctcccttaaggatgttatgctgcctactcacaggtacagcttcagagatgtttatttggtctatgagcttatggattctgatttgaatcagatcatcaaatcctctcagtctctctccgatgatcactgcaagtacttcttgtttcaggtacgttggttcgatacattttctgtttctcttgttaagctttggtttgatgattgaattgtatctttttgtcgacattgtagttgctaagaggattgaagtatcttcactcagcaaacatccttcatcgcgatttaaagccagggaatctcttagtgaatgctaattgtgatctaaagatttgtgatttcgggcttgcgagaacttatgaacagtttatgacagagtatgtggtcactcgttggtaccgagcacctgagcttcttctctgttgtgataactacggaacctccattgatgtttggtcggtaggatgcatattcgcagagattcttggaagaaaaccgatattcccgggaacagaatgtctcaaccaactaaagctaatcataaatgttgttggtagccaacaagactgggatctccagttcatagataaccagaaagctaggagatttataaagtctcttcctttctcaaagggtactcacttttctcatatttacccgcacgcaaatccgctggcgatagatttgttacagaggatgcttgtgtttgatccaaccaagagaatatcggtcagcgatgcgcttttacacccctacatggagggactgttggaaccggaatgtaacccgtcggaaaatgttccggtcagtagtttggagatagatgagaacatggaaggagatatgatcagggagatgatgtgggaagagatgcttcattacctcccccgagcttaaatcaatattttgtaaaatcatctctctaacacttgtttataactttagtttgtggtaacttgtattcgtcttccatgtttctttgttacgttgttttgtgcggaatgtcattgagatgtatgcgtcaaagtagactttcggttattgaaatttggtctggttatttgatttataccggatccggtttactcccctcgtatgagagaccttcggaactatggagaaggttttgactctctcttcagtgatatgatccgtcgcaaatcggaatctgccggcgagatggttccagtcgtctttgttcccttattgatagaataatcaaaaatccgagtcggagacgacgaagacccgagttccagctattaactatgcagataccatcaagagagcatagtttcattctatttctcttcatatctggtaaaaatcctcgtcgcacgaatttgccctctctcgaatttttgagcttttgaaattttatcttttgggaaatgctgcagcttttgtaattggtgctgcgtctgtacctgtacctgattctaattgctacgctctcgacaattcaagtcgtcttgtcgattttgtatcctctttctattttattaaagcttaggatcaattcttagtaaaaaagtttgctttttgttgcattggtttgatttcgtgtcttgtaaagctgcttcctttaacttggtttgatcagagcagctggatcggtcatccatttgaatatgatggcaaggttgtgtatatgtttctcattttttagtgttgagagttagttttaaggactttggggttgagttggtatgtgttttttgatgcaggaatttgatttggtggttagattttgcaaggatgtggaaacaagagggcaggcggtaaaatatttctatatcatcaaattcaaaagctttttgtttctactctagattccactaatgtgcgttttcttgcgtgcagggatatgttgattttggacgatttgacccgttaagctactttgtttctagttctgaaaatttcgatttcgtgcaagtaagagctttcacttctttgctttgctctttgggatcaggcatcagaaccaattgttgcatttggtagactagtattatgatattatcctcggaacatggattcatttgttagtatatataaatatagggtttacc

SEQ ID NO: 2962 - DNA, 3000 bp, Unknown; identical to SEQ ID NO: 2956
  misc_feature (1)..( 3000): cDNA_ID_1818934_gDNA_ID_1620618_Annot_ID_162143 3000 nt of promoter + ATG

SEQ ID NO: 2963 - DNA, 3000 bp, Unknown; identical to SEQ ID NO: 2954
  misc_feature (1)..( 3000): cDNA_ID_2150275_gDNA_ID_1620618_Annot_ID_162135 3000 nt of promoter + ATG

SEQ ID NO: 2964 - DNA, 3000 bp, Unknown; identical to SEQ ID NO: 2953
  misc_feature (1)..( 3000): cDNA_ID_1016101_gDNA_ID_1620618_Annot_ID_162133 3000 nt of promoter + ATG

SEQ ID NO: 2965 - DNA, 3000 bp, Unknown
  misc_feature (1)..( 3000): cDNA_ID_3070544_gDNA_ID_1620618_Annot_ID_162126 3000 nt of promoter + ATG
gaaagcattcataaataatagacatgcactctccagtttcttatgcgtgtcttcttgtttcaccaggccagagaaaaaaaaaatctagctttatgatatagtaaacaccaccgtttcccatatctatgaactgtcccaacttctaactgtggggccaaaagcaatctagtaacagagaattcaaaagttagttttgtcaagttcttgaaattgatcattagcccattagctctatatatatatataaaaagtcatagacgcaaaaagccatttcctggtgaaaagatgaaaagcttccatccatctttttatatgtcttttagcaaacaaaaatcaaagtcccacatagtgataggctgatagcatgttccatgtttcttgtctttaccattgcaaaaactactccacttacatagatagtattttgcccccaaaaaacaaaaacataaatagtataacgtaacccccttctctactaacttttggttagcctatagttaaagttcagaattattaaaattgctaaatttgtgtaacaagattatctagctgatttcttcattttgatatctacatctttttagtcttttgaagtagttaactcatctggattttatgtcttgcaggctctactgaagtggacatggttccaaaaccattcacaaagcacatctaagcaaagatatctaaatgtatttacttgtttttgtgttacgaatatgtaagaattatctaaatcaatcaatgtggtttcatatagtataaagtattaacaatcggacaaactatagttctccttgaattccatccatacacaaatctttacaaatcgatctaagtctaacaaacaagatcgataggccaaatatcaaaactcctgaaaaaacgattcagaacatgttttgattcacttttgcactcatctcgtcgttttggcgcgtagcctgatgagaatctccatgaacattgtaatttgaggaaatttgatacggtttcgcagaaaaatcaagagatcatcaaataaaagtaatagagtagaaaattgtgtatttacttacggataaatcaatactggatcgtttagttctcgtcagatacctcatatacacgcgtctgtgtttggggggaaactttttgcatgggatgtaatttgaatacaaacgggctaaaatcgacggtggtcataactattgtccccgaaaatgtagcgttcttattttgttttgtttttttaactttcgttgtcatataaatatcatagctttatttatggttttcgtttataatatttgcgttgatgaaaattaaaacaactactataactaaggagagtacatgcactcatgcatgcatgcaaacacggcatatcgtaaaattgtaaataagcaaattcatttatcgtgtgtttttaaaacaaacaaaaaatgttatttttataagataaaacactattttacaagatattataatatttttatttttaagtgataaagagtaacagaaacgatagattacctattacaatttttcttaatactaaatttgaaagtcaagatgagaggtccctattgagctataaactttttgtcaatttgattcatctcgagtattattcgttttgtgcaaaaaaataataaaaaaatacattacatatacctttctaaaagaaaagaagagctcaagaggggtatatatattctgtaatatgttagagcacatgccttgtataccgaaaaattgcgacccatatatgaaccatgacggataattggatttatacagtccatattaataattacaattcgaattcgtttaagaaaaagaaaagacaaactattatctgtttttttctgaaaaagagagacattattctgtaatattttaaagcacaagtctcgtatatattcctggcacaaaatagcgacccatagtcccatactaacaacaatgaagaactaaataaataaaaatttgaaaactaaaaaaccgtaaatgtctttcagttatttatagaaaatactgcgttcaaaatcgttgcaagtagaactagacaagaactaacgtttttttcaaaaaaaagcattaaacaaaagataattttacagtcaaagtgattaaagttgtggatttttttatacggtgcatgcataaccatttatttcaacttcgaacttcatctttcaactaaatggatgaaattacaattatataaaaaaaaaaatgtttagtttaaaattatgtagtataattaagtggattagatttgtacttaaaaatatgacaaaaatagtagaatatagccgatattttaaacttataaaaatttcaagtacgtacgttcgaataatccttatatccataatccactagctcaaatggtgtgtttttgtttgatattcctgcgagaatatactaatcagtatttggtcgttttaataatttgaatgtggattgtggaataatttcttctaactatattaattatctgaagaacaattatcttacgtacccgtgatctacacaaacggaatcttataaatatatatctttcgtcgctgagtggaggagaacaaaacttagcaaacttcaaacatttttttaaaaaccaaaattttacactaatggtttagtcgtggttcgagttaagaaaaaaaagaatctgtttagaacatggcccaataatagttcctatgaaaatatgctttttgattattctccaagcaataataagcccaattatatttaggcccagatctgctttttgattattctccaagcaaagtaaacttatacggtcgagattttattatcattttattttttgtccttttgaaaaataccgtttaaaccctaaaagctaactgccaccgtgggtttatggtcggcaaaacccagaaatcgaccatcattcaccgtcaatttcccaactttcatgaacctttagctctatttctcaatctctgaataagggtcaatcttttctttttatcaaaatcgatg

SEQ ID NO: 2966 - DNA, 3000 bp, Unknown; identical to SEQ ID NO: 2933
  misc_feature (1)..( 3000): cDNA_ID_2150231_gDNA_ID_1620618_Annot_ID_162102 3000 nt of promoter + ATG

SEQ ID NO: 2967 - DNA, 3000 bp, Unknown
  misc_feature (1)..( 3000): cDNA_ID_2993752_gDNA_ID_1620618_Annot_ID_46966 3000 nt of promoter + ATG
tctagcgttacacataggtcgatatagctagcacaagaatgaaaactaactttatttgtcttgggaacaagcgaaagatcgaaactccgacagacgtaatcttaattcgctgagaggcgtgtgagaattgcctttttccttgaatataaaatgcactcccataatgtaatcaaacaaaagatataaatagaataagaaaaataacaactcagcgtaacggagtccgattaacggagtgagaaatcatctggtttctcgagagttctaagccaatgataatcgaaggaaacgaacggtgttgtgtgtgtgtggttaagaaaagaacaaactcatacgagacacgtgcaccgaagctttttcccacgtgccaaagagtttcgtcttcgttcacacagaaccaagatgggtggtaacgaaggtaggaccctaaagcaccagcctacaacacatagatgaaatagtatatgcgtttacatggatttgatgaattgttgtgtttagtatataagtatattgtttagaattatcaaaaagtatactttataaaaagagtggtggtaacatatttagtttctgcaccaatataaaaagaaatatggtgatgtctaaagaaaaaagagagaaaacttagccaccaacaaaatattagaagaagatttcaccatgtgaatggaagggtaatgttttttttctttctttattttgaaatgaagggaaggaagttgttataaacaaattttcgaaaaggttaatgatttaaatctactataacctttttgatcctttagtttggaacaaaagaaagtttcagagttagcgatattttagtggaaactagttgttgattctccaactaaaattcaaccaccattagcataaaacatggttattttggcgaagtagtttactttgcaacatctatctgtattttactatataaaataatacttaacatatacaaataaatagaaattaacattagaaccaatagttatatagtttagctgtttaggtaaagcttagtaagagtggatgcaatcctttcccgttttctctccgcatttcacgccgtcgaagccttattagggtttaatacaaatccataatctctcgtttccttattattaaaacatcccatgtggacaccaggactaaaaatcttgacaatcagctttatttgatgactgaagtatcaaatttaaataaattaactagttaactagttatataatgagacttattttgaccacttaggtccactaatagacaaattaaattatcttatattggttattgtcccatcgtatgaaaatcaaggatggtgttttctaccagggaaatagttacatatatagtacatgatcaaacttgaataaactacacgataatgatcattatttgttgaaatcaaataactttaacaaacaaacaaaaaaactaaaatcaaataagaatattagtagcatagtactttcattataacctttatgaaattttagtaaatagtataagaatttctcaatatgcatcgattttgatttaataatgagtaaatgaaacgaatagaaacaacattttgatttgattaaacaaatagataaaaacaagactcataaattaaaatttggaagtttccgacaattagaaaagctgattgatatcgcatctgattgcaaatctgaccagaactcgaaaatattgaaaacatattttaggaataataaaagagatgatagcttaagtggaagttgaatgtcggaccgtacgtaccgggatagttctaatagacacttctcatttattctttttccttcaattatcccaactgttacacagttatattccataaatacccctagtcaaaatgtgaattcacgagtcaaacccataaatgcagactactgtcggtgtcggtgggtgaaactagcgtaaaatgatttagggtaaaactggaatttcactatatgcaacaaaagagcattcattcacatgtttatgtcttttgtgtgatttatatcttctttcttttgacagttacaaacttacagctaatcctttgattaaggaagcatctcttaattaatctcaagtgggctgataaatttgaactttcatcagatccaagaacccaaaattatatccaaccgatcttcaaagaaacttaccaaataaattgtaaaatagtagtatatgacatatccaccaaatctacaaagttcaaaggctactaaaaccaaattccaccgaagaagaccatataataactataggccaaacaaaactacaaaatcaatttctggaacaatgtgaatttaataagtatggtaaagtctgtacacatatctaaatgacaggtacactgtgattttggaagtggaagacacttgtacaatgtgaatccattttgacgactgtccacaagactcctcactaataaaccaaagtacttcacgtactctatctttttatatcagtttaaatgaccaaatcaaatttcaacatctactaatcactaactcaaacccataacaatattcagccataaacacataatatgttttaagttagtgactagactgacgcactaaatcaatcaaccaaacaaaaaaaagaaaacgaaactgaaataaaatatagcgtgattagctgctttaattcaatcaacgtgccacttttttcaccctaatatcataatcaactcttactttattttatttctttacatcttcccgtttttttatatttccgttatatgatataaaaacaataaataaaaatgcgtaaaaattggtgggaaagcgtcggtagctcacggccacgcagtgatgatgcgagtaagagacacttgtgaagtgcaataaaacccccttcttcttcctctctttctccttcgtcttcttcttcttcttcttccttccttctctctccttattaagaaagaccaacacagacacggaagaagtagcttggttcttctctttgtgaaggtgaatgcgggag

SEQ ID NO: 2968 - DNA, 3000 bp, Unknown; identical to SEQ ID NO: 2958
  misc_feature (1)..( 3000): cDNA_ID_1821441_gDNA_ID_1620618_Annot_ID_46967 3000 nt of promoter + ATG

SEQ ID NO: 2969 - DNA, 3000 bp, Unknown
  misc_feature (1)..( 3000): cDNA_ID_1818907_gDNA_ID_1620618_Annot_ID_46968 3000 nt of promoter + ATG
gaaacctttatgacttgaaaccaaattttgacttttaagaagcgataaaattatgctatacgaggttaattatgcaacattatcccaaaaagtttgtttcgaaaatacgaccatgataatctcaataaccgtttaatatctataactaggctataagaatcctatttctattcgaatattctttaaaatccaactttatctcttcttttgcaaaaaaaaaaaaaacttcaatttaagttctatataaaacgttgtcacccatacgtttaatcagaaaacagaaagaaacatactcaaaactttttaagcagcgacgatcatagatcaaatatgaggatgaacaaaattttacttgtttttgtgtttctaagcattgccactgtaatcaatagtggaacaacaagcaactttgtccgcacagctcaaccatcaactgagatgtctctcgaaacttttccatctccggctggtcataatgctccggaacaggttttgatttcttagttctactttttgattttctggttcttagatcataaatttgtgtttggtaatttagggtttaagtttctgaatttaaaagtatcaatatcagtaaggtctgcacatgggaataattagtaacgattaattatgttttacgtacagaggccacacgttgttttttctattattatttttgtcttttttgttgaagtccctgattgtatattttgtatcttaacaaaacaattaatccatcttgatttcttgtatctttggctaggttcatatcgtccaaggagattacaatggacgtggtataatcatatcgtgggtgacccccttaaacctagctggttcaaacgtggttacttattggaaggcagttgatggtgatgtgaaaccgaaaaagaagagaggtcatgcctctacctcgtcttaccgattttatgactatacttctggttttcttcatcacgccacaattaaaggactcgaggtttgtaatttgtataatttaacttgttatataagtaacaacatcactttcttgtttcaaaagtttttataaaagtttctttcttatatcttttcggcagtatgataccaaatacatctatgaggttggaactgatggatccgttagacaattttccttcactagtcctccaaaggttggacctgacgttccatacactttcggcattattggtaattaaattttcttttacctatcttttgaaactagatataactaatacttccaactcgatctaataattacattgtgttttgtaggtgatcttggacaaactttagcttctaacgagacattatatcattacatgtcaaaccctaaaggccaagctgttctcttccctggagacttatcttacgcagatgaccatccaaaccatgatcagagaaagtgggattcgtggggaagattcgtggagccttgtgctgcttaccaaaccttcatctatgctgccgggaatcacgaaattgattttgtcccaaacattgtaagttcacattataattctctcaatttattgctttttttctgatcagtagtttcaactttaataaccatatgaatcttaattagggggagcctcatgccttcaagccctacattcaccgttatcataacgcctacaaggcctcgaagagcatatctcctctttggtactctattagacgtgcatctgctcacatcatcgtcctctcctcttattctgcctacggtaattagtaaacacgtaacatctttaagattattgtttcttgttttttttttgaataacgtgttattcatatttcaggaaaatacacacctcaatacgtgtggctcgagcaagagttgaagaaggtgaacagagaagagactccatggcttattgtcatggttcactcgccgtggtacaacagtaataactaccattacatggaaggtgagagcatgagagcaatgtttgagtcgtggttcgttaacagcaaggttgatttggttttgtctggtcacgtccattcctatgagagatccgaacgtgtctccaatattaaatacaacatcaccaatggcttgagctatcctgtgaaagacccttctgctccaatctacatcactatcggagatggaggaaacattgaaggaatcgcaaataggtaaaaaagaaaaacattttatttgattgctttgttgtcatattgttgatatgatactaagatcttgttgtggctttgatctaattttgcagttttactgatccgcaaccgagctattcggcgtatagagaagctagttttggtcatgcagttttggagatttacaatagaactcacgcatactacacatggcataggaaccaagacaatgaacctgttgccgctgattcaattatgttgcataacagatatttctttccagtagaggaattagaatctggcaacactagggcctaaacttctttagtcgttggtttcatttagaactttatttttttttgttttctttttagattacgtattttgttttctgcttggatttttgctgttcttttatttatttacttttagactttaataaagtttgtgtttgatttttccaactctcaaaatatctcggatcagcttaaacaatttttgtgaagtactatcatactatcattaacacttttggattcagtaattaatttatgttcgatacataatctccagacattatatatctaatgggttatagccttataggcttttagcatagttgggcttgggcttttgacccaactaggatttagtgatctgcaccgtaagagcaaagcctttttttttttttttttttcgccataagagcaaagctatatacagtatcggagattaaaattttcttactattagttaaactgactcttaaagcaaaagctctagtgatctgcacacaacgcgttgttttagtttcaaatagggaaacatcacgctgttttgttcgaattcgttttgtcgccgtcggta

SEQ ID NO: 2970 - DNA, 3000 bp, Unknown
  misc_feature (1)..( 3000): cDNA_ID_1819102_gDNA_ID_1620619_Annot_ID_46971 3000 nt of promoter + ATG
ctagaacgttccggtctaggccaagagacgtacgtacccgaaggtcttcaaactttgccactacaacagaatttggctgtatcacgtatagagacggaggaagttattattggtgcggtcgataatctgtttcgcaacacgggaataagccctagtgatataggtatattggtggtgaattcaagcacttttaatccaacaccttcgctatcaagtatcttagtgaataagtttaaacttagggataatataaagagcttgaatcttggtgggatggggtgtagcgctggagtcatcgctatcgatgcggctaagagcttgttacaagttcatagaaacacttatgctcttgtggtgagcacggagaacatcactcaaaacttgtacatgggtaacaacaaatcaatgttggttacaaactgtttgttccgtataggtggggccgcgattttgctttctaaccggtctatagatcgtaaacgcgcaaaatacgagcttgttcacaccgtgcgggtccataccggagcagatgaccgatcctatgaatgtgcaactcaagaagaggatgaagatggcatagttggggtttccttgtcaaagaatctaccaatggtagctgcaagaaccctaaagatcaatatcgcaactttgggtccgcttgttcttcccataagcgagaagtttcacttctttgtgaggttcgttaaaaagaagtttctcaaccccaagctaaagcattacattccggatttcaagctcgcattcgagcatttctgtatccatgcgggtggtagagcgctaattgatgagatggagaagaatcttcatctaactccactagacgttgaggcttcaagaatgacattacacaggtttggtaatacctcttcgagctccatttggtacgagttggcttacacagaagccaaaggaaggatgacgaaaggagataggatttggcagattgcgttggggtcaggttttaagtgtaatagttcagtttgggtggctcttcgtaacgtcaagccttctactaataatccttgggaacagtgtctacacaaatatccagttgagatcgatatagatttaaaagagtgagtgattctatttatcgttattaagttatgatacgaattaagaagatagagacgtatagactggttttatatatcgactatcgtactttaatttggtcggtccaaatatgtacaactaatctatccgttctctatgtattgttctcttttaagatttcttgttttttttttctttggttgttatgatgcttaattcctctcgtcaactgtttaagaataagatttgatgcgtggtagtggacttgttttcacacttcgtatatatatgaccttgtttacttttctacaaagaagttttatcacacatatttagacagggaaaacaagaggaatatatataaatgtaaaacttgccttcgtgtagaagagaaaatgattttcttaatttgatccgtaaaaatgaaggcaagtaaactggagtgcttgtacttgtagcatttaaacaaactcgagtgtgcaataattccacaagcatgttactttaaagatgggaagatgatatttagcagatcgatcttgcgcgtgagatgacgtaactgttctcggtaagatttgtctttacatgaaacagcttgagaagcccatatctaaatatctctttaatcgtgtgccaatcaattttcttatgtttggtttgtctatatagatatatgaccattgtattaatcatcacaaacagaacagttggaagtagatatattaattcatacccaaatctttcaacaaatttttaagtccaacaaaatgtcaatatcacaagttgcaattgatacctaggatttttcattaatcaatataaaaaccaaaaacaatctgtaaaccctacagcctaaatattgtatttattatcaaaacctatataaaaccctcaagtcataaaaccttaattaatattattaaataaatataaatagatttgaatcaagatcacgtcatgtttgtttgattttatttcgcttcatatcattgaagaaaatcataaaaccacatgagatgaatatcttcgacaacgaatacaatcagcgtaatatacggcttggatgatatgactatagatctttcagtatctatttaaagaaaaaatgacgaaccaaaataaacttcattcgtttgttaattaagagattattattttttcttagataaacgaaagtcggtggatagaaaaatattaaatgctcaaattattatggttggtttagtcttctgaattcgtagaaaattgagatgagctaagcaaaaatgttctttatcctcgtgagctgctccaagaagtggttgatgatgtaatggacaaactcgtttcgtggatcttatcattctaggctatggaccaatatggtgcagtcgacacgttcggggctttgtctgcattttgtggtctcgttattctgagttgtgatcatcattaataagtgagttgtaatgcattacaaaatcggtttgtagttattcatcctttccaaatcaaaagtgacatattgacaattttgaggcaagctttttgtttttataataatactaattagattacataatcttcaatttatattatttttaaaattagaaaagagcatttttaaagcaaaaattacattgaatcataaagaaatattggtttaatttatagagatgaacatgttgataattgaaacaaatttatttaattattttttgtatgcactcaactctgtttggcttcaatcatataagtataaaatataattaaaatgtttttattaaaatattagatttcatgattcttgttttagtatataaaaaaaattgatatctccatatcgctagtgaatagtgcagtatctctttacgcgctatttcaagaccaaaccttttctctcttctagagtgaaactgtggaagcaactctcacagagcagca

SEQ ID NO: 2971 - DNA, 3000 bp, Unknown
  misc_feature (1)..( 3000): cDNA_ID_2993353_gDNA_ID_1620619_Annot_ID_46973 3000 nt of promoter + ATG
tgaactcattcaaattgatgttattgtgaaagaatgtgactggaaaaacagactcgaaaatttgatctttaccactttcacagtcagaagtgacactccattgtcagccagttcatcttcatacaaaactacctgaaggagtagagaataagtacatcaaagggcccagaaaaatgtgtgtttgagtttgtatcgataaggtgaccaacctcatcatagaagagaataggttctttaagtgagagagcagccaaatcaatctgatcttcacagttctcccactgaagagtagcttccccctttggattagcttttgcctcaacctgcttcacattaaaaaagcatacagcaatgagcatgaaagtcacacttgattgattatcgtgtgacagacagaaaaagagtgaaaatgagagcaaggcgaaccgtttctttgtctttctcaactacttcacttccacagtatggcgttgtaaacgtgtaatcataatctagtatcacctgctgagacggcttgctgcaagtagatcagagtggtatcagatacaactatcaagcaaagcttccctattgaaaagaataatatcttttgtgatatatttttcagtcaaatcctgaaacttacctcctgaatttccattgtgctgcagcaggaacttcaacaggtggaagcccttcctgcttccaaccagctagtgcgtcaaacgcattaaaatgaatcttagtgttgctacctaagtgtttaaggactaatgcattctcgccaaaaaccatttcaggtaagtgagatgtcttaagctttttttcccacctgtgttacaatcaaacatcacattcgtgaatctcagaagatgctatttacatatttgagataaacagagagctataccaggaaatgtgatgagcagagatcggaacaactaaaatcagtaaccacaaaaactaaaccaaagcaaatacgattttgattttttcacagaatagatcatacactccaccaaaaactaggaaaaactcgaaatcaaggacacaattctgatttccttcgatacgttccactaatacggtgtacacgagctcaaaaacccaaactacactactcagttcatcaaattaacgacgagcacaaatacaaaaccgtaaacacaaatatcacctacaagtaatcacagacaccaacaaattcatcatatatgatcgtatcttatgaggtgagagagatagagattaagtactcttcgacagcgagagaagtgagaatcgtgccgcggagggtttcgatctcccagtcatggatgcgtaaacctcgacgtccgtcgggaagaagctcagccccggaagacttcagaacatctttatcgaccaccgtctccatctgaatcgccggctaatattggcactaccttttctcctccgacgatgtcacttgtgtgaccaaccggactatccaaccaagacatttgacttttgatgggccggcctagtttcattttagtttgaaaaaagaaggtcaatttgattttggtccttaatgggctttaagtttataacgtaggcctttttcataataatgtaatatagctagaatttcatgcttttggaacacactataaaaaaggtcaatattcaatgtttcttttttcattattagtagatttggctaaataaacctctagaggacctagaccaggtttgaaacctgacatggtggaacaccactagcccacttgttctctcaagctcaataatatccatataaatcatcaaaagatgaatcaatcacaaaaattcacaactaatttgcacgatacacctcatgaacaaaatattcgtcgtcattgccactattaacgattcaaagtggtaaaaaaatcaggaagcagtgaaaggtgaaacctcatgaatctctagactctaatgcataaacatatttcattatatatcgtagtagaatactgagacacattgacatatataagtatcaaacagaaattgtataatggtatctttattttattaacacatgtgtgcgtcaatgtgaatcagatagaattagacacactatctttttaatatttaaagttggagccgttttggtcaaaactaatttatgtgcactactcatttatttataggttttttaaaaacacaaaaattgtgaaaaagcttctaagccaggtggcgggttttggtgcaaagtctttgatatgttcggagttgctgcttcgtagagaaaaaacttttctgataacatcggagtaaaaggaaagtaagtcggagtttaatcatcttaagatttgattgaatggctacgctcactgaaatagcaacccttgaggagaagtgagttttttcttttcaccttctatttctatgtgtatatcttatctactcttttgaaattaagacagaaaagttagagatgtgttcgtaggattgggtttttgtctgaaagactgaaactttgtaaataccttttcttaaaattgatgagtttggaggaacggtttcagtaaattaggttgtgtttcgattctgttgtttttgtcggtgttcttcgtgagaatttgtctgaatttctgcatcttcctttgattgaggattgttttttgattctgttctatagcttttgctcttaaggaatcaaagaaggcaagtttttttgtcaagtcatggctttttttctgtttcggggtgcttattaatttgtttaattctgggttatttagttataatgtgtgctaagtgattcctctactagtattcaagttaatggatttgattcatctttggttttaggtatatcgaattgtgcaagatgcatggaatcctacccaacactgccattttatctgctttctttgaggtttgattactttttccttgtccagaagatctgtttagcttaatcttagtgttagtctgagtataaactacgattgaacctgatcaactgaattttaggcggaggttaaaaagtcaaggaatcaaagatgcatt

SEQ ID NO: 2972 - DNA, 3000 bp, Unknown
  misc_feature (1)..( 3000): cDNA_ID_3052345_gDNA_ID_1620619_Annot_ID_46977 3000 nt of promoter + ATG
tgagccgctcggatccttcgtatacagaggcgttgcagttcctgcgcaagctcagcgcacagcgattaaaacctcatgttaaacgggaacctgggatacatgattgattaaccatggttaggttaaccgaagatgaaccaaaggtcattggttttggctaattgacgctatagtttttttcatttcttgtgtgtacataacaagaaccacgcttaggctcttttgtttcattttacacattgtttcatctgtattactggattacacaattggaagtaaatataaagattctcaatttcatttgccagtgttcttaaactcgtgatgaataacgaacgatgatgattttaataacaagaaaaagaattaaaaaaataatcacgtgacttgtggaagcaagcaaggcaacgcgttacaaaagcacgtgacgtagcgtattggtggcaatttctcattttttcctcagaatacttactttagagcactaatccaattatcatacgacgcgtgtcccacgtttacttccttctctcatataacaacaaacaacccactccgaattttctggtattattactaatttgccattacgtcgtactgtagtgttttcttaaatttgacgtaagaatgaatgaatgttggaagagtaaaagaaaatgttaataatgtccaacattaatataaactggtttcattttcacatttaccttaagtgatacactgagatcttacatttattaaattttcttcgaacaacaaactatattaattcatagatgatagatcgaactcatatttcatggaatgcttttgcaattttaaaatgaaaaaataaaaagagcatgattaagggtattttggtcaatgtctaagagagatagctgtttccaagacttgttctccaagctggtagtgcaagatctcgttaagtataaaaagggaagctgaggaacacaattttgatacttttgagatacaacgtagaagagaagctctaaggttttcaagttctgctcaacaccactgcttactaattaaggtatccaatgattaatgtgttcatctattttaatcattagttaatcttcttaaccatcatacttccttcaagcaagctctaattattaatgtgttcatctattatgtggttaatgattagtgtgattactacattaaaggcttgcttggtatagtttccattataatccactaaaagagggaaaaagaagaagaaaatggattgaattaaaagtttgttattattttttgggtaaaaaaagggaagcttgtttagcacatttactcagttactcgtccaccaaaatcttttctatgttttattttgggtataatcttgttttcttttcacacaatcacacatcgatttcgggtaacctaagttataatatgtcattgttttgctttctgcacacacttatatatatcagcatatcgctaatcatgcacaaattatacatcacgatttctacccaacaatgacacactcattggaaaaatcccatacgtatgcaaatgtgcatatcttgataagaataatcacattttattgattaaaaatatttcgttgaatagaatgatataggcagatagtttcttcctaagtgtttttttctttggtgtgtctcgttttttgtttgttgcttaatctacatttatactcaacccattagccgcccctatataataacaaacacatatttgcatgaattttaattgtgtgatgccccgttgcttttaatcttgaaactgttagaaattaaagagaatatctagcgagagataacaaaaatatatggctatatgctgcatttttaaatatataaaacaagtcaacacaattaaatacgagacttatcgtgtaagaacttaaataacacacattttcaaataccatttcgggtagggccatatacattttaatcgtcacaattcacatcgtcgtatcgattatcacacgtttgagaagatcagaaaaatacttatactattaactctgtgtgtagattcatgtctaatatagagaaatactcaaatacaaataactaatgagataaggagttgatgactcatcacataatcataactatatattgtctaactccagtgcatggaaaactaaaacagtgcgtaacattttttagccattacattatatatagtttagtgagtaaatacatttttatcaattatatatgtaaatgcaacaatatttcgaagttttttttgtagttctttcataaacaaacaaaaaaattgtagttctttaacaacgaaaaaacagtactttgtagtgtcaatccttagaaagattgtgtgtgtttattttccttcaaagagggatattgtgaatacgttacatattggtgacgcacacaaaaacaaaaacagaaatgtatagaatacgtttaatatcaatttgacacgcacacaaaaacaaaaacagtagattgtgaaaaaagatgatttgttttgtaagtattggcgtaggccaaaaggcggcttaagtagagagtaaacgtttgcttcccgcgttatacaaagccctaattctcatcatcatcatgcgtgcaagctattttccatttcctttaacgattctcattcttactctcttcaagcttcttctttctttccccaatatcttttctcttttatattcattatttttctccctttttctctcccaaatcttttttttttctttttcccggaaaattctctctgttgttgttgttgttgttgtctctctcctgataagctcgaccaagtttatctctttctcgctaatcatttctctttaaacttctctcatcgttgaaccattttgttttagtacataaagattcttcttcattctttttgtacgcgtttctatgttacaaacgcatttctatcataaaagttattattacttgagctcaatcttcattggtttattcatatattcagatcaatcgagttcggtactgcgacgttcta

SEQ ID NO: 2973 - DNA, 3000 bp, Unknown
  misc_feature (1)..( 3000): cDNA_ID_1819079_gDNA_ID_1620619_Annot_ID_46980 3000 nt of promoter + ATG
tatgaataagttagttaggatgactttcagtttcagttcaaatatagatacatgtcacatgaaatttatctaacaacaaaaatcaattaatctttttaccctaattgattcctgcgccatagaaacatctctttaaagtgttataatgttaactgtctggtacggaagcagaggtgtggttcaacgccatcctttacttttgtccaaaatccacaaagaatgattctaaaattagcaatcaacattacagagcaacaacaactaatctcacgttgttcttgtcctaatcctcgccatcatcaatgcgtgttcggaagaggtagtcttcgccttcaagttcatcttgatatagggatattgatggatcattacatttctcatcttctttctcatcattacatctctttccctgaccaaacatgtcgagttttcaatactctcagaatatcatcactagttaaaatatatgagaaggttcactttcagaaaatatggaggcttaaatcgttcacagactgcaacctctatagaaatgcctaactttgaatatagcaggatcagatttcagatcttaagattcatttttcatacatgtggttgtgattctctccattcagctattagtattccataaaccaagatcaatttgttttggcaataagcaatacttgttactaagaacttgtggggatttgctgaagagctactataaggtaattgaaacagagaacaaatgttaatccttaagcaaagattctagaaacattgctgacctttcttaagatatagaagaaataatggaagccatcgccaaaagtgttgtactccatggaccaagtaaacttaggatccttaaacagaggacgcctgaaatgcggctgcattgacaaaagaagagtttttttttagagctattaattgagaaaatgcaagaacatgagatcagatattttgtttgaagacctggccaaaagtaatggaaatgaaaatgccatctggtttcaaaacccggtgaactccatcaagggttgccatgactttgctaacagtttctggacggggattccaaggatcaccagcatccacaaacagtacatcctacaacacgagattaattacaaaaagggacaaatcatgagctatctctccttttcaagaaaatatatactttagaacctcactgaaaaatctgaagtcctaaacaaacaatggatcgaaagaaagttgtagctcagttacagattttaccatggtccctttctcaataaccacatcaaaagactcgctgtcaaatgggaggtctagcatgtcagcttgcaccacttttatttctgaatatatcaaagtatcacatcaaatattgaacacgtcgagtgtaagatctaactttaaaccagcagaaactaataaacttctcagtataattaaatatagactattgtcagtgtctagttttaaagaatcagaattcagaaatcattgttaactctagttcttcttcattacattcatgcctatagaactactcaaacaaattataacttaagcaatacctttgtacccttttggtagcagccgactctgcatcttctctaccgccacggaagataaatcaatgcaggtaatatcaacaatcccatccttatacaactcttcacacaactgagagttcccacatcccaattccaataccttcattacaacaacaaggaaaactcaaaaatcaattttttttttgcaatcatcaagagattaataacaaaagagagatagagagagggaatgtacggaagaagagggtttgatgttggatatgatgagatgctggaaatgagagtaatccttgaaccattcatagtgttcttcagaagagaatctctcgtccctgcattcttccaagacattcagaaacacaggaaagagagagggagactacttgtagctgaatgcaattcatgattaccagtagtgaggatcgaggtaggttaaagcagaaggaggaccaacggaatttggattctccatagctggacttgctcgattctcctccttatcagctcagccaataaaccctaaaccccttttcactaatcacactagttaactaactcttatggaattggtaacagttgacttgatcttggcataaactagcttaagagttaagggggcttgttttgttataacatatgggcctataaaagcagccgcatttcttaagcccatgtgattttcttacatctacaagtctctgttttttttttttattcacgtcttaacggattacttttgtccaaatcatttaagatcagcagacttattgcctgtgacgattatcaattcattctatatttttccttgttttgtacgacacttaacctatccaatgatttgcacacacaaaaaaaaaaaaaccctatccaatgactacattttctatgtatgtatgttattgtcaatgaaaaatatgccattctcaaaaatgaatattcttgtttttattacaatttttattaatatccatgatacatgtgtagttgacaaggtgacaactcagaatcttatattcacaccaatcacacatcattaaagaaaagagtttaaccataaatttgcgacttcaagagactttcactttcgcgacccaatttttttttttttgtggcgtaggtacgctcttttagtaggatgtctcttcccattattttctcaccaaatatgaaatcaaatcccataaaaaaaataagacataaaaaattacacatgtccaattccaagtggttcgttgcattttacactaattcccaaatacatttccttgtcaattatccaaaaacatattaattcaatttttttttttttttttgacatctctattttttttttttattataaatgtggaagaggctctgagataactcgtggaccaaaatcgtccattgaagtgaacagtcagcatcgttttgcttgcttgtgcgtttctctcgaactctctccatg

SEQ ID NO: 2974 - DNA, 3000 bp, Unknown
  misc_feature (1)..( 3000): cDNA_ID_2049393_gDNA_ID_1620619_Annot_ID_162200 3000 nt of promoter + ATG
tattcatttttgagaatggcatatttttcattgacaataacatacatacatagaaaatgtagtcattggatagggtttttttttttttgtgtgtgcaaatcattggataggttaagtgtcgtacaaaacaaggaaaaatatagaatgaattgataatcgtcacaggcaataagtctgctgatcttaaatgatttggacaaaagtaatccgttaagacgtgaataaaaaaaaaaaacagagacttgtagatgtaagaaaatcacatgggcttaagaaatgcggctgcttttataggcccatatgttataacaaaacaagcccccttaactcttaagctagtttatgccaagatcaagtcaactgttaccaattccataagagttagttaactagtgtgattagtgaaaaggggtttagggtttattggctgagctgataaggaggagaatcgagcaagtccagctatggagaatccaaattccgttggtcctccttctgctttaacctacctcgatcctcactactggtaatcatgaattgcattcagctacaagtagtctccctctctctttcctgtgtttctgaatgtcttggaagaatgcagggacgagagattctcttctgaagaacactatgaatggttcaaggattactctcatttccagcatctcatcatatccaacatcaaaccctcttcttccgtacattccctctctctatctctcttttgttattaatctcttgatgattgcaaaaaaaaaattgatttttgagttttccttgttgttgtaatgaaggtattggaattgggatgtgggaactctcagttgtgtgaagagttgtataaggatgggattgttgatattacctgcattgatttatcttccgtggcggtagagaagatgcagagtcggctgctaccaaaagggtacaaaggtattgcttaagttataatttgtttgagtagttctataggcatgaatgtaatgaagaagaactagagttaacaatgatttctgaattctgattctttaaaactagacactgacaatagtctatatttaattatactgagaagtttattagtttctgctggtttaaagttagatcttacactcgacgtgttcaatatttgatgtgatactttgatatattcagaaataaaagtggtgcaagctgacatgctagacctcccatttgacagcgagtcttttgatgtggttattgagaaagggaccatggtaaaatctgtaactgagctacaactttctttcgatccattgtttgtttaggacttcagatttttcagtgaggttctaaagtatatattttcttgaaaaggagagatagctcatgatttgtccctttttgtaattaatctcgtgttgtaggatgtactgtttgtggatgctggtgatccttggaatccccgtccagaaactgttagcaaagtcatggcaacccttgatggagttcaccgggttttgaaaccagatggcattttcatttccattacttttggccaggtcttcaaacaaaatatctgatctcatgttcttgcattttctcaattaatagctctaaaaaaaaactcttcttttgtcaatgcagccgcatttcaggcgtcctctgtttaaggatcctaagtttacttggtccatggagtacaacacttttggcgatggcttccattatttcttctatatcttaagaaaggtcagcaatgtttctagaatctttgcttaaggattaacatttgttctctgtttcaattaccttatagtagctcttcagcaaatccccacaagttcttagtaacaagtattgcttattgccaaaacaaattgatcttggtttatggaatactaatagctgaatggagagaatcacaaccacatgtatgaaaaatgaatcttaagatctgaaatctgatcctgctatattcaaagttaggcatttctatagaggttgcagtctgtgaacgatttaagcctccatattttctgaaagtgaaccttctcatatattttaactagtgatgatattctgagagtattgaaaactcgacatgtttggtcagggaaagagatgtaatgatgagaaagaagatgagaaatgtaatgatccatcaatatccctatatcaagatgaacttgaaggcgaagactacctcttccgaacacgcattgatgatggcgaggattaggacaagaacaacgtgagattagttgttgttgctctgtaatgttgattgctaattttagaatcattctttgtggattttggacaaaagtaaaggatggcgttgaaccacacctctgcttccgtaccagacagttaacattataacactttaaagagatgtttctatggcgcaggaatcaattagggtaaaaagattaattgatttttgttgttagataaatttcatgtgacatgtatctatatttgaactgaaactgaaagtcatcctaactaacttattcatagtattttacatttttactatctttctttttttgttgccaacagattcaattttagtttgactactactactagtaatatccaaaaaaaaacgaatcttcaaatcaaactctaattggtgattagagtggaaagaaaagaggaattgaatttacgtatgtacaaaaaagaagaaaatatccatcaatgcgcttagtattaaaaaaaactttcacaattatggcaaaaaaaacactttcacattcggaccaaaacgacgacgtaacataaatgtatcgttttgcataaaagcagtaaaagtgagagagagagagagacagataggaatctttgagcgattcgtcttcctcctctatcgccctctactcttcaccggaactgtgatctcaccggaatatccctcctttatttatcctctactcatccgttttactctctccctccgtcgatcttctctttctcttgatcgcctccgtccattctttatcatttcttaattcagaattgtgatcg

SEQ ID NO: 2975 - DNA, 3000 bp, Unknown; identical to SEQ ID NO: 2973
  misc_feature (1)..( 3000): cDNA_ID_3093197_gDNA_ID_1620619_Annot_ID_162198 3000 nt of promoter + ATG

SEQ ID NO: 2976 - DNA, 3000 bp, Unknown; identical to SEQ ID NO: 2972
  misc_feature (1)..( 3000): cDNA_ID_3052345_gDNA_ID_1620619_Annot_ID_162195 3000 nt of promoter + ATG

SEQ ID NO: 2977 - DNA, 3000 bp, Unknown; identical to SEQ ID NO: 2970
  misc_feature (1)..( 3000): cDNA_ID_2049420_gDNA_ID_1620619_Annot_ID_162187 3000 nt of promoter + ATG

SEQ ID NO: 2978 - DNA, 3000 bp, Unknown
  misc_feature (1)..( 3000): cDNA_ID_3082954_gDNA_ID_1620619_Annot_ID_162183 3000 nt of promoter + ATG
ccactgttacaagcccatttccctgcaatgatcctcctagcagccaccttcaaccacaacaccacaattagagtatgagacctgaatttaactattttatgctttagaagcagagaaagatcttaacttgtagattaacatctgaatcaacaagagctgggcacttcccaccaagttcgagaaccactggagtaagatttctcgcagccgcagccattataatgcgagcaactcttgctccacctaaagaaatactttaaactatttaaaataatgttttcctgagatcctaatcaacatttcaaagattcttgaaagaaaaggagagaggacaaaccagtgaaaaagatcttgtcccatttttgatccagtagtgccgttgtttcagggactcctccctcgataactctgattgttgtattgtccaagtattcactaaacaactttgctaaaagagaagatgctgctggagcaatttcagaaggttttagcacaaccgcattaccagctgcaatagctccaatgactggctcgacagacaatactaaggaaaaaaacaaagcaccatgaagacatataaactttaatagtttagaaattgagacaaaattgtcaataaataaaattgagcttacagaaagggaaattccaggctgaaataaccaaaacaactccaagcggttctgagactatttgtgcagacgagggaaatgttgtcacagaagttttgacctgaaaggtccaagcatagaaaaagcaagtggttttagaaaggacacatatcaatgaagcagcaaagcttgaacggtctagttaccgtttctggagccatccagttctttaactctttgattgcaagcatacaggatgattttgtattcgaaatctaaaaaacgagaaaaataccaaagagattcaacagtggataagtggaatgcagtgaagaaacgggacattgaaattatataaaaaacctcagctagaaaagcttcaagctcaggcttagaaagatcttgatacaaagcttcggtgatgcatttctccttctcatcaatcatcctagcaatgttttgaagctgagaaattctccactcgtagctcttcgttctgccagagttgaagttgcttctgagctcatctacaagcaaagctgcttcttttccactaaagtctgatgcttgctcctttaccacagcagatagtgttgcataacaagtactgattcaagacaccaaaaccgcaatgtgagagactttaagactaaaaatcatggataagactaaaaaaacatggataagtatcaactgttctcacgattatttattcataccactgtacttaaacttaaaacccactatactaaatagaaaggtaatcatcaaaaaatcagtatgtaaaaaccacttttgtgaataaaatatgtaaaatgggtgaataaagaaatgtgcttacaatttcaaccgataagggatacaagcattgctgcaatatccaccaccaccacgacgagatatccgaaaaggtgaagttgcaacatttaatctgcaacaaaagaggccattcattaaaatggtactaattagatctaatcatatcatattgaatgaccaaatcattcacagaagcatccattgctccaattaacattctagaccaaattcaacttaaaggtaactcttttatacaggaaaccgagaaaccgaaaacgcaattcacataaaaaggaaggcttgtttggagaagcagaatcgaacaagtcaatctcaaaccctgatgagcaggtttttcaagttacctggcaggagaaaaacccttggcaaaacaaagggtttgaatatgattaatctctagaagcttcgtcatgacttgggttcagttaaaaatctcaaattggagacattattggtgtttatatatttgagagagagagccagagaggagacgttgaattgaatgaagggtgtggtcggaagagaagacgtgtagaagagacgagacaagtaaatttaagcattggccccatttacagccacaagtccgctacaacaaattatttccaagaaactctgagataacgtcgtgatgaaacggctcatgctgctgttgtgattcgtgaattagaggtttatcttttgggtttttgaatgttacttaattggacggtcgatttttcaaactgggtgtgaaatgtgaatgggtcattcataatgggcttttgttttaatgtgaagccattcacacactctttgtccttcttttctattattcataactgtcactctttgttcttcgaaatagtaaagagcaaatcgattctttgttgatctgggccgtaaaatttccatggttgtgggaagtattctcgcagctgatctgggccgtcaatgctacagtttcatgtcagagagaggtcaagaatcaacacgtggccaaccatgattttaaaccaaagcaaacacacgattagaccccacattgtttgttcaccaacccccgtggaccctcctttagccgacgtgtccacgtcaatagtggtttttcttcctttcaaagtacacaaattccattctttctcattttactttttggattacgttgttgttataaactggtaaaatgaattatgaatgcaaataaatttcatttaagttttgttggcttctaatatttttttcacctaaaattctaataaactacacagccatgagccatcgtatgaaaagaagaagaaaaaaaatgtctttttctagaaggatctttcaacgactaaaaaagattttaagcttttgactaattttgtcaataatatacacaaatttacactcaattatagccatcaaatgtgtgctatgcagaaacaccaattatttcatcacacatacgcatacgttacgtttccaactttctctatatatatatatagtaatacacacacataaacagcaaaagcgtgaaagcagcagatcaagataagaaagaagaaagaatcatcaaaaaatg

SEQ ID NO: 2979 - DNA, 3000 bp, Unknown
  misc_feature (1)..( 3000): cDNA_ID_3070582_gDNA_ID_1620619_Annot_ID_162182 3000 nt of promoter + ATG
ggagatgcttgagttctgtaaagaaaagggtttgagttcgattatcgaagttgtgaagatggattatgttaacactgcgtttgagagactcgagaagaacgatgtgcgttataggttcgtcgttgatgtcgaaggaagcaatctcgacgcttgatatcatgaaactcgaggctttttatacatactcgaatactcgatttaaacactcttatgtttgtttgtgagctttttcattcgtgtgtcactatttttcatgagaaagtggtaaaagatataatgatattggatttctaatcatgaatcatatgatatatgtgttaaaatatttgcccttatgtcgggtttgagtcttactatatgaaacacaattcttcggactaaaaacagtgactgaaagcgaaatccaactacaaagtacgacttgcatattatattttattcgttaatatttgtaagctgtggtataagaaacttgatgcgagtgtttggtccttgaatcttttacaatagtatgcatcgttgacgatttcatgtttatcaaagtgagtggtaggttaaggaagactaatttagatgtacgaccgttgattataattttttcatgtataaatgttgatacacaattggtggtgcaaattgaaattacaaatgtgtgcaacttagtcaaatgcttagttggtagataaagagatgtctcttggtgctatgtcagaacctctattggaccagacaagagagcatggcgtggatatttatatttgaagtcgataattcgttacccttttgggctttatatacgattccctcttctttacaataagtggttggatgattgtttaatatttctaaaatttcagattagaaaaaaaaaaaaaaaagagaattcaaaaacaatttaaagaataaaacactatacatctaccagctatgaggagtccataactaagatatagagtaatatgttggatctgtgtcaaaacaaatattttttctcagatcattctttaagtacaatctgaccatcattcttgacgtatataatatgtgcagagttcttgggattcactaacgttgtcatcatggcatattcatgaaatatgtcgacagattaaatccgcttaagatcatattttatagctatagtcaaatatttaagatccattgtctacaataaaagatgacattatcttttatggggtatcagatcggccataggcacattattagctatcagcctccgaccaaaaaaaccaaggcattgaatggatgtatataactatataactttacagcttttggtttatagatgagacgtttacactggggtaaggatgaagtgaaaacgaaaaaaaaaaacattagacctaaaaaaaaacaagaaagagaatgaatatactttatagattgtataaacgacatcaacccgtgatcgttacgtctaggaccagccagatgaatatactttatagattgtattttttacttacgtccaaaaaatcttatcttatgtgttttagaaattgactaggtttaatccccatcatatccataggccccttttataatgcacatgtgagattcttaatgatcaccatttaaactttctccgcgtttacacaaattacgtatcttaaataactaacactcaactaaagcctttgatgaatattattattatgctacttatacacgacaagaaattgtcctaactacctacttgttgcgaatgaagcaagcaaatatgtattaagataatttatgtttatgcctaattattatcttaatcaacaaactataatttacaaaattgttttgtgtgactgttgctctctcggacaacactcgtttatttcgcatcaattattctcattcttatgtgactcactcaaaaccaaataagatggaccacttcgagccttgtttctgttatatattcgtccacaggctacactgaaagcgatgcggtcatagcccattctctcgtcgctttcatgtttgttctccaaacctttttttttctccttgattgtgctactgctttggcttctttcaattcttagatatttttaattttattttcagctataacttcatttaatatggctaaatagttttcttggtttagagtctttagactaaggaataatttcatgaccatatttttaacttttcgattttcgaaagattcagtttaggcctaactcagtttgccaacttgtgtagtgtgtgaacaatttacacaaaaatcaaactctgcaaggtcatttttccaaaattttgattattaaaaaaataaaaaaaaagatgaggataactgacatgtcagttttgtggtgtcccttgttttgtctttgattaatgtatggttcatttcatacgagaccctctgttttggcaaacctataacgggttttctcttataagttctaagatgagaaagtactacattgagatataattactcaattacatactgtacttagtcgtaataatagtcggtgattatccttttaaactttctatggaccgaaatgttccagaaaaaaaatgcaatagtttagacttttaactttattttattagcttttcttcatgtaaaccaaaaataacccaaaagcaagcggtaataattattctgtcccccatgaattgcttttactttagtgaatgaagtagattttaaatgcgaaaatatggctgctgctgctcatttacagttttacactaatgaataaatatgatcaagaatcattgattctacaccttgtcccatgtcaagtctagtcaaaagcttattttatcaactccggctctttaagattctctctctctctctctccttcaccatctcagagattgctccactatctcatagatttggtgaccagaacaacttatctcttgagtggttcaacctctatctctctctctttctgccatgaaaatgcaaagccaaatgtaatagttagagagggagaaaccaagaactgaaagaccatg

SEQ ID NO: 2980 - DNA, 3000 bp, Unknown
  misc_feature (1)..( 3000): cDNA_ID_3070589_gDNA_ID_1620619_Annot_ID_162179 3000 nt of promoter + ATG
tagacaaagttatcataatcgatcaagacgttaaaaagaaaacactaaaaaacgaaaaaaagaaaaagaaagctagttagggttttgattcatgggctcattcaaaagcccattgattctccttacgaacagcttcttcttcctcaggtgtaaaatcattctcaatgttgaaagttgaacgaatctcctctggagtcttgcctttgatcatgtccgcaacagtttggcatgtgagatcaagcaagctttttatgttgaggtaattcgcagcaaggatgagttcaaagatggtggattgttcgagatccatgaacttctcgtcccagttgttgagatcctcttcagagataggattagcctcgtcgacgtggtgtttcttgcagtactcgatcactttcacaagaatcttgctttccacgtttgcaagagggattccatcagcaacgcaatcgtcttcaaccatatgcgctatggtctgcgattggattgctaccgcttcttccacctcaaacgactgaccatcggagctcatcaacacgatcatcttcgaagacattgtgtgttccttgtggaggaggtttttcactgtgaagcaaatttgatgaaagatttaagaatttagagagcgaacaaattgtgttaaggtgatgaagttgtgaaaccctatgcgtctttgtatttataagccctagctagagtcggtgacaacaacatattataattcaacgcgtggtacactacggacaaatattttatttatatatataataattttaaattttataattttatatttagtaataaagttatataattttatattaatcttgtaattaaaaaaattagtgatgataaaataataaaataaatattttacctgtgttatatcaatccaaacccgtctcgatgtatttcctatcaatccaaacccgttctgctatacttcccgtctcatgatattttaattttttatgtttaaatattaataatgtttcataaaggtaaaatatatcactaatattctttaaaaataataattgtttttgactttaatgtgatgacattctttgtaaattcttactttactaacacaaaagtactttaaaaagtacttcaaaaattttaatatatataatgttattttttggtaaaaattattataaataaatatttaatttaatcataatttgggattgatatacttgtgtttttaactaactattttttattttaataacctaaatttaggcatttgttaatattttttgaatctgcaatatcaacttaatacatgtacaatttatttttgccaaaaaagagcaaaattatttagtacaattgaaacgaaaaatgttgattgagaaataattagggtttcaaattttattacgcaattatttttttaatgaaaatattaaagcatatattgtaatataagatttgattcattttattaactgaaaataaatgatgtaaaacgaaaaatcagggtgattaatgctaattggaaagatttaaatgttttttttttttttaatttcataaattttagtaacataatagattttatatttatatttaaaaataagtttagtaaaataataaatgtcaatggcatgccatagtaaataagtgctaagtgaagatttatttgttaaagtggctgcaaaaatgtatatatagatagttattgtttctaaaaaaaaaagcaattaaaaaaataacgaaatacttattttccttaactgaaagaaataagtaattttatgttgctgggcctttatatgagttttattatgctgttgtaactttaccatggttgggttaaaatgaaagaatgaaaaaaaaaaaaaaaaagtaaattaattgtcgactcatttttcataaaaggtaatttcagttgagtaaaccaaaataaaccaaaagatatacgaagattcaacagtacacccatccacgcgcggctgcgttgaatactatacggggggtgtcaacaggtcgacctaccaaaaacaatgcatctaagcagttgcaaagacacactaagcaaatctttcacgtgcaataaattatacttacgtcacagccatcagtatatcctttcaaatattcctcctcacaattgatgtatttacatgtgtgtaagttgacacaaacaaatcacttgccctgaaaactaaaactctcgagttttttcaaaaagaaagtccaattcaatttaaatttgaagtcttcaatttgttttcaaatactaaaaagtgcggctctccctctagtgtatggcctcgtttactagtagtgcggggaccttttaatcttttattactacttgttgcattcaagcatgaagcatggacagacactcccttagaaagaaaaacaaaattatgaaatttcctgcttcattttgaaatttctgcggaaacttatgatttggatatattataaacatagtaactcctctacattaaaaaaaaacattacaagtcttcttttcatttgggacataaatgttaaaatcttttatagatactgtatttaagtcaatgatctgattatctgacagacatcgtgagactcctcatgccatcaaaataaggcttcttcaagatctctatttgcattgtcaaaaatcttcaaagctgtaaataattttcgagtaatcttttgttctcggtcagagagatatgtaataaataaagtttacttttcctcaaagttgtacatttttttttattttttgttggtttggcaatttttccggtaaactatgcaaattctattcgccgaaacattttgcagatcactaaaccaaactgaatcacacgcgcgagccaaatgcgcgtgagatttcatcaccttcgtcaaaatactatcacatcacaccaaacccctgagccgactataaaaccttttagatctctccctcgtgttataactccgccaccaacaatatttttctctactcaattcactcacactccaaaagcggtagcaatg

SEQ ID NO: 2981 - DNA, 3000 bp, Unknown
  misc_feature (1)..( 3000): cDNA_ID_3070593_gDNA_ID_1620619_Annot_ID_162177 3000 nt of promoter + ATG
attcgccagttccctgtctgaatcaggagaggttaaagtggaaggaaaggttaaagacggagtcccgcatttgacaaaggttggatcttttgaggtcgatgtaactcttgaaggtagtatcatactgtgcaggcaggtggatcaacctggtatgatcgggactgtcggaagcatccttggagagtctaatgtcaatgttaacttcatgagcgttgggagaattgcaccgaggaagcaagcgattatggcgattggagtagatgacataccaagcaaagagacactgaagaagattggggaaattccagcggttgaggagttcgttttcctcaagctctagtttggtgtgttgttgattcttgaatcttaaatctcaccggtgaagatttgatgttgtttgttggtttaggcaataatgttattttggctttcatacagttttggtaacgttgagagtagtgtctctttgatgtttcaactttatggtttctattacttgagtgcttctttcttctctgaatatttatttcctgaatattagtgaccacaaattggtttataacccaattgaacgaaccgatgtaactatcgtagagaatctgttaattaagccaatccaatttttcaaaattggtttggtttggttcagattaggttcggtttgctctaagagatgcagttgtttgtgaaacgccaccgttttggaaaactgtgtagctcgaaaagatacgaacttaatgagtggagagaaaacacgtgtcctcagcttgaacagataattctgcgactcttgagaaaggaagacgaaggaaggagaatagtagaagaagaagaaagggagagtcttgtgatatctacgtagaaggaagatggccttatctcaagtgtctgcgtctctcgccttttctcttcccagtactctttctttctctcttcgctacccttcttcttcctctagttgtacaattgtctctataatgtatgtatctgactagtttcggatttcatgtttccagattctggtgccctaaagctagccacaatcacaaacccaacttctacatgtcgggttcatgttccgcaacttgctggaatccgatccaccttcgcttctggttctcctctctgtacgtcttccttgcccctgagaaaattcttcaattctctacattttgaagtttagtttgaaattgggctcaaattttgatatttctgattactgaattgttcatatatagtttggttatctgaaatatggggcaacaatatttatcataaagttttctaattttgctttctgcattgtctttgttagctgagtaaatccatggaaaaattgaaactttgtttctttcgtttttgtatgttgtgtgtgtccgtttcagtgccattgaagttgagtatgacccgtagaggaggaaacagagcagcatcagtttccataagaagtgagcaaagtacagaaggaagcagtggtttggatatatggcttggtcgtggcgccatggttggttttgcagttgccattactgttgagatttccactggaaaaggacttcttgaggtaatcaaacatcataactgatattgttgcttatataaaagttgaaagtttgagaaatgtaagagaagtagaataacttaagatttgatttgtcttcttatttcagaattttggagtagcaagtccattgcctacggttgctttagctgttacagcattggttggtgttctagctgcggttttcatcttccaatcttcttctaaaaactgatcgacaagaatcttgttttgtgatgctgccgaggatcattttcttgtattaagaatcttgtattatatatcactgtaacttctacatccatcagtggagaatcttacattcttagttttttttggcaacatacatgatctatacatgtcttttggccaaatcttatttttatatttttaatacatgatctataacatgtattaagtttgaaaacataacaaaatttttgtaacaaaaataaccaaaatattatttgaaaaagaaatatccaaagttttaatagtaataatacaaaaatagaagtttgaaaacattttttaataaataaaaaagtgttaaaaatttatcacaacgctaacaaacaaattcacctaaccgtttacttttagaatcagaaataaacaacaaaaataaactttcagaaagttgcagtttcacatatgttacaaacatcatcagattctttgaaacaaaacagtaaccaagaagtttcttatgcatagctttgttcaaaatcaatactttggagttagtcaattaaattcatatgcaaatctctgaccttttgcttttgtaagctaaatgcattgaaaaaagggagaggctctggatcagtgtgctcatggtgggccggcccatcactatgggctgtctaaaacaaaaacaattttggaaggcaaaaggtataataaccccgtccctgtatgttgggctaggcctgtccagtatccaccaccactaactcaattcccccattattacaaatttacaatctctccaccaattggccaacaatggagtatatattaactataaagcaaatcataaagcttctatagtaacatcaagctatgaatatttttatacgttctgcaagaaacgtgacatcaacattttgtgattaaaccgattcttaatttgtccctttctatcatcaagttaaaaacgtgacatcaacactttgattaagagaatcaagaaacgtgacgtcaatattttgatgaagcttgtgaaatgtggacagctattttatcctcgatgatattcagattgttttaataaaaatcatttcagctatttttagtcaatatagacggttttgccaaactcaaaagtcaaaagtcaaaggtcaaaggagtccattatataaaccatagcttaatcatttgattactaaacactagtataaaaaattgaacccgttaaccggcgacccgaaacaatg

SEQ ID NO: 2982 - DNA, 3000 bp, Unknown
  misc_feature (1)..( 3000): cDNA_ID_3093183_gDNA_ID_1620619_Annot_ID_162212 3000 nt of promoter + ATG
tgtcagcaaaaacgacatcgtttaagctcgacctgttcgtctcgatgtttacgctttgattagttactatttttctgcaattctgtttcttctctgtacatcaccaacaacatttaaattccaatggcgcattttaaatgtcaataataaatcgagatccgtaatttcgaagctacaagcaaaccttcttgtgcttctctaatcattgcgttttccttttaaagagtttctcaaagttttcccttttttttgggcataaaattgtttccttttcctcctatcagtgtgtctgaaaaaaattcaatgtctttatgttctgttcttttctgatctctctgaatctctctctatcgcgacagccatggccgaagacccttctttcctccccaaggtacctttcgttctgtgttctgtgagtggtgttgatctgattagctgatttgttctctagtttcaatcttagctcttagttatttttttgagttatttcatattcttatactctaaatctataaaacttgattctttcagcattataaaataaaaagattctgagattttcttgattttatatagacgaatctgtggtacccatttgacttaaacaaacaaacaagctaattaacacgaggacatataaatgtattgttttttttttttaatgcaggatggttttgtcttgaagcttcctaaaaagtcatcacttgtattgagaatggtcgttctcctctttgtaatggtctgtgctgtgtacatttgctccatttgtcttaagcaaataggagttagtccaaactatggtttcttgaacgttgaagtgtttgagaggccttgtcctgagcctaacatcgaaccgtgggacattccttttgtgcattaccctaaaccaaagacatataacaggtaaagagagatacaaaaagtttgagcctttatcatgttttgagtctaaaagcttgtattgattagtgcttttgtgggttttgaatgttttagggatgaatgttcttgccacccggttaggtactttgcgattctatcgatgcagagatctggtagtggctggtttgagactttgttaaacaatcatactaacataagctccaacggggagatattttctgtgaaagataggagggctaatgtttccaccattttcgagactcttgacaaagtctataatctagactggttgagtagtgcctctaagaacgagtgcacttccgctgttggcttcaagtggatgcttaatcaggtaaagtgattgttattcacggacactgtgacatatctttagtctttcttactcatatgttttcgactcgtctctgtttccatttgagtgcttgaacaaagagattgctatattccatccttatctgttggtcactgttgcttataactaactacttgtgaatttaaagtgataagatcttgttctgttttctagataagagcagcaacgttttcgttttacaaaagatgtgtgttgagaataggacaatttctcaataatgtgtttgcttttgctatatactttgtaaagttgataaacacgttgcagggattggtcttagagaataggacttcttttcttccctcagtgctcttcacttataagggagtttccgagtcaatgtcatttgaaactaacctgttctatttaggtagcttctttctggttgttgatgttcaaaaaagttgcctgaataaaagtttaggttgaaatagtctgtgatttgatgttggaggaacggaagatagctgatgttcccttcttatttgatccataaacctcggttctatgtagcagtaattgaactgataaatgatcacagttattttatctgatgatgaattattaacattgcagggtctaatgaaacatcatgaagaaatagtagaatacttcaaaacccgaggcgtctctgcgattttcctattcagaaaaaacctattgcgccgcatgatatcagtactcgcaaactcttatgacagagatgctaagctactaaacgggactcacaagtctcacacccattcggccaaagaagctgagatattagcaggttacaaaccaatgatcaacacaacacttttaataaatgagctgagacagattcaagaaatgactttgaaagctttgacttacttcaataccactcgacatatccttgtctactacgaagatgttgtcaagaacctcacggtaattattacatatttttttattgaactagttccagttactgattgtttattatcttatatgtgtttttgaatgaagcagagactagacgatgtacaggagtttctaaaggtaccaaaacgtaagttaaagagtaggcaagtgaagattcatggaggttcattgtcaaaacatgtacagaattgggaagaggtcatgaccacacttaaaggaaccaatttcgaaaatttcttacaccaagaattttaatttttttttgtatatatcagaccaaacaaacccttgtaggaaagttttgtttcacttgccttttttcttttttgctgtttgctgtagggtttggcattaattctcttaaatatgaagaagatttaaacaaaatttcgttgaaaattgtttcttcccctgaagagattttttatctaaatttcttaaaagcagaagaatcacaaaattatagtgaaaccgaaagaaaccagagcgatttagtttgatttattttgttcaattcaacatcaataacaccaaaccggtaaaaaccggaaggctaattcgagattgattgatttaaaccggacaaaaccactcaagccgcgtgaccgagtttccaacacattgcagattccagtcccaaaaagaaaagagagttaaaaatgcaaaaacggtgaaggggaagagaagcgaaattgggggattgggaatagcaacgttttgcaaatggtctcttctttgtagctgcaattgcaaagaacactgagagagagagagagtgtgtgtgtgacctttgagag

SEQ ID NO: 2983 - DNA, 3000 bp, Unknown
  misc_feature (1)..( 3000): cDNA_ID_1819067_gDNA_ID_1620619_Annot_ID_46984 3000 nt of promoter + ATG
taaaagtcaatatttgctctagaccctccaattttccgtaaaaatctccataaaagtctctgtccctccttgccaaccaaaaactacaaacacacatcatccttcgactatcttattcatagctatcaccacccaaaaaagaaatcaccctaatcaaaaaaaaaaaggcaaggagagattttatcattattctattttcatattttttgaaaaaactcaagcaattgacttttgtgataaagatttgaagaaagagatgaggaacgaaacgggtggtaccatggtcgttgatctccaaaccgatccatataacaacattcacagtcgccataatctgagctacgaccttagcgagggtcccaaacctaggcctaaatttggtaatatctcgaaaactgaccacgacgagatattccctcccgacgatcccatcattatcaacagcaacgtgactcaccagcggtttagcagcgtctcggcctcgaccatgagcagcggtccggccagcggagaaggttctccttgcgtaatgtcgccttgggcccgcgtgtcgcctccttggggtgcagatttcaacgaagacaatgtcctcgagaccaacggtctcattggatctattgttagaaaagaagggcatatatactcgctagccgcttctggtgaccttctctacacgggctcggattcgaagaacattagggtttggaagaatttgaaggaacacgctgggtttaaatccagtagtgggctaatcaaggccattgtgatattcggagaccgaatctttaccggccatcaagacgggaagatccggatttggaaggtttcgaagagaaaaccaggaaaacataagcgggttggaacattgccaacatttaaatcaatggtcaagagctccgtcaaccctaagcatttcatggaggtacgccgcaacagaaactctgtgaagacgaagcataacgacgcagtgtctagtcttagcttggacgtggagcttggattgttgtactcgagttcttgggacacgacaatcaaagtgtggagaatcgcggattcaaaatgtttggaatcgatacatgcacacgatgacgcgataaactctgtaatgtccggttttgatgacttggtgttcacgggatccgcagatggtactgttaaagtgtggaaacgtgagttgcaaggcaaaggaacaaaacatacgttagctcaagttttgctcaagcaagaaaatgcggtcacggcgttggccgtaaaatcacaatcttccatcgtatattgcggttcttcggacgggctagtgaactattgggagcgttcaaagcggtcattcacaggcggaatactcaaaggccacaaatccgcagtgctttgtctaggtatagcggggaacttgctgttgagtggttccgccgacaagaacatatgcgtatggaggcgggacccgtctgacaagtcccatcagtgtctctctgttttgacgggacacatggggccggtcaagtgcctagccgtggaggaggaacgggcttgtcatcagggagcaaaagcctcagtggccgagggagaccggaagtggattatatacagcggaagtttggacaagtcggtgaaagtgtggcgcgtgtcggagagaatggccacgtggaaggagatggacgagccagcagcatcttcagagcggaagagctcttcgtctccgcatgaaggaagtggcgcgtggagttcacgcaatgtggaaaaataagagtggaggagcatagtgtgattatttacgagagtgtcacgtcgtcacgagagccatattcacgccgggaaagagacagaggattgatttcatttttatgactaagtcaacggagaggtttgtgccacgctagctggtgtgagaatcaaagtcgggttaatggttttcacgtaatgagttttttggttatttttttctttaaaaaaaatgtttgaaacgaaattgaattatttatttattttccataaatttgtaagataacaagaacaaagaccgaatcaaacatatatatttgttttctttagtggtctatgtcgtggttgcaactttataacttggaattttggatgagtcgttttcctcttcattagaattagtctttctatattattataatataggatgttgatattttttaattgattttccaacctggaaatatccacccaaagttgttagaaattactaatctttgtgaatttactgttaccatttaaacctaatctatctttatgagcaaaaaaaaaaaagtcttattcaatcacttaaccgaaaacatttccacaaccgggatcatcatatatgtctctgcgcctctctttgataaatacttaaatagggtcaacacctccggttttctattaaccgtgtaattcgggttatgcgaacattattgcaggaccgaagatatatttacgaaattgccctctctctttgactccatcaacgcctttcgcaacgcatcgttttcaactcccctaacccgcgttgacggcaagaattttcccggaaaataactcatttttccttttgattgcagagaaaataaaaaacaaagagaaagtcttcccctttttttgtcaagtcctcgtcttttactagtgtatacgatccaacccatctttctgtctttcttctttttgtttacttcttctgcaaattcccttttcccggaaaatttatttgctgatttttcttccttccatcgccactttcctggaaaaaaaaactaaatttcgtctctttctttaagctaaaggagctttctgtgatcaattttttctatatttctgtagttgcgttcttatttcacgcgctttgtgatttgattatttaagccactaatggcttaggatctgtatattatcacttcatgaattctcgttttctcggataagttgttaagtttctaaattagggaattttaggaattagggcttttttgggtttgtatgtgtgcttgattgggtaagaag

SEQ ID NO: 2984 - DNA, 3000 bp, Unknown
  misc_feature (1)..( 3000): cDNA_ID_1819055_gDNA_ID_1620619_Annot_ID_46988 3000 nt of promoter + ATG
actttgcgattctatcgatgcagagatctggtagtggctggtttgagactttgttaaacaatcatactaacataagctccaacggggagatattttctgtgaaagataggagggctaatgtttccaccattttcgagactcttgacaaagtctataatctagactggttgagtagtgcctctaagaacgagtgcacttccgctgttggcttcaagtggatgcttaatcaggtaaagtgattgttattcacggacactgtgacatatctttagtctttcttactcatatgttttcgactcgtctctgtttccatttgagtgcttgaacaaagagattgctatattccatccttatctgttggtcactgttgcttataactaactacttgtgaatttaaagtgataagatcttgttctgttttctagataagagcagcaacgttttcgttttacaaaagatgtgtgttgagaataggacaatttctcaataatgtgtttgcttttgctatatactttgtaaagttgataaacacgttgcagggattggtcttagagaataggacttcttttcttccctcagtgctcttcacttataagggagtttccgagtcaatgtcatttgaaactaacctgttctatttaggtagcttctttctggttgttgatgttcaaaaaagttgcctgaataaaagtttaggttgaaatagtctgtgatttgatgttggaggaacggaagatagctgatgttcccttcttatttgatccataaacctcggttctatgtagcagtaattgaactgataaatgatcacagttattttatctgatgatgaattattaacattgcagggtctaatgaaacatcatgaagaaatagtagaatacttcaaaacccgaggcgtctctgcgattttcctattcagaaaaaacctattgcgccgcatgatatcagtactcgcaaactcttatgacagagatgctaagctactaaacgggactcacaagtctcacacccattcggccaaagaagctgagatattagcaggttacaaaccaatgatcaacacaacacttttaataaatgagctgagacagattcaagaaatgactttgaaagctttgacttacttcaataccactcgacatatccttgtctactacgaagatgttgtcaagaacctcacggtaattattacatatttttttattgaactagttccagttactgattgtttattatcttatatgtgtttttgaatgaagcagagactagacgatgtacaggagtttctaaaggtaccaaaacgtaagttaaagagtaggcaagtgaagattcatggaggttcattgtcaaaacatgtacagaattgggaagaggtcatgaccacacttaaaggaaccaatttcgaaaatttcttacaccaagaattttaatttttttttgtatatatcagaccaaacaaacccttgtaggaaagttttgtttcacttgccttttttcttttttgctgtttgctgtagggtttggcattaattctcttaaatatgaagaagatttaaacaaaatttcgttgaaaattgtttcttcccctgaagagattttttatctaaatttcttaaaagcagaagaatcacaaaattatagtgaaaccgaaagaaaccagagcgatttagtttgatttattttgttcaattcaacatcaataacaccaaaccggtaaaaaccggaaggctaattcgagattgattgatttaaaccggacaaaaccactcaagccgcgtgaccgagtttccaacacattgcagattccagtcccaaaaagaaaagagagttaaaaatgcaaaaacggtgaaggggaagagaagcgaaattgggggattgggaatagcaacgttttgcaaatggtctcttctttgtagctgcaattgcaaagaacactgagagagagagagagtgtgtgtgtgacctttgagagatggaggaaaaacgacgcgattctgctggaaccctagcttttgctggtagctctggagattctccggcatctgagccgatgccggcgccacggcgacgcggcggaggtttgaaaaggaaagcgaatgctcttgggggttctaatttcttctcttctgcgccgtcgaagaggatgttgacgcgtgagaaggcgatgcttgcttctttttctccggtacataatgggcctttaactagagctcgtcaggcgccgagtattatgccctcggcggcggatggggttaagtcggaggttttgaatgtagcggtgggtgcggatggagagaagcccaaggaggaggaagagaggaataaggcgatccgtgagtgggaggctttggaggctaagatcgaagctgattttgaagcaattagatctcgtgacagtaatgttcatgtggtgcctaatcattgcggttcgttcgttcttcttcttcttcctgtttttggttgagactaaatgcaaaatattgatttcgttttacatttgttactgttttgctttgcaaattttgaaactttatgtggagagactttccaaagtaggcaaagtaaagaactttaggtagtctaggatttatgtatcacttcgtctggaaacaaggagagatttggaattgggtttggttctagaaatcatcatatggcggatcaaagtagaatgtgcatgctcattttatctagtagaatctcattggaaaaaacttaggctatgaactgatgctcctagtccttttcttgtggtaatatgatatctaagttagattttgagttgttggtattgttgatttttcacaacttctcaccctcgcatttatgataaaaaggagttgtttttaatttgggttcctgtacttcaaattctttgaaggttggttttcatgggaaaaaattcacccgcttgaggaacgttcattgccctctttcttcaatggcaagttggagggtcgcacttctgaggtatatagggaaatacggaattggatc

SEQ ID NO: 2985 - DNA, 3000 bp, Unknown
  misc_feature (1)..( 3000): cDNA_ID_1819223_gDNA_ID_1620620_Annot_ID_46991 3000 nt of promoter + ATG
agaagcaaaatatcaccgatttgaagatttgtccttaatatagcaagagatggattcatctcacaacaagacaaaactgaggtaaccgaccaaatcaggaaagataagaactttaacacgcaaactattatttctaacactaatctcgaaacatcgaagctaattccaatgtacagaaaaatccgcaagcctctaacctcgggtgaaggaaaattcggcgttgaacactacacaacatgtggaatgaccaagacggaagaacttaaccgcaatgtacaaagtcacgtgaatcaatcaataccaatgagacgaagaaaatgatgcaaggagagagagatagagagacgaattatctgcttcgtgtgagcaatttaagaaagccgtgtacagagaaacgtagaaggagggaaacaaaaaaacagagtaaatgtttcgtgcggggaaattaggctcagtggcattgaatgcttaattgagagggatcaacatctcaatatcacgcgcgcgagtgtaagcataggtttacgaaactcgctttttgatggatacacgtggatgtgcagtgtgtccacgtagacgaaggacgctgacctcatggcgtaacgacttgtctacgtgtcacttcccttgacatgtcaaaattttagccgtatgcgtttaataacattatattggatcatgttcaattcatctatgcaaacatttttttagccgtatgagtttccgtatgcgtgaacggtgaaccagattgtgacaagatttgcggaaccttagaactaaaaggatgcatttgggtctacctaagcaaaagactgagtttgtgggttaagcggcattattacgtttcgttccttttccttcgattagaaaaatattaatgtaactcgtgtttcgtgaaacgagtcttttgagggtcaacgtactaagttgcttctaacccaaagaacaaacagttgtagtattagtatagtgtaattgtgtccttgtatgtagttagcacatgtgattctaaaaaacttgtgacaagaagtacctaaatatgttgttgattcaagccaaataaagcgtcttttgagctttgtttttcatagatgacaatttgatctaaaatgcttagagagttagagggaaccttttgcctacgtgttttagaacaaagaacataagtgtggagcccttgttcacattttcttagtttaaatattgaagatcttattctgttctcaagctctcatatctgtggtaactttcggcccattgtcgatcgagaaaataaataaaaaaactatacaaaatatggaagaaggaaatgtcagtaacatgttgcaaatgatcatactctttaataactttttcttttgagcaaacactcactctataatatctataagtgtaaatgatgacaaaaaagggtctataaagtataaaaaatttccttcacatgcacatgcccaacttcaagttttgtgtatgatgtttctttaactttttattagtggttatttcccaacttgtgtttgtttggaagcaattatttcaaaattatataaattcttaactgaatgtttgtcgctaatgttataaaaaaggtagtataaaatatgaaattagtctcgtttgcttggttgtaaactacatctatgtttattcatgtgtatattatataatgtacatctagctaacagacaatagtcatgagtctatatgtatataggagagtcgagcctttataatgaaagaaatagatatctacgttcttttacatttgacaagaatcaccagatatacataaatcggaaataaattaattagtgttaaaaggcaactatatagtattaaaatgctcattatttttagtacgtagttggaaaaatgtatgtgttccagtttacttgatttcattttttcatcgttatcgttaggacaaaatcttgtctccaaatcttgttttattttttcccacaaaataccaaaaaatatcgtttagttttaaagttaaatcttgtttaaaccgcgcgatcatgtgtatcgtgacaatatatagttatatactagtatatgttttgtaaggttccaataatttagggtggcaagaattgaattttaataatcctaatggacagccaggtatgttggtcgtcgaatctcgaatcgactgaaccatcatatatagaagatttgataaatataactgagaaaataaatgcaatacaaaaatgaaccaccctaaacgtataatttacaagatagaggtcaatgatatgattagagagcctaattaaataagggacaggtattggaagttgaccaagtaaaaataagtatattaaaagtcaaataaaacatatattccaacatcaacatcagcatccagtgagaaacgttccttctgaaatgtttttatttgcaaaaaagaaagataaattgtcgaaagtgtttagggtttatgtttgggtgtttacagcaaacaacggtcccacgtataaacgtgactggtttgcgcgtttgaactgatgtcatgactgaccacaaatagatattcgccacgtgtattattacagataagtcatgacggccatgttgtgggtccctctgtagctgtttattattcattcaccactttgttgctgtttaatttggcgctgcgccgagccgacaaccaaaagatttttctctttttctgttgtcttaatgatgtcataccaaataatcccagcattgtagatttgtactaatatttttttcttagttcgacccattttattaccctaaaatatagacacaaaattgtgaatgttgttaatatgttcttttgtagtaaagacaatcaagtactctgtttttcttcttttcttttttgacataaggatatacatttttcagctttaaccaattggttggttcagatttctaaatttaagtgaataaatgaccaaaacgcttttaaaaaaataaaaatcaaaacgaatttcatttggttcttttgatattataaccatg

SEQ ID NO: 2986 - DNA, 3000 bp, Unknown
  misc_feature (1)..( 3000): cDNA_ID_1974423_gDNA_ID_1620620_Annot_ID_46992 3000 nt of promoter + ATG
ttcacaattttgtgtctatattttagggtaataaaatgggtcgaactaagaaaaaaatattagtacaaatctacaatgctgggattatttggtatgacatcattaagacaacagaaaaagagaaaaatcttttggttgtcggctcggcgcagcgccaaattaaacagcaacaaagtggtgaatgaataataaacagctacagagggacccacaacatggccgtcatgacttatctgtaataatacacgtggcgaatatctatttgtggtcagtcatgacatcagttcaaacgcgcaaaccagtcacgtttatacgtgggaccgttgtttgctgtaaacacccaaacataaaccctaaacactttcgacaatttatctttcttttttgcaaataaaaacatttcagaaggaacgtttctcactggatgctgatgttgatgttggaatatatgttttatttgacttttaatatacttatttttacttggtcaacttccaatacctgtcccttatttaattaggctctctaatcatatcattgacctctatcttgtaaattatacgtttagggtggttcatttttgtattgcatttattttctcagttatatttatcaaatcttctatatatgatggttcagtcgattcgagattcgacgaccaacatacctggctgtccattaggattattaaaattcaattcttgccaccctaaattattggaaccttacaaaacatatactagtatataactatatattgtcacgatacacatgatcgcgcggtttaaacaagatttaactttaaaactaaacgatattttttggtattttgtgggaaaaaataaaacaagatttggagacaagattttgtcctaacgataacgatgaaaaaatgaaatcaagtaaactggaacacatacatttttccaactacgtactaaaaataatgagcattttaatactatatagttgccttttaacactaattaatttatttccgatttatgtatatctggtgattcttgtcaaatgtaaaagaacgtagatatctatttctttcattataaaggctcgactctcctatatacatatagactcatgactattgtctgttagctagatgtacattatataatatacacatgaataaacatagatgtagtttacaaccaagcaaacgagactaatttcatattttatactaccttttttataacattagcgacaaacattcagttaagaatttatataattttgaaataattgcttccaaacaaacacaagttgggaaataaccactaataaaaagttaaagaaacatcatacacaaaacttgaagttgggcatgtgcatgtgaaggaaattttttatactttatagacccttttttgtcatcatttacacttatagatattatagagtgagtgtttgctcaaaagaaaaagttattaaagagtatgatcatttgcaacatgttactgacatttccttcttccatattttgtatagtttttttatttattttctcgatcgacaatgggccgaaagttaccacagatatgagagcttgagaacagaataagatcttcaatatttaaactaagaaaatgtgaacaagggctccacacttatgttctttgttctaaaacacgtaggcaaaaggttccctctaactctctaagcattttagatcaaattgtcatctatgaaaaacaaagctcaaaagacgctttatttggcttgaatcaacaacatatttaggtacttcttgtcacaagttttttagaatcacatgtgctaactacatacaaggacacaattacactatactaatactacaactgtttgttctttgggttagaagcaacttagtacgttgaccctcaaaagactcgtttcacgaaacacgagttacattaatatttttctaatcgaaggaaaaggaacgaaacgtaataatgccgcttaacccacaaactcagtcttttgcttaggtagacccaaatgcatccttttagttctaaggttccgcaaatcttgtcacaatctggttcaccgttcacgcatacggaaactcatacggctaaaaaaatgtttgcatagatgaattgaacatgatccaatataatgttattaaacgcatacggctaaaattttgacatgtcaagggaagtgacacgtagacaagtcgttacgccatgaggtcagcgtccttcgtctacgtggacacactgcacatccacgtgtatccatcaaaaagcgagtttcgtaaacctatgcttacactcgcgcgcgtgatattgagatgttgatccctctcaattaagcattcaatgccactgagcctaatttccccgcacgaaacatttactctgtttttttgtttccctccttctacgtttctctgtacacggctttcttaaattgctcacacgaagcagataattcgtctctctatctctctctccttgcatcattttcttcgtctcattggtattgattgattcacgtgactttgtacattgcggttaagttcttccgtcttggtcattccacatgttgtgtagtgttcaacgccgaattttccttcacccgaggttagaggcttgcggatttttctgtacattggaattagcttcgatgtttcgagattagtgttagaaataatagtttgcgtgttaaagttcttatctttcctgatttggtcggttacctcagttttgtcttgttgtgagatgaatccatctcttgctatattaaggacaaatcttcaaatcggtgatattttgcttcttttttttctcggccacagattaaaatcgtcaaattatctgatttttgatgccctgaagctttagcttgcatctgtagtcatttgtcaaagataattgaacagaggctttctatattcgtcgtcaagggtttaggagattctgggttttggcgtgattttgaggggaaagattgaaactttccccgtgaatggtaagacagtgagag

SEQ ID NO: 2987 - DNA, 3000 bp, Unknown
  misc_feature (1)..( 3000): cDNA_ID_1378208_gDNA_ID_1620620_Annot_ID_46993 3000 nt of promoter + ATG
ttcatctcccaaaaagctcctagatgatggcttgtcctgtttgattaggctggtgatggtttactcaaagaacagactcttgaatgttatggaaaaaagaacggggaaatggttttcaacttttcgtactattatcaatgactcatagcttcttacctgaaatccctttacctgaatatttttccacttaagtttttttattgttttgttttctacgctctcaattttactctgcctgtctgtacctcttgcaggaatggtctaaacaaggatggtaagtatgcatttgcggagatgatgaccgaagacgtagagacttgtagagatgaacgatgctaccggctatggatcaacagcctcgggattgacagttatgtcaataatgtatttgaagatgttagaaatgggtaatctttattttgagcttatagtaaatcaagcaattagtagaaaattttcctgcagttgatgacgttgcatttggaaaatactgaaaacgctctttggtcctgatgccttttgtttgttccatttactattttatgcagatggattcttcttgaggttcttgacaaggtctctcccagttcagtcaactggaagcatgcttccaaaccaccgattaagatgccgtttagaaaagtagagaactgcaatcaagtcataaagatcgggaaacagctaaaattctcacttgtaaatgtagctggaaatgacatagttcaagggaataagaagctcattcttggtaatcattacccgagagctcatgtttctcttagcttgatacaaaaacatgatcgccttgccttacaaactggagatttatatggttgtgtatctcaggtctcttatggcagttgatgagattccatatgctccaacttctcaagagtctcagatctcggacactaggtaaagagatgactgatgcagatatcctcagctgggccaacaggaaagtaagaacaatgggacgaaaattgcaaatcgagagtttcaaggttcctttctttacaactacttcaaacacttaccacaatagtattatataaagtatgtccacctatcaccttctagtgaatcaaattaaaattctccaggacaagagtctatcgagtgggttattcttcctcaaccttctatgggcggttgaaccaagagttgtgaactggaatcttgtcaccaagggtgaaacaggttttcactactctttttactaaggtatagttacttactccgtttacctgaatcaaagcttatttgattattatatggttattgaaacgtacagatgatgagaagaggttgaatgctacatacatagttagtgtcgcaagaaagctcggttgttcggttttcttgttacctgaagatatcgtggaggtaagaactgagagactataatgtatcatcatccgaaatagcaattgctcagatgagatgtgttttggtatgttgtgacaggtgaatcagaagatgatcctaattttaacggcaagtataatgtactggagtcttcagagacattcacgggagagttcagattcgtcgtcaactcagagcaccacaacgacgtgcaccagcacagcctcgtcccctgccccatctgtcacagaagaggaggaagtctcctcattgagcggtgaagtcacgagcttggccgttggtgatgcggtttctgaaatcaccacggtctcagaggaagcatccatcgaatagagagagcgagatcacatatatactgatatacatctcttgctatagcaaagtagctgttataatagtgacttctctgtaatcttttgtttttttgtttcatcaactaaaattaccaaaaataataacaatgttacaaacactcaatcacatcgagaaaagtaaagtaaaattgtgaaaatttgtttagtacttaaaaagttaggaggaggaaaaagtgtacatcttattttgaaaacagacactacgcaaacaaccatggatcagacgacgatgatccacaacagtcaaggcaaacaagagatagatagctcaacagacgatgaagatagagaagatggaacgagacatgcagacaaaagaggacttgaaaaccgtggcgttgggcacctctaagatcaactacatggatcctaggatcacggtcgcatggtgcaaacgtcatgaagcacccattgaaaaggtagttaattatatacaaaacttgaatattgatctaccatgaaacaaagagagtcctctaataaagttttttttttgtaatggctggttcgttaatgtagatattcaacaagtcacttctggagaaatttgcgtgggcaatggacgtagaacctcacttcacattctaatatgcattgcactgcagcagctgatgagagtttctctataaaacagagcaaagcaggctacattttttttcttccaagtagataaattctttttgtttgtatctttatttgagatcatgtcttctttttttttcgtatatacaattgttcattgtttgcttgaattcaaatttagtctgttttataaaaaatgaaaccataatctttactattttaaaccataaaaaaaaagtcaattgtaaatacaaaacaccaaaggccaattaagatttattccaactggaaggatagagcaaaaaaaaaagaataatctggcgcaaaaatgacttacacaaatcaataagttttccaaattttgtttctttagcagaaaatcaaaaatgttattttggtcacaaatgtaaaaattggtataaacaaggttttaacaaaaaaagaaaaatatatatatacaaaggcaaaattacccctgagaaaatctggggccttgacacgacgatcctccatcatcctcttcctcgaggaacttcaattccaatctgtgagatctctgcacaacatcttgtctattttcaatcgaaacctctgtgagatcgcttttgatttttgtaattctcgtcgcaggatatctctctcattgggatcagac

SEQ ID NO: 2988 - DNA, 3000 bp, Unknown
  misc_feature (1)..( 3000): cDNA_ID_2781818_gDNA_ID_1620620_Annot_ID_46997 3000 nt of promoter + ATG
tagtgtatagttagtttggatcttcactaaatatgttcgttgtttctacttttgtaggaaaccttttgacttcacaagaatggcagtgacagaagcagaaaatcctcttcttggtgaaatcacttgtggcaccttactacagaagttgcaggtagatttcgcaacatacacacttatccttttaatatatggttccacaaactcaatgtacaaacttgttacaggaaatctgggatgaggttggggagagtgatgaagaacgagacaaactgcttctacagattgaggaagagtgtctgaatgtttacaaaaagaaagttgagctagccgcaaaatctcgtgcagagcttcttcagactttgtcagatgccactgttgaactttccaatctcacaactgctctcggggaaaaaagctatatcgacattgtaagtaatctcacgtcttacaagtggtaaagagatgagatggttacagtgtagtgtgattcaatgtctttgtttccattgcagcctgataagacttcaggaacgatcaaagaacaactttctgcaatagcacctgcgcttgaacaactttggcaacagaaagaggaaagggtccgggcattttctgatgtacaatcacagattcagaagatatgtgaggagatcgctggcggattgaacaatggacctcatgtggttgatgagactgacttgtctctaaagagattagatgacttccagaggaaactccaagagctccagaaagagaaggtaaaatattagttgggatatggttatgtgtggcctatgttcaaaccagaactaaaactgctttgtgtttgagcagagtgataggttacagaaggtgctcgagtttgtgagcacggtgcatgatctatgtgccgtccttcgtttagatttcttaagcactgtcaccgaagttcatccgagcttagatgaggcaaatggtgttcaaaccaagagcattagcaatgaaacacttgcaaggttggctaagactgtcttgactcttaaagaagataaaatgcaaagacttaagaaggttagtcaaaatcatggtctttgtgatctctgacatgagcttggtcagtttaggctgcacatatgttgaaatcctttctgattaattgcgctgaaagtttgtaacttttctctgcaccattcttgtttgtggatttcattaatgtatcttggttttatgcagcttcaagaactagctactcagctaactgatctatggaatctgatggatacttctgatgaggaaagggagctttttgaccatgttacctctaacatttcagcttcagttcatgaagtgactgcctctggtgctctcgcacttgatcttatcgaacaggtatcgtaaatttgtaatgtatcaatcaatgtgtatgataagtactgcttttaaaaatcttctgtgaactcttgaaggctgaggtggaagtggataggcttgatcaactgaaatctagcagaatgaaggaaattgcattcaaaaagcaatcagagcttgaggagatatatgctcgtgctcacatagaaataaaaccagaggttgttcgtgagaggatcatgtcgttgattgatgctgggaatactgaacctactgagttactggctgacatggatagccagatcgcaaaggccaaggaggaagcctttagtagaaaagaaattttagaccgtgtagagaaatggatgtcagcttgtgaggaagagagctggctcgaagattacaatcgagtatgctaacattggctatgttaataaacacattacttattaagcatagagttcaattgatgattcttttgggtttttgttctggaaaaacaggatcagaacaggtatagtgcaagccgaggtgcgcatttgaatctcaagagagctgagaaagctcggattctggtcagcaagattactggtaagaacttccaaaagtctctcttagttattactacacatagaattaaactgagactgaagaatatatcatactttgtttgtgcaagctatggttgacacgttgattgctaaaacccgggcatgggaagaggagaacagtatgtcctttgagtacgatggagttcctttactcgccatgctagatgaatacactatgcttaggcaagaacgagaagatgagaagcggaggctgaaagtaagttgtttcatcctgtgttaaaccgattgttgaaactaacttcttttaaaataatcttgccttttcattaacaggaacagaagaagcagcaagaacagccacacacagatcaagaatccgcctttgggtctaaaccaagccctgcaagacccgttagtgccaagaaaccggtgggaacacgagtcaatggaggagggctcaacgaaactcctatgaggcgtttgtctatgaactcaaaccagaacggaagcaagtccaagagagacagtctgaacaagatagcttcaccttcgaacattgtagccaacacaaaagatgatgctgcatctccagtctctcgtgctgacccagtgatggcttcaccgtgacaatatcaaaagaaagagagttataatgcttacttacacttttgttagttgctaatagtgctgtttaagaaacaaacacttagaaacaaagacaatgagagtagaatgttacttagatgtttctgtttctgtattcattcactcaaatttgtttggtacttgttagcatgactaatgtgaagtgaccggtttagtgaatgaaagtcaaggttctaattggaattacgaaataatatttgggcaaaattgtaatatactgaaagatcttttgggcatgatttaaaagtttaaaaagtttccaagaaggtttgggattttagaggtcctttctgcgacgtcgtttctagtttgcaatcagaagcgcgttaaatacaggaaaatttcttgagctgttttgtcttaacaaatcaatcggagaaaaagctacggagctcgagagaagagagaatctatg

SEQ ID NO: 2989 - DNA, 3000 bp, Unknown
  misc_feature (1)..( 3000): cDNA_ID_1819200_gDNA_ID_1620620_Annot_ID_47000 3000 nt of promoter + ATG
gatcccaattgatttcttcttcatcttcttttatgaacctggctttcgcatcttcttagctctgggccattcctccggtgattttggtgagcaaaatggttgatttagttgtcacgctgagtcacaaatgtcagcttttttggtttctggcttcatgattcacttccatttctgttttagtattttaaagtttgatcttgtccatttttataacatcacagtagcatctttatgtagtcacacgaacatagagtaagaagaatggttcttgtacaacattttggaagcttgatttgagtgatatctagacaagaaactcacagaaaaaaatatatatgttgtggaggaaagaatttagtaggttaactaataactatagtgcttgtggtgtagcaatttcttattttatcactgaaaccgagataagtcgtatttcagaacatgatttgctacgatggcgtttgtcttctctgttgggtgaaatgagtcccaaaatacatatttgcttgcatccgaacatgtgaatgggttcattttatcacacaagtagctcatctcatagtatcccgttccgcaacacgcacttcttacgttttcgaaacctgcaatgcacataggaatattatcataagaattcttgatttaagagcatttggtacatattgaaacttagccctatgtctttgcagggttgcaatggttgggaaaatatttttgttagaactttgtactaaccgaatgcttcaggatggtatatgatttctgaaacaaggtcatatggatttgaaaacaccagctggattccgttcagatctctgttcaactggaagactttctcttccatcttgatgttgaaatctctagccacaatgttgtattcttcaatacatttgcttccataaaagagctgagttgttctttccaggggtaagcatccaaaaggagagagtcccgacaaagacatcttccgagctccgagtctgtatatatctgtcacgaaatctgctgctattcctatcaggaaatattggtactcgttcactgagtacttccgtaacttgcggggaagaagatagtaattctccaggaaatcgttggttccgatactaatcaggtaaagtgattcactaataatctcattagctttctcttcacccaagtagcttcttagcctggtttggtattctttgtagtattccacttccttccatagcggcattacagactttagaaatcgatgacaattcagagaaagcatgtcagaaatctaagtccagtacagtagaatatatatatgttgtaagatatataactatgcttgacttactaacacggcagaggttgcattgtctaagccggttccagctgaagcgaaacagacaccagtggcaaagtctgcaatgttgtatgctggatctaggtaggcagggactgcgttcttgagtcccaaaccttcagaaatgaagtctggtgcaatccggccatttgaaaatctcccagtcgctttgccgtcaaagtaatcccggccatatggctggaaattgctcttcagaacagtagaaatctggttgttgttgcctgaatcaacagttgagtcaccaaatacgataagtgcgggaaattttgcacacgtttcaggtatcttcaccaagagctgagctgctagcaacaagaacgcaagaactctgtttcgctgcatgctttttacacaagttttttcaattttttgcttctgcaaaacaagaacctcacgattaattgggaagaacaattggagcaagcatttaagatggagaaagataggtatcttctatcaaacctgactaaaacagatttagctcgtgtagttaataccttggcctgttgttagatgatgcttattaaatactccttagtctgatatgtctctgtttatttttggccacagagagttagttgaggtgagtaatgagctgaaaatgattgagagtttcaataatagttgtgcagcagagagccgtatttatagctactaaaaaagagagaaagacagaatattttaaaatagaaggattcgtaccattgcaagcttcagatgtatatgtaacgcatcttcctttttaccggattcacgctcaaaactcaactctctgttcttgtatcacttactgtttttattgcttactgagtctagagtcttgaatgtaaagattatttgcactttgggtgaactgtgtcgcacgttttggggctttttagttcaaccatagttttggttgttgcaacgacaataacaagtaacggcaagaaagtgtctctcatgcgtcaaatgtgacatttccgataaagtaactttgttttttgagtctcaactaaagatttataaatttattgacaagtggttcataacataggtttgcgttttgaattaactagaggctattagcaattaagtggtcatttatcgtttgttgaattatagattaagtagttgaacattaatttccaaattctcccatccaaatgacgtcaaatctacacaacctctatattaatccagcaattttaattaaacacaagaatgaaactaaaaaagccaaaccacttagcaacagtaacatactgctgcttgttctgtttggtaggactgtaccaatcaggcccaggagataaatggacttcgtctgtcccaaagatatacaagtacctttggttctttctagaggcttctcaaattagctttcaaaatctcccatttgctataatgacaataataccctcacaggctcgccgaatcaaagcgatcattttagcctcagcccgctcgtgcagcggtaaggctatttacgtaaattactaaaaaccccgaaagagagaattgtgaattctactatccatccaccaagcactctgtgtgcctctgcaaattaacaatttcctcagaacaattacatttcgattcgattcgattctcttatcttcttgatctctgtttgttcatctgtggtggatctccagatg

SEQ ID NO: 2990 - DNA, 3000 bp, Unknown
  misc_feature (1)..( 3000): cDNA_ID_1819181_gDNA_ID_1620620_Annot_ID_47005 3000 nt of promoter + ATG
cgcgtggaggctccttgcggaagcttctctgtcggaggaaaggtttaaggaggttactgctctcgcctttgaagccataggttgtagtaaccaagaggaggatcttgaaggaaccatagttcatcagcaaaactctagtggcaatgttaaccagaaaagcaacagaacccatggaggtccgatcacaaatgggacggccgccgagtgccttgtccttcagtgaacaatatggtgacttggtggtttgtatgtataattaaaagcctaaataagcaaactctctttgtagttgcatttgaagcttcttggtttatgtatgatggttgtgggcattttgtgcctagacttctggttctttgttttttgttatgagttggtgtttatgaattatatatgttcttcactaatatgattattatttgtatagatttgattattcaaaggatatgtcttaagaaggggttcaggttcagccaactaattacttgtaaccaagtctttctaccatcaacaaccatgttaagattcagacacttagtttttacagctcgagactcgagagagagtaataatactgattattgtcttggctataaccaccacaagctctggttatgaagtcgtcctctatagactataattcactaactcgatgctagttcatgtttaagtaatattttgtttagttgactagatggattttatctttgctcgccattagctcaatgagctacgtatatgttaagagtcacactttcaataattaatagctttttaccgttaccataccaacaaactttagataattgggttaataacacctttaagccgaaatagtagtatcataggatccgataccaaacgaacaagacaaaaaatcaaccaaagggttctttaaccttcgtgaccataataacttagtttctaaagagaatggtcacgataaaaaaacaagtctgcaaatcctaatgccgattactccttaaccattcatatcacacacaagccctaaacctggacgaagtgtcaggccgtagcaccaccaccgctgccaccagtctgatggagcatcgcatcgatctcatcaccatcctccatgtcaagctgtagtgtcaagaattattagtatcagaaactataaacttcaaaaggtaagaaataaagcatgtagaatgaatgttatacctcatcgggagtttgctcagcacgaagacgacgcccatcaaacaagaaagcaatggagttcatgtccacagattgccggtcacagtaagcattcatcagcttcttgagctgagtgcttctcttgatcctaaagaaaacctcgtttccatcctataaaacaaacatatagaaggaacaataaacgttagagaccgcatatgaaacaataactaaatcacatggctctcttttggtagtaacctgaaagagtcgaaaaattaaacacatatcaacaaacattcagtttaaggcttcgtctatgagaatttgaagcacaaacatcagccaaactaattgaaaacttagtacagagactacaacttcatcagaagatatataacaacttagtacagagacagcatcgttcacagtctttagaacattcaacaactaagtaaacttatcccttccaaaactataaaaccctcaaacaacaacaggaaccaaaagctcaataacaacttacacctaaacaagacttatataatttcagaaatttgataaacaattagcaaaaacaagcaaacgtgtaaacataaagcaggatactttaaacctgtaaaacaaaagaggaagaagaccattaagactgagctagtagtacgaaaccctaaaattaaaccaaattggagaatgaaaaaccctaatcgcagctacacgaaatcagaaacccaaacattcacaagaacacacaaggatgagaaggagaaagagagatacctgtcccttgactttgagattgatgtgagctcctccgtctcctggcttcttgtcttcctcctggtttgcagacatcgtgaaaggttctccgtccggttacaaaaacacgaaatttgagagaacgatgagagattcacacaatcaaagaatgatgctgagagatgaatataaaaagactgactctgaaaatctctctaattggccgtggcttttgtacttggacgcatcggattcctctctatcataaatcgtagggcatctatccaacggttcatattctctctaggttctcttttaatccaacggctgctagttatgttcaaatctgtcgtttcgttataatgggcttatatttttattgggccacatctaacccactagacaatttcatttggttaaatattttaggttgcagttcctgatctcacgtgacgtgagtcctcctatccaccactctccatgatttcatcatctgttgaagacttgacaatttgacatagaagaaataaataaattgttaaatctataaatcatgtcactttgtgtattaacaaaatgattagttgaaggagataaagtctgtcacacactcttcacaaaagaaagaaatgatgatgaattaacgaaatatgcgcaatgcaacatataaagaacctaggtcttgactcttgtttaagaaacaataaaagtcaaggtttttgttaggtttctgttataaccaaaatcaactatgaaaacattcatatgttagaaaaacatcaaaattatagagagttcctttaactgaagattatggtaaagtaaaactttttgctataaatagagctttaaaattatacagttttagttaaatctattatttcagctattcttccgtgttattagttatcccacaacccccacttggcacttgtttacacctaaatcgtataaatactgtagaccagctccgtcccaaacgcaacaaaaactttccttcgtctccataactatcaaacgacactcatctatgcgtttaatgctctgtttctgaagatacactcgagaataaccatg

SEQ ID NO: 2991 - DNA, 3000 bp, Unknown
  misc_feature (1)..( 3000): cDNA_ID_3091999_gDNA_ID_1620620_Annot_ID_162258 3000 nt of promoter + ATG
atttatttggcagtctctacgactacgatcgtacgtccctccttccatcaccgtttgttttatttattgtttcttttctttttttactttaaacaaccatttatcatgttttaagacctcgacatgtaattcgaattagtattgcattaagatttaaagagttacggcggtggatcggtggtagtcagtgcaagtaacggatcataattgcggttgaccaagcctctttcactggcctctttgtaaccatgaaagctgagatgctattggtacaccactaagtcccaaattcccaataatcgtgcgtcagtaaacatcaatttcgagaggacaagtatcaaaatgcgatatctgctgttacaaatattcaactcagttacaaagcccttaacaatgtattgatttctaattttctataaagtaactttgtgaatacacctaagtttatcaatgaagaataaaattgtttaaaataatcgacaaaataacattatacatgaattttacaacaagtgtttgagcatagtagctaagttgttttcttggggtactctcttggtccgaaaatggtggaaccaaccctcacattggtgcttcccatctcaatctgcagaaacatagtcaaagatcatcttccacatatatgtggttcctcggatgaaagaaagaacacattcaaatgattttcgatattgagttgattgcattttcgatattagaagagagacaaagatattaccgctagctcgaagtcaccagacatgcccatggacagttcaaattgatcctcagccattccaagtgccttgcatacatcagctctacagtttgaaagtgtctgtcccggtttatggggaaaagaataaaccttggtaagtaaaacttgtaggaataacccgagaacacgtaaaacaagtatccaatcaagtagtagaataccctgaagttctctggggtagacgtataatcaggcatcccaatagtcattaatccggagaataccagatttggacagtgatgtttcacatgtcttgctagctctacaacgctagaaggttcgattccagatttagctgcatccataatcaatcagtcagccaactgaagaggctggacaaggaaatcagcatagaggtaaaatactcacaaacttctccgcttgtgttcacttggaccaaaacctttagtggatgtctcccaagatttgaaacagctcgatctagatgatttgctacctgtgaaatcaatcccaagtgattgtataaccaaaataacctcctagtaaagtgaattgtgcaagttaaacgccacaacaacctctaatcgctagttataataccttttctccatccacaccatgaaccattgccaaatttgggactccagctgcaaacattggattaaacgactttcactttcactaaacccctaattcaatattaaagatggggataaaagtcagactcaatagcgttttggctttgttgctctgtaaatgccccacgaaatgccactctatatcttccggaagctgtatatcaatcaaacaaagtgaaggagaagctccattagcatcatcaaaagcacaaaatatatcacattcccagaaaatggagagacacatagtagttagtgattgaaggataaacattcggattttgaaatgaaatcgattatctagtgaagataacaaggattggagagaggaacctgtggagctttatcgatgatttcttgaacgtaattctcgccgaagcaacggtgacctgcgtcgtagatttggcggataagtgagacgggtttagtcttggagactggaaggaccctgacccgctcggcatctcttcctacttgctccgccgccttacgagctctaagaatcacagagcggagagcacttgcgacggttgcctccaccgcaggagctgccatcgccaatcgccactaacgcctgtcgtcaatttgggcttcttcgggagtaatgtttttgtcacgtaaattagtttatggcctttaattggataattcacggtccacacgttcaatactaattgcgattatttatctcttcacttttaatcaaaatttccaaggcagagacacatgtaagggttgatgtatatagtcatcaattcacgagattattggaatctttattgcataaacaatatcaaaattgtgtttttatatataccctttcaaaacgttatgggattcaaaattacacccacacccaccacttattgattggacataacatcattcaatgtaaaattacacccacctcttattcatgttttaattttcacttctgtatatatttttcgaatttcatgtattctgtttgtacttttttgggtcttatgttaagcccatttgtgggtttgtaaaagtctttgacaatatccaataaatcagtgaaaaaaaaaagaaaaaaaaaattattatcactgtaaacttcaaatcaattcaacttgtgctttacatgggtcttcgctggaccaatatgttttgtgggcctttcaagcccaacaatagttatctaccctagctcaaaaagagttatcttattctcattctctctctctctgccgcagctatcaatttactggagaagagatggtgggatcagaggttttggaggaatgtggagaaaaaataagcaagaaagagtcaaagaagcgagccgctaaactggagaagttgctccgtaaacaggaacgagaagaagccacatcatcatctctttctctggaggaggaggatgaatcgtgttccagcaactacggtgacgtgactactaacgagttgcagtcggctgttgagggaaaagagctcactgatgtgagcaacttggttgaagagattgtggggtcagaggtttcgatcagaggtcgactgcacaagaatcgcttagtcggtaccaaattgtttgtgatcttgagggaaagtggattcacggttcaatgcgtggtggaggagaccagagttggtgcaaac

SEQ ID NO: 2992 - DNA, 3000 bp, Unknown
  misc_feature (1)..( 3000): cDNA_ID_2167214_gDNA_ID_1620620_Annot_ID_162255 3000 nt of promoter + ATG
gtcccaaatttggcaatggttcatggtgtggatggagaaaaggtattataactagcgattagaggttgttgtggcgtttaacttgcacaattcactttactaggaggttattttggttatacaatcacttgggattgatttcacaggtagcaaatcatctagatcgagctgtttcaaatcttgggagacatccactaaaggttttggtccaagtgaacacaagcggagaagtttgtgagtattttacctctatgctgatttccttgtccagcctcttcagttggctgactgattgattatggatgcagctaaatctggaatcgaaccttctagcgttgtagagctagcaagacatgtgaaacatcactgtccaaatctggtattctccggattaatgactattgggatgcctgattatacgtctaccccagagaacttcagggtattctactacttgattggatacttgttttacgtgttctcgggttattcctacaagttttacttaccaaggtttattcttttccccataaaccgggacagacactttcaaactgtagagctgatgtatgcaaggcacttggaatggctgaggatcaatttgaactgtccatgggcatgtctggtgacttcgagctagcggtaatatctttgtctctcttctaatatcgaaaatgcaatcaactcaatatcgaaaatcatttgaatgtgttctttctttcatccgaggaaccacatatatgtggaagatgatctttgactatgtttctgcagattgagatgggaagcaccaatgtgagggttggttccaccattttcggaccaagagagtaccccaagaaaacaacttagctactatgctcaaacacttgttgtaaaattcatgtataatgttattttgtcgattattttaaacaattttattcttcattgataaacttaggtgtattcacaaagttactttatagaaaattagaaatcaatacattgttaagggctttgtaactgagttgaatatttgtaacagcagatatcgcattttgatacttgtcctctcgaaattgatgtttactgacgcacgattattgggaatttgggacttagtggtgtaccaatagcatctcagctttcatggttacaaagaggccagtgaaagaggcttggtcaaccgcaattatgatccgttacttgcactgactaccaccgatccaccgccgtaactctttaaatcttaatgcaatactaattcgaattacatgtcgaggtcttaaaacatgataaatggttgtttaaagtaaaaaaagaaaagaaacaataaataaaacaaacggtgatggaaggagggacgtacgatcgtagtcgtagagactgccaaataaataatggaccactattatgtggttcaagaactatatccttttcttagattccgaatcttaacttgtgtttcttgccttgtttggttttttttttgtttattttgtagttttgtctcataaaataacgaacaaaaagcaatggtctaaatatttctcaatatatgtatttaaaaattatatcatagtttcgcaaaaaaacgaccgaacgaacgatggtagtcatttgcccaaattgagcctcgtagtagttgctacgaccacacccccgtcccatgaataaacacgaccatgtaaatattatctataaagacaacataaatttacaaattaatgttgaacagaaaaagtcaaaaagaaaatttcgttaatataataataatattctatgataatataaaacgtggcataacacatgacttcacatgacatcataagaagacatatgccacatgaactcttcatcgcctccatccttttagtctcgtttacatgcagcaaactacgatctacgattatatacaatgaaattcaaattcataatcaattggcattaaacatacgtatatcataattcataaggttaactaggtttagcaaatgttattctctttggataaacgtttagcaattgtttatctcaaatttaattgaaaatacttgtaagacacagttacaattagttctcaatttccaatctacacaagatttaaatctttctttagttcattctgatctatttttctctcaaagaaaatgtagtgctccaacttttctcccaagactaataaaaattttcttaattgcatgcaaaaatattttttccaactttaatcttatcaaacttagatctcattttatcttccgaataagatttttgttttggtcctttgcctaatcaaactaactaattagattagaagaaaaatacaattagacaaaataatatcgatgaaaaaataaaatccacaagaaaggacctaagaaatttcacgtccgaatcacaaccacagaaaaaaagagagaaatattagtatataattaaaattttgtcgtctgtcttctctggttcactcatctcctatctatttaaagcccattcgatatcctaaaacactgtatcatcaaaaaacacctcaaagaattattcattcaggcatcttctcaaatttttgtttgtgaaaaaaacccacatcaaaagatctctcatttattcgtttcgtttctgctgttttgagtgtcgggttcgttttagctgtaatctttttttccggcgttcgatttgaaaaaatccggggaacaggtgatcggaatcacggctatacacgggatatcacggggtgttagctcacatgtccatattgtccgacagaagggttgtttaatcgaaactaatcctttgccgcacggaggacgtggagctctgccgtctgaaggcggcagcccttccgatctcctctttctcgccggtggcggttccagctttaacttcttttcctttaggttttaggagttagggtttgttagtgttttttccttcttctttttttggtgctcttgaatcgcttttttcttgggggaagttttttcttttgctcttcgaaatttgtcttttttgagaatg

SEQ ID NO: 2993 - DNA, 3000 bp, Unknown
  misc_feature (1)..( 3000): cDNA_ID_1023229_gDNA_ID_1620620_Annot_ID_162250 3000 nt of promoter + ATG
cctcgttcaattatagcatggagatagagaaaacagacacagaagcaggatttcccctgcaaatgccatgtccagcaacttatgggagatcttgttcatctaatgaataaccaaaccacaaaagaaaactatgactcgaagactcgagaagatgttaatggaaacatagaaccgtaacaaaatttatgaaaaccagctgacttcttcttaagcatcagactctttcttttcttcttggttctctcctccctgggtaacaccaacctcagctggtcttataactcggtcatacagcgtgtatccagactgcacatattgacacccatcattactaattggtatttaagactatacaatatgaaataaagagacaaagaattgagcaagctttatatatttaccttcaagacatgagcaactgtgccttctggcttagaagcatcagggacttggaacactgcgttatgtctgtttggatcaaatggctcgtttataggatcatacttctccataccaaatttcttaaatacctgcagcggcacacatgtttaaccggtctcatctgcattgcttacttaaggtcttataattacatttctcgatatttacctcagcaagctgtttctcagtcatctccactccttctaaaagggtctttaatagtggagctgctccagcagaatcttctgaggtgtcaagctttgagaagctttctttgacaaccgaagaagctcttccaagattatccgccacatccaataggctctttgcaaaattctgcatacatatatagtgaatatatatatttcagaaaactattatatgaaacaaaagctgcaaaccaagttcttaaagactaacctgtacggcatactttttggtgttttcagcatcacgtcttgttctgtccatgacattctccatctcagcataagtgcgaagaactttgtctttcaactgcttaatctcttcttccttctcagacagtagctcttccttctcagctacgagcttcaccaaatcatcggctgacaattcatcatcatcactctcagaatctgattcagaagatgaagatgcagctcctttagcacctttccgctttctttttgcagaatctgtcacagaatctttagattcagagtcaagacctggttggtttgcctcagctgtaggtttctcttcacttgtctttgaggcctcagtgtgggtcttcttctcatctgattcaggcgaggtagaggaagaaaaattgaacctttgcagtgcaaacgaatccatcatagacatctgagctggaacaagctgcccccaaaaaaaaaagtaaaatgggttaaactcagtgaaatgatacagagcaaaaacctatagagaatctaaaccattcttctattgtttattcatatatctgaagattcaaacataagagatcaaggaaacagtatcagaagatagcaatcatttctagaaactcaaatgagggaaagccttaaaccctaacaaaaccctgaattgcaatttcggcatgaatagtgattaatttgagtgaaaatcgaaccttatgcgagaaatcgtgagctagggagtgaaaccggctcgagaaaacaggagtctgattcctcgccggaagagtgacggcggatagagatgagcgtatgcccgcgttgcgggttactcgcgacaaaattctcaaaaccaacatctggagatccaccacagatgaacaaacagagatcaagaagataagagaatcgaatcgaatcgaaatgtaattgttctgaggaaattgttaatttgcagaggcacacagagtgcttggtggatggatagtagaattcacaattctctctttcggggtttttagtaatttacgtaaatagccttaccgctgcacgagcgggctgaggctaaaatgatcgctttgattcggcgagcctgtgagggtattattgtcattatagcaaatgggagattttgaaagctaatttgagaagcctctagaaagaaccaaaggtacttgtatatctttgggacagacgaagtccatttatctcctgggcctgattggtacagtcctaccaaacagaacaagcagcagtatgttactgttgctaagtggtttggcttttttagtttcattcttgtgtttaattaaaattgctggattaatatagaggttgtgtagatttgacgtcatttggatgggagaatttggaaattaatgttcaactacttaatctataattcaacaaacgataaatgaccacttaattgctaatagcctctagttaattcaaaacgcaaacctatgttatgaaccacttgtcaataaatttataaatctttagttgagactcaaaaaacaaagttactttatcggaaatgtcacatttgacgcatgagagacactttcttgccgttacttgttattgtcgttgcaacaaccaaaactatggttgaactaaaaagccccaaaacgtgcgacacagttcacccaaagtgcaaataatctttacattcaagactctagactcagtaagcaataaaaacagtaagtgatacaagaacagagagttgagttttgagcgtgaatccggtaaaaaggaagatgcgttacatatacatctgaagcttgcaatggtacgaatccttctattttaaaatattctgtctttctctcttttttagtagctataaatacggctctctgctgcacaactattattgaaactctcaatcattttcagctcattactcacctcaactaactctctgtggccaaaaataaacagagacatatcagactaaggagtatttaataagcatcatctaacaacaggccaaggtattaactacacgagctaaatctgttttagtcaggtttgatagaagatacctatctttctccatcttaaatgcttgctccaattgttcttcccaattaatcgtgaggttcttgttttgcagaagcaaaaaattgaaaaaacttgtgtaaaaagc

SEQ ID NO: 2994 - DNA, 3000 bp, Unknown
  misc_feature (1)..( 3000): cDNA_ID_1450493_gDNA_ID_1620620_Annot_ID_162247 3000 nt of promoter + ATG
atttgttcttggatctgtagatacaaaaccttttaatgtttgaaaaatgtgttaaccttgatcttgaaagctcttttgaaaccgcttgcgaagaagccaccaaaaggcgccataatggatgcgaatagaccgagagaaaaagcatgccattggacaggcagggtcgagatccctttccatggagactgttaagcaaagttcacaacggagctcagtttcaaaacaagacaacatcatcggctggttttcacgagaggacagttaattgcttacaaatggagtaatccaagagggaaatgggtaatactctggcctgaagagagggcctggatcacaatgaagccaaccagttgaaaaatcctgcaaaagatatgcaacacaaggatgaagtaaaggccgagacaaaatattgtgatggagatatcactttttgttaccttccttggacatgtaagccattggaactggcctaagacattagcaaactgttgtacgaagcagataataatctatcagtcttgagaccaaaagaaagagttacgaacgaatgaataaatgatagaagaaggttattacaataaatgcagagattatagttgcaactgatgctccgatgaaaccttcccatgttttctttggagacaacttgatgagcggagttttcccgaaatagaaaccgaagaagtaagctgctacatcgttcatagcaatcagtgctgctggtagaagaaacctgcatatttaaaagaaattagcactcgggaaaactattatgcttcagtggatatatataagagtccattgtaccagaagatcccttcaaaaatattggcgacggtgaaagaagattgagtaaagacaacgataaggatcatatgtgtccaagcgtattgcccaaactgatacttatacatcttattcttcaatgtaaggataaaccatatgagacctgaatccaacttaagctgttaataaatcaagaaagagagtattgtttttgtgaagaaaaaagaaacagacaaacctgcgatgtacaagaagtagcaaataaccatctggtacttgataagaccactcacaagcttgtatatgaatctatctgaagaaaccgtgttgactagctgctgttgaatgatgcgtccatagacaaacaacatagccgtgaagaagaagtgccaattcaagagccagaaaccgggtaagcgacgttcttcatgagctcttctgcgaagaaagaagagctctttggccatgaatatctgtataaccacaaccatagcccaaatgtagagatgacccatgtagattataaacacaactccaccgagcatccagagagatgagcatgtccttatccacattgatctgtacttgttcttatcaccaagtaacaaattgcttactctgcttacattgcttctgttcacctcagctaaattctgatcaatattgaaaaagacaatcaaattttggattcaaccggaaaagagagtatgacattgtatagatacctcgcttgatcgcctgcggtgtcgaatgcgagctgttggagagctaggagtataattgtaatcccttggtgaattaggaatgttgggataatggttatctctctggttattagtattcattcgagacgttggtgtagtagggtaactagtatcccttagctttctaatccgtggagaatttggactgagatctttctccattgccattgagatccctaggaaatgctctcagttcctggattgagttcttgaaattcagttaatcatgatgatctgggtttctttatacatccgaggaaatgaatttggggttgatctataatttcaaaatgtcaaccataactcgagcttatacacgtcttaatgaaacacacacattgatatctgatgagagattacttgtgtaacaagcatataatagaggatttagatttgaatgtgtaagcctagaaatctaaatgattcatcaaagcaaaacgtgatgattcacatacaaaggataaatttcataagtgaacattgcaacaaaatgggatcatgacaagtagaaaaaagagaatgaacttacattaacgaaaacgtggtgggatgatggtgattgaaaatgcgaaaccctaattaatgaaaagaaacgtgaagaaagaaactcaaaaggtgagggaagaaggaggaggaggaaggtggtggatgagcacttagcggtgaggtttcatcaaatcatcggaagagagaaccaataaactattcatgtcgctgcttcatgtttaaacccggaatgagtgacacgtgttgtcttgatctgtttgggctgggtcagatatttaagcccattaaggaaagccttttaactattcagacatgagcatgaggagtcaacgaggtctgtgagatcagtggtcaaatcagtaaataacgcgaaaagacagggtctctcacctttttgctgttgttttttcctcattaattattgagttccgtaaaatgggtcccacttttcccatttcccaacctccataaccaaagttggagatttctctgtttcctatgctctctctctctcttactctcacagtgactattcgtcgcttcagatctaaaagagaggaagataaaccatttggattcaatatcgattaaggtaagaaagccatcttctacttgttggattcgattagtttcatttcagctcattgcctctttacttcttcaatgttgatttcttgctttggctttggttttatcaccaatgctgtttgatttctttgaagttcctttcgagcttttcttgagcttagtttcacattcttagcttcactaagttctttgatgtgtttttgttcccaagttcaaaatgttgtttctgattcaatttggttttctaaaaaagattgcaactttggtttcttttagtgtatagttagtttggatcttcactaaatatgttcgttgtttctacttttgtaggaaaccttttgacttcacaagaatg

SEQ ID NO: 2995 - DNA, 3000 bp, Unknown; identical to SEQ ID NO: 2988
  misc_feature (1)..( 3000): cDNA_ID_2781818_gDNA_ID_1620620_Annot_ID_162246 3000 nt of promoter + ATG

SEQ ID NO: 2996 - DNA, 3000 bp, Unknown
  misc_feature (1)..( 3000): cDNA_ID_1017855_gDNA_ID_1620620_Annot_ID_162242 3000 nt of promoter + ATG
gcaattagtagaaaattttcctgcagttgatgacgttgcatttggaaaatactgaaaacgctctttggtcctgatgccttttgtttgttccatttactattttatgcagatggattcttcttgaggttcttgacaaggtctctcccagttcagtcaactggaagcatgcttccaaaccaccgattaagatgccgtttagaaaagtagagaactgcaatcaagtcataaagatcgggaaacagctaaaattctcacttgtaaatgtagctggaaatgacatagttcaagggaataagaagctcattcttggtaatcattacccgagagctcatgtttctcttagcttgatacaaaaacatgatcgccttgccttacaaactggagatttatatggttgtgtatctcaggtctcttatggcagttgatgagattccatatgctccaacttctcaagagtctcagatctcggacactaggtaaagagatgactgatgcagatatcctcagctgggccaacaggaaagtaagaacaatgggacgaaaattgcaaatcgagagtttcaaggttcctttctttacaactacttcaaacacttaccacaatagtattatataaagtatgtccacctatcaccttctagtgaatcaaattaaaattctccaggacaagagtctatcgagtgggttattcttcctcaaccttctatgggcggttgaaccaagagttgtgaactggaatcttgtcaccaagggtgaaacaggttttcactactctttttactaaggtatagttacttactccgtttacctgaatcaaagcttatttgattattatatggttattgaaacgtacagatgatgagaagaggttgaatgctacatacatagttagtgtcgcaagaaagctcggttgttcggttttcttgttacctgaagatatcgtggaggtaagaactgagagactataatgtatcatcatccgaaatagcaattgctcagatgagatgtgttttggtatgttgtgacaggtgaatcagaagatgatcctaattttaacggcaagtataatgtactggagtcttcagagacattcacgggagagttcagattcgtcgtcaactcagagcaccacaacgacgtgcaccagcacagcctcgtcccctgccccatctgtcacagaagaggaggaagtctcctcattgagcggtgaagtcacgagcttggccgttggtgatgcggtttctgaaatcaccacggtctcagaggaagcatccatcgaatagagagagcgagatcacatatatactgatatacatctcttgctatagcaaagtagctgttataatagtgacttctctgtaatcttttgtttttttgtttcatcaactaaaattaccaaaaataataacaatgttacaaacactcaatcacatcgagaaaagtaaagtaaaattgtgaaaatttgtttagtacttaaaaagttaggaggaggaaaaagtgtacatcttattttgaaaacagacactacgcaaacaaccatggatcagacgacgatgatccacaacagtcaaggcaaacaagagatagatagctcaacagacgatgaagatagagaagatggaacgagacatgcagacaaaagaggacttgaaaaccgtggcgttgggcacctctaagatcaactacatggatcctaggatcacggtcgcatggtgcaaacgtcatgaagcacccattgaaaaggtagttaattatatacaaaacttgaatattgatctaccatgaaacaaagagagtcctctaataaagttttttttttgtaatggctggttcgttaatgtagatattcaacaagtcacttctggagaaatttgcgtgggcaatggacgtagaacctcacttcacattctaatatgcattgcactgcagcagctgatgagagtttctctataaaacagagcaaagcaggctacattttttttcttccaagtagataaattctttttgtttgtatctttatttgagatcatgtcttctttttttttcgtatatacaattgttcattgtttgcttgaattcaaatttagtctgttttataaaaaatgaaaccataatctttactattttaaaccataaaaaaaaagtcaattgtaaatacaaaacaccaaaggccaattaagatttattccaactggaaggatagagcaaaaaaaaaagaataatctggcgcaaaaatgacttacacaaatcaataagttttccaaattttgtttctttagcagaaaatcaaaaatgttattttggtcacaaatgtaaaaattggtataaacaaggttttaacaaaaaaagaaaaatatatatatacaaaggcaaaattacccctgagaaaatctggggccttgacacgacgatcctccatcatcctcttcctcgaggaacttcaattccaatctgtgagatctctgcacaacatcttgtctattttcaatcgaaacctctgtgagatcgcttttgatttttgtaattctcgtcgcaggatatctctctcattgggatcagacatggcttttgttgtaacatccctgatattcgctgtcgtaggcatcattgcttcgatatgcactagaatctgcttcaacaaaggcccctccaccaatctgtatgtcaattttcattcctttttgcttcttctccctttgatttagtcatctttttgctgtctttgatccattgcttcgtcaaagttaataaagtgttcttcggtatcaattgagatcattatttatctctctgagcttagaaactattattggttgatgactttatatttgctcattgacttttgctaatttgtttttgaatttgttccttcctgtgatgggtttttttcaatgtaagcaactagtaccgtcacagttctaactcttgtgctggaaaaagtgttgatctttttccctttttttatcattgacttcttatgtacttgtttgtcttgtttct

SEQ ID NO: 2997 - DNA, 3000 bp, Unknown; identical to SEQ ID NO: 2986
  misc_feature (1)..( 3000): cDNA_ID_1974423_gDNA_ID_1620620_Annot_ID_162239 3000 nt of promoter + ATG

SEQ ID NO: 2998 - DNA, 3000 bp, Unknown
  misc_feature (1)..( 3000): cDNA_ID_1819223_gDNA_ID_1620620_Annot_ID_162237 3000 nt of promoter + ATG
ttatattggatcatgttcaattcatctatgcaaacatttttttagccgtatgagtttccgtatgcgtgaacggtgaaccagattgtgacaagatttgcggaaccttagaactaaaaggatgcatttgggtctacctaagcaaaagactgagtttgtgggttaagcggcattattacgtttcgttccttttccttcgattagaaaaatattaatgtaactcgtgtttcgtgaaacgagtcttttgagggtcaacgtactaagttgcttctaacccaaagaacaaacagttgtagtattagtatagtgtaattgtgtccttgtatgtagttagcacatgtgattctaaaaaacttgtgacaagaagtacctaaatatgttgttgattcaagccaaataaagcgtcttttgagctttgtttttcatagatgacaatttgatctaaaatgcttagagagttagagggaaccttttgcctacgtgttttagaacaaagaacataagtgtggagcccttgttcacattttcttagtttaaatattgaagatcttattctgttctcaagctctcatatctgtggtaactttcggcccattgtcgatcgagaaaataaataaaaaaactatacaaaatatggaagaaggaaatgtcagtaacatgttgcaaatgatcatactctttaataactttttcttttgagcaaacactcactctataatatctataagtgtaaatgatgacaaaaaagggtctataaagtataaaaaatttccttcacatgcacatgcccaacttcaagttttgtgtatgatgtttctttaactttttattagtggttatttcccaacttgtgtttgtttggaagcaattatttcaaaattatataaattcttaactgaatgtttgtcgctaatgttataaaaaaggtagtataaaatatgaaattagtctcgtttgcttggttgtaaactacatctatgtttattcatgtgtatattatataatgtacatctagctaacagacaatagtcatgagtctatatgtatataggagagtcgagcctttataatgaaagaaatagatatctacgttcttttacatttgacaagaatcaccagatatacataaatcggaaataaattaattagtgttaaaaggcaactatatagtattaaaatgctcattatttttagtacgtagttggaaaaatgtatgtgttccagtttacttgatttcattttttcatcgttatcgttaggacaaaatcttgtctccaaatcttgttttattttttcccacaaaataccaaaaaatatcgtttagttttaaagttaaatcttgtttaaaccgcgcgatcatgtgtatcgtgacaatatatagttatatactagtatatgttttgtaaggttccaataatttagggtggcaagaattgaattttaataatcctaatggacagccaggtatgttggtcgtcgaatctcgaatcgactgaaccatcatatatagaagatttgataaatataactgagaaaataaatgcaatacaaaaatgaaccaccctaaacgtataatttacaagatagaggtcaatgatatgattagagagcctaattaaataagggacaggtattggaagttgaccaagtaaaaataagtatattaaaagtcaaataaaacatatattccaacatcaacatcagcatccagtgagaaacgttccttctgaaatgtttttatttgcaaaaaagaaagataaattgtcgaaagtgtttagggtttatgtttgggtgtttacagcaaacaacggtcccacgtataaacgtgactggtttgcgcgtttgaactgatgtcatgactgaccacaaatagatattcgccacgtgtattattacagataagtcatgacggccatgttgtgggtccctctgtagctgtttattattcattcaccactttgttgctgtttaatttggcgctgcgccgagccgacaaccaaaagatttttctctttttctgttgtcttaatgatgtcataccaaataatcccagcattgtagatttgtactaatatttttttcttagttcgacccattttattaccctaaaatatagacacaaaattgtgaatgttgttaatatgttcttttgtagtaaagacaatcaagtactctgtttttcttcttttcttttttgacataaggatatacatttttcagctttaaccaattggttggttcagatttctaaatttaagtgaataaatgaccaaaacgcttttaaaaaaataaaaatcaaaacgaatttcatttggttcttttgatattataaccatgaatgccaatgcatgcaaaggtacaacttcatgtcttcatcatttcagtgaggggccccaattgttagccatattaatgatcttcttacaagtactttaaagtttttgttgtacgtagtggtacagtaaaaatatagtaattgtttcaagcataaagcaaaaagttaacgataccataaacattagtttttgttataaaagttcttgttatacgtacgtggttgtattgatgatcgacttatataatcacaaagggttaactatttttgatatgggaattatcaaagcccggtgaaattaagagtccgaggaacaaagaggtcaacaacaacatcagctgaagccgacccgaccaaaatctcggctcctcctccacaaaatcaaaatacgtgattacgcgtaattttggtagactgcaatattaaataaaaaacttgtaagaaagaaactaatcatcagactttttttgataatctatacttaatttaaattaatcaacgatcgtataaatgagaatcccacaaaccaaatagccagaactaataacaagactctttctctctccacctctctttctctcttaaatttcgttctgtctccggcgaagtcgccggcgggaagctaaaaggcaggttagaacgaattcccggcagacaatccaacaatg

SEQ ID NO: 2999 - DNA, 271 bp, Unknown
  misc_feature (1)..( 271): cDNA_ID_1010729_gDNA_ID_1620620_Annot_ID_162234 3000 nt of promoter + ATG
gaattccagtgaaattcccagaagaacagaaatctaactgaaaccgcaagaacttactgtaagcccaattctgttaatgataatgttaaatgggctataaaatgagccccgtcatcagccgctgaagtgaaacgcatcgtttagtatcgtcgtcttctggggaaaatatctttttttttaaacactatcaattcgactggaaaaaggatatttccagattaggtagagagagagcaaaagtactttcattcagacttcagtttaagctatg

SEQ ID NO: 3000 - DNA, 3000 bp, Unknown; identical to SEQ ID NO: 2992
  misc_feature (1)..( 3000): cDNA_ID_1819177_gDNA_ID_1620620_Annot_ID_47007 3000 nt of promoter + ATG

SEQ ID NO: 3001 - DNA, 3000 bp, Unknown
  misc_feature (1)..( 3000): cDNA_ID_1819170_gDNA_ID_1620620_Annot_ID_47009 3000 nt of promoter + ATG
aatattattattatattaacgaaattttctttttgactttttctgttcaacattaatttgtaaatttatgttgtctttatagataatatttacatggtcgtgtttattcatgggacgggggtgtggtcgtagcaactactacgaggctcaatttgggcaaatgactaccatcgttcgttcggtcgtttttttgcgaaactatgatataatttttaaatacatatattgagaaatatttagaccattgctttttgttcgttattttatgagacaaaactacaaaataaacaaaaaaaaaaccaaacaaggcaagaaacacaagttaagattcggaatctaagaaaaggatatagttcttgaaccacataatagtggtccattatttatttggcagtctctacgactacgatcgtacgtccctccttccatcaccgtttgttttatttattgtttcttttctttttttactttaaacaaccatttatcatgttttaagacctcgacatgtaattcgaattagtattgcattaagatttaaagagttacggcggtggatcggtggtagtcagtgcaagtaacggatcataattgcggttgaccaagcctctttcactggcctctttgtaaccatgaaagctgagatgctattggtacaccactaagtcccaaattcccaataatcgtgcgtcagtaaacatcaatttcgagaggacaagtatcaaaatgcgatatctgctgttacaaatattcaactcagttacaaagcccttaacaatgtattgatttctaattttctataaagtaactttgtgaatacacctaagtttatcaatgaagaataaaattgtttaaaataatcgacaaaataacattatacatgaattttacaacaagtgtttgagcatagtagctaagttgttttcttggggtactctcttggtccgaaaatggtggaaccaaccctcacattggtgcttcccatctcaatctgcagaaacatagtcaaagatcatcttccacatatatgtggttcctcggatgaaagaaagaacacattcaaatgattttcgatattgagttgattgcattttcgatattagaagagagacaaagatattaccgctagctcgaagtcaccagacatgcccatggacagttcaaattgatcctcagccattccaagtgccttgcatacatcagctctacagtttgaaagtgtctgtcccggtttatggggaaaagaataaaccttggtaagtaaaacttgtaggaataacccgagaacacgtaaaacaagtatccaatcaagtagtagaataccctgaagttctctggggtagacgtataatcaggcatcccaatagtcattaatccggagaataccagatttggacagtgatgtttcacatgtcttgctagctctacaacgctagaaggttcgattccagatttagctgcatccataatcaatcagtcagccaactgaagaggctggacaaggaaatcagcatagaggtaaaatactcacaaacttctccgcttgtgttcacttggaccaaaacctttagtggatgtctcccaagatttgaaacagctcgatctagatgatttgctacctgtgaaatcaatcccaagtgattgtataaccaaaataacctcctagtaaagtgaattgtgcaagttaaacgccacaacaacctctaatcgctagttataataccttttctccatccacaccatgaaccattgccaaatttgggactccagctgcaaacattggattaaacgactttcactttcactaaacccctaattcaatattaaagatggggataaaagtcagactcaatagcgttttggctttgttgctctgtaaatgccccacgaaatgccactctatatcttccggaagctgtatatcaatcaaacaaagtgaaggagaagctccattagcatcatcaaaagcacaaaatatatcacattcccagaaaatggagagacacatagtagttagtgattgaaggataaacattcggattttgaaatgaaatcgattatctagtgaagataacaaggattggagagaggaacctgtggagctttatcgatgatttcttgaacgtaattctcgccgaagcaacggtgacctgcgtcgtagatttggcggataagtgagacgggtttagtcttggagactggaaggaccctgacccgctcggcatctcttcctacttgctccgccgccttacgagctctaagaatcacagagcggagagcacttgcgacggttgcctccaccgcaggagctgccatcgccaatcgccactaacgcctgtcgtcaatttgggcttcttcgggagtaatgtttttgtcacgtaaattagtttatggcctttaattggataattcacggtccacacgttcaatactaattgcgattatttatctcttcacttttaatcaaaatttccaaggcagagacacatgtaagggttgatgtatatagtcatcaattcacgagattattggaatctttattgcataaacaatatcaaaattgtgtttttatatataccctttcaaaacgttatgggattcaaaattacacccacacccaccacttattgattggacataacatcattcaatgtaaaattacacccacctcttattcatgttttaattttcacttctgtatatatttttcgaatttcatgtattctgtttgtacttttttgggtcttatgttaagcccatttgtgggtttgtaaaagtctttgacaatatccaataaatcagtgaaaaaaaaaagaaaaaaaaaattattatcactgtaaacttcaaatcaattcaacttgtgctttacatgggtcttcgctggaccaatatgttttgtgggcctttcaagcccaacaatagttatctaccctagctcaaaaagagttatcttattctcattctctctctctctgccgcagctatcaatttactggagaagag

SEQ ID NO: 3002 - DNA, 3000 bp, Unknown
  misc_feature (1)..( 3000): cDNA_ID_1819160_gDNA_ID_1620620_Annot_ID_47012 3000 nt of promoter + ATG
ctaaatcggttgacaagtcggaattttccggtacaccggcgtttatggccccagaagttgctcgtggtgaagaacagaggtttccggctgatgtgtgggctttgggatgtacgatgatcgagatgatgactggatcaagcccttggccggagttaaacgacgtcgttgctgcaatgtataagattggattttcaggcgagtcgccggcgattcccgcgtggatatcggataaagctaaagactttctgaagaattgtttaaaggaagatcaaaaacagagatggactgtggaagaattacttaaacatccatttcttgatgacgacgaagaatctcagacaagtgattgtttgaagaacaagacttcttctccaagcactgtgttggatcaacgattttgggattcatgcgaaagctccaaaagtcacttagtttcgattgatcatgaagacccttttgctgaatactcggaatctttggattcaccggctgatcggatcgagaaactcgccggagatgagttttcaagcttacttgattgggatacggaagacgatggcggatggattcaagtgagaggcgagaaacataaagaaaccgagaaacgcgacggcgacgaagacgtgatttgcgttgaagcaacgtcatcgtcgcaaacgattgaagaagttgaagattggatttcgaatcaagacagcttgttctcggaatattcctctgacgacatcattaataatttctactctaatgttgctattcaaggaaatttaattgcatttcattattgtactgatgaaggtgaaaatgtatccataaagaatatgtttcgtactaataacaaacatttgtttttcaaattgcaagctcatgttaaattcactaaccaagtctgatgaaacaatgtccatgtgttcaaacttcaaaataaaagaatctatgtacattagtacattacctaaatatttccaatgcaacatatgcgttaggttatgtgctaacgatcactattgtatggactctagaagacaattcaaattgcatatttcaaagttggaaacacaagtctttgtgttcttgttagaggttacgtcaatctataagataagattgactatagacgaagtcaaaactgtactttgtccaagatttatttacacacgaagtcatgtcaatacaattttgtgtgtgtttacctaaaccgcataagaccccgttatgttaacgcagacgactctctgggagtacataatcatagtcgtaaattaattactaagcaccaaaatacatatttgaacaagtaaataaaatgatatctaataactttagtcaactttcaccgtctgaaatctaaaaacacacatacaccgacactgataatttcgtcggtcttgagagttgatagttctactctatagacatgattattggagcagaacattcctactttgacaccgatacctaacaaaacaaattagtttatatcaataccgtacaatttattaggtaccgtttgtagaaatttgttgaaacattaattatatttttcttcccgtacttatccaaatacaacaatttaagaataccacttaatagaatgatatcctttggtcgacaatagctctaaatcactttcacttagtataaatgtattatgtatagtacaattttttttgattattttatatttaagtatttgtcttcttttaaatcattaaaacattgatatgaactgttgtaagctaatactattacaaaataaaataaaaccattgtttcttaccatcattctcattgccactatctttaatatttcataaaagcataacatataataaagtttacctacaaaatgaaaactgatcacaggtagaaataagttcgttgtgacttaaaagttgatgctgatgattgatgagtcagtgatgacgtcctggtgacattcatcaaacgcataacataccaaagttacttgtcatctctttttgtctatcttttagttttagtatgggtttgtgaattggtgatagtagtaagtggtgaatgcccaaatttgaccacttcatcgcataataaacttatataaaacaatctgataaaaatattcacaattactgcaatcaaattctatgatgaaaatggttattaagtttacctgcagaaacacatgctatgatgttctccaattcaaaataaatcaattcaaccgatccaaaaacctacataaatgttttgaatttatgtatgatgtaaatgtaatagtgtcttgttaaaactagagcatgttactaaatcattatatagaaatgagtcagatagaagaagtattaaaaagagttgacttgagaaaaaggatgggaacttgggaagagttattgttggcaaacacactcaataatagcaaatatcatataaaccttttatttttgtccttttctgttttgctcatctttcatgccttgcattagatggctggagttggtgtattacatataaaccgtaagcccttatatccattctccaatatttaatttcatctcaaattcaaactggtactgaaaatttattatttctgttgttatttctctaagagacttatctatatatatatctcctatgcatgatatactatatagaactttcaatatttttttttttttgatcaaagattattttcttttctttaacttgtgttttattaatcactttctatccgttgtaaatcatatatattaagagcatgagtctaaaatactcacttttggtgactagtaactttgctgtaccttcattttttttaaaaagagctacaagactctgtaagagtgaaacgaagcccaatcccattatctgttatgaaaagttcataaaagcccaattaatatacaaattcactacacgaggagaaacgacgtcgttagtggagtggtaagtgttgacaaagtgacgagtgacgacgaccttttgaattaacaatcgaagcagtgactgagtttgatatca

SEQ ID NO: 3003 - DNA, 3000 bp, Unknown
  misc_feature (1)..( 3000): cDNA_ID_1819156_gDNA_ID_1620620_Annot_ID_47013 3000 nt of promoter + ATG
cgtctgaataggagcttaagtacatggagatatccgctataatccatgtatcatttgctatacggtgacaatatcggagaacttttacttttcgggtcggaatgaccggggtaattaatgtcagaaactccatatcaatgatctacatgtccacaaatgaaagctattattaaagataaaatgaatataattgaaataaaaaaggaaaaaattaatatattaatcgaaaaaacgttttataccatcctaacatcgtcgttgcttgattcgattgacacatttccaacgagtgatgggaaaatagtcacccaacgcatctaaaaaaggtatagatagaaaagaaaaataaattaaaccctaattctactatacatgtaacaagaaattaatatgattcattctagttagttattcttgaaggaatatatagacttacagggtttttaagttttgtcaaaagccatgaagcatcaacgtggattacttcagaagctcttgacgcctcatggacaaaccttgggacgttttttgcgtaccaaggaaagaatcgagagtagtattcgttcagagtcagcatctcttcacgttgtgatctcctccacaaaggagactcgagcgttgctaaagcaataatttcgttgactatacatgccaagaccacccataagttaagcaagtacgaggacacgttcgggaattgatttctccaaaaatccaataacattgtgaaggcattgagtgtctcattgtcagaccgcgaaacagcattctcgaactgcagctcattggcctcagacaaaatttcggtttggttgatgtttccatcttcagatgtcaaagttttttgagatgccatggtctacctgtaattcgtgttacaaacgtttagtaaggaattaaaggttttggataacatagatctagttacctttttttaattttactaaagaacatatttgatatgacaaagtagatcttatcctgatataatttcaaataccctcatttcaaatgcacacatatttttatttcccttaaaggggttggagattttatcaaagcctttttttaaaaatatacatttcaaaaattgcaatataaaaataaaaattatcaaaagataaatgagatgattgaaaagttgtatatattttactaacctgtatcaaatatttgcgatgcaagaactggtgtcttaggtgaagcaaactacaagggatctgattggggaggatgcaagtatgaaattttattttctaaatctagtgcaaagaggaaaaatttctttattatccaaagaattattttttcaattaaatctttttcattacataataaagaaaaaagctgtatattctatttcgtcatagtcattcgtatttatagaaaatataaaccgcgtgacaattcttatgtcaaagttgtgtatttgtttctatgataatactatgatcatttcatcattattttggtataaataaattgtatctaattttttttcaaactttgttaatttcataaataatagaataagtgcgaccagaaaacataaatgaatcaagtaattggataaaactataaaaattttatagaaaatataaaacgcgtgacaattctcatgtcaaagttgcatatttgtttctatggtagtattcttatgatcatttcttcattattttggtaaacaaattgtatctaaaagatagttaaaaatttattaatttcataaataataaaataaatgcgatcagaagacatgaataaattaagtaattgaataaaaattggaaaatagtgttgacagtttttgtttgtgagtcttattcaacgcataaaatatacaataaagaaagttaggaacttatttattttagatcctttttttaggtaattttaaaacttcaaagtaaattatgactcaaataattatttatcaagtaaaaggttattggtaaacattttgttataaaactttagagcatctttatccatatagtttttcaaatagtaaagaaattcactatcaactttttcccaactgtaaaagattcatgtacaggaccatcaattaatggagattctttcagttcttcactgtttcaatctttaactaatcgtcgtgatgaatacaaaatagatacattcagaaaagcaaacacaaatgacggaaacaaattgaaaacaaatacatttaaaagttgcatatttcgttgattgttgattaacattgcttgtcttatcgtactaactacaagtttacaacatcggagtggtttttaattgcttaagatctctaaaacgatttcaataatggtagactgatcttcatttcgatttcatgataacaccgaatgttaggctttatatcctctaaatatcgacatgcattgtgaattgagaccgtaccccgactaatcttgtgacttaatggtcataatggtcgtacaccaattattcacaccggttaacagtaaccggaaccacaatatggaattgaaaagcaattcaactcaaattccagatctttttcttttgtcaaaattgtacaactttctgtttatacattgtgccaaaaataaaataaaaaacaacgaattatagtttgacacgtgtaaatcagaagacaagtcttatgaactttgccatattccggtgacttgctccaaagtctcatatgcgtttaccgatcttctcgattctccaattccaaaccctaacattttgattagtccttctgggtttccacagccttgaggtttgatttttttattttcgatctttcttgattcatttttgttttcggtagcgagaaaatatctgaatcggaaaaaacatatgaatctgagttttgttctttggtttgaaagttcttcaaatataatttagctgacaaactatagatgaggatgaaaaaatccttcctttttgatttttaatcattttgctgatcaattgttccgacctgtgttcttcaaaaaaaacagagattcggaaccaatg

SEQ ID NO: 3004 - DNA, 3000 bp, Unknown
  misc_feature (1)..( 3000): cDNA_ID_2999628_gDNA_ID_1620620_Annot_ID_47014 3000 nt of
tgccatcagtaattgattcccccatatgaggcacaactgcttccacggtatctccttcagtaacaataacaagaaagcgtgtgagaaaaccctacaaatccaatcaaagctacagtagtagcagattgcaaaaccataattaagagatacacgtttcataagaatctgcatccgaatggaatcaaaactatgagctcctggatttcttctaagcaatcataggttcccagatatggcaaacctaataccacaacaaaaagagagaaagagctcaggttgaacatacataccagtttcagctgaaaaaggcctgacccatctttgcagggttgaagaaactaaactcgccgacctcgagatgcccgagttccctgctagtgggatacaaacaaaataagagcacaaaaatcttaagaaactaaaactaacccaaaagtcacatataaataagttgtaagaagtacctggcaaagcaaggttatgaaagctatgagcatgatttccacgatgcagatatgcctgttcagattctcaaataaaactttattagattgttcatcgaaaataagcagatacatagaaatctgatgataagatacataaccatatactaccaactcgattgggaacaaaaacaaaacgtacccctgtttctgaacctgatagcaagctaggggaagatgcagcaacacgagaagactgcagtgattttgcgaataactgataaaaatatatagagataaagttgtcacatttcgatagagccgatcaagttgtaccaaatgagataaaatcgagcactaaccgaaggagaagagccattactggcagctctccttataacagcacgcatcatcattggttccgaatctctgttttttttgaagaacacaggtcggaacaattgatcagcaaaatgattaaaaatcaaaaaggaaggattttttcatcctcatctatagtttgtcagctaaattatatttgaagaactttcaaaccaaagaacaaaactcagattcatatgttttttccgattcagatattttctcgctaccgaaaacaaaaatgaatcaagaaagatcgaaaataaaaaaatcaaacctcaaggctgtggaaacccagaaggactaatcaaaatgttagggtttggaattggagaatcgagaagatcggtaaacgcatatgagactttggagcaagtcaccggaatatggcaaagttcataagacttgtcttctgatttacacgtgtcaaactataattcgttgttttttattttatttttggcacaatgtataaacagaaagttgtacaattttgacaaaagaaaaagatctggaatttgagttgaattgcttttcaattccatattgtggttccggttactgttaaccggtgtgaataattggtgtacgaccattatgaccattaagtcacaagattagtcggggtacggtctcaattcacaatgcatgtcgatatttagaggatataaagcctaacattcggtgttatcatgaaatcgaaatgaagatcagtctaccattattgaaatcgttttagagatcttaagcaattaaaaaccactccgatgttgtaaacttgtagttagtacgataagacaagcaatgttaatcaacaatcaacgaaatatgcaacttttaaatgtatttgttttcaatttgtttccgtcatttgtgtttgcttttctgaatgtatctattttgtattcatcacgacgattagttaaagattgaaacagtgaagaactgaaagaatctccattaattgatggtcctgtacatgaatcttttacagttgggaaaaagttgatagtgaatttctttactatttgaaaaactatatggataaagatgctctaaagttttataacaaaatgtttaccaataaccttttacttgataaataattatttgagtcataatttactttgaagttttaaaattacctaaaaaaaggatctaaaataaataagttcctaactttctttattgtatattttatgcgttgaataagactcacaaacaaaaactgtcaacactattttccaatttttattcaattacttaatttattcatgtcttctgatcgcatttattttattatttatgaaattaataaatttttaactatcttttagatacaatttgtttaccaaaataatgaagaaatgatcataagaatactaccatagaaacaaatatgcaactttgacatgagaattgtcacgcgttttatattttctataaaatttttatagttttatccaattacttgattcatttatgttttctggtcgcacttattctattatttatgaaattaacaaagtttgaaaaaaaattagatacaatttatttataccaaaataatgatgaaatgatcatagtattatcatagaaacaaatacacaactttgacataagaattgtcacgcggtttatattttctataaatacgaatgactatgacgaaatagaatatacagcttttttctttattatgtaatgaaaaagatttaattgaaaaaataattctttggataataaagaaatttttcctctttgcactagatttagaaaataaaatttcatacttgcatcctccccaatcagatcccttgtagtttgcttcacctaagacaccagttcttgcatcgcaaatatttgatacaggttagtaaaatatatacaacttttcaatcatctcatttatcttttgataatttttatttttatattgcaatttttgaaatgtatatttttaaaaaaaggctttgataaaatctccaacccctttaagggaaataaaaatatgtgtgcatttgaaatgagggtatttgaaattatatcaggataagatctactttgtcatatcaaatatgttctttagtaaaattaaaaaaaggtaactagatctatgttatccaaaacctttaattccttactaaacgtttgtaacacgaattacaggtagacc

SEQ ID NO: 3005 - DNA, 3000 bp, Unknown
  misc_feature (1)..( 3000): cDNA_ID_2167230_gDNA_ID_1620620_Annot_ID_47015 3000 nt of promoter + ATG
ttgataatttttatttttatattgcaatttttgaaatgtatatttttaaaaaaaggctttgataaaatctccaacccctttaagggaaataaaaatatgtgtgcatttgaaatgagggtatttgaaattatatcaggataagatctactttgtcatatcaaatatgttctttagtaaaattaaaaaaaggtaactagatctatgttatccaaaacctttaattccttactaaacgtttgtaacacgaattacaggtagaccatggcatctcaaaaaactttgacatctgaagatggaaacatcaaccaaaccgaaattttgtctgaggccaatgagctgcagttcgagaatgctgtttcgcggtctgacaatgagacactcaatgccttcacaatgttattggatttttggagaaatcaattcccgaacgtgtcctcgtacttgcttaacttatgggtggtcttggcatgtatagtcaacgaaattattgctttagcaacgctcgagtctcctttgtggaggagatcacaacgtgaagagatgctgactctgaacgaatactactctcgattctttccttggtacgcaaaaaacgtcccaaggtttgtccatgaggcgtcaagagcttctgaagtaatccacgttgatgcttcatggcttttgacaaaacttaaaaaccctgtaagtctatatattccttcaagaataactaactagaatgaatcatattaatttcttgttacatgtatagtagaattagggtttaatttatttttcttttctatctataccttttttagatgcgttgggtgactattttcccatcactcgttggaaatgtgtcaatcgaatcaagcaacgacgatgttaggatggtataaaacgttttttcgattaatatattaattttttccttttttatttcaattatattcattttatctttaataatagctttcatttgtggacatgtagatcattgatatggagtttctgacattaattaccccggtcattccgacccgaaaagtaaaagttctccgatattgtcaccgtatagcaaatgatacatggattatagcggatatctccatgtacttaagctcctattcagacgatttacgacctgagtttctcagatttccttctggatttattattaaacatgtagcaaggatattcagaggtacacttttttccgttttacaatactatatatagtatcgttttagcctattactactttttttttttttttgttatcacattaagtactgtttgaaaacatttgatatatataaaatatctaatttgatgttagagagaagactaagttcaatcggttaaacgtatgtacgtaggtaactatgttggaacactgggtttacaaggaggatgcaattctaaaccggttgaggccttacctctcttctggtttaggatttggtgccaagaaatggctcgtcgctctacaacgatactgctccaaaactacttatgttccatcaatgactatggggaaccaacttctctctagtagtaaaagattttctgttttatttttgattagttcagattaaccgttttcttatactgacataaccaccatggtatactcatgcagtaactaattccgccggtaagaacaacttgctccaagcatcaaaacgtttggttcacatattttgctccggtacgtgtggggtaatcgggaaccgagggaggtggctcggtgcgggtcgaaggtttgacgtcagagtttccagtctagagagtcgggacatgataaggcacccttatggtattattagcgctagcggtttgactaaaatacatgctaaaccggaaatactatttcctttaatctacggtgtaaagaaactagagatacataaccacttacgattatctggaaatgatttaaaacaagtccttcggatcacaagagacgacattacttcgaggaatgacgtctccctattcagtttccgggtacgtagataagattatttcttatgaaaaaacaaaaacgatcgagttatacatattgttcactaacgtaaaatataattaacacgttaatgaatgcagctgaataattctacggaggtgtttttgcttcaagaagcatacaatgaggcatcatcgtcgatggtgatccactccatacttgacgtgtcatctcttgcgaagattataaacggtgaccgttcctactcctttacctatccgtgtggattcaccataatgccgggccaaaactccggcgatgaagacgctggatgtgttgtgtctgttggatttctgacgattgcaactgaagagattgtagcgaatacactggtgagtgatgtggagagaggaatttatctgctactattacaaatttcgagaatgtcttagcgggaaatcagtaactccgttaaaagctttcatgcgtttggcattttttaatatgttgtttggaattttcaaactttttagtcgtattatatcaagttctatgtatccacatacaaacttattctacaccttttaatatattggcattaattatctctaccaaagaagacaaattcacatgcatttacacaaacttgctaaagatagataaaaaaaaatgatttacgtagataaagcaaaaaaaaaaaaaaacttgagatttatatatctaatgagttggctttatacgaaagtaagccaaatatactcaaggggactttttgtgttgtctccagagaaacaaactctggcatgtctctctcttctctaatctaaatatcgtatatcctctgtttttatttataggttctgcgtatattaccagagttaaatctttgttccttttaccttcttgctccttgtcatttgtcagagaggagaggtaacaaagaccgagtatggaagaactcagggggtgaatatcattttgttggttccaaatctttttttaagaccccccctgacgttctaccaatcacccgggacgcagagggggca

SEQ ID NO: 3006 - DNA, 3000 bp, Unknown
  misc_feature (1)..( 3000): cDNA_ID_1819140_gDNA_ID_1620620_Annot_ID_47018 3000 nt of promoter + ATG
acattcgaataattggcttttcgtcgaaagatgagaatattttcttttgcagaaagtaattttatattcacaaactaaaatgagtaatttataactacagcctaaaccagaataaaatttagaactacacttattttggtaatacgaagttttgattgggttatgagtctggcacaagccaagtaggatttctcctctgaaacattaaaataattattctatgtatttgttttttcttatatccactaccatcatgacatgaaaatgaataactgttattcaatcaaactgttttattcaagtcaacgaagagaaacaaaaggtagctaggctcctcttcagctatgaaggacaaggcaggctaaaagtctcaagcattatgccaagagacaaacaccctaaacaaaacaaagtataagaagatggcttctcattttgactcttctaagtcctcaatgacagcgtgaaaggacacaattttagggtcttgaaaagctctctggtcttatggctcatctgtaaggctcaaaccaatcggttgtgtagagtacaacaaacaaaataattgaatagtatgttggtttgtcatctgcgtgaagagagatgtgtttaggatggtggctgccatgtcccgggcctaaatgatgatccagatcctgatggctctgttgtcctgcatcatcatcaacatcaacattaacattagtttaatttaaagcataccaaacacaatacataacttatgttcatagagaacagtttcagcatagtagcagtctgtaactatcagaaagaacgagtcatgtttcgtatccgtgagctagaatctgaactttaggattaacaatgtcaagttggctagacttactttggttcgggtggttctgcagaaactatctcgggttcatgttccttggccctgtaaagcaatgtgagaacatgtggttatgttagtcttctgaaagatgttgtgctttgcatccaggaaaaaatagaatgtaagaagatttaacacatatatgattagtgcggagatattatgaatcatgatgactcaccttgatttatctgcttcttcactagcttcctctggttcaccaccttaaagcattaacaaaaaaaggaaataaacttaactgtcagtcttacttccacgactttatggtcgaaccataatctcttttaaggttataagaaatctagcaactgtagtaacctcagcccttgaatcaacaaatgacttaaacgatatataatggtgcatgagaacaattttgttgcccttttaagctaccgcaatcataatggttatatggggaacattcaaaagatgtttctttcacaaaactattataatcatcagccaatggacaccatttcatgggtcaaacaccacaaaaatataaacgcatatccatcataatctctatcaaatttacacaagggattcctaagaagttagtcatcagcatctatggtgactcaattaatctattggcagagaaaatgtaataccttttgaatctggtggaaattggcgaacaaagcttgtcaaatctggaccatcaactttacctttacacaaggagaccgaacattaagctaccaattcataaatgaaacaaattttctgggctctaatgttaattaccaatggtgattttgcgtccggtgcctactctggctttcttctcctcctcttccttcttgagaacttgacaaggaaataaaggcaaaagaaaaacgataaatgttttgccttgaacttgagcgacatattaaatggaaaatttgcatacggatttcttgacttgctaacacagaaacagaaataattcttgactttgttcattcacaacttcgaagttcataaaatcaagtcctcaaagtcataaactgtttgcagtaaggatcaatgacacaaggaaataataattttaagacgtttaaaaggatataagtttagaaaatgtatttataagctgaaacacctacgagcaacattaagctttacacgctcacgccttgcttcaagttcaatcatttcctgaaccaataacaaacaccaatatcaaaggccaagcatagccagtctgtatgcaatgaaaaacttccatggtaagaacactatgctgaccacaaataattctggttaaaaaggagtttatcttacctcaggagtaggagccctttttcgctgcccattcagccaacaaatccattcaactacaacattgatcaaacaaaaatgtaactagattcgtgtatacatgccatatatcttatagatgtgcttatttcagatctgacatcactcaagtaaatgaatatatggtcgtatataacaacccattttatgttttaaagaagagttaccaggaatagaggttgggtcctcctctcgtctaaacttgacccatcttttctccttcactggatagtagaaagaagcacatcagaatatattactctacaaatggattctacaagagtcttaatattcgttttgatcatctaaataacctctgttagtttcattttacatgatcacacttagctgaatcttttcatgtatgaaaagaagcagacaatgttctttaaaacaatacgatattaatttttctaaatccatttgcttcactgcaactcgcgatatgcaaagacagctgattcatcaaatcgtacggagaaaaccaaagaaattcagcaacttgacaaatttaagagatacataaatttcacgcaataaccaaattccaacataaatcaaacaaaaaaaaagattttttaaggaaataagaggttggaagaacaatactcgccgaatccgtcaatctcctccattctggaaaagtacttgttaccagtcttgtctactccgataaaactcttgctactgaacaatcccgcaaatctcgcccatagcctcgacatagcttctcccgccgatttcttcttcgtatgatccaaaaactcaaacacaacacacccagaagaatg

SEQ ID NO: 3007 - DNA, 3000 bp, Unknown
  misc_feature (1)..( 3000): cDNA_ID_1809003_gDNA_ID_1620620_Annot_ID_162276 3000 nt of promoter + ATG
acattctgactctgacgtaagaggtaaaaagttaaaaataatactcgacacttacttggaatttaaaactgagttggttttgaagaaatttttttctaattcttttgcagaagaagaaaagactctttattagtctctgtctctatggacacagatctgatcagcaatctccccgatgatgttcttggcaaaatcctgtctttagttccgacaaagcttgctgctgcaacgtcggttctgtccaagaggtggaggaatctgcttccgcttgtagatagccttgattttgacgaaacgatgcttttctatcccgacaacaaagacggagaggacgaagcatctagttacgagagtggtcaacgtcgacgtcatagcttctctcatttcgtggacaaaacgcttgctctgttaagcaatgctcctcttaccgagaaattctctcttaaatgctatcacgaagatgatggagctcgtatcaaccgttggattcgcaccgcgctagaacgtggctgcttggagctaaacttagaggcagccaattatctacctatagattctcagtatttcactagcaacacactggttaaactcaccatttccgatggattttatcctggaggccatcttcttccttttgggggtgtgtttttccctgcgctcaaaacacttactctcgtttcagtttgttttacaagtgttgagatgattaacttcttcatccatggatgccctgcgcttgaggaattattcctatgcgtttggatgcaatacatgtcaagtccaaacgtaaagcgagttaccatcactagtgattttgatgacgatatccaacgtcctagcatggtgctgaagacaccgagtcttgtgtaccttgactactccagttatgtcgctggaaactattatgttgttttggattcgctagtcgaagctagactggatcttcgattatatgagccaatcatctatgatgaggatggtttgtggaatgcagaagtttttggcaatattacgaatctgattgaggcgatcagaaccattaagatccttcacttgtctcctagttctctcgaggtcagcttcttctcttgagtcttcacatgatgcaggagagagccagtctagtgctagctagcaaggtctttaacttatttatatatggcttacacatatcaggtgttttactattgttgtgatttgccggtgttggaagatctcgttaatttatctatcgaaagtgacaaggaaaaaggctgggaagtaatgccaaggctgctcaacaagtccccaaatctacaaactttagtcgtcaaggtattatcatcttttcaagaaaacacacataaattctgttccttcttgtcattatacatgtcaaatggtggtgtggtttcagggtcttgtgcacagagttacatattgttgtggagacgcgtgcgcttgcatccgtatgaaggacagggagatagtatcctgtttgtcgaggtgtcgagtgaaggtgcttaagattttagggtacggaggaagttttagagagctgaaacaaatgaggcattttttggggaagttgaaatgtctcgaaactgtgaaagttggcgttaaagagggcagcaaaaagagtaactacttggtagctaatgtaatggctctccccagagtttcatcaaaatgcaagattcaattcatatgatttctccctctttctctctcgtggttatgcatttgtttaaagtttagaaatttgtttttgcaaaagcatatatgcattcttctcaaaattttcgtttaagagtttcttacactatctaacacaagaaaacagagttatgcacacaaaaaaggattttactatgtcaaacctttttaaaaagatgatttagaaaaacagtaattatgatagttccagctgcttctaacaatgagaataatgatgaagaaatgttaaaaaaagcaatttttttcttaaggctgaaaaggttttgctgaaatggtttcgggcttcgataaggctggccctaaaacgttttttttcttcattgttgtttttttctttttctttcttcgatctaaagctctcttcttcttcttcaaacggagctctcttcttcttcttcaacctttgttcttcgatctctgtcttttttttttttatctcttcttcgattgtaagaaaaggtatgatttgtctctctatacatttcatctttcttattttgacactttgatcgattctctattttttggaatctgattcatatgtttggggtttaatagtttcagctcaaagaaatctgggttaaagtgtgtttgaaattgtggatcgattcatagattctcgataccaataggtacttgtgaatttctaagtttttgggtttttatctttccccttgttgtatatgatgtgttagaattcataagctgcagattctatctttttggttggatatgtctctgtttgaagttatatatttatagttttgaattcataggatgtggtgatacgtttgtaatctcgtgccatatctttggtttgtcaaagagagtgtgttttaatgtcaatttctgggtaaccaagtttgagcttattccttttgattctgcccggctctctgattttttaaggtgagattcctaagcatgtcaattacttttttttttttttttttaacattctcaattttcttgagttggtgacgttttcgagattttgttgattagtgcaagacgacaagtgatgaaaagatagagacaaagaaaggcttcaagtttgttgataactgctgtctaaagagttcgttcccttgagagattctgactctgacataagaggtaaaaaagttcaaatactcaacacttacttggaatttaaaagaacactgatttgttgatattataaggtataaaaatatttcgtcttctcaaaatccaattcttcatcatattataagttcccccaaccggaagagaaattcaaagatcagaaaacggtgaaagatg

SEQ ID NO: 3008 - DNA, 3000 bp, Unknown
  misc_feature (1)..( 3000): cDNA_ID_1819116_gDNA_ID_1620620_Annot_ID_162275 3000 nt of promoter + ATG
acagctctccacgttccgttcccagcttgaagagttcgctcgtaaacacaaggtcgttatttgttgattcttttttatattttgttgttgttgtgtttgctgttgttttgtcatcgtcttgatttcgtaataagaacatgtagtttaataacattttcctgaatttgataaaattgtggtgaaaagaggcataattttttctttggttgcagaatgacattcgtaagaatcctgccttcagggctcagttccatgaaatgtgtgctaacattggtgtggatcctcttgcttctaacaagggtttctgggctgagctccttggtattggtgacttctactatgaacttggtatgtttgctctctctttctagtgccactgaagaagatgcttctgatttttggttagctatgagtcttaagggatataaaatctcttgtgtacttttttctcttgttttgaattggacatgccctctgtgatattagaaagcagggatgtaacaattttcgtgaattcattaaataggagttcagattattgaagtttgcatgcttacaagatcacataatggaggtttgatcagcttgcaagagctctgcaaccatcttcgtcagagaaggaagaaagaccgtgaagctgtgactgaagatgattgtcttcgagctattagcaagctaaaggtttctatctaacttgtgtttttcttttttctttcagatttttaatcaatgggaaaattttgaactgttcttgctggtatcttgggattttctcctcaggtattgggtagcggatttgaggttatcactattggcaagaaaaagcttgtccgttcagtacccacagagctgaacaaagaccataaccagattttggagttggctcaggttataatcatatgagatacatatttccacaaaagaaaacaactattacatgtgttacattatatcttagtagttctacctgaagtaactcaaggatttctgttgctttccgcacagggccaaggctttgtgattgtggaagaggtacaaagacgcctctcatggacatctggtcgcgttatagatgctctcgaaactttgttagaggtatgcatttgcaattcattgcttcaattggattatgtgcttcaatacttctattatactgatagatgcaatgcaacctatgcgagtcctgaaaccttgcaattctattattcattttcaggagggccttgccatgatcgacaatggccataaagacggaaagtgtcggtactggtttccctgtgtttcttcggtttactcatccatcggatctgatacttaaatggtacatgctcagttgttttgcttgttttatacagtattaaatacagtcacactcgttacatataaattacgaagaaatcttttcagtatattactgaaattttcttgtacatgtatcactctgtaaaaaaaatatttatgcttggttgttggagatttcggtttcttctatccagtcagagtttggctcactccatgacctaggtctcaccccaagctggaaataaaacaccatctccaatgcctcaaagaccttactctcatccagaacattgttccatgctccactcacgatgcagtaattgttgttatacggtgctcgatgatgttccgcatgctgtctccgtgaaacaagtaaccccatgtcctgcaacgcgaccacgagaggtggaagcttgctcttggttccatgtgcccaagcatggaattgctggctaaacaatatgcaaaatgcaaatgtgcacacaaagccgtgaaacacagggtcgttaaatgcaaggtctagtggaagaactgtgaaggttatgacttgagccagagcgtgtagattgttggcaaattgccgtctggtgattgtccaaggccacttgtggtgaccctgaaatgcttcgatttgggttcctactacaggtgttgactcatcaccgtagttatcaatggcccagtggtagacaccggaacctagatcagctaagatgtaccctgcataaccggctaaagctggttcgaggcagagatgagaatcaaaccctccaatgacagatttagctaaagagacaaacaaagtggtgcagcccgctgcaacccataaccggtgagtccatgtcgatttcaaagttgggtcattggacagaggagggctggcaaggcgttgctcaaccacaagcttctcacggttagggcgaggcttggtcgattgcagagattggtcgttggacagaggaagattcacagtgcgttgctctaccagaagcttctcacgattaggctgaggcttggtggtagtaacagagcaggtgacacgtacacggagaagcgagggacggtggctttttgggatgttggtgataggtcgtagagggtacttggttggaagtgatacagccattgagagtgattgcaggtgaaagttgtcaaatgttctcgttttctcgacggcataaccacatgatagaggacgagattacgctcaagttatgttgtggtgtacgttagtgttgcgtggggctattctgatcactagcacattaccaagttggttggttataccaactgtcaaacttataaaatagttttcaaatttggattcttagtttctaaaagttacaaattaaaacccaacatttcaaaaatgttctattagacccacctacccaaaaaataatttttgttcggtttctcaatcagttattctggtttagtttgaaattcgattagattggtatatttggattgtgtttgtcttattttaatagatgcgaaattcgaatatgttagaacgtttgaccaacaaaaatggttatactaaattaaattaatttgaatgtatcattacatcaatctggaggatagacgaaataaattataaataaacacgttaagaaaaccagtcatggacgatcgaaaaatcgagacttgcgaattcaacacggaagcgagacagtaaccgacttaacaatg

SEQ ID NO: 3009 - DNA, 3000 bp, Unknown
  misc_feature (1)..( 3000): cDNA_ID_3091991_gDNA_ID_1620620_Annot_ID_162274 3000 nt of promoter + ATG
gctggtagtttccatagccgcccccagcataaccaccgtagtaggcgttagggtcctgaggaggaggtgcatatccgtatgcttcatatccttgaggaggatacccatagtatcctccaccaccaccatactgggcttgatcaggttgagtctgtgaaattcgtggatcaacaagtcatcagatcacataacgtatatgaaagcgtagtaagcttggtgcattgtctaacagatacaaacctgtttgttggaaggactgcgaccccatgaaagacgaatgctttgtcccccaagttgtgttccgttcaacacagaaagtgcttgctcagcacatgccctgaagcatacagacagattaaatatgtgaaaaaacattctcaaaataagtaaagatgaagttcgtctccaagttcacatttacctattggcgtattgaacaaatccgcaacgttttcctgcgggtattttcacatgaactagttcaccaaattgaccaaaaactgacttcaaatcatcttctgttacactttgatccacagctccaacaaaaatctggaatagagaacataacgcttcaatttcaacaatatatcccacagagaaaaaggcttaggcaacgtcaaagaaaaaaaaggcttagggaaaccaaaacaagttacgcactgttgtgttagttggatcactttctcctgaatttccttgagtgttctgatatgaagctgcaataaaacagtcaagagaaggtaaggaaaaaaacctcaaacatctatttatttaattaagctgacagtgcaaggacacagacactaacacaaacgcacacacacgacaatagcagtagcagaacttatccaaatcaagacccaaaattatcaacatataaagcaaatgccatacataggttacagctcgaagataaaggtaaagtgattctgaagttagttgctaattaatacaaaaaagcacattaaagatatactaggggaagtgcctgcaagatccaacttcgagaaattagagaatcggacctaaattctctagggtatcacaagtaacctaaattccttccaaggtctgacagtcttaccattgtaatcaacttttccgaaagacgaaatgtaacactaaaaaaggttgcaagtataaatttagaggcacaacgtaactgaaagaaggaaaaaaattgcagcactaactactggaaaaagatgaattgagaggtatgaaaaagatatcaaaacactctttaaggattcaaactggacaaaataaagcgaagagtaatgaactatgtaacatgaaaagaaataaaagatagggctaaaaattaaaaggaaagacttatgcttgataagtaagaaactggaaaataatttgcaaatggagtaaaagctttgtaattaacttcttctgaaaacataaccaactgacctaaatgaggccacgcaaggtggaatcattttcagctgaaatcagttccaggcccccgaaagagagcctcttgttctcctgcttaaagacaacatgagtttttttcttataagttttaggatgttttgcgatattaaattctttgaagagctgaaaggcaagaagcgggagaaaagggtagacagattctccagtaatcagaaagatagcagtaaaggagtaccccaaagaaaagacaatcaactaacatagacagtgtaagacaaagtgagtcatatcatcactcaacttattcataagtgatcagatatcaggctccttaatatcaaaacatacctggttgcattgtaagaggcttcttgttggcagcaggaccagtacgcataggccttgatgagcagtattgaccattcatttcagtcatggcacgaatctgctcactttcatccgcaaacctgacaaatccataacccttggaccgtccagtagtcctatcattcacaactttagctcccttgacagaggaatacacagctttaaacgtttcagtaagcatgtggtcggtaacatcaggtgccaagtctccaacaaaaactgtgtgctcaggcccttcagcctggcgtctctctccagctccaagctgagcccagttcaacctgaaggcctgctcactgctcggcatcggagcaccattgtaagtctgtaaattcctctcagctgtagcatggttcacaaactcaataaagccataaccttctgaatatccgttctgtttattgcgaataactttagctgctgtagcctgcaaccacaaaggatgaaactttcaatacttgtagaagaaaaacgagagactaaaaacagaaatcaacaggattttcaaaattacctcgccagtaagaccaaagacgttcatgagatagttctcatccatccatggctgcaagtcaccgatccacagggaccggatctcaccagctgatcctggattctgagatccaccaccaccatactgctgctgctgtggttgaccagaagacggtgcagactgctgattccatcctgcaggcggctgaccttgttgttgctgctggtgctgcatcatccacgactgctgctgctggaggtaagcttgttggtcggaaggaatctgccctggccctgttgcagcaccgttggaagctggaggtggctgctgcatcatgacgacgataacctagcaaaaggtacgactgtcgtagatgcaattaaagggttgagctcgaggacgtaagggcaaaagagagagagagagaaagattcgctgtcgctgtttcttttttatagtcaaaagttggttctaatatggcccaatataaaagtttgagctcggcccattataagagcactcgaacaacccggttaagtaagtctagggttgaccaaaaaaatcgatacgaaccggtcgggattggtttgggattgagatgcctgatttcgaactctcagcgtcgccgatatgttttgtcctgttaaaccctaaaactaaaaccccgcgaagagagaagagttctctgtagtgttcttttg

SEQ ID NO: 3010 - DNA, 3000 bp, Unknown
  misc_feature (1)..( 3000): cDNA_ID_1455881_gDNA_ID_1620620_Annot_ID_162273 3000 nt of promoter + ATG
cgaccaataatgcatagacatctttacaataataaataaactatagaaacgtgacacaagaatcgagacatttgaccaaaactgggtaagcaacgcatgaacgtttccagttctctagctgtcaactcaactggacaaaccactacaactcaaaaatcaaacttcaattggtatacattgcaaggacttcaaaactaatatttgacaaggaaaattttaaaggacagtgcaaaacaataagacatcctgtcactagctataatcattaagctagatatttaaactaataacttttttgtgaaggttcggctttttttccaacaacacaaacgaaaataacaataagaaaaatcaacgtaccacataaatcttgagggaatccagaagctttatgtgaaaacacatctctgcttcttcgaccgaatcaatagggttagaacaaagctctgaaatccaaatatctgaaacaatcccaagatattctttttcagcatcttcctgatctgtcatatgagcatccatattatcctcagccaaaaagatatctttatcagaacctaccccaccaatgacaatatcaacagcctcttcttccaaaacatccttctccgatcgcttaatgcgtttttttcttcctactaatccactatccaactctgcttctctcttcaatgacagcttttgagttccactagaaccgtccagagacttcagtacaatcaataacacctgggaatctggaaaaaaactgctcacttcacccatgacgttccgctcaagagaaatctgaatttgctcaaccgagcatctatgagatgaacaaaggttccaagcagtaagaaacgaatccaacagcctcagcgtctccaagagaaatctcaaggtcccatgtttcacaagaaaatcagaatgtagcatccctttagtgatcagtgaccggctaaatggtcgggggcatatgcatttcatgatagtctgaacatctgagccaccagaaggaggtgtagcacgttgatctggattgagaaagtcaaaagaacatgaagttcttactgacgataccaaatttgctgccaaggaaatagaagaaaacctgcaatgacttcagttactagaatgacaaaacagcagaaattggacggtagacgcagtaaaataaagatagatacactttcgtactctgaagaagactaaccaggatggtgatgaaaaatcttccacattgtatggaaactcgtccaagaaatctgaagctaacgacggtctacccctaacaatggctagaagcaaatccctgtgataaccaatttctgctgctctcaaccccttcatgagcattagtagtctgtcagaattgcctctcaactttctctttgcatctggcatcaatccattagaggggtctgtgcaaactttaacaagaacatcatgggccaactcattcacaatcccagcatcctctcttgctgaaatgctggctagatgctttagcgtcacaattccaaaaagaacactccttagaccaggagaaattaatgattcttcaacaaggatcttatcctttaacgtagacaagacagaagccacagtgtcatcatcatctttcccaaggcctggcaggactttcgagtacatttccttcttatttaacactgagcttaacaatccaggcttcccaacttcaaggaatgatattgcaaatccaacaaatgccttccttgttgagtgtttcttaaccttttcagtcccttgcgtattatactctgctagttttgcaaaacccttaaaatcaaacttcttagctatctctgatgccattcctggaccacgtctaacaatcgaagctaacaatgaaagtgcagcagactgttgttttccctctttgctgttcaattctttgtaaatatcatccaatttttcttcaacaagtaacctaccaaactggtcaatagctcttccaatatcagttgatctatcttttccctctggatgactcaaaatcgtctggataagcgagaatatataggacaatccttgtttttcatgtcgaagcttccatgcctcaagaagctcagcaaagtttggtgagctctggaaataaagacgcaacaaatcgccaccggtttctcccttcagtaacttaacaaattcttttgcagcatcagagcatagcttaatctcatgtaagcaaatattatgcaacaattctctaagcttagcttcgtgggatggtctgaaagccatcactggaatttttcctacctcaacatctctattccctccgtccaccaccattcctgatatatcaaacaaagtattcaatcagatagtaagaaactacttctccaccagtccacactgttcaagagaattaaaagctactcaaagacaaaaactttcaaggcaattacaaataagtgatacaagtcttcattcaaaggtaaagccagacaaatttcagctaaaattttattaattgactcaaaaattccaacaattaattccaaaaaattctaatggttagttttttttttgttggaaaaaaccaaacagatattgctaaaagagtctgcacatgtcaagctattatcgtaccttgatcttccaagtctgatgatattgattccgccatcaaaagaacactacagagaactcttctctcttcgcggggttttagttttagggtttaacaggacaaaacatatcggcgacgctgagagttcgaaatcaggcatctcaatcccaaaccaatcccgaccggttcgtatcgatttttttggtcaaccctagacttacttaaccgggttgttcgagtgctcttataatgggccgagctcaaacttttatattgggccatattagaaccaacttttgactataaaaaagaaacagcgacagcgaatctttctctctctctctcttttgcccttacgtcctcgagctcaaccctttaattgcatctacgacagtcgtaccttttgctaggttatcgtcgtcatg

SEQ ID NO: 3011 - DNA, 3000 bp, Unknown
  misc_feature (1)..( 3000): cDNA_ID_3091995_gDNA_ID_1620620_Annot_ID_162270 3000 nt of promoter + ATG
tacatgaaaagattcagctaagtgtgatcatgtaaaatgaaactaacagaggttatttagatgatcaaaacgaatattaagactcttgtagaatccatttgtagagtaatatattctgatgtgcttctttctactatccagtgaaggagaaaagatgggtcaagtttagacgagaggaggacccaacctctattcctggtaactcttctttaaaacataaaatgggttgttatatacgaccatatattcatttacttgagtgatgtcagatctgaaataagcacatctataagatatatggcatgtatacacgaatctagttacatttttgtttgatcaatgttgtagttgaatggatttgttggctgaatgggcagcgaaaaagggctcctactcctgaggtaagataaactcctttttaaccagaattatttgtggtcagcatagtgttcttaccatggaagtttttcattgcatacagactggctatgcttggcctttgatattggtgtttgttattggttcaggaaatgattgaacttgaagcaaggcgtgagcgtgtaaagcttaatgttgctcgtaggtgtttcagcttataaatacattttctaaacttatatccttttaaacgtcttaaaattattatttccttgtgtcattgatccttactgcaaacagtttatgactttgaggacttgattttatgaacttcgaagttgtgaatgaacaaagtcaagaattatttctgtttctgtgttagcaagtcaagaaatccgtatgcaaattttccatttaatatgtcgctcaagttcaaggcaaaacatttatcgtttttcttttgcctttatttccttgtcaagttctcaagaaggaagaggaggagaagaaagccagagtaggcaccggacgcaaaatcaccattggtaattaacattagagcccagaaaatttgtttcatttatgaattggtagcttaatgttcggtctccttgtgtaaaggtaaagttgatggtccagatttgacaagctttgttcgccaatttccaccagattcaaaaggtattacattttctctgccaatagattaattgagtcaccatagatgctgatgactaacttcttaggaatcccttgtgtaaatttgatagagattatgatggatatgcgtttatatttttgtggtgtttgacccatgaaatggtgtccattggctgatgattataatagttttgtgaaagaaacatcttttgaatgttccccatataaccattatgattgcggtagcttaaaagggcaacaaaattgttctcatgcaccattatatatcgtttaagtcatttgttgattcaagggctgaggttactacagttgctagatttcttataaccttaaaagagattatggttcgaccataaagtcgtggaagtaagactgacagttaagtttatttcctttttttgttaatgctttaaggtggtgaaccagaggaagctagtgaagaagcagataaatcaaggtgagtcatcatgattcataatatctccgcactaatcatatatgtgttaaatcttcttacattctattttttcctggatgcaaagcacaacatctttcagaagactaacataaccacatgttctcacattgctttacagggccaaggaacatgaacccgagatagtttctgcagaaccacccgaaccaaagtaagtctagccaacttgacattgttaatcctaaagttcagattctagctcacggatacgaaacatgactcgttctttctgatagttacagactgctactatgctgaaactgttctctatgaacataagttatgtattgtgtttggtatgctttaaattaaactaatgttaatgttgatgttgatgatgatgcaggacaacagagccatcaggatctggatcatcatttaggcccgggacatggcagccaccatcctaaacacatctctcttcacgcagatgacaaaccaacatactattcaattattttgtttgttgtactctacacaaccgattggtttgagccttacagatgagccataagaccagagagcttttcaagaccctaaaattgtgtcctttcacgctgtcattgaggacttagaagagtcaaaatgagaagccatcttcttatactttgttttgtttagggtgtttgtctcttggcataatgcttgagacttttagcctgccttgtccttcatagctgaagaggagcctagctaccttttgtttctcttcgttgacttgaataaaacagtttgattgaataacagttattcattttcatgtcatgatggtagtggatataagaaaaaacaaatacatagaataattattttaatgtttcagaggagaaatcctacttggcttgtgccagactcataacccaatcaaaacttcgtattaccaaaataagtgtagttctaaattttattctggtttaggctgtagttataaattactcattttagtttgtgaatataaaattactttctgcaaaagaaaatattctcatctttcgacgaaaagccaattattcgaatgttctcacgttggtctgtagctgtaaactttatagtttatataataaggtgttctactgttcttatataatttgcaagaacaaataatattaaatgcaaataaaaaatagtcaacggtccaaagtggatcataagccgtccgttcggtcgtctgaacttcatccaacggttaaaagaaatatacctgacgtggccttgggccattgtatattagtagtgagtgtgcccttggaaggttctgtaaaatgttttattcgcctctatcagaagcttgacgaaatctcttctccgtctctctctctctttccctcgtccattccacgatcttcttccaatctcaaatctcccattttctagtgtttcattttgatccttcttccttcctctggagatttctcaaatctcttcaactattttgatttgccgcc

SEQ ID NO: 3012 - DNA, 3000 bp, Unknown; identical to SEQ ID NO: 3004
  misc_feature (1)..( 3000): cDNA_ID_2167230_gDNA_ID_1620620_Annot_ID_162265 3000 nt of promoter + ATG

SEQ ID NO: 3013 - DNA, 3000 bp, Unknown; identical to SEQ ID NO: 3003
  misc_feature (1)..( 3000): cDNA_ID_2167226_gDNA_ID_1620620_Annot_ID_162264 3000 nt of promoter + ATG

SEQ ID NO: 3014 - DNA, 3000 bp, Unknown; identical to SEQ ID NO: 3002
  misc_feature (1)..( 3000): cDNA_ID_1819160_gDNA_ID_1620620_Annot_ID_162263 3000 nt of promoter + ATG

SEQ ID NO: 3015 - DNA, 3000 bp, Unknown
  misc_feature (1)..( 3000): cDNA_ID_3070615_gDNA_ID_1620620_Annot_ID_162279 3000 nt of promoter + ATG
attgacatgcttaggaatctcaccttaaaaaatcagagagccgggcagaatcaaaaggaataagctcaaacttggttacccagaaattgacattaaaacacactctctttgacaaaccaaagatatggcacgagattacaaacgtatcaccacatcctatgaattcaaaactataaatatataacttcaaacagagacatatccaaccaaaaagatagaatctgcagcttatgaattctaacacatcatatacaacaaggggaaagataaaaacccaaaaacttagaaattcacaagtacctattggtatcgagaatctatgaatcgatccacaatttcaaacacactttaacccagatttctttgagctgaaactattaaaccccaaacatatgaatcagattccaaaaaatagagaatcgatcaaagtgtcaaaataagaaagatgaaatgtatagagagacaaatcataccttttcttacaatcgaagaagagataaaaaaaaaaaagacagagatcgaagaacaaaggttgaagaagaagaagagagctccgtttgaagaagaagaagagagctttagatcgaagaaagaaaaagaaaaaaacaacaatgaagaaaaaaaacgttttagggccagccttatcgaagcccgaaaccatttcagcaaaaccttttcagccttaagaaaaaaattgctttttttaacatttcttcatcattattctcattgttagaagcagctggaactatcataattactgtttttctaaatcatctttttaaaaaggtttgacatagtaaaatccttttttgtgtgcataactctgttttcttgtgttagatagtgtaagaaactcttaaacgaaaattttgagaagaatgcatatatgcttttgcaaaaacaaatttctaaactttaaacaaatgcataaccacgagagagaaagagggagaaatcatatgaattgaatcttgcattttgatgaaactctggggagagccattacattagctaccaagtagttactctttttgctgccctctttaacgccaactttcacagtttcgagacatttcaacttccccaaaaaatgcctcatttgtttcagctctctaaaacttcctccgtaccctaaaatcttaagcaccttcactcgacacctcgacaaacaggatactatctccctgtccttcatacggatgcaagcgcacgcgtctccacaacaatatgtaactctgtgcacaagaccctgaaaccacaccaccatttgacatgtataatgacaagaaggaacagaatttatgtgtgttttcttgaaaagatgataataccttgacgactaaagtttgtagatttggggacttgttgagcagccttggcattacttcccagcctttttccttgtcactttcgatagataaattaacgagatcttccaacaccggcaaatcacaacaatagtaaaacacctgatatgtgtaagccatatataaataagttaaagaccttgctagctagcactagactggctctctcctgcatcatgtgaagactcaagagaagaagctgacctcgagagaactaggagacaagtgaaggatcttaatggttctgatcgcctcaatcagattcgtaatattgccaaaaacttctgcattccacaaaccatcctcatcatagatgattggctcatataatcgaagatccagtctagcttcgactagcgaatccaaaacaacataatagtttccagcgacataactggagtagtcaaggtacacaagactcggtgtcttcagcaccatgctaggacgttggatatcgtcatcaaaatcactagtgatggtaactcgctttacgtttggacttgacatgtattgcatccaaacgcataggaataattcctcaagcgcagggcatccatggatgaagaagttaatcatctcaacacttgtaaaacaaactgaaacgagagtaagtgttttgagcgcagggaaaaacacacccccaaaaggaagaagatggcctccaggataaaatccatcggaaatggtgagtttaaccagtgtgttgctagtgaaatactgagaatctataggtagataattggctgcctctaagtttagctccaagcagccacgttctagcgcggtgcgaatccaacggttgatacgagctccatcatcttcgtgatagcatttaagagagaatttctcggtaagaggagcattgcttaacagagcaagcgttttgtccacgaaatgagagaagctatgacgtcgacgttgaccactctcgtaactagatgcttcgtcctctccgtctttgttgtcgggatagaaaagcatcgtttcgtcaaaatcaaggctatctacaagcggaagcagattcctccacctcttggacagaaccgacgttgcagcagcaagctttgtcggaactaaagacaggattttgccaagaacatcatcggggagattgctgatcagatctgtgtccatagagacagagactaataaagagtcttttcttcttctgcaaaagaattagaaaaaaatttcttcaaaaccaactcagttttaaattccaagtaagtgtcgagtattatttttaactttttacctcttacgtcagagtcagaatgtctcaagggaaactccttagacagcagttatcaacaaacttgaagcctttgtctgtcttttcatcacttgtcgtcttgcactaatcaactaaatctcgaaaacgtcaccaactcaagaaaattgagaatgtttaaaaaaaaacagtaattgacatgtttaggaatctcaccttaaaaaatcagagatccgggcagaatcaaaaggaataagctcaaacttggttacccaggccagcaatgagagcaagagattgacataaaaacacacccgacaacaacaaaaaataacaattggtttaaaatcgatctagagtctgctccaagaaatcttaccgaattgaagaaagagaagg

SEQ ID NO: 3016 - DNA, 3000 bp, Unknown
  misc_feature (1)..( 3000): cDNA_ID_1819136_gDNA_ID_1620620_Annot_ID_47019 3000 nt of promoter + ATG
gttgctcgtaggtgtttcagcttataaatacattttctaaacttatatccttttaaacgtcttaaaattattatttccttgtgtcattgatccttactgcaaacagtttatgactttgaggacttgattttatgaacttcgaagttgtgaatgaacaaagtcaagaattatttctgtttctgtgttagcaagtcaagaaatccgtatgcaaattttccatttaatatgtcgctcaagttcaaggcaaaacatttatcgtttttcttttgcctttatttccttgtcaagttctcaagaaggaagaggaggagaagaaagccagagtaggcaccggacgcaaaatcaccattggtaattaacattagagcccagaaaatttgtttcatttatgaattggtagcttaatgttcggtctccttgtgtaaaggtaaagttgatggtccagatttgacaagctttgttcgccaatttccaccagattcaaaaggtattacattttctctgccaatagattaattgagtcaccatagatgctgatgactaacttcttaggaatcccttgtgtaaatttgatagagattatgatggatatgcgtttatatttttgtggtgtttgacccatgaaatggtgtccattggctgatgattataatagttttgtgaaagaaacatcttttgaatgttccccatataaccattatgattgcggtagcttaaaagggcaacaaaattgttctcatgcaccattatatatcgtttaagtcatttgttgattcaagggctgaggttactacagttgctagatttcttataaccttaaaagagattatggttcgaccataaagtcgtggaagtaagactgacagttaagtttatttcctttttttgttaatgctttaaggtggtgaaccagaggaagctagtgaagaagcagataaatcaaggtgagtcatcatgattcataatatctccgcactaatcatatatgtgttaaatcttcttacattctattttttcctggatgcaaagcacaacatctttcagaagactaacataaccacatgttctcacattgctttacagggccaaggaacatgaacccgagatagtttctgcagaaccacccgaaccaaagtaagtctagccaacttgacattgttaatcctaaagttcagattctagctcacggatacgaaacatgactcgttctttctgatagttacagactgctactatgctgaaactgttctctatgaacataagttatgtattgtgtttggtatgctttaaattaaactaatgttaatgttgatgttgatgatgatgcaggacaacagagccatcaggatctggatcatcatttaggcccgggacatggcagccaccatcctaaacacatctctcttcacgcagatgacaaaccaacatactattcaattattttgtttgttgtactctacacaaccgattggtttgagccttacagatgagccataagaccagagagcttttcaagaccctaaaattgtgtcctttcacgctgtcattgaggacttagaagagtcaaaatgagaagccatcttcttatactttgttttgtttagggtgtttgtctcttggcataatgcttgagacttttagcctgccttgtccttcatagctgaagaggagcctagctaccttttgtttctcttcgttgacttgaataaaacagtttgattgaataacagttattcattttcatgtcatgatggtagtggatataagaaaaaacaaatacatagaataattattttaatgtttcagaggagaaatcctacttggcttgtgccagactcataacccaatcaaaacttcgtattaccaaaataagtgtagttctaaattttattctggtttaggctgtagttataaattactcattttagtttgtgaatataaaattactttctgcaaaagaaaatattctcatctttcgacgaaaagccaattattcgaatgttctcacgttggtctgtagctgtaaactttatagtttatataataaggtgttctactgttcttatataatttgcaagaacaaataatattaaatgcaaataaaaaatagtcaacggtccaaagtggatcataagccgtccgttcggtcgtctgaacttcatccaacggttaaaagaaatatacctgacgtggccttgggccattgtatattagtagtgagtgtgcccttggaaggttctgtaaaatgttttattcgcctctatcagaagcttgacgaaatctcttctccgtctctctctctctttccctcgtccattccacgatcttcttccaatctcaaatctcccattttctagtgtttcattttgatccttcttccttcctctggagatttctcaaatctcttcaactattttgatttgccgccatgtatcgacgcgccacttccggcgtgcgttctgcctccgcaaggctttcttcttccctctccaggatcgcctctagcgagacagcttcggtttcggctccatctgcgtcgtcgcttcgcaatcagacgaaccgatctaagagtttctcctcggctctccgctcctttcgagtttgctctgcttccacgcggtggagccatggtgggagctggggatcgcctgctagccttcgcgctcaagctaggaattccactccggttatggagaaatttgaacggaaatacgcaaccatgggtatgtctgtttgctttctctgacgttctaagaatgattgctcttaacttgtgtgacaagaatctgtgtttaccgcatatctgcttagatcgatttttcgctttaaaatgatgatctactgattctgatatgttctgattcaaagtaaaactagctagatgaacatttgatttgctcttgcattttggtttatgatttgtagatttagtctactaaatttcttttttgtatattctaaaaggacaagcaaattcatgtgttatgtgtcaattgaatt

SEQ ID NO: 3017 - DNA, 3000 bp, Unknown
  misc_feature (1)..( 3000): cDNA_ID_1819132_gDNA_ID_1620620_Annot_ID_47020 3000 nt of promoter + ATG
atgcttgtggatctctgtttcatagggagtctcgcttccatcaaatgttacaacagccaataatgaggtcggatcagccacagaaacattaccttctgagcctcgtttatgtgctgcaaataaatccacaaatgtttccactcaaggaaggggctttaatcataagaggtaaattgctttaagaaatcgccagatgataattgtgaaaatctcttaacttccgaaaacaggattacttagaatttttctgaaaaatgaagtaaatatgttaacagaaccctgatttccatctcaatatttgcattctgtgacaaattttctttttccatgtcaatcttagcaatctagtatagtttagcataccaatgtctaaactttgcctagataaatttcttccttctctctgattcttgtatgcttttgttgacaggcaggctggagctcagattttgaagcgtagtgtacaaattccagaggtttatcaacaggataatgttagtcttgtagaaagatagttcatttgtttgattcggttattacttagcagctgcttacttgttagtttcctattgcagattgatatccaaagctcaagttctagctgtgagttcattttccacggatatttttttatctttgttatagctatcgtattcttgtttctgcttctttttgatagtgaaatgttatctaacatacttatccctcaactttcattcatgtgaaattacaaacatccagtggatagcatgtccgaacgagttaaacctatagaagaagataacttgatgccggaacctcttagtaatggttttcacaatgctgctgcaaaaccctcttcaactgacaatttattgtcagaaagtacacctgttgatgacaccttggaattgtgtcggggtagagtggcggcatcttcaactgcatcagtacctatccaggccgtcaaaaagcctaaggtaaactcctaagtacagtttagattgattttctggtcctaaagatttgttaatctattcattctctcacatttcaaacgagtgtgttcattatagtcgttgttatattgtcaaatcagcctgagtgttcattttactttatctattactcaattaccacgttttcaattctaaaacttctaccacatacaggagttcaagctgaatccagaggctaagattttttctccgtcttatacaaaacggctttcaccgtctcctgtcggtatgcctcatgttggaaatattgcttacataccaagcaacactcccatgctaccagttcctgaagctatttacccagaagttgtaaacaacccttatgtgccgcaagcacttccaccttctaagtttgtaccatatggtaatgtgaccgctggacatgctgtcggtggatttcaatttcctcaacacgtaagtattatcttactctcttcgagcatgttatgtcaaagggcttttatcaactagtaattgagaatagactgttcctctcaccactaagcgcctgaatggttaacaaccataaatgttagtattgaacaccagattaaaagatcattctgaattgatatggctttgtctgtactgttaaaatgcttccatatactttctgccaccaacttttgtttgttttgccatggatgaatcattcttccacttgcaacccattttcctgcagatgattgggccaactgttaacagagcacagcctcagagatacaccgctcagtaccattctgttcaagctgcaccaatgcttgtaaatccaagtcctcaggttatatttcatggaggtccccaaaactcacttttgttgaaagcgcggttttaagaaaaatttatctgtattgagatgtattggtgttattgtttctaaagactctttttactgtcctccaggtgatggttgcaagatcggggcagcttgtctatgtccaatcagtttctcaggttagaacttgatgtatatagcttcttgatgaacctttaatgatgttagtttaatcgaatgtatgtcctgtattgctgagtgaaataagaaatattattacgcagtcattggtttaagtttggtcgaaaatctcctcttattcatatcgttatagtcatttttagtaatagtctttcttatttttccaggatctggttcaaggaacaccgcctctctcacctatgctctcctgccctctacctaccgcacaacatgtccaatacctgaagcatcaaggtaaatacctgagtctaccttgatttgcctttttggaccaaaccaaaagattgtgccttaactagaatgaaccattatgtgatgcaggtgtagtagcagctggccagccgctaccgctatgtgtctccctaccattcacgactggtggaccgcaaccttatggcattcccacccaattcccagctatgcagcagcctcctttccccacgaatcagccaatgacagttgcagttcctaatggtttctacacaaagtttccataaacaaagtctcattgtttttggtttcatacctttattctttgcctctccaacctaataagggttaaaaaggtcctagttttggttcctagttttttcctattcttcggttttgtgtaagtatgttgcgagtgttaagctctgttttggcttattatattggggtttttttgcattggtttatcggagttgaatttgggtgaaaaatgttgtagaatatgaaaacattatatgattgattctttggaaaaagtatcgttgatcacatattggtgatctcaataaattgcagttcataaatgttggaagttaaattacgtctgaaacagagcgagactaatcacgtaacatattacacaagagagattagagagatacaaatgagagatcataaacgttaagtcggttatgtttcggtttgagctaattagaagttcatataatccgccgtccgctaatattcctcgattagaatctccggcgatcagaaatctcgcggtgaattttgatg

SEQ ID NO: 3018 - DNA, 3000 bp, Unknown
  misc_feature (1)..( 3000): cDNA_ID_1819128_gDNA_ID_1620620_Annot_ID_47021 3000 nt of promoter + ATG
cctgtggatcggtgacttgcagccatggatggatgagaactatctcatgaacgtctttggtcttactggcgaggtaattttgaaaatcctgttgatttctgtttttagtctctcgtttttcttctacaagtattgaaagtttcatcctttgtggttgcaggctacagcagctaaagttattcgcaataaacagaacggatattcagaaggttatggctttattgagtttgtgaaccatgctacagctgagaggaatttacagacttacaatggtgctccgatgccgagcagtgagcaggccttcaggttgaactgggctcagcttggagctggagagagacgccaggctgaagggcctgagcacacagtttttgttggagacttggcacctgatgttaccgaccacatgcttactgaaacgtttaaagctgtgtattcctctgtcaagggagctaaagttgtgaatgataggactactggacggtccaagggttatggatttgtcaggtttgcggatgaaagtgagcagattcgtgccatgactgaaatgaatggtcaatactgctcatcaaggcctatgcgtactggtcctgctgccaacaagaagcctcttacaatgcaaccaggtatgttttgatattaaggagcctgatatctgatcacttatgaataagttgagtgatgatatgactcactttgtcttacactgtctatgttagttgattgtcttttctttggggtactcctttactgctatctttctgattactggagaatctgtctacccttttctcccgcttcttgcctttcagctcttcaaagaatttaatatcgcaaaacatcctaaaacttataagaaaaaaactcatgttgtctttaagcaggagaacaagaggctctctttcgggggcctggaactgatttcagctgaaaatgattccaccttgcgtggcctcatttaggtcagttggttatgttttcagaagaagttaattacaaagcttttactccatttgcaaattattttccagtttcttacttatcaagcataagtctttccttttaatttttagccctatcttttatttcttttcatgttacatagttcattactcttcgctttattttgtccagtttgaatccttaaagagtgttttgatatctttttcatacctctcaattcatctttttccagtagttagtgctgcaatttttttccttctttcagttacgttgtgcctctaaatttatacttgcaaccttttttagtgttacatttcgtctttcggaaaagttgattacaatggtaagactgtcagaccttggaaggaatttaggttacttgtgataccctagagaatttaggtccgattctctaatttctcgaagttggatcttgcaggcacttcccctagtatatctttaatgtgcttttttgtattaattagcaactaacttcagaatcactttacctttatcttcgagctgtaacctatgtatggcatttgctttatatgttgataattttgggtcttgatttggataagttctgctactgctattgtcgtgtgtgtgcgtttgtgttagtgtctgtgtccttgcactgtcagcttaattaaataaatagatgtttgaggtttttttccttaccttctcttgactgttttattgcagcttcatatcagaacactcaaggaaattcaggagaaagtgatccaactaacacaacagtgcgtaacttgttttggtttccctaagccttttttttctttgacgttgcctaagcctttttctctgtgggatatattgttgaaattgaagcgttatgttctctattccagatttttgttggagctgtggatcaaagtgtaacagaagatgatttgaagtcagtttttggtcaatttggtgaactagttcatgtgaaaatacccgcaggaaaacgttgcggatttgttcaatacgccaataggtaaatgtgaacttggagacgaacttcatctttacttattttgagaatgttttttcacatatttaatctgtctgtatgcttcagggcatgtgctgagcaagcactttctgtgttgaacggaacacaacttgggggacaaagcattcgtctttcatggggtcgcagtccttccaacaaacaggtttgtatctgttagacaatgcaccaagcttactacgctttcatatacgttatgtgatctgatgacttgttgatccacgaatttcacagactcaacctgatcaagcccagtatggtggtggtggaggatactatgggtatcctcctcaaggatatgaagcatacggatatgcacctcctcctcaggaccctaacgcctactacggtggttatgctgggggcggctatggaaactaccagcagcctggtggataccagcagcaacagcaggtaacattctttggtttttatctgaatatcttcgaatgaaaagtatctatgttttctgtttttttgcgagataactgattcttcttcactctgtttgtttatccgaatttgcagtgaagcatgatgtgtaagtcgtgatcgagctgaagttgtagaaagctgtaaccgtttgacaatggtgaatgaattattgaagtggatgtgtattagctcttcttgtctcagattctctcttcaactcttttttttttcttttggattatttttctttcgcgtggctattgttgagtgtccttgcaagtcataacaaaaagcttaaacccaagtgttttttgtcatgactaatatgaccattatgttttcttgctgtaccatttcttcttgtatcacctatgacttccaattattcagtagtaccctcataatttttcaataatactcgttttgtgatcctattatagttgattcgttttcaatatatagtagaattgtgatgagttatttattcacctttggttaaaagaaaacagtaaacttaaataagattttatttaatggggtagcatgaaatcaacatg

SEQ ID NO: 3019 - DNA, 3000 bp, Unknown; identical to SEQ ID NO: 3010
  misc_feature (1)..( 3000): cDNA_ID_1819124_gDNA_ID_1620620_Annot_ID_47022 3000 nt of promoter + ATG

SEQ ID NO: 3020 - DNA, 3000 bp, Unknown
  misc_feature (1)..( 3000): cDNA_ID_1819120_gDNA_ID_1620620_Annot_ID_47023 3000 nt of promoter + ATG
ctgaagcatacagacagattaaatatgtgaaaaaacattctcaaaataagtaaagatgaagttcgtctccaagttcacatttacctattggcgtattgaacaaatccgcaacgttttcctgcgggtattttcacatgaactagttcaccaaattgaccaaaaactgacttcaaatcatcttctgttacactttgatccacagctccaacaaaaatctggaatagagaacataacgcttcaatttcaacaatatatcccacagagaaaaaggcttaggcaacgtcaaagaaaaaaaaggcttagggaaaccaaaacaagttacgcactgttgtgttagttggatcactttctcctgaatttccttgagtgttctgatatgaagctgcaataaaacagtcaagagaaggtaaggaaaaaaacctcaaacatctatttatttaattaagctgacagtgcaaggacacagacactaacacaaacgcacacacacgacaatagcagtagcagaacttatccaaatcaagacccaaaattatcaacatataaagcaaatgccatacataggttacagctcgaagataaaggtaaagtgattctgaagttagttgctaattaatacaaaaaagcacattaaagatatactaggggaagtgcctgcaagatccaacttcgagaaattagagaatcggacctaaattctctagggtatcacaagtaacctaaattccttccaaggtctgacagtcttaccattgtaatcaacttttccgaaagacgaaatgtaacactaaaaaaggttgcaagtataaatttagaggcacaacgtaactgaaagaaggaaaaaaattgcagcactaactactggaaaaagatgaattgagaggtatgaaaaagatatcaaaacactctttaaggattcaaactggacaaaataaagcgaagagtaatgaactatgtaacatgaaaagaaataaaagatagggctaaaaattaaaaggaaagacttatgcttgataagtaagaaactggaaaataatttgcaaatggagtaaaagctttgtaattaacttcttctgaaaacataaccaactgacctaaatgaggccacgcaaggtggaatcattttcagctgaaatcagttccaggcccccgaaagagagcctcttgttctcctgcttaaagacaacatgagtttttttcttataagttttaggatgttttgcgatattaaattctttgaagagctgaaaggcaagaagcgggagaaaagggtagacagattctccagtaatcagaaagatagcagtaaaggagtaccccaaagaaaagacaatcaactaacatagacagtgtaagacaaagtgagtcatatcatcactcaacttattcataagtgatcagatatcaggctccttaatatcaaaacatacctggttgcattgtaagaggcttcttgttggcagcaggaccagtacgcataggccttgatgagcagtattgaccattcatttcagtcatggcacgaatctgctcactttcatccgcaaacctgacaaatccataacccttggaccgtccagtagtcctatcattcacaactttagctcccttgacagaggaatacacagctttaaacgtttcagtaagcatgtggtcggtaacatcaggtgccaagtctccaacaaaaactgtgtgctcaggcccttcagcctggcgtctctctccagctccaagctgagcccagttcaacctgaaggcctgctcactgctcggcatcggagcaccattgtaagtctgtaaattcctctcagctgtagcatggttcacaaactcaataaagccataaccttctgaatatccgttctgtttattgcgaataactttagctgctgtagcctgcaaccacaaaggatgaaactttcaatacttgtagaagaaaaacgagagactaaaaacagaaatcaacaggattttcaaaattacctcgccagtaagaccaaagacgttcatgagatagttctcatccatccatggctgcaagtcaccgatccacagggaccggatctcaccagctgatcctggattctgagatccaccaccaccatactgctgctgctgtggttgaccagaagacggtgcagactgctgattccatcctgcaggcggctgaccttgttgttgctgctggtgctgcatcatccacgactgctgctgctggaggtaagcttgttggtcggaaggaatctgccctggccctgttgcagcaccgttggaagctggaggtggctgctgcatcatgacgacgataacctagcaaaaggtacgactgtcgtagatgcaattaaagggttgagctcgaggacgtaagggcaaaagagagagagagagaaagattcgctgtcgctgtttcttttttatagtcaaaagttggttctaatatggcccaatataaaagtttgagctcggcccattataagagcactcgaacaacccggttaagtaagtctagggttgaccaaaaaaatcgatacgaaccggtcgggattggtttgggattgagatgcctgatttcgaactctcagcgtcgccgatatgttttgtcctgttaaaccctaaaactaaaaccccgcgaagagagaagagttctctgtagtgttcttttgatggcggaatcaatatcatcagacttggaagatcaaggtacgataatagcttgacatgtgcagactcttttagcaatatctgtttggttttttccaacaaaaaaaaaactaaccattagaattttttggaattaattgttggaatttttgagtcaattaataaaattttagctgaaatttgtctggctttacctttgaatgaagacttgtatcacttatttgtaattgccttgaaagtttttgtctttgagtagcttttaattctcttgaacagtgtggactggtggagaagtagtttcttactatctgattgaatactttgtttgatatatcagga

SEQ ID NO: 3021 - DNA, 3000 bp, Unknown; identical to SEQ ID NO: 3008
  misc_feature (1)..( 3000): cDNA_ID_1819116_gDNA_ID_1620620_Annot_ID_47024 3000 nt of promoter + ATG

SEQ ID NO: 3022 - DNA, 3000 bp, Unknown
  misc_feature (1)..( 3000): cDNA_ID_1809003_gDNA_ID_1620620_Annot_ID_47026 3000 nt of promoter + ATG
cgaagatgatggagctcgtatcaaccgttggattcgcaccgcgctagaacgtggctgcttggagctaaacttagaggcagccaattatctacctatagattctcagtatttcactagcaacacactggttaaactcaccatttccgatggattttatcctggaggccatcttcttccttttgggggtgtgtttttccctgcgctcaaaacacttactctcgtttcagtttgttttacaagtgttgagatgattaacttcttcatccatggatgccctgcgcttgaggaattattcctatgcgtttggatgcaatacatgtcaagtccaaacgtaaagcgagttaccatcactagtgattttgatgacgatatccaacgtcctagcatggtgctgaagacaccgagtcttgtgtaccttgactactccagttatgtcgctggaaactattatgttgttttggattcgctagtcgaagctagactggatcttcgattatatgagccaatcatctatgatgaggatggtttgtggaatgcagaagtttttggcaatattacgaatctgattgaggcgatcagaaccattaagatccttcacttgtctcctagttctctcgaggtcagcttcttctcttgagtcttcacatgatgcaggagagagccagtctagtgctagctagcaaggtctttaacttatttatatatggcttacacatatcaggtgttttactattgttgtgatttgccggtgttggaagatctcgttaatttatctatcgaaagtgacaaggaaaaaggctgggaagtaatgccaaggctgctcaacaagtccccaaatctacaaactttagtcgtcaaggtattatcatcttttcaagaaaacacacataaattctgttccttcttgtcattatacatgtcaaatggtggtgtggtttcagggtcttgtgcacagagttacatattgttgtggagacgcgtgcgcttgcatccgtatgaaggacagggagatagtatcctgtttgtcgaggtgtcgagtgaaggtgcttaagattttagggtacggaggaagttttagagagctgaaacaaatgaggcattttttggggaagttgaaatgtctcgaaactgtgaaagttggcgttaaagagggcagcaaaaagagtaactacttggtagctaatgtaatggctctccccagagtttcatcaaaatgcaagattcaattcatatgatttctccctctttctctctcgtggttatgcatttgtttaaagtttagaaatttgtttttgcaaaagcatatatgcattcttctcaaaattttcgtttaagagtttcttacactatctaacacaagaaaacagagttatgcacacaaaaaaggattttactatgtcaaacctttttaaaaagatgatttagaaaaacagtaattatgatagttccagctgcttctaacaatgagaataatgatgaagaaatgttaaaaaaagcaatttttttcttaaggctgaaaaggttttgctgaaatggtttcgggcttcgataaggctggccctaaaacgttttttttcttcattgttgtttttttctttttctttcttcgatctaaagctctcttcttcttcttcaaacggagctctcttcttcttcttcaacctttgttcttcgatctctgtcttttttttttttatctcttcttcgattgtaagaaaaggtatgatttgtctctctatacatttcatctttcttattttgacactttgatcgattctctattttttggaatctgattcatatgtttggggtttaatagtttcagctcaaagaaatctgggttaaagtgtgtttgaaattgtggatcgattcatagattctcgataccaataggtacttgtgaatttctaagtttttgggtttttatctttccccttgttgtatatgatgtgttagaattcataagctgcagattctatctttttggttggatatgtctctgtttgaagttatatatttatagttttgaattcataggatgtggtgatacgtttgtaatctcgtgccatatctttggtttgtcaaagagagtgtgttttaatgtcaatttctgggtaaccaagtttgagcttattccttttgattctgcccggctctctgattttttaaggtgagattcctaagcatgtcaattacttttttttttttttttttaacattctcaattttcttgagttggtgacgttttcgagattttgttgattagtgcaagacgacaagtgatgaaaagatagagacaaagaaaggcttcaagtttgttgataactgctgtctaaagagttcgttcccttgagagattctgactctgacataagaggtaaaaaagttcaaatactcaacacttacttggaatttaaaagaacactgatttgttgatattataaggtataaaaatatttcgtcttctcaaaatccaattcttcatcatattataagttcccccaaccggaagagaaattcaaagatcagaaaacggtgaaagatgcgacgacgaccaggaattggaggattacaaaaggccgcagctgctagggtattgatcctaaacccaatttcattgttttctctcgaatcagatttgattgaatttgggcttttaattctctatacatcaaaaacaggatcagtaccggttactaggagaaaatgtagccaagttacggactgatatgatgaaagaacagctctccacgttccgttcccagcttgaagagttcgctcgtaaacacaaggtcgttatttgttgattcttttttatattttgttgttgttgtgtttgctgttgttttgtcatcgtcttgatttcgtaataagaacatgtagtttaataacattttcctgaatttgataaaattgtggtgaaaagaggcataattttttctttggttgcagaatgacattcgtaagaatcctgccttcagggctcagttccatgaaatg

SEQ ID NO: 3023 - DNA, 3000 bp, Unknown
  misc_feature (1)..( 3000): cDNA_ID_1823127_gDNA_ID_1620621_Annot_ID_47029 3000 nt of promoter + ATG
ctgaagaagctcttgtaatcggtttagcaacacgaggagtagcagcagagacggttcgagccgtggttaccacccttggaacagacggtttctgggcggcgcgtaggttaaggtccagtgaagacgcgcttctcattatcattgttagttcttgtggggaatatttcagtggaggaagagaagagagatgaaaagatatttagactgcaaaaatatcatggagtttccggttcttgtcaagccccacactattagtcaatattatcaaattgaccccaaagttttatcatttttggttacacccttgcatcattacatgttcattcaaaacgttatcgtaatacaagaatagtaagttaatctctaactttagatacgagaacgaaactaaaagctagttagcaaataaaacattttgaaagtatttgcattatcaggccaaaaacataagtagccttttctgtaaattctacgactatcttaactagatatcatttttggggattgttcccttatttatatatatcaaatcttatcggaaaacaattgttataggcttcaggaccaccataatcgaatacccctaaagaaaatatttcaatttgattggctacggaaagacgtaagtaactggatcaaagaatttgattctgtcccacaaataagttactttttgcattcttgaacttatttccacggtcatgagtcatgaccaaaccaagacatttggatttggatatatcgaataattttgctagaattgatgagaaatgactgacaagctttgatagtatatttaatgactaattgctgatgattttttacaatgacctaacaataacggaataactatggaagttttattattcaagataaaaccagttaataagtgttcacgatacaaaaaatcgattttcatcatcagtagtataaatgtggtataactaaaaaaataaagaaattgaccataaggtgatccaaatttcctaatttcatttataaaagggcaataaatatacactaaaaatgatatggaacttgaaaaaagcaattaaactgtgtttttctgctttctttatatagtataaaaatatttttttaatgaatcatatgtacaagccttcttcctcccaaacatcaacaaggaaatgcaccatctcctgtaccaatatcatcatcaatttaaaaaaaactttcctagcaacaatgatatatactagattcaaatcctgatatgaaaatgttctaagggggataaagaatcttctgctgtaagttaattaaaattaagagttatgattagcagaaaacaactaattaaccaaatcaaatcaccttaagaggtattggttgaggaaaaagcttgtttgtgctcaataagctatcatacgtcgagttccagctgaaatcatatgaattcaaagtttcattttaacattgacgaattcagtagaccaatcctatataaacataaaaatagttcgttcaatattcgtaactgtttgtggttgtcaccttattgcaggttctggaactagacattgttgtctggttaagcattcacgccattgttgtctcgtgtggttccacaaaataagtccttttatggaaggaaatgaataagtagtagtgtatcttttagtgtatagaataactgaatgagtaataaatactgcttgcttcataacataagtttttggcatccaaaacaacctaggccttagaagttagaacattcaaaagttaccatggtttacaaattcggtagagttgcttgtgctgcattggggatcaaaaggcgggtttgaagattgggactgaatcgttatattgtggtccatatcacacgtacttgtgctccagaagtcatctgatgaagcactatctttcttcactatctttccttggattttgagtccctttgatggctcatcgacttccacaactaaacgcctttctctgttgcagcatccgaaacagtttatgctctgaaagattgaacattatgtcaatcatttgttactatggtctaatatgtttgatctacttggaaagaaatcaatttggttctccgggtcgctcacattgatgagagttttgcaatttgatcgtagagattccattagccaaaaagggagagtttggaagtaagctgccgggaattggaagaaagagcaacaacgcttcttactaaattgtgttcgtaattttagcaagaatgaataacaagaacacatagctagctaatacatgacaggacaaaagcacaatgaacatgaaagagaattaaggaaactcaaaaaagattagcaaggaagtgtagtaatatgcctcatatgacaagcaaacatatgcatttaagcacaaaaggaatccatatgttataacttacaagcaagtaaggcatattatgccgcataattacatattttaccttgatttagtacaaagtctgtctctgaactgaagcacatatatacatccacatgatttaatagaatcttgaaaagaattcaaaagaaagaaaacaaaagtttaaacaccttccaacaaagggtattgttaaaaacactcgatcattattacgttgattttatatttcttctcttcttcacgttatttacagtttttttttcatgtaaaaatgatcttttcgtttgattcctatcgtaattgtaagtaaacaaaataaattttagtattattttaagatgagacttatatagatatgaatctatgtgaattattaaatttaatgataataaataaccaaaaactttaataaaataaactgttacatattgtaaaaaaaaagatttttataaatgtttatattcaaagagagaatctttattgagtacaaaaggaggaatatatgtgatagatctaattacataatctactttacataaatagaagaagatatcgtggagtgattgatatgtgattgatctagtcagatatcatgattgatccttaacaacttatatagtagttatg

SEQ ID NO: 3024 - DNA, 44 bp, Unknown
  misc_feature (1)..( 44): cDNA_ID_3092820_gDNA_ID_1620621_Annot_ID_162325 3000 nt of promoter + ATG
ttctccacgaccggcttaaagagtacaacttaaatttgtcaatg

SEQ ID NO: 3025 - DNA, 3000 bp, Unknown
  misc_feature (1)..( 3000): cDNA_ID_3070637_gDNA_ID_1620621_Annot_ID_162299 3000 nt of promoter + ATG
attgccgtgaagctatctcctcgttaatgtttgcagcctctggattttccgagttgcctgagctgcgtgaattgaggcaaatgtttcacgaaaaatacacagattcacttgcattgtttgtcaaccaggaggtaaagagtttttctagtgtattcatttatttgtaagactcatcttgaaatcttatacggttaagttaaccacctgcttgtttcttgtacagcttgttgagaatatgtcatccaagcccttttctatggagaagaaagtgaagttaatggaagatgttgcattggagttctctattcgttgggattctaaagatttcgagaagaggattgtgagacagaatagtatttcagtaatggtatgacaatgactcatttgttttagggaacaactaaactgaaatatttggatagtgattgaattctgatttctttcttggacgtgaacaggagaccccaaaaagcaccaacgacaagtataagcctgtagacagaaacatggccttgccaaaaagagaagagtttgaaggttctgaaaatggggttagcttgaacagaaaaacggctgaggcatcagaaagaagagatcctttgtttcaatctgataaagaaagttatcagaatggtctcagaggaaatcagcgtgggctaacatataaagaaaggtcagagaatgttcttcacgcctctagatcggaaagcaaagacaataaggccgaaaggaaagagttttatctgcattctaagcaaaaccctgctagagaaaaacatcagcctatttttaacgaaggtgacactatagtgatgaaggtcaactatgggaatctcggtcaagggaatggacatcgacctggtgtagttgatgcgcataagaaaaccgagtttgttgcctcagaaaggaaagagttttattcgcaatctaagcaagaaccttctagagaaagacatcaacctatttttaatgatggtgacactattgtaatgaaggtcaagcatgagaaccacgttcaagggaatggacataaaaatggtgtagttgatctgcataagaaaatagaggttaatgcttcagagaaacttaagtctagcagcagcaaaagagctgacaagttagttatcggctttaaacaagagagtttctttcaagggtacaaacatgagaaaaatgaagagcatgcacatcagaaagtggaagatagtacctcaagacctccgaagccaaatagcaagtcaaagagagcggaatctatcaatccaggttcgagacatcataatgatcgggagagtaaagaaaatgcagttcttgtgggaaagagcaccgaagaagatccatctggtgataatgttaagggtggagaatacgaatatgatcatgcaaatccagcaaggaaagttgaggagcgagaaacagagagaatgaaatcacccttctacaaatcccttccacctccgtatgttaaaaaatctattgctaaagcaaggcatgaaaaagctgaagctttagataatccaaaggctcgttttgatggtgaagaaggaaatcatccagacaatggtaaaaatgtttatggggcagagagacgaaatggagcaggtcatcatgaagtgaatgacatagacaatgcatctctgaaacggcaaactaacagaagaaagcacattgtagaatcgggaggtgatgatcacataagtagccgaagaagggaaaactcaaggaaaggccttcaagtcttaattgacgaggatgagaaagacagtgaggagaagatgatggataaacttctgatgcattacagtaaaaaaccttcaagctatgaaaaggacaatgtgcaagaagaatccaaaagcagacgtacccatcttaaaaaaggtgaatctgatgaagagatgatgattcatcagccggctcggtcacggtctctacccgctgaacagttggccgggccatctgaacctgcaaaaacatttgcccgtgcagcctcgtttcagccagaacgttccagtgaagctaagcacgttcaccccaagttaccaaactatgacgatttggctgccagatttgcagagctaaaaggaaggtaaatatatgaacagttgatgcctagaaagatagaattaatgagattaaatagcctgttacacattttcttacttcttgatatagtacttgtccgatattgccccatgtatgtggtgcttgttataatagttgaaattggaagagtgacgcattgttacggagtacggaccccaagagttgttgatcatctccttgtttttggatcatcttatgtaaccatttgaaaacaaggatctgtttagaaaaagggaaagtggttaccacacagtttattactagcgagttatttgatgttaccatgatttttgcattaggtcctgaccagcactaacttacaagctagtagctaccatatacaagatataaatttacttctaaattaccatgaagtgtttaagttgatcttactgagaatattttgagtttttttttttaaatctgaacatgataataaacaaaaactattaaagggaaaagtcaacgagaaccctttttaaacgaaaaaaaaaaggtcaacgtgaactgcagagtgagcttagatgttcccaaattcgttcataaaccctaaattcaattttcccgatttatccccagcaattgtgtgatatcttctcaattctcatctttatcttcctccttacacagtaaaaaaaatacgttgtctgattactacttacactttttctcaaatctatcgctacgattccttctctcataaagcctcccaaaatcaatcatagacaatctcattaacagttttgtgttgatctctaactccatcgtcttaggagtaattaagtgaaagaacccaaattcgtttgtcatagaaaccacaatttcgagggatccacgcactttcacagtttgctacactttcaaaacaagccctggtctttgaaattggtgaaaatg

SEQ ID NO: 3026 - DNA, 3000 bp, Unknown
  misc_feature (1)..( 3000): cDNA_ID_1808734_gDNA_ID_1620621_Annot_ID_47030 3000 nt of promoter + ATG
attaatgagataatttaaactcaccgacgcggtttcgtcttttcttcaagtgaaaaagtgaaaaccgatgttaaggatcatgcattcaaaagagatgtatagaaatataccggatatgttgtatccatagttcacgtagattcataactactatataagttgttaaggatcaatcatgatatctgactagatcaatcacatatcaatcactccacgatatcttcttctatttatgtaaagtagattatgtaattagatctatcacatatattcctccttttgtactcaataaagattctctctttgaatataaacatttataaaaatctttttttttacaatatgtaacagtttattttattaaagtttttggttatttattatcattaaatttaataattcacatagattcatatctatataagtctcatcttaaaataatactaaaatttattttgtttacttacaattacgataggaatcaaacgaaaagatcatttttacatgaaaaaaaaactgtaaataacgtgaagaagagaagaaatataaaatcaacgtaataatgatcgagtgtttttaacaataccctttgttggaaggtgtttaaacttttgttttctttcttttgaattcttttcaagattctattaaatcatgtggatgtatatatgtgcttcagttcagagacagactttgtactaaatcaaggtaaaatatgtaattatgcggcataatatgccttacttgcttgtaagttataacatatggattccttttgtgcttaaatgcatatgtttgcttgtcatatgaggcatattactacacttccttgctaatcttttttgagtttccttaattctctttcatgttcattgtgcttttgtcctgtcatgtattagctagctatgtgttcttgttattcattcttgctaaaattacgaacacaatttagtaagaagcgttgttgctctttcttccaattcccggcagcttacttccaaactctccctttttggctaatggaatctctacgatcaaattgcaaaactctcatcaatgtgagcgacccggagaaccaaattgatttctttccaagtagatcaaacatattagaccatagtaacaaatgattgacataatgttcaatctttcagagcataaactgtttcggatgctgcaacagagaaaggcgtttagttgtggaagtcgatgagccatcaaagggactcaaaatccaaggaaagatagtgaagaaagatagtgcttcatcagatgacttctggagcacaagtacgtgtgatatggaccacaatataacgattcagtcccaatcttcaaacccgccttttgatccccaatgcagcacaagcaactctaccgaatttgtaaaccatggtaacttttgaatgttctaacttctaaggcctaggttgttttggatgccaaaaacttatgttatgaagcaagcagtatttattactcattcagttattctatacactaaaagatacactactacttattcatttccttccataaaaggacttattttgtggaaccacacgagacaacaatggcgtgaatgcttaaccagacaacaatgtctagttccagaacctgcaataaggtgacaaccacaaacagttacgaatattgaacgaactatttttatgtttatataggattggtctactgaattcgtcaatgttaaaatgaaactttgaattcatatgatttcagctggaactcgacgtatgatagcttattgagcacaaacaagctttttcctcaaccaatacctcttaaggtgatttgatttggttaattagttgttttctgctaatcataactcttaattttaattaacttacagcagaagattctttatcccccttagaacattttcatatcaggatttgaatctagtatatatcattgttgctaggaaagttttttttaaattgatgatgatattggtacaggagatggtgcatttccttgttgatgtttgggaggaagaaggcttgtacatatgattcattaaaaaaatatttttatactatataaagaaagcagaaaaacacagtttaattgcttttttcaagttccatatcatttttagtgtatatttattgcccttttataaatgaaattaggaaatttggatcaccttatggtcaatttctttatttttttagttataccacatttatactactgatgatgaaaatcgattttttgtatcgtgaacacttattaactggttttatcttgaataataaaacttccatagttattccgttattgttaggtcattgtaaaaaatcatcagcaattagtcattaaatatactatcaaagcttgtcagtcatttctcatcaattctagcaaaattattcgatatatccaaatccaaatgtcttggtttggtcatgactcatgaccgtggaaataagttcaagaatgcaaaaagtaacttatttgtgggacagaatcaaattctttgatccagttacttacgtctttccgtagccaatcaaattgaaatattttctttaggggtattcgattatggtggtcctgaagcctataacaattgttttccgataagatttgatatatataaataagggaacaatccccaaaaatgatatctagttaagatagtcgtagaatttacagaaaaggctacttatgtttttggcctgataatgcaaatactttcaaaatgttttatttgctaactagcttttagtttcgttctcgtatctaaagttagagattaacttactattcttgtattacgataacgttttgaatgaacatgtaatgatgcaagggtgtaaccaaaaatgataaaactttggggtcaatttgataatattgactaatagtgtggggcttgacaagaaccggaaactccatgatatttttgcagtctaaatatcttttcatctctcttctcttcctccactgaaatattccccacaagaactaaca

SEQ ID NO: 3027 - DNA, 3000 bp, Unknown
  misc_feature (1)..( 3000): cDNA_ID_1819263_gDNA_ID_1620621_Annot_ID_47031 3000 nt of promoter + ATG
atgaaaacattattaggatatatcagttttatgaaaaaaggttttccaattgttaatcccaataataaatcatttaaaaaaatttagaaagaaaatgctgagttagaaacaaaaggaaaaggaagcacaaatggagtaaaaatgtatgaaaataaaaagataagataatgaaattttgggattagatagagatgatggagggagaaagttttgagaagcagcaagaaaggaaaggtgtcactgttgtacttggtacctctatcttaccctaatcgctggaccaacttgtctcttaataaaagtggtttttgtgtctaatctgactttgcttactctctaatcactctatctctctcagtgctaatcaagataatcataccttttttagctgttaccacttttctagtaaaggaaattgtagttacttcaattatataaatttcaatagaaaacccatcaaacttaactagttgggaacatgcatggtaggatacttattttgtctaatgctttgtattttacttatattttacggtttattacatatggatacaatattttataattcaaatcaatgatggatagtattaatatttataacaagttcatatacacattcatgtacagttatggtgttatcacacaaccgaactgagtagtttattgacttgtaatagtgtcgctactttacctttttccaaaaataatgcatgtgtgaggagttgtcgacgatgatgaaaaaatgacttatgatattcttacgaaataaatctcactaaaatttgaggtttttttttttttttttgtcgtaaaatttgaggtattaacccaacatatttggatgatgcaaataaaaactttgaaagtaacaacgttaaatagcataagacattcgttttttcactaagcaaaacagtcgtgttgtacaatttaaggtaacaaaaccgtaaaaactgaaacacatatcaagagattatttgacattttcgaactgtgttacgttcttgactccagtattcacatctagacgagacgttactgtttattgtaaccaataatgtatatatgtttggtattcttatataagtttcttattgtttttttgcattgccaaagtgttttatgtgtctcagtgatcaacatcataatttgtatcaaagtcactgatatctttcttctcaaatctagtactgcataatataattttttcttagtaaatgtgctacaattttataattgttaaacttagcgtcactcatgagtcatgaaagctgatgaccaaaatcatacaggatataatatatgttgggaagaaaagagatctggagcaacacctactaagttcgctgattagttttctaatagttacttttaagtattactaataaactattacttcctctgtagtcaacgaaataagtgtagttaactttcatttgatttcttaaaatataaactttcattatttgatttaattcttttggcctaccacaagcttttgggtgtgtacatgtgggtgcatgtatttaaatatgtaacacttgtttttttatattcataaaatgggaaatgctgtacttgcttattaattactcactatttacatattccaactttgaaatattgttgattggtgaaaaaggtacttcataataatttaactaaattgtaccatcatatattcgtctaagaaaaactcaatcttttatcattgttgatttcacacacaattccaaatttgacacgagttatataacatgatacccatattcaacaaaccactagactctatatttatctttagttttaaaaatttgtcctcaatattaaaattaaggggttggttatatatatcaagaaaaataaaaagattccatgaggtggctttaatagttctgattaaaggtgttaattaattaacaagatgaataaaaggttccatttaagagtaaagtatatgataacagtgtgggggatgatattggttcaccttaataaagcgattgcaataattttatgtataactaacgaaaagtttataccgtttgattaagaaaatgagaaggtcatgtccctctctctctctctttctcttgtatttaaatcaaaagcaatctctaaccatatccaaaatcccccctaattccgggttttctttttataacaagtattaatttggacttggttcccacttatgtttcttctttttttttgccaaccacttatgtctcttttttataatcctaaacttttcatatgttttttgaaatgtcccatctagattcagttagtggattttactcaacttgtaatacgattctactacataagatgagtgaaagagttaacatgcgcttatttttaaggttgaaaatcgcaatgtacactctctagaattatagtataaaaataaaaaaaaatctaattcagatttttgattgttacaggctaacagcaaaattaatatggatttaaaagattaatactggaaaataataataattaaaagagttttaattaaaacttccccccccccccccctcaatcccacgattaattaaaaaaggaaaccaccgaataaccgtaattactataatgacgtggcacttagatttcgaatagccgctgtaataaatattaaaaacgttttgtcattttcctttttctcttctcaaagaaaaaaataatcactctctctttttttttttttaattcacagacagaatcaaaacttgtgtagaccgagaatccatctctcacaaaccccaaaccaaaaaaaaatcaaaaaaaaaaatcaagaacaaatcgaaatctcaactctgtgaaaacctcgtccttgttcttcttctgcttctcccattccttcgatttttgcttcaatggatgtttgatttgctctctgactgcgtttggtgagcaacaagtccgtcttagtgtttatgttttgttttcttgcctgatttttcttctttcttctctatttggttgctgtctcaaatg

SEQ ID NO: 3028 - DNA, 3000 bp, Unknown
  misc_feature (1)..( 3000): cDNA_ID_1823138_gDNA_ID_1620621_Annot_ID_47033 3000 nt of promoter + ATG
atagatcatttttgcttgagaattgaagttttcattttgaaacaactctacttaagtatcttattaatgaatacgtaagaacttacaacttcaatgtttcaaaatagatttaaatatataaggaatagataatgtttttgtataattcagataagttctcgaaggaatatatatatatcaagatgtatttgaaaaaaaaaattattaaaaagtcccacatatatgtatatatatatatatagatatactgaaaatcattgagacaaaaaacattcaaaatcagtagagcttataggttataagtaaaatgacttatattattataaagaaaaagacttatagaacaaggtgagaacgtagttacatgtagtatatatatagacaatggacatacaaataaatgtgtaaatattgtgtaatgtacttataaatattggaagatgcatgtttgaggaagttgcacttaaggtttagggacgttcgtagtgagactgagacctcttgcgctgtcactgtttaggccacgacgaatcagtctgatccgttactattgccttgctgtttactaatattctttattatttataattatttaattgtttttttttaatcgtttaatgctttcacagttttattttaattataatatggaatacacttggcgattcgccaactaattcctgaataatttataattgaagatttgaatgggcgtagatgattgcgggtcattaataccaagttaactcccaactacatttttttacatttgaacaatcaatatcaattattttaaattaaactatataagcatacccctccaaataagaacctatttatgatttattgtataaaaacacaacaatatctttaagaaacagttttttttttttttgttgtcaaagtagaacatgtagttttgtactctttgttgcatataataataaaccataatatagtttgagggaagagctgaaagctaaagatgaaatgtagtttagattagtaatgatctttaagaaatagttaatgtttgaaggaaagagctgaatcttataagaaattagcatatatcatttctagattcttattctataatctatattgtatttttgtgacaaaataaaataaaacactaccagtacaatatacttgaataccggtatctatatgtataaaacacggaaaaacaagacgtaaagtggtttagcacatttgtgttaataacgttggccgttgaaaaagtttcgatctctcctaagaagatttacacataaaagtcaaaccaaacccacacgtcggtcgtgaaaaagcagtaatttggtccatttcatcaaccaggggtacttttgggatttgagtattatctccgggaaagaaagtacacgggggatacgtccaagtgccagctggcatccgtacttcgtcttcccaaaataccttaacaatcaaacacctctttctttcacacttccccacgttcctttttttttattaatatattttctccttaatctctattttcaagtgccctaatctttatagtatttgtaatctgattatttttttcgccaattaacgtgggaaagtaagttttgttttggtttataacggggaaatgtaaggttaggtattattatgttgacaaaaatttaaaggtaggaactattttccttttcttacggcaaaggtggaagaaactaaagaattagaggaagcagttctgtattgaatcatcaaccgtcaaagtagacacaataccaaaccaaatatattttcacgtttgcttatccatctttgaattccacctgaatcaaaaagaaagaaagaagagttctctaaatttcgacatttcatgataagataaacacaaatttaagaaaaaaaatagttggatgcttcaattggtattcctctaacgggcccttcatttaaagcacactagataacagagtaatagttttccttttccacatgtttcatttattaccatctatataaattatattttcaggtggaaaataaatccactatctctctaccctattttagattcaactaatggcttttactagtaatgataactcaatcggtcattttggttgcacaatatctaacaccaaccaacccatattctgatttcattagacactagataacaatttttgtttagttttcaaccattacccatatttaagaatacaagaaaaatattaactaatcttaaattaatttgtttgccttaataaattattatgcacatatttgtatgatctcaacattttatgcaatctgcaatattgatcaatttagtagatcggtcgtcttcgtctttttttctttgaaaagtcaaaagtcaaaagggtttggaaaatttaagaacatgtttggttgaaaagagaaaagactcaagtggtcggatctgtccaaaagttttgtgacggtcacaagagggaaagataaaaaggaaacggatttgaaggaaacggctcagagagatttaagacactcgcagcatctctctacttctctctctctctgtttcaacccctcttgtcgtctatctccatcaaaaagaccaaaatcaaacatcattgaatgttagacagagaggcaaaaactaatcaaagtgtttctaatccctgaaaataagcccacttcttctattttcctcatttcagtttctgggttttaatcgatctccccctttctcacccttccgtctgaattccggtctgcaatcgtcggaaagttttggactttacaccaacgccaaagcgagttcttgtttctctgtttgcttctctaggaccaatcagtttccatttacagatgcgtactattcacctgtcagagctctgagatttgtctttttgcatctctctgaatatttctcttttctcagatccattgacctcatccacatacataaagtttaggtatttttaaaagggttcaattctggggtttaccggaatttcatcatctttgaagaccatg

SEQ ID NO: 3029 - DNA, 3000 bp, Unknown
  misc_feature (1)..( 3000): cDNA_ID_1819259_gDNA_ID_1620621_Annot_ID_47035 3000 nt of promoter + ATG
tataacgagttaacatgttgccagtttgaatcaagaagcttggatgatgaatgaatggatcggtttgtggtacaattcttaaaattgtagtagaggagacagagaaaaaacatgataagactttggtatttacaacttgacggagacaagacagtaagccaaatctgtcacaaaaacactcaaactcttttctcagtgttttgagtttaaagagagacttattcacttcccctttcgtaacacttatttgtctcccaaccaaacagtttctgtcctttcccttgtcctcccacgtgcatctttatatctcatgacttttcgtttctagatcttgaataatgtcttagtggattaggtttgttgtcggtaaattaggtgaccgtttttttcttatatttggaagatcgcgggatgaagcagatactgagtttcagggcatacacacctaatttgaaaatcattgttagtccaatttcactttaatcttgtttacaaaaaaattgatctgaaaatgttgatgggataagtaaaaatgtaagttttgctagtagtcatgatataataatagcaaaaccagatcaattttgagcaaaaggaagaaacaaaaaacagatcgatcccacgagcaagactaagtgtaaagtggttcccacaagagccatatggatatggtccttcaacttttaaagcccattacttcagtggtcgacccgacattacgccacgagtagtcacgcacgcacgactccgttcacgtgacattcacgttgatatttccccctctactctcttctgcttggttgatctaaaaaacatgaagagaccaacctaatttcatattaatatatgatatagacttcatactcaacagtcactttcgtaatccaaatccatatcttacgaaattagttcttaataaaggttgtggattaagttataatattgtgttaagagttaagacacagcatataaccttgtaccaacagtgctttattcttaaatggaaacaaaacatatgtcaatgtcaagcatacagctaaaatatcattatctaatattaagagtaaaacaagataattaaaaattgaaacaacaccatatttttatagctttacttatcgtatttttctagtcttcatggtaattgtgttgctttattttgtttataaatgaatttggttcgaccagatagtctaatatcagtttttaaacactggttttaataaaatcatatgtcggcaattcaacctgttacgttgtatgattgtatcctagtcaaataggggaggaggtactagtcgtttcaattagtttacgtaatcaatccaaagaaactataagctataaagatcctcaatttgttggttacaataaaaacaacagttgtcaaaatttatgtttataaaaagtaataactatgttccttcccatatagagcaaagtacctcaggataggcaaaccgtacttaatagcccttattcataatttgatccaactcttccccacaaaattgcaactgatgaagtcaatacttgtatagtgagtcaagctataaatgtctagtgatagttttgtctcttaaaaggttaacaaaagttatgacaagctgaaaaatcagagtttgctaggagtattacttacagttatcagtttaagtatcacatttatagtattgtatacaatgattcttaaattccaccttttccgtgcgaaaccaaattttctattggaaacatagaatgtaaacaaaaatatgggacgttgtccgttccaacattaaccaaacttgtctattactaatattcgtgttggtttgatgttggatgtctaaattcgttgaatcatgtgtctcttgacgaaatatgcatcttcttatttcttagtatagatgcactttatcattcttttagtacatgcttaatttttttttttaaaatatgttgattgtcatattgccaaaagtatgaattaaagacgcacatctaacacaagttagcagccgtaaatccttccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaaatg

SEQ ID NO: 3030 - DNA, 3000 bp, Unknown
  misc_feature (1)..( 3000): cDNA_ID_1819255_gDNA_ID_1620621_Annot_ID_47036 3000 nt of promoter + ATG
ttttatgcttttctgctttaaatacatcttataaattttatttttatattcaagatccaccttatctacactgtataacaagttctcacctacttttaatttcaaattttgatcaaaacataacattattacaaacgattatatcataaattccgctcattatataatgagcaaaacttgcaaaataaatttatggaaggatttacggctgctaacttgtgttagatgtgcgtctttaattcatacttttggcaatatgacaatcaacatattttaaaaaaaaaaattaagcatgtactaaaagaatgataaagtgcatctatactaagaaataagaagatgcatatttcgtcaagagacacatgattcaacgaatttagacatccaacatcaaaccaacacgaatattagtaatagacaagtttggttaatgttggaacggacaacgtcccatatttttgtttacattctatgtttccaatagaaaatttggtttcgcacggaaaaggtggaatttaagaatcattgtatacaatactataaatgtgatacttaaactgataactgtaagtaatactcctagcaaactctgatttttcagcttgtcataacttttgttaaccttttaagagacaaaactatcactagacatttatagcttgactcactatacaagtattgacttcatcagttgcaattttgtggggaagagttggatcaaattatgaataagggctattaagtacggtttgcctatcctgaggtactttgctctatatgggaaggaacatagttattactttttataaacataaattttgacaactgttgtttttattgtaaccaacaaattgaggatctttatagcttatagtttctttggattgattacgtaaactaattgaaacgactagtacctcctcccctatttgactaggatacaatcatacaacgtaacaggttgaattgccgacatatgattttattaaaaccagtgtttaaaaactgatattagactatctggtcgaaccaaattcatttataaacaaaataaagcaacacaattaccatgaagactagaaaaatacgataagtaaagctataaaaatatggtgttgtttcaatttttaattatcttgttttactcttaatattagataatgatattttagctgtatgcttgacattgacatatgttttgtttccatttaagaataaagcactgttggtacaaggttatatgctgtgtcttaactcttaacacaatattataacttaatccacaacctttattaagaactaatttcgtaagatatggatttggattacgaaagtgactgttgagtatgaagtctatatcatatattaatatgaaattaggttggtctcttcatgttttttagatcaaccaagcagaagagagtagagggggaaatatcaacgtgaatgtcacgtgaacggagtcgtgcgtgcgtgactactcgtggcgtaatgtcgggtcgaccactgaagtaatgggctttaaaagttgaaggaccatatccatatggctcttgtgggaaccactttacacttagtcttgctcgtgggatcgatctgttttttgtttcttccttttgctcaaaattgatctggttttgctattattatatcatgactactagcaaaacttacatttttacttatcccatcaacattttcagatcaatttttttgtaaacaagattaaagtgaaattggactaacaatgattttcaaattaggtgtgtatgccctgaaactcagtatctgcttcatcccgcgatcttccaaatataagaaaaaaacggtcacctaatttaccgacaacaaacctaatccactaagacattattcaagatctagaaacgaaaagtcatgagatataaagatgcacgtgggaggacaagggaaaggacagaaactgtttggttgggagacaaataagtgttacgaaaggggaagtgaataagtctctctttaaactcaaaacactgagaaaagagtttgagtgtttttgtgacagatttggcttactgtcttgtctccgtcaagttgtaaataccaaagtcttatcatgttttttctctgtctcctctactacaattttaagaattgtaccacaaaccgatccattcattcatcatccaagcttcttgattcaaactggcaacatgttaactcgttatagatgatagtttggtgagttctataaaattgcgattaaagttatttctcttacaatttttcttggaacattttatatatgtataacttgtacatgaacgtagctcaaaagctaagaaaaaggtagcgccataatcattatgatgaataaaataaaccccagtttctctgaaagtgttggtttttaccacaccatattctagaagttaatttattggggttctaccacaccatatgcaccatgtgattcatgttattgttctaattctaaaactttcactgcgattttaattataatggttcactaatcactatgaaaacattagatgaaaattactaacacgtgattcttccagaaatcccgaatctctcagttacacaaaaagtaatatttttgtcatgacccagctttttccaatgccgtacataagcatggggacaggcaactaaaaaagctacaccaatcaaggccttagttcataatcgaacaatcacgtttagcccaaactttaaatgggcttaaaataatgtgggccttgacccacaaatagaaaaacacgtgacattccctctttgataatgattgcaaaaaaacagaggtgtgtttactcaaacgtttcccgtgtcctctacggtcagtatcattctttcggtgacgctaatttctccggtggttggaggagaacaaagtctcaaagagacggcgaacgaagacgaagacgaggagcgtggagagagtagacggcgaacgaagacgaagacgaggagcgtggagagagtctacctctctcgacg

SEQ ID NO: 3031 - DNA, 3000 bp, Unknown
  misc_feature (1)..( 3000): cDNA_ID_1026104_gDNA_ID_1620621_Annot_ID_47037 3000 nt of promoter + ATG
aactactgcattttccttaacaccactctcaattcagctttgacgcagacaatttgtggcaatatgaaggttggtttcactttattagtatctcctgtacaaaagaaaaatgtgaaactaatctgccaaggagagactttgaacattatatcatcgttgcaggatctattcacggttggactaggctggatgctctttggaggactcccattcgacctggtaattttcttcaacattcctattattccattgaacctaaaatcggcatctacgtttgctacatctcactacctttcttttttggttcatttacacagatgaatgtgattggacagctttttggtttcttcgggtcaggtttatatgcatattataagatcatcgggaggtaacaagtccaaaacaaagaaaagccaaagaaaacatgagtggcctagtgatgataaaggctcattagtttaaggaaaagttgttgactagtagtgttcaagtggagatagagtgttgagcttttggttttggaggtgactttagagtagtattaataatgaaaggcctaattttttgaacttgcgtcttgttcttcttcagttttcaacaaggcgaaagattagactatggacaaaactgattttctatttttttgagatctactgactctaatttatacaactgcttcttttcattgtatatatgtagtattattatacacacttgagaaaaggatgactgtaattatacaactgcttcttttaaagcgttcaatgatgatttggtactaggcattcttgcaaagagctcggtgaaagcaaaaataattacttcaacggttaaaattgcaagtactagaaaagaaaaaaagagcacacccagtgggactcgaacccacaatcgcttgattagaagtcaagcgccttatccattaggccatgggtgcttgttgctacatccttctgagttgttttatatatcatataattgtatttgtaatcgtgttccataccttcttcaaaagcaaaacattctctcgccggtaaaaaagcagagatcccttaaccatgatttccttcaaagtatattccccttcctcatcctcttcccatgctcatggtatcaatcttccactctgacccaactcaagctctgatttctcctactccgtcgccaaaaatcttggaagtagatgtcttagcccgggaaaatcaaattttctcaataatcaatctatggacgttccaccacgccgctctttggctgcgtctctctcgcctctccggctaatcgatggactccctcgtcggaggagtttcaattataatcagatgcctgaagagcccatcaaactcactgttctcaagcttgatggatcttcctttggtacccattactcatctcctacttgcttttaccattaaattttatatgttaactaagaatgtttgctcaaaagaactaaaagttattgctttacaacgaattctagttttttctgtgttgtttcgtttgaggttgtccagagaaatttgactggtttctgaatttgtgatttagtacaattccctttaagcgtaatttggatttgtaggtattcaagtgttgaagacagcgacagtaggggagctcaagatggcagtagaagctgcgttttctcacttgcccatctcaggccctggcaagatctcatggtaccatctctgattctttgacttgagttattcttataatgattccgattttgtgtctatattaggataagtaactgctaaatgattcttgatgatcctatttttaccctgtgattataaaggccgcatgtttggggacaattctgcttatcttatgaagataaaagattgattaatgagtctgagtacctcactgaatttggcattaaagacggcgatcaggttacccttttactctttctttatcacttgaatacatcaaagagtctatgcttatgatattatttcatctttacatgtgatgtcgtagaacgatgcatttgggtagctagagtctctaacctggattatgtagattgttatagtccagtttagttttgacaacatagtgctttgttttgatgctctataatgtgttttatctgccatcattcagcttcggttcatccgccatatctcaaactactgcatgttaatggtgaagcataagagcaagacaccccgtgtttcttctttcaaacaactcaaactgtaagaacttttggtgttaaaatgtttttagcatttcattatccggaatctccatagtaatacatgtttttggaccaatcaggttctcaaccacaccggaaacccggaaaaagaacgtaataagggaagttgaagaagacggtgttgttgactccatccctcggagccaaccaagctttctagcaactgtattgggaggtttgctctcttacaagtcgacgccaagtcaacgaggtactaaatacagaaacgtgactgcaagtagagtttttaacaaactcattgcaaggtttcgtttcaagtgtaattccgagaaggatgtgtggaacagaaaaaaactcatatccgaaacctaaaaaaaagcactccttttctatcatttgattcttgtagagattttgatttcctaatcttggtgtttatatacaaacttggatgttgtgtgtgtgcaaaatgaataaggcattgtgtatttacgtttgtagtggatataattgcaaccttaccgtcttagccattttaaccttatctggtacagcgttcgcgtttgcgtttgcgtttgcgtttgtgtttgcgtttgtggccaaaacgcaatcatttactttttaattgattttccgctccattgattttaatctgacgaccacagcctttagcttatttgtgtggcgaagagaagagataacattcctaagcaaatctcttctctctcccattcgtctccaaagagattacagttttgagcatttctcatctctcgaagctcttctctgtgtgtgtggcg

SEQ ID NO: 3032 - DNA, 3000 bp, Unknown
  misc_feature (1)..( 3000): cDNA_ID_1819251_gDNA_ID_1620621_Annot_ID_47038 3000 nt of promoter + ATG
agttttgacaacatagtgctttgttttgatgctctataatgtgttttatctgccatcattcagcttcggttcatccgccatatctcaaactactgcatgttaatggtgaagcataagagcaagacaccccgtgtttcttctttcaaacaactcaaactgtaagaacttttggtgttaaaatgtttttagcatttcattatccggaatctccatagtaatacatgtttttggaccaatcaggttctcaaccacaccggaaacccggaaaaagaacgtaataagggaagttgaagaagacggtgttgttgactccatccctcggagccaaccaagctttctagcaactgtattgggaggtttgctctcttacaagtcgacgccaagtcaacgaggtactaaatacagaaacgtgactgcaagtagagtttttaacaaactcattgcaaggtttcgtttcaagtgtaattccgagaaggatgtgtggaacagaaaaaaactcatatccgaaacctaaaaaaaagcactccttttctatcatttgattcttgtagagattttgatttcctaatcttggtgtttatatacaaacttggatgttgtgtgtgtgcaaaatgaataaggcattgtgtatttacgtttgtagtggatataattgcaaccttaccgtcttagccattttaaccttatctggtacagcgttcgcgtttgcgtttgcgtttgcgtttgtgtttgcgtttgtggccaaaacgcaatcatttactttttaattgattttccgctccattgattttaatctgacgaccacagcctttagcttatttgtgtggcgaagagaagagataacattcctaagcaaatctcttctctctcccattcgtctccaaagagattacagttttgagcatttctcatctctcgaagctcttctctgtgtgtgtggcgatggctgctaattcgataatggcttcctccaaacccctaatctccctgtcatccaaccaacaaccaaaccgagtccaaattcccaaattcgccaaacttccccaaattcccaaatccctcacttcctccaccgatctccgtagcaaagcactatcactctcctccgccaccgccaaatccttagctttaatcgccgctttcgctcctccgtcgatggcggaggcgatggagaaagcacagctcttcgatttcaatctcacgcttccgatcatcgttgttgagtttctcttcttgatgttcgctctcgacaaggtctattactctccgcttggtaacttcatggatcaaagagacgcttccatcaaagagaagctcgcgagtgttaaggacacttcgactgaagtaaaggagctcgatgagcaagccgccgccgtgatgagagcagctagggctgagatcgccgccgcgcttaacaagatgaagaaggagactcaggtataaaagaaacaacaatgcactcagagtgaagaaattggtaaatggattgtgtattttttttgcaggttgaagtcgaggagaagctagcggagggaaggaagaaggtggaggaagagctaaaagaagctttggcgagcttggagagtcagaaagaagaaaccattaaagctttggattctcagattgctgctcttagtgaagacattgtcaagaaggttcttccttcttaaattatatttttgttaactgtgtaattctctgtctctctatctcaaaacttatttacaagaaattactgtaaatctcttcttcttcttcttctctgtttcttggattgttcgtcgttcaaagaagaacaatttttattttgtaagtttataaataattagctctcttctgtcattttagatgattaaagtacaagtatgtatatcgaggaattagttgttacggataaaatcttcatgcgagtcttatcgtcactagatttatgtctatttgaatcgattgaacaaaaacgcaaatggcaggagttgcttgtgtaaagagtagagagaaattgagttttcagagccaaacactccagctttgtccgaaagtgttcatagaaagttaagttgactcttccataacgagctcaggtccaacaacgaagcccaaacctcagttactctatcttattattgggccctaaaacgaaatgggccctaaagctaacgcgggtcggtgtttgattaaaacaaatgacggggcctccacgccttgttccttcttcttcttcttctcacgctcacggttctctttctcttctctgtctttttcagcttctgaagttacttgtttcagttcccgatgatcaattcttagtttttttggcttgttttcttcgtctctctttcatcaggcctttggagttttgtgttaccattttcgctcgcgtcattactggtgttagggttttcttcaaaagcttcttaatccgtcgaaattgctcttttctctccctcattgtcggttactttctttgacccttctcttatgcttcgtaagctgtgatttttttctctggtttcattgcaactctagttcaatttcagtttgatttcttcgcttaaatattttgttctatgagatctgagagttgtctttattgttggcttatttcaatcaaaacattggctggttaactttgattgactcatgattgattctatctagcattaattggttttctttgtatttggttactgttacttgttcttctacttctccacgattctacttctccacgatactgtctctgtcccttgttcgtatcgctaacttattcccatagtgggcacgtctctggtttctgacttttctcttcaattccatgtattgcgttttaccatgatgtttagtttcggaatcatttcttgctttctctatctgcttgtaagaatagttaacaagtgagaggaaagtcctttttgttgcttaaatagtttgatttctgttgttgagtttatgcgatatcccaactggtgaaactgtgtttattggttcagacagagataa

SEQ ID NO: 3033 - DNA, 3000 bp, Unknown
  misc_feature (1)..( 3000): cDNA_ID_3092812_gDNA_ID_1620621_Annot_ID_162322 3000 nt of promoter + ATG
tctcctgaagtagattttgtgatacctgaaacgcattagcttttttgtaaagctcatcttgaataacggatatatcatgcatagctagctccaacaatggtttctctttctgcaactcctctcgtaaatcctccagcaattctttttggaccgatatttcccgctcaagcgcaaaatttttagcctcaacaactctgagctttactctctcactttcaacttcagtgtgcgcatccctcaagctttgcatatatgacaacacacttttcctctgttcctcgagttcctccaattgtttttccaatagtagctctttttcttccatttgctccctggaaaataccaaagcttcccgagaagaaataagctcgaatcttacatcagtcagaagctttttcactttcatgaagtcctccatggtttcattggcttctcctaaacgtttcacggtttcctctttaagcttattcacttcatcctgggctatcagccactcttctgtctgtttcttcaagttggcttctgtttctctaagcttttcttgttcaagtttcttcgtagccttagaaatctctaattcttcttccttctcctcaagagctctctgaagtgcatatatttcaccttcttgtctcttgacaacttcgttggctttgcttaagagttgtgacttgctttcaaattcagaaatagccatagaaacctccttgcttctgtttgcaatctcttgacgcatcttctctagctcttcctctttcaaagtcaaggacgattgcaaagcagcacgttcctcgtctctttcccttagcttatgctttaactcttctatctccctggcttgagaagctaactccacatttgcccgcttcagctcctcttgtagactctcatgcttcaacgaagcttcagagattgttttctcacgtttttctaactcctcctttgcccggttaagtttatttttgtcagagagaagcttcctctcagcatcgtgcaggtcctcttcccttttcaacaaggccactagcgcagcctcaaggtcagactcaagcacgccaaggtttgaataggggagatcatcatcgtcaggataaaccgagtgttgattggtttgtctctccaatctgtgtgtccgagcaaataatttatcgaaaagaacatttgcagactcagctgagccattgtcgttgatgttgggtcttgtattgtgcaagactgattgaacactcagtaaaagatgtctctttctccttgtaatgctcgggaatgcgacaagactcttctgcttatggtttactactcttgtcaaacaatactgcataagaaaaaatcatatggccgacatcaaaatcaaaatcaaaagtttgattattttggacagacactaatcaatatggatgcaagcaaacttattcaaattaaaggaacagtattgaaatttgcaatctttttaagccagaacaaggaacaatcagaacaaggccagcaaaagtcaaaaattcaagtttgataaagttaagagtaagtaaagtgttgtgaatcagcagcgatatataaatgaaaatataggggataatatagagaaaggtaaggaaacaaacatcgcagggagagggagaggagaaggaagcaagattcaagcgaatggcctgagagaaacccatcctgagagcataattatgcaatcgccatggagcttaaagacggaacaaaacccaaatccactggatcaaatttaacaagtgggcgttttggagaagaatgcttacgagaacaaatccaaggaagaagaagaagaatctagctagggaatggatattgttacaaaattcttttaccaaaaaaaaggatacaaaataataaatagaggctcgcgttggcttgcgagttgtggtcgccagtaaactcgaaagtcctttttgcccttattcataagatgcatgtcggcattgtccaaatacacggccaagggatctatttgtaaaaataatggactcttcttaattacgtacgtggtaacggttttctagtatgacaattctctttctttcgcgtagtcggctagtcgcgtggttagaaatgcttacacactaaagagtatgttatattaaactggaatataaatttaagaaactgaataaaagtcatcaggcccatgacattggcccaatagacccaatgaaaaaccaatccatcagctagttttcttaacatatcaacccaacgaggttgtatcttgttacatttgcaagtgaacttttttatcattaaaaaatgtaacaatggtatttttggtttagtgttcctaaaatatttgtttcccacataagattttatctacaccaaatagtccaattgtataatataatccatcttcacaaaagcattttaaaggatatcctaccttctaaattccggcgaaaaatatcttaaatctgaaaaagtgatttatcgtgaatagtgtaatgttagcaaaatcttaaacttcaaaaaatcgtaaaacataaagaattaagtgtgacggattaattaagatatcgaaaccaacacagtaatcctcatctatgacttggaaaaactcataagtggcaagtggagttcgagtttggtcattattgtgaaacaccaaacctaatccacttacaaattcattaaaaactacaaatttgtgtggtagtttttttttttttttgggaaatttatgtggtagttaattagttaacaaacaattatatataaatacaaattttgtttggagttaggtccgcttcagcctgcttaagcgattctaagcttagtcgtataatcgtattagcaaaagctcgaacagtttacttctttaccctggaaagtcttatcatcatcagttcgtgtcgtttgactttttaaactttgcaaggaagggttttgtggtggtttgggagaattaggcaattgttggtgatccgatttttctgggtttggttgggttccttttttattttttaataaaaaaaaaaa

SEQ ID NO: 3034 - DNA, 3000 bp, Unknown
  misc_feature (1)..( 3000): cDNA_ID_3070630_gDNA_ID_1620621_Annot_ID_162319 3000 nt of promoter + ATG
ttcaacatagaagagtgtgaaacagattcatggattgaacataagccgttgattcaagatcaagccgcgtttcactccatagacatagaaggtgtctcacaacttcagaaggttcgttcaaaccttaaggattttgataaagttgatgcaacaatgaatcaaatgctgtcatcaattggatttgttgttgatgaattacactctagttgtggaagtgctaccgtccatgtccagaagaagcctagtaagtctctcaaatcctggaagttcaaatttaaaaccagctcacaagaccaaggggatcatgaatcacttccaatagggttacatatcagattcaagtcctggaaatttaagttcgtgaatagaaatttacaaatgatgagagaacatggatatacaacacactttcagctaatgtctgataagagagaacatcaagagatgttcattgtggccaggattgttgatgtgagatgtttgcttagcatgatacttgggataacagagagtgatgcaggtcatggagaacaatttgtgtatgaccggattacaatggtaaagaggctgctgttgcaaaccagtttagtcattcaagaagtgatgagaaacaaaaagatcaagtttaccaaacggtggtggttcaagtataaatttggggaagagggtttcacgagactgaattctttcaatttgcgtatgacttatcattttgcggtttggcattgttggaagagcaagaccatggtgcatgttgaaatgagtggtgatcactggtcttggatggtcttagtcatgaaatctacaacatctagctttttgtcacttctctatgatcgaagaatgggagatccaagcagacatgaaacgggtcgggagattgtgtcacttcagggtcaaattcacactggttctcctatgattcagtgcataaagatgagcttcagcattctccttcttcagggtctgtttcagagtttgacaatgaagatgctcacatatatgcacttgtttggtagcaaaagttgtgtttcaactttgggagtgaggaaattaggcaaagattggtggtttaaatacaagacagatgcaagggctacagatttactgacaaatccgtagaaagagtaactacgaattagacaacagaggatgatgaagttgtcacaagcttggcgattcaaggtttaggacttggtaaaaggaaagctatgattcatgttgatttatgtggaagaggctacatggagttactctataaactggcaaatatgtttccatgaaccttgaggtcaaggttctctgaagaggggagatttgttataggaaaactgaagtcaagctatagcgttcaggggtcaagctggcgagctggaaatgtgaagtcagggatgttaagcaaagcacgtgttgtgagctggcgatctggaaatgtgaagtcagggatgttaagcaaagcacgtgttgtgagctggcgagctggcaatgcaaatggacgttaacggcgatcgttattaacgtggttaacgtttactttctttacctttttgtataagagcaacatgttatgctcatgctttcattatcgaataatctggttgtaatctctctctagagacttctagatttccctcatcgttttaccggagctctcgtcgagtctcttgtaggtgagaagttgatatcgcgtctctttacgaacgttgtatcaagtgtgttaatcggagtactctattttcatctctctgttctattgatttcaaactctgtttattcatttctggtttacgttaacaataatcctgcaacttggcgccttcattgattcgcgagctggtcgctccgacggcgcagctcgctcttcgtcctttaattgctatatccttctttcgctgcttcttctcgatcacgtaacatgtccgtgagacctaagatggtgagagaagcagagttgcatgctcagaaagacaaagaaaagaattgatcgacaccaagaacacagctgacacaacaatttacagcatagagaagagtcttggtgaatacagagagaagatcccaagtgaaatcgccaaggagattgaagatgctgtggcagatctaaggagcgcttcctctggggatgatctcaacgagatcaaggccaagattgaggcggcaaacaaagctgtttctaagattggggagcacatgtctggtggttctggtggaggctctgcaccaggaggaggatctgagggaggcagtgatcaagctccagaggcagagtacgaggaagtgaaaaagtgaggagatttggtaaattcttgccacttgggttttaagagatgaggtttagatcatggtgggttctatgtccaaggaacttttgccttttagaacaacgagcagtggatatgtttctggaataagcttttgtcagggaactaaacttaatgtttctctgctaaaaaacctttgttatgtaatgtgatggttaaagagaagaagttttcaaaattttgtcactttatactttatagtttattttcattggattggatattatctttctttaagcttataagttttcaaagaagcggtcacaaaactagcccgagaagaagctaccacaaaactagcgatgtaagaaccaacgacgacacagctggctagctcattgtttggttcttattctttggaacccaccaccacgccaaaacttatacggaacaactacaaccactacagtggttccgaagtttttatcacttgacttgtttgtagcactcaccggagagacccgctaaaggagccagaggtttcaataatctcattgtgaaacgtgcggataactttcgttggggaatttgtaatttacgcaattaccctctaatttattttaatttttatgaaataattagggctgatttaatcgagatcccatttcttttgttggcttacttctctcgaatttacgcaggaagatcattagcagagaattctcatctgattcagtcc

SEQ ID NO: 3035 - DNA, 3000 bp, Unknown
  misc_feature (1)..( 3000): cDNA_ID_2132751_gDNA_ID_1620621_Annot_ID_162318 3000 nt of promoter + ATG
ttatttaataagctttattgaaataatgaactttcctaaagaataaaattaattttgtaaacaattaataaataatctgtgttgctatgaatgaattacagcttggacgcggatgaagatcgtatatggctggtagatgttaagatttattattaaggaggagcaagaagagtgaaggcactgcgtcatttgctgtttttactgtgctattttctatgataattatgtttgatagaagaatttgatatttttttatttatttcttgtcaataaaccttaaacatattaactgaaaattctacgattttttaattaatcatagtttatttgctttctacattgttatattaataagattatatatatatatataaatgaattcaaattaaatatttttcctttttcttttgtcattgtagattttattaaaaacatgttggtggaattacataaaattagaatatttttttatttgtttatttcattaatattgttgacaaaaatagttaattaagtaattttataagtttctatcttaaattaatgtcagattcagcagttaccatttgaattctaaattattcaacgagattccacaaaaaatcacaaaaacaaatagtgagattcagcggttaccatttacacaaattgttgaattcattaaagttagagtcaccgtgtttagtacttggttcattaattatatagttctatagaggatcatgaaagttatgtataatctaatgcatatatgtaattagtgaaaacaccaaaaaaaacagaaaatatggtttagagggattgacatggcataaaaagcaatgttggatcgctgaattattttttcttggttcggtaggactcggtccaatgttggatttgcgaatcgctgaaataaagagttttggttcggtgggacttggtattggttgggctaattcagcgtgaataaaaaggcccaaacgtatttaaatattgggccgggtctgtgggaaaaaggcccaaacgtaaaccgaatcgtagattgaaatgaccggtctagtttcagtcttgttcgcgagcgtcgagagaaatcgagaggaaaccctaatttggcgagtggaggagcaagatgatgaggaacattggatctgcgtgtgcgaaggtaataggaaatatcggaattgattctcatgtttcaacggaggttttgttgcgtctcttatcttcctcaaaatatcctcaggaaccttccatatcgtaaaaacaacacaatgtaattagtgaaacaacaactagaaatagaatcatgtacatttatgaatcttaaagaaacagaacgtaccgcaaaagctgaccggagagttctatcgtcgaaacccaataaaaggtctctaacactcgagtaggctccaagacatggatcgtttaaacacttccccacattaaagattgcgtaaaccctaagtttctcgtttctatcgatgattaataagaaacgttgatctgtgttgcgatggatgaattacagcttggacgcggagggagatcgtatacggctggtagatgtgaagattcatcactgatgaggagcaagaagagtgaaggcactgcgtcatttgctgtttttactgtgctaatggctggctttgcgggacatttttggtacagaggaaaaggttaatttttcgtttacaaaattagaagatcacggttgctgtttgtatcttcttcctctcacaatcctttgttttatatatacacatatatgccagctactctagaacgcttagccctctccagagctattgatgaaaagagtaaaaagattcgtcttcttaaacgagaagtggaggcgatcgaactaaaggtaagaacactcttcgtttactagcccattagtaattctcctttgaaactgtacattttagcttttgggtaacacaaatctttgacgatgaagacaaattttggaaaacaaaatgtaattcgtttctcttcgtctcaggttcgctgaatatgtgatgagatcaaggagatcaagatcagtttgaagtcagaatatatatatatctttgttatctcgttgtgtacaattaattctctataaccaagtatggttttaagttttgttacttaaaaaagtgataataattatcattacgtgttggctgctccacatcttacatgcttgtgaatggttaaaaaaaatgatcactttgtactgaacctcgctttactgtcatctggctccaaagggtttctcattctcaatcttaagccctctaactttcttcccattgataacgacaaggccatcctcggggatgttgggatcccattattgcacagacaacaggtgacaacaagagcacatagaactcgaattcgaactacaattaggtaacaagtgagttagcaaagatacagatcataacccaatattcgaattacaagcttttggtgatcaattctgttggtgcaggaattagcacctccgacaataccaatttaaaccaaggaataacgtgaataaaatcgagaattcgattgaaccggggaatcccggctagcccgttaatgggcctaagtcatgagctcgtcagaagatttgggtcgacaatcgagatcgccataggcggcttctcaggtcgtgtaaagggaaaacttccatttaaggaggatctcatgaagaatggaagtaatgaagatttagacctaggataattagaagtttatcatattttgatacgttcaacccattgtataaatagggggggtcaaagtccccaaggatcatctttaaccgaatacaagagactacaattatagagcaaaccccagctttttattcaagcaactttgttctctccctttgattatttgtgagctaagagaggagtgaatttgtctaaatcccttagtacaaattcattgtttgattacagaatcaacaattggcgcgccaggtaggggggaatataaacaaattttctctaccctcctttaatcaaagcaagc

SEQ ID NO: 3036 - DNA, 3000 bp, Unknown; identical to SEQ ID NO: 3032
  misc_feature (1)..( 3000): cDNA_ID_1819251_gDNA_ID_1620621_Annot_ID_162314 3000 nt of promoter + ATG

SEQ ID NO: 3037 - DNA, 3000 bp, Unknown; identical to SEQ ID NO: 3031
  misc_feature (1)..( 3000): cDNA_ID_1026104_gDNA_ID_1620621_Annot_ID_162312 3000 nt of promoter + ATG

SEQ ID NO: 3038 - DNA, 3000 bp, Unknown; identical to SEQ ID NO: 3030
  misc_feature (1)..( 3000): cDNA_ID_3092804_gDNA_ID_1620621_Annot_ID_162311 3000 nt of promoter + ATG

SEQ ID NO: 3039 - DNA, 3000 bp, Unknown
  misc_feature (1)..( 3000): cDNA_ID_2150159_gDNA_ID_1620621_Annot_ID_162303 3000 nt of promoter + ATG
atacacattcatgtacagttatggtgttatcacacaaccgaactgagtagtttattgacttgtaatagtgtcgctactttacctttttccaaaaataatgcatgtgtgaggagttgtcgacgatgatgaaaaaatgacttatgatattcttacgaaataaatctcactaaaatttgaggtttttttttttttttttgtcgtaaaatttgaggtattaacccaacatatttggatgatgcaaataaaaactttgaaagtaacaacgttaaatagcataagacattcgttttttcactaagcaaaacagtcgtgttgtacaatttaaggtaacaaaaccgtaaaaactgaaacacatatcaagagattatttgacattttcgaactgtgttacgttcttgactccagtattcacatctagacgagacgttactgtttattgtaaccaataatgtatatatgtttggtattcttatataagtttcttattgtttttttgcattgccaaagtgttttatgtgtctcagtgatcaacatcataatttgtatcaaagtcactgatatctttcttctcaaatctagtactgcataatataattttttcttagtaaatgtgctacaattttataattgttaaacttagcgtcactcatgagtcatgaaagctgatgaccaaaatcatacaggatataatatatgttgggaagaaaagagatctggagcaacacctactaagttcgctgattagttttctaatagttacttttaagtattactaataaactattacttcctctgtagtcaacgaaataagtgtagttaactttcatttgatttcttaaaatataaactttcattatttgatttaattcttttggcctaccacaagcttttgggtgtgtacatgtgggtgcatgtatttaaatatgtaacacttgtttttttatattcataaaatgggaaatgctgtacttgcttattaattactcactatttacatattccaactttgaaatattgttgattggtgaaaaaggtacttcataataatttaactaaattgtaccatcatatattcgtctaagaaaaactcaatcttttatcattgttgatttcacacacaattccaaatttgacacgagttatataacatgatacccatattcaacaaaccactagactctatatttatctttagttttaaaaatttgtcctcaatattaaaattaaggggttggttatatatatcaagaaaaataaaaagattccatgaggtggctttaatagttctgattaaaggtgttaattaattaacaagatgaataaaaggttccatttaagagtaaagtatatgataacagtgtgggggatgatattggttcaccttaataaagcgattgcaataattttatgtataactaacgaaaagtttataccgtttgattaagaaaatgagaaggtcatgtccctctctctctctctttctcttgtatttaaatcaaaagcaatctctaaccatatccaaaatcccccctaattccgggttttctttttataacaagtattaatttggacttggttcccacttatgtttcttctttttttttgccaaccacttatgtctcttttttataatcctaaacttttcatatgttttttgaaatgtcccatctagattcagttagtggattttactcaacttgtaatacgattctactacataagatgagtgaaagagttaacatgcgcttatttttaaggttgaaaatcgcaatgtacactctctagaattatagtataaaaataaaaaaaaatctaattcagatttttgattgttacaggctaacagcaaaattaatatggatttaaaagattaatactggaaaataataataattaaaagagttttaattaaaacttccccccccccccccctcaatcccacgattaattaaaaaaggaaaccaccgaataaccgtaattactataatgacgtggcacttagatttcgaatagccgctgtaataaatattaaaaacgttttgtcattttcctttttctcttctcaaagaaaaaaataatcactctctctttttttttttttaattcacagacagaatcaaaacttgtgtagaccgagaatccatctctcacaaaccccaaaccaaaaaaaaatcaaaaaaaaaaatcaagaacaaatcgaaatctcaactctgtgaaaacctcgtccttgttcttcttctgcttctcccattccttcgatttttgcttcaatggatgtttgatttgctctctgactgcgtttggtgagcaacaagtccgtcttagtgtttatgttttgttttcttgcctgatttttcttctttcttctctatttggttgctgtctcaaatggcggatgttcttatgaatctgtggaacttatctacttgtctgttttcatttcatggttttgagtgtcggtagatcgaaactacaactgtcacttaccgattcactagtgagctcactaccactagatttagttttttgtctgcattagatttgcttccactcccaggtttgatttgcgtttctccgatttgtttacttagatcgattcagtaatcacaagttaggttttttctttctgttttttttttttcctgtgtggatatttgctctcgttgatcctgtggtgtaggcagaaaatgttgattagatgatttgaaaaaacctgacttatagggattatcttcggatccatatacaccattatgagtagactatgtatatgtattggataaacaagtgcttctatgttcaacactataaaaatgtagcttcaatattcgtcactgacaatgctgattgatgtatagctcatttcagaaacactagaaaaagctctgatttaagtgaatgctattttaggtatactctacaatacggttttattagtggtgtgctaattccttttctgtctcttctatattttgttgatttgtagtttactatactatg

SEQ ID NO: 3040 - DNA, 3000 bp, Unknown; identical to SEQ ID NO: 3026
  misc_feature (1)..( 3000): cDNA_ID_1808734_gDNA_ID_1620621_Annot_ID_162302 3000 nt of promoter + ATG

SEQ ID NO: 3041 - DNA, 3000 bp, Unknown
  misc_feature (1)..( 3000): cDNA_ID_1819247_gDNA_ID_1620621_Annot_ID_47039 3000 nt of promoter + ATG
tcgaatattgggttatgatctgtatctttgctaactcacttgttacctaattgtagttcgaattcgagttctatgtgctcttgttgtcacctgttgtctgtgcaataatgggatcccaacatccccgaggatggccttgtcgttatcaatgggaagaaagttagagggcttaagattgagaatgagaaaccctttggagccagatgacagtaaagcgaggttcagtacaaagtgatcattttttttaaccattcacaagcatgtaagatgtggagcagccaacacgtaatgataattattatcacttttttaagtaacaaaacttaaaaccatacttggttatagagaattaattgtacacaacgagataacaaagatatatatatattctgacttcaaactgatcttgatctccttgatctcatcacatattcagcgaacctgagacgaagagaaacgaattacattttgttttccaaaatttgtcttcatcgtcaaagatttgtgttacccaaaagctaaaatgtacagtttcaaaggagaattactaatgggctagtaaacgaagagtgttcttacctttagttcgatcgcctccacttctcgtttaagaagacgaatctttttactcttttcatcaatagctctggagagggctaagcgttctagagtagctggcatatatgtgtatatataaaacaaaggattgtgagaggaagaagatacaaacagcaaccgtgatcttctaattttgtaaacgaaaaattaaccttttcctctgtaccaaaaatgtcccgcaaagccagccattagcacagtaaaaacagcaaatgacgcagtgccttcactcttcttgctcctcatcagtgatgaatcttcacatctaccagccgtatacgatctccctccgcgtccaagctgtaattcatccatcgcaacacagatcaacgtttcttattaatcatcgatagaaacgagaaacttagggtttacgcaatctttaatgtggggaagtgtttaaacgatccatgtcttggagcctactcgagtgttagagaccttttattgggtttcgacgatagaactctccggtcagcttttgcggtacgttctgtttctttaagattcataaatgtacatgattctatttctagttgttgtttcactaattacattgtgttgtttttacgatatggaaggttcctgaggatattttgaggaagataagagacgcaacaaaacctccgttgaaacatgagaatcaattccgatatttcctattaccttcgcacacgcagatccaatgttcctcatcatcttgctcctccactcgccaaattagggtttcctctcgatttctctcgacgctcgcgaacaagactgaaactagaccggtcatttcaatctacgattcggtttacgtttgggcctttttcccacagacccggcccaatatttaaatacgtttgggcctttttattcacgctgaattagcccaaccaataccaagtcccaccgaaccaaaactctttatttcagcgattcgcaaatccaacattggaccgagtcctaccgaaccaagaaaaaataattcagcgatccaacattgctttttatgccatgtcaatccctctaaaccatattttctgttttttttggtgttttcactaattacatatatgcattagattatacataactttcatgatcctctatagaactatataattaatgaaccaagtactaaacacggtgactctaactttaatgaattcaacaatttgtgtaaatggtaaccgctgaatctcactatttgtttttgtgattttttgtggaatctcgttgaataatttagaattcaaatggtaactgctgaatctgacattaatttaagatagaaacttataaaattacttaattaactatttttgtcaacaatattaatgaaataaacaaataaaaaaatattctaattttatgtaattccaccaacatgtttttaataaaatctacaatgacaaaagaaaaaggaaaaatatttaatttgaattcatttatatatatatatataatcttattaatataacaatgtagaaagcaaataaactatgattaattaaaaaatcgtagaattttcagttaatatgtttaaggtttattgacaagaaataaataaaaaaatatcaaattcttctatcaaacataattatcatagaaaatagcacagtaaaaacagcaaatgacgcagtgccttcactcttcttgctcctccttaataataaatcttaacatctaccagccatatacgatcttcatccgcgtccaagctgtaattcattcatagcaacacagattatttattaattgtttacaaaattaattttattctttaggaaagttcattatttcaataaagcttattaaataattcgaagaacattcaattattttgatactcaccaaacaaaaattagagcaataaaataataataataaaaaatagagaaacgatttggtttttaaaatttgaaaaactaaaagtaaaatgatatgaaaaaaattaaaaatgtgtacctcatatcaattttcgtaagaatgatataaatattttgcacaaaacagagaaaaagaaaagaacaatagtataaacgtatgggcttgggccggtcacctagcaaagttattgaatgggttcgttcagtagtacaaaaataataaaaattcccaatcgatcgaaatattattaaaagagggaaggagcaaaaaagccctaattttcggctggaggagcaagacgatgatgacgatgatgatatgaaggaacctcggatccgtgtgcgcgaaggtgagccgaagacatgaatcatatgaatgtttcctggtcttgttctttccagtgattgatttatttttgatggatgtttacagtttggccgcggaacgagatcctatagcactaagaggtctggccaatctaaagatagaactttctccaccatg

SEQ ID NO: 3042 - DNA, 3000 bp, Unknown
  misc_feature (1)..( 3000): cDNA_ID_2993630_gDNA_ID_1620621_Annot_ID_47042 3000 nt of promoter + ATG
caacaattggcgcgccaggtaggggggaatataaacaaattttctctaccctcctttaatcaaagcaagcatggttcaaatcgtcatcgaccccatcattcctccagtcaacgatgatgggacggaatcaagtctcctccacggaggagatccaccatctaccgtcgaagtagcggccaaaacgaccgtgaatcaaccaacacacggggagacccctatcgactcaccatctttctcattggaggacatcaaagccatcctcacaaccgtgacgaaagatctctctgaatcagtcatggagactaatcgccgactcgacgagctgccaaaaggaaggcggctggggtcagaccgcgccaaagccgtccaagacgaggtcgagcggctcctaaaagccggcctgattaaagaagtacaatatccagaatggctggccaacccagtcgtggtcaaaaagaagaatggtaagtggagagtctgcgtggattacaccgacctaaacagggcttgccctaaagacagttatccactgccacacatagatcgcctagtcgaggcaacgtctggaaatcagcttttatctttcatggatgccttctcggggtacaatcaacgaaaaacctatcttctataccagtaaagccctgaatgacgccgagaccagatatccgaccttagaaaagctggcgttggcggtgataacggcagctcggaaactccgaccttatttccaatcacattccatagtgttcactgatcagccactacgcacagtgctccacagcccaaaccagtctagacgaattgcgaaatgggcaatcgaactgagtgaatacgacgtggaatatcgctctcgcccgagcctcaaatctcaggtcctagcggacttcatgactgaactatccccggatgtgattgacgttatcccggacgaaaactggatactctactcggacggctcctcatcattacaaggctccagcctcggaattctacttcagtcaccaaccagagaaatccttgaacagtcacttcggctccagtttaaggcatcgaataacgaagcagaatacgaagcacttctcgcaggacttcgactcgctaaggggctcggagccaaacagatcaaagctttcagtgactctcaactcgtagtcagtcggttcagcggggaattcgaagctaagaacgaaagaatgcgggctcatctttcaatggtccacgtccaaggacttcccagaatggcattgtagattggttccgatcttcagaaagagatcagcgatcttcagatcgcattggttgctgtaaaagagcacgggaagagggagtgcaacaggttgcggaatgaccgagctgctaaagtcgcccgtactacaaagaaagcccaagctcgtcttgatagagtgaaggcttatctcaaggagcaagaggacctcgtcgggccaaaggtggatgctgagaatcaagccagaggcgctgaggagatagtgggcatccttatgcagagaggtgcgaagattgcggcatctgaactcagcggccttaaggagttaaccaaaagggcgaccgacgaagttaatgccttgaacgttatcgagctcggggacgatgatctgaacatgtccccagatcagctcggtttttcgaggcaaacctcccaagttgctccagtggcggaccagcacggctcaaatgtcgacctcgttagcggaagtgatattcgacgtgtaagcgttgaagaaacgaaccagacgacctgaataggtcgtctttgtaatctattttgaaatattgatcgtggacccaattttcggggcgatctcaaaactcttatttaaccgtgaacccactttcggggcggtttttaatttttacttctacgtcagggtcgacctcgcgtcgtatgagcgtccgttctcggggaggaaaaggatgtggacggagtttcctggtagattttttttaaatagatagggtaaagatatgtcgatcccgattagattctcatagctttttcttttgttgcagatcgatacaggcctagtccggattttcccgtcgagttcgaaggagttttagaggcgatcttccgagctcgtcgtcgtacctggaaagacgtcacgaggtcgcgcgtcaacaggataatggggaaggtcaggaaatccttcattagcttttaaacatgccacctcccccagctcccatcgaagaggaaagacagcctttagacggagaggcggctgcgtcaaatcctcccgttagtgctggcccttccggtggcgaactggtttgaagtttggatccttattgagcttatgacaggttacctccggggcgattcctgtcatatccttcgtagaccaagcaaaagatgacgacctcgatttcaggaaggcgatcagctcttcctttatctctccttctagctcgcttccgataccgaccgtccgagatggatccgactcgtcgatgttgacctggataattgttataggaaaactgaagtcaagctatagcgttcaggggttaatctggcgagctggaaatatgaagtcagggatgtttagcaaagcacgtgttgtgagctggcgagctggatatgtgaagtcagggatgttaagcaaagcacgtgttgtgagctggcgagctggcaatgcaaatggacgttaacggcgatcgttattaacgtggttaacgtttactttctttacctttttgtataagagcaacatgttatgctcatgctttcattatcgaataatctggttgtaatctctctctagagacttctagatttccctcatcgttttaccggagctctcgtcgagtctcttgtaggtgagaagttgatatcgcgtctctttacgaacgttgtatcaagtgtgttaatcggagtactctattttcatctctctgttctattgatttcaaactctgtttattcatttctggtttacgttaacactggtatcagagccaagcgtttcctcggaatca

SEQ ID NO: 3043 - DNA, 3000 bp, Unknown
  misc_feature (1)..( 3000): cDNA_ID_1819239_gDNA_ID_1620621_Annot_ID_47043 3000 nt of promoter + ATG
agctgaagcgggcaaatgtggagttagcttctcaagccagggagatagaagagttaaagcataagctaagggaaagagacgaggaacgtgctgctttgcaatcgtccttgactttgaaagaggaagagctagagaagatgcgtcaagagattgcaaacagaagcaaggaggtttctatggctatttctgaatttgaaagcaagtcacaactcttaagcaaagccaacgaagttgtcaagagacaagaaggtgaaatatatgcacttcagagagctcttgaggagaaggaagaagaattagagatttctaaggctacgaagaaacttgaacaagaaaagcttagagaaacagaagccaacttgaagaaacagacagaagagtggctgatagcccaggatgaagtgaataagcttaaagaggaaaccgtgaaacgtttaggagaagccaatgaaaccatggaggacttcatgaaagtgaaaaagcttctgactgatgtaagattcgagcttatttcttctcgggaagctttggtattttccagggagcaaatggaagaaaaagagctactattggaaaaacaattggaggaactcgaggaacagaggaaaagtgtgttgtcatatatgcaaagcttgagggatgcgcacactgaagttgaaagtgagagagtaaagctcagagttgttgaggctaaaaattttgcgcttgagcgggaaatatcggtccaaaaagaattgctggaggatttacgagaggagttgcagaaagagaaaccattgttggagctagctatgcatgatatatccgttattcaagatgagctttacaaaaaagctaatgcgtttcaggtatcacaaaatctacttcaggagaaagagtcaagtttggtggaggccaaactagagattcagcatctgaagtccgaacaggcttctctagaactattactgcaagaaaaggatgaagaactcgctgaagctcgaaataaattgggagaagtgaaccaggaggtaacagagctaaaggcacttatgatcagtagagaagatcagcttatggaggcaactgagatgctgaaggagaaagatgtccaccttcacagaatagaaggtgagttgggcagttccaagctgaaagtcactgaagctgaaatggtggtggaaagaattgcagaattgacgaacagactgcttatgtcaaccaccaacggtcaaaatcagaatgcaatgaggattaacaatgagataagcattgactcaatgcagcaaccactagagaaacctcatgatgattacggaatggagaacaaacggctggtgatggagttaagcttcaccagagaaaatctacggatgaaagaaatggaagttctagcggtgcagagggctttgacatttaaagacgaagagatcaacgtggtcatgggaagattagaagccaaggagcaggaactcaagaaattgaaagaagaaacgatcaatgacagtgaagatttgaaagtgctatatgccttggcacaagagagagtcggggaaaaaacaatgggtgatctggccatagagatgcttcagcttgaggcagctaaccttgaagttgaagctgcgaccagtgcattacagaagcttgcaaaaatgagcacggaactgttaactcaagctgacatgagcattgaggccgacacaactcacactgtaatgccagagagagggtattcagaaggaagtaatgagtgtcttggtgaggtaaaaacagaagttgtcaggctctggtccttgacagagaaactcctggagaacgcaggaatcgttgctggtacatctacatgcatggaaggtgtaattttataaagctttgattaactttataagcctaatctgtatgattcttttgtggatatgtagaattactggcggttaaatatgtttacttgtcactgtgagcaagtctattggagagtcttaatcaagaactctttgcattttataataataaatattaaataatttaaagtttagagtttttattgaatctttacaattttttattgtccaatggtggtggagactttaagaggatttcttcaaaaaaaataaagattttaaaataaaatattataaagttttttatttgacaaaacttaataattattagaaataataaaattgtaaacatgcatcatgacataaaagcaaaaaaatatatagaaatgaaaatttgaaaaaggataatatttaagcttgattcggaccaaaattttgccatatatatactctgatactcaatcaaatcatatttcaatcgttcatgctaagtacaaaagtcgggttttgatacttaataattactacaaatattaaaattgtatacatacatcatgatataaaagcaaaaagaaaatatacaaatcaaaaaacttaaataacgactagatttaagcattattaaaacaatgcataatcctttttttatatagttttttctcagccagtcacaaagcaacacaactaaagtctttaacaaatgttaaaactctaagcttaggatcaatccttagcctaatatcttgttttcatttatttttattacattggaggtggtctaagtgatctcaaaactaagtgatttttaatgatttgtatttgtttattacgtagataaaattcagccgagagtggctgccaccacaaggttcttgccaagggtaatctctcgtttaggtgtcgttgatagaaaaaggtttgcgacgtaccctgggacttatgcctacaacagcatgtatacacagatagtaggccgttagagtgtaactgataggatcacccctactagcatcgccaaataccaaccttgcccctaaatttccttctctatttttttgagtaacttttttataaattttcaaactcgctcccgcttctgagtctttttccgtacgaaagagagagagatacgtctatgcgattctagggtttttccggcgaaatttctcagccaaagatg

SEQ ID NO: 3044 - DNA, 3000 bp, Unknown; identical to SEQ ID NO: 3033
  misc_feature (1)..( 3000): cDNA_ID_1819231_gDNA_ID_1620621_Annot_ID_47045 3000 nt of promoter + ATG

SEQ ID NO: 3045 - DNA, 44 bp, Unknown; identical to SEQ ID NO: 3024
  misc_feature (1)..( 44): cDNA_ID_3092820_gDNA_ID_1620621_Annot_ID_47047 3000 nt of promoter + ATG

SEQ ID NO: 3046 - DNA, 3000 bp, Unknown
  misc_feature (1)..( 3000): cDNA_ID_1819336_gDNA_ID_1620622_Annot_ID_47050 3000 nt of promoter + ATG
cttcagaagttggtgtggatatacgagagaggaagtcacataaacaaagaacatgaagattcaaagagttgtatgaacatatcagacaaagcaagcctgttcacttttccactatgtatgtaatttatagaacatgatgtcaacaaagattcacacacttcgcaaagcaatgagcttttacattgctctataaataagtatactttttcatatacgtgagttggaaacataagctttttaagccacatgaaaatgctcaggaaaacacaaggtttacaatcagatgaggagataaaaagtcgtggcaacgcgcagaatcgggatggattccttaagagacagatgcacttaaatgcaagatggtagagtaggtccgtggcagagaaaggccactgcaatgtatatgatcaccagtagtagtagtattaagaggaccctgcaagagacaaaaagggttaggaattaggaactatgttcgattcttaaaaaattctcacttgacattacaaatgtggaacttggggtgattaaagtactttttgctatagttaaatgtgttcttaggccaaaaactagttttagtatacagtcttgcaatcataatactgaaaattgtttactaaggttttaggaaacatacgtgagcttgcagtttctccaccagacgttgcttctaaaacgacgagcttgctttctgaaccggaatgtattcccctgcatattggcggttttatcgacaagaagctccaaacgttcacctctatctaggactttgtcaatgttttctatcatgacaccccgcacctatccaaaaccaaaaagaaaaaccaggatgtattgtcaaacagtgaagccaagactcagaaccatgtctctaaacaacttcacaatccgactgaacttgtaagacaaactcatcaaacctgattcatttcacccttaatacgattaatcctatcggcattaggatcattagagtaatagtcaatctgctgactgagaactctagagaattcctcattcattgcataagctagtgctgtatgaacagccctgccataagtccgtacgaatctctggtgaatatcctccaaaaaggcaaaaggaattctccctgacataaaaaagttttgacttttgagttagaaagacattcacatctctctaatgcacagcttctcggatataattgtgttgatgttatgtccaaaaaaatcaaattcattcacatcacaatataagaccaaaggtctcgaattcaataacagagcgatcgttcagagcaaaaaaggattagacttttgaattccactgtcaccaaagttggaaacttcctcaaaattagccatagaagtaaaagaaaggggaggacgtacttccggcggtttcttcggccatacagagaacggtgaggccatcggtgcgtttaacgtggaagacgtaacgatcctgagagtaggagacgttgctgtcgttgtctccagggaccttctcgaggatctgtttggcgatggtgctcgcattcgtagaggtggcggtgaactcagaaagaaccaccgtgccacgagccacgagggcgtacagaatcgccatctccgtcgtcgatccccctgccgaatcaacaaaactcgtgtaaggtcaacgaagaagaaggttttcccgcggaaaccgagccagccagacgaatcgctggatcaatcaatcagagagagagagagagagagagagaaccaattggcttctttttctctctgcatataattgaatctctttctctctctctcctcttggagtttagctggagctggagaccttttcgcctccgctgattacaaatatttaatttcggatagctacgttgatttatttttaaaatactgtattattataaggatcaaaatgaaattttgtcaaaatatcacgggcaaaactaagttagttctttttgttttgtcggaactaatttagttctaataagtaaaaaatataaatatgaaaagaaaacaatttgcttcagtttcgaaaatattgtaccgtgaattgttttataaggattattaatggttaacgctaaattagtttgatatcaaacttataagaaatacaaagaaaacaaacaaattctatcagtttcaaacaaatagagaaatctgagcaaaaagatcgaataattgtaatttatccgtggaagaagatgtgattttaaagtgtaaatttttacgaatatgaaggataaaatgtagggatgtgttcaaatcatcattaaatcagtttttttttttttagtgtggtagtgacgtaccaaacaaaaccaaaaagcggtctatttccttctggtttgaaacgatttgggtcaaaattgggtttcgagtttgaataagatatgagtgaataatatactaactttagccaaagacaaaaaaaaaaaaggaaaattaaaggcagaaaaatgaaaatgacatccaatgagctgagcctaaaccaaacatagccagagataagccttacaaaatgtacaacagatataaaatcccaattcccaactctaaaccaagacgtggttcacgacccaaaccgaatctcacgggaaaaagtgggacatatacacatatatacacggtaagcttcgcgcctccgtcaaatcacgtgttgtttcttctcggcttttccgttaaagtaaacgtcacaacaccgccgttaatcaccgtggtctgtgggaattcaacccagaggcagagaagaccctgagagacgccatctggtccttcttttgcctccatctgtgtcctctctctctctcctcgatctcacgacgatcttcataaaccctacgctctgcttactcttccatcatcttttgctcagatttcgtaatttgtggtttctcgatcgggatattagtactcgatcgtgtctccgattgattctgatcggaatatcaaattcggattccggagagctggagatagagagagacttaggtaaagtttggtggagatg

SEQ ID NO: 3047 - DNA, 3000 bp, Unknown
  misc_feature (1)..( 3000): cDNA_ID_1012056_gDNA_ID_1620622_Annot_ID_47051 3000 nt of promoter + ATG
ttgaccaatgcacggcttaagtgtatactgtaatatctcataccagacctagcagcagcttctagttcaagaaaggatgcaactacgacacttcttgccaattctatatcagataatagctttgttatccactcctcaagagagcaccttctctgcaacaagatcaaagctatcacttatgaaacaaatagtttgcacgaataattgtaacattattgttgggacatgctttccgtatattaatccacctgaagtctaccactaatctgcataattcgtacttaatcttggttggacaagatttggagaaaggggaaataatagcactaaatagaaatatattgaaagtaacagcagttacacaagtgacctcattcagttagcctcaagaaaaaatgcatacctcttctaacactgctctgcttttcatacgcaacagccctttggggggagctgatgggaaaccttttctaggaaatgttcttttaagctgtaaggaaaacatgagtgtgcatatgctgtcaatcacattgcatttaaaacatgaagaaaaaatgaagagttagatcggcctatattcagggagaacaaaatcttacatccgttaatagctttagaaaatcattaaatcgtctcaacactcctcgcattgtggtaataccttcaggggattgcacacttacctgaaccctgtaaaactgttcatctaaaatgttatatatgtaagcaagttcaactatattggaataacgtatgacatgcacagcaataaaactcttcagcagcaaaaaaacaaaaaaaggcacactccgctagataattaagttagtccaggaacacaaatatatcactgttgatgttgaattttattgatccgcagacgttcaagatatggttgacataaccagttcagctaatttgctacaagtcgataaacattgaaatgctcttgcaagagataaacactgaagaattcaattaccacaacaggatctgaatttcttgattttggaaggacaatccacgagggtattgtaacgcaataactccatccagttcgagggtcatgaggccaaacagtatctctaccattctgcagaaataaacataaatatctcaaaatctccaacttgtacatatatggaattcaatcgagtagaatgatactttatagtctggagctatccaaagctgcataaataaagatttagctacccctgatgttaaacaaaagataaactaacaattcaatagagggcaacaacagaattcaccaattgtaggaaatgacttctaatgccttatgtggtgagtctaccattggacttgctggtaactacactagctatccccatagcttgggactaataacaaagacatccacatttatctcaagtcccattagaataaagcaggcaactgaagaattctagcacggcacttccaaaaggtaacgtggtaaagtccaataaagttcgaatttttggcaacaaaagaactcacccatttgcgcggtggaggactccaatccattcctaatggaagcggcgatgttccgtcatgcctgtgcttgggcggactccgtctctgcatcatctccaccaaactttacctaagtctctctctatctccagctctccggaatccgaatttgatattccgatcagaatcaatcggagacacgatcgagtactaatatcccgatcgagaaaccacaaattacgaaatctgagcaaaagatgatggaagagtaagcagagcgtagggtttatgaagatcgtcgtgagatcgaggagagagagagaggacacagatggaggcaaaagaaggaccagatggcgtctctcagggtcttctctgcctctgggttgaattcccacagaccacggtgattaacggcggtgttgtgacgtttactttaacggaaaagccgagaagaaacaacacgtgatttgacggaggcgcgaagcttaccgtgtatatatgtgtatatgtcccactttttcccgtgagattcggtttgggtcgtgaaccacgtcttggtttagagttgggaattgggattttatatctgttgtacattttgtaaggcttatctctggctatgtttggtttaggctcagctcattggatgtcattttcatttttctgcctttaattttccttttttttttttgtctttggctaaagttagtatattattcactcatatcttattcaaactcgaaacccaattttgacccaaatcgtttcaaaccagaaggaaatagaccgctttttggttttgtttggtacgtcactaccacactaaaaaaaaaaaaactgatttaatgatgatttgaacacatccctacattttatccttcatattcgtaaaaatttacactttaaaatcacatcttcttccacggataaattacaattattcgatctttttgctcagatttctctatttgtttgaaactgatagaatttgtttgttttctttgtatttcttataagtttgatatcaaactaatttagcgttaaccattaataatccttataaaacaattcacggtacaatattttcgaaactgaagcaaattgttttcttttcatatttatattttttacttattagaactaaattagttccgacaaaacaaaaagaactaacttagttttgcccgtgatattttgacaaaatttcattttgatccttataataatacagtattttaaaaataaatcaacgtagctatccgaaattaaatatttgtaatcagcggaggcgaaaaggtctccagctccagctaaactccaagaggagagagagagaaagagattcaattatatgcagagagaaaaagaagccaattggttctctctctctctctctctctctctgattgattgatccagcgattcgtctggctggctcggtttccgcgggaaaaccttcttcttcgttgaccttacacgagttttgttgattcggcagggggatcgacgacggag

SEQ ID NO: 3048 - DNA, 3000 bp, Unknown
  misc_feature (1)..( 3000): cDNA_ID_1819332_gDNA_ID_1620622_Annot_ID_47052 3000 nt of promoter + ATG
tttgaaactgatagaatttgtttgttttctttgtatttcttataagtttgatatcaaactaatttagcgttaaccattaataatccttataaaacaattcacggtacaatattttcgaaactgaagcaaattgttttcttttcatatttatattttttacttattagaactaaattagttccgacaaaacaaaaagaactaacttagttttgcccgtgatattttgacaaaatttcattttgatccttataataatacagtattttaaaaataaatcaacgtagctatccgaaattaaatatttgtaatcagcggaggcgaaaaggtctccagctccagctaaactccaagaggagagagagagaaagagattcaattatatgcagagagaaaaagaagccaattggttctctctctctctctctctctctctgattgattgatccagcgattcgtctggctggctcggtttccgcgggaaaaccttcttcttcgttgaccttacacgagttttgttgattcggcagggggatcgacgacggagatggcgattctgtacgccctcgtggctcgtggcacggtggttctttctgagttcaccgccacctctacgaatgcgagcaccatcgccaaacagatcctcgagaaggtccctggagacaacgacagcaacgtctcctactctcaggatcgttacgtcttccacgttaaacgcaccgatggcctcaccgttctctgtatggccgaagaaaccgccggaagtacgtcctcccctttcttttacttctatggctaattttgaggaagtttccaactttggtgacagtggaattcaaaagtctaatccttttttgctctgaacgatcgctctgttattgaattcgagacctttggtcttatattgtgatgtgaatgaatttgatttttttggacataacatcaacacaattatatccgagaagctgtgcattagagagatgtgaatgtctttctaactcaaaagtcaaaacttttttatgtcagggagaattccttttgcctttttggaggatattcaccagagattcgtacggacttatggcagggctgttcatacagcactagcttatgcaatgaatgaggaattctctagagttctcagtcagcagattgactattactctaatgatcctaatgccgataggattaatcgtattaagggtgaaatgaatcaggtttgatgagtttgtcttacaagttcagtcggattgtgaagttgtttagagacatggttctgagtcttggcttcactgtttgacaatacatcctggtttttctttttggttttggataggtgcggggtgtcatgatagaaaacattgacaaagtcctagatagaggtgaacgtttggagcttcttgtcgataaaaccgccaatatgcaggggaatacattccggttcagaaagcaagctcgtcgttttagaagcaacgtctggtggagaaactgcaagctcacgtatgtttcctaaaaccttagtaaacaattttcagtattatgattgcaagactgtatactaaaactagtttttggcctaagaacacatttaactatagcaaaaagtactttaatcaccccaagttccacatttgtaatgtcaagtgagaattttttaagaatcgaacatagttcctaattcctaaccctttttgtctcttgcagggtcctcttaatactactactactggtgatcatatacattgcagtggcctttctctgccacggacctactctaccatcttgcatttaagtgcatctgtctcttaaggaatccatcccgattctgcgcgttgccacgactttttatctcctcatctgattgtaaaccttgtgttttcctgagcattttcatgtggcttaaaaagcttatgtttccaactcacgtatatgaaaaagtatacttatttatagagcaatgtaaaagctcattgctttgcgaagtgtgtgaatctttgttgacatcatgttctataaattacatacatagtggaaaagtgaacaggcttgctttgtctgatatgttcatacaactctttgaatcttcatgttctttgtttatgtgacttcctctctcgtatatccacaccaacttctgaagtcggcagttgaatgatcttgtacgtcgttgaccctacaaattcttgtcattttacaattgaagccatttgttgatcataaatcgaatgtaaatattagaaaagaaagataggagaacaagatacaacaagtgtcataaattgtcgtccgaaaataaaatatgggtatcatctctagttaaggccagacgcacctcattcaccaacttgacatcttgtcatgccacctaataatagctaaataaattatagtaggtggatttaaccttttatttatataatagcagcatttcaaatataaaattttgtttttatcaacaccatgtttactaactaaaaggatggaatttatatccatatatgatcaaaatactaaaatgtttggttgaaccaaaaaaaataaaaagcgtcgactttacggtttaaatatcgttacagaaaaagaagaaaagaaaagacggctacatcacgcttactaaaaattctacagtccaattaaagtcataacaaaattaatactatatatttattaaaaaaaacatgattatttactttccttacaaaaaaaaacaaaagtgtaaatatttcctggtctaacgctttccctctgcgtgccccgttccttccctcgcggttactcttccgttttatgtttttttttctgagatggtcaattttcccgtcgtctctgaattttccctttttctcttcttcactccaccgccttccccgaatcacttcctctgcctgatctaattcaatctccttcctagctcaaagaagtcaatttacacgagcagatctctgcactcaaaactcctggatcttcatttctgggcttcaatttagagtttttttatattaa

SEQ ID NO: 3049 - DNA, 3000 bp, Unknown
  misc_feature (1)..( 3000): cDNA_ID_3070660_gDNA_ID_1620622_Annot_ID_162361 3000 nt of promoter + ATG
atctgaatgtttacgatcttaccccaatgaatgtttatggttactggctcggaattgggatctatcactctggtctcgaaggtaaatcgttttttttccttctcgattctgggtttgattgttgttctaagattgcggagaaagatgagacaatagtaggtcaattttgttggattgtaatattaattgttgaaaaaatccattgtctgtattgttgcttggctttgtttgattctaaagtctgctttgatcgatgaaaactatttattgttaaagagtagaattgacttttggtcatagaatcgatttagagactaaatgtgttttgatgataacaacttaggagggtagagttttgtggccgttgtttgaacaatgactcagtcacacacacgccatacgttgttgttaatcctatattgaatgttctctcgtggttttggctattccttgtttgtagttcatggggttgagtatggatacggggcacacgagaaatcgagctcggggatttttgaggtggagccaaagaagtgtcctggtttcacattcaggaaatcgattcttgttggtgaaacagagatgaaggctaaagaagttcgaagctttatggagaaattatcagaagagtatcagggtaacaagtaccatctcatcacaaggaactgcaaccatttctgcaaccatgtttctttgaaacttactcacaaatcaatccctagttgggtcaaccgtcttgctcgcttaggtaacccaaaacttcctctacaatagaatctttcaggggatcaaataagtaatgttgtacattggtttcttttgaaccttcttaaggtttcctctgcaactgtgtcttgccggcttgcttgaacgagactaaagtgaagcgggtaggaaaagacgggaagctgctcttggaaggagaaaatacgaagaagaagaagaggaagaagaaaatacgaagaagccgatcaggtcctttatcttcgtcttcttcaaatgcaagattagataatactcctacacataacagatcaatatcaacgggtaatcctcctctttctgcttctccatcttgtcctttgagacctcgacttccttctgttgcatctggagctgaagatcaaaatcctccaagcgtaagcgtcaagacatgattatttttcattgtttgaacagctgctagttatatacttgtttatgaatgcgaaggtggtgcttgtgctttgttctcaagttatatatcctccattcgtttggttatacttggtataatttacttataggagaatcatgaatctctctctgtagatactaactgtagagtgaattcaacatttgtttgttatgttttgatgtaaaattttgaaaattgtacgaattacttgtttgaatatcaacaaatcgaagtaaaatagctaaatattttggaaacaacaagtgttttattttaaatttctaattaattcttaagcaataagtcccaaattttcacaaatagagtttttattaaaagaaaaaaaattgatgagcgtaaaaataaaaaaataatgaattttattttattttattacagaaccaggaagtggcataaaccctagtttgaccttttcagaacacaactcactataaatacctatcaaaggacactcttccgcagctacaacgaattcccctggaaccctaattcaccgttcctgtgaaaagctcgcatacataagatctgttctatttctcgctttttgtttctagatttcagtctttgctatttcattatcgttctggtttttatatttgttgaaatctgttatgtaattgaaactgttggctctgccattttgattgaagtgggattccttaggctttgattttggttagttctcagatttaggtttaaaggttcttgttttttgatttgaagcgttatagcaatcccaatgatgacttattaagattaaaaatgttaaaagtagtgactgatatcttttgatgaaattttagctctgagggatttgatttgttctttgtttccttcttacattccgttgttggacatccattgtgggttaatttggtgagtttttgcttttgcttgcttgatgaagcatattgatgcacacgaccttagctgcatcccaatgatgaatgatatgaaaaaaatgttaaaagtagtgactgattataccttgattactagtcaattctgagggattctatcagctaagctaaattcaatccttttgcgccatctctttgtttacttaactctctatgtgcccttcgatgattaataatatattaatggttaaaagtagtctgatatcttattgatgaatatttcaaatccgagggcttaacttatttcttataaaagttgtgactgatagcttgtgcacaatcttgttttcattcttggtatcatctaagagatacctcaacgccagcttctgcagtgaagtgcaatgtcgtaagtacgattccacccggcagaagaaatctctctcgattgcacttcatctgcagaagctggcttttttaggcagtgggagtgatttttttggcagaatatctccattgtattatgctcttttgttttccctggtgtgcttgaccatgatgaattcgctagtggttcacaattttgatagaatagttggattaaatggataacacagcgacaccatctattaatgatacaaccaactaaaaatgttattgtccaacctcaccaccaaatcatctttcgaaagctttcctttgtcttgttaaaatcaactatttaaagatgaagtatacaaagcttagcagtacttgttggacccacgtttgatatttttggggttgagatgtctgcaagcgtctttcttaaagtccaaaagaatgtgtgtgaaacgttgactttctgcaaggtttaccactgtttgtgcgcttagcttcgtttggagaatcttcttcttctctttctttgtagaccggctttgctttgcatatgagaggatg

SEQ ID NO: 3050 - DNA, 3000 bp, Unknown
  misc_feature (1)..( 3000): cDNA_ID_3070648_gDNA_ID_1620622_Annot_ID_162354 3000 nt of promoter + ATG
aatcgtgtataaaactatccttcttccaccttctcattatattcatttccatctttctaatttatctttccatttccgagccgttgagaattttttctgagagataatttaacaaatttcttcttcttcttctgtttctgaaccaccaaatctgcctttctcaattagctatgggcgtcgctgttctaaatccccaggattgcttgaaagatccattctctcacatgaaacaacatcgtaatcctagcgcatgtcccaacaggcagaagaagacggtctccaacaaccgtacacgccggagtcctcctcgtagtcaatcctccagatcttcttctcctcctgtagcgccgccgcttcctcctcctcgtgcggctgtctctgctttcgttccaaagggaacccttaagaagagtcttagcaataccgttgccgttagccaggtgagaatccttaagcgcggcgaagaaatccccaaggagacttcagatctggttgtggaaatgtcagatctgggatctactcgtcggattggaccagatccgggtttgattccgggtcagatccgtttatctggccgcaaatcgaaatcagcaccgttttacgccggtcctgtgaccatgacctcgccgcctcctagcgatgtcccgcttccagctttcttcacgaagaaggcaacaaatgatctcatcaggatccttcgcctagacatcgcctgacggtgtctgtcaccgatcatttttgattttttaaaaatctccgatgatccaaatggttaccaaagtgttacatttccgtattaccgatcgtccgattccgcctgaaaaccggagatctgcaacaaaatataatctccagacgatgatgaatctagaagatgaagaaacacacatcttcgttatgaaccgtttcgaatcttcccttattttttcaaggggcaagatcgaaatatcttcttaacaggtcttagtttctcttcttagggtttagtgtttgtgtaggagtatttgtgtatagactttttactagttttcgtatctttctctgtatcttcgggtttttaatttctgcttaatcgtcaggttctctgggtaaatcataggttggcttttgtcatttcgtctgtgtcttaagtggattagttggtcgtaagacaagttatagagatgtgtttacgggtaaagatgaagcttaggttttgatgtaatcttcttcggtttttcaattctctgtatttctctatctttttagtttatcaagtttaagttttatttggggtttcttcttcgtttgggtatctttctgtttttccttaaggttcttcgtttgtttccgtgtcgtctaggttaagtcaaagtaaagagatgtaattactggttagatgaatcttaaggtttccatgtaaccgtttgtactacaattctctgtacttctctatctttaatattatcgaatttaagttttatctttggcgtttaaagttcagtatttggacatttgatacacatcacatgagattaaataagatggttgacccaataaaaccataaacaaatgaacatacgatgggtttacgcaaatgatctcaatgaattgtaccttggaaaattatggaatttgtgactagtatatgttgagttgtattattgattagcaattctgtaatctcaaacaactcggagaatatggcgcacaaaaaaataacttgcacagatgtttcccgatgtaagagcgacagttttgatatgtgtgtgtgtgtgacaggcaaagacattgacaaattgatataatctctagtccagcgtataaacaaatcactaatgccaatttgatatcagaagttgaaagtgactttctctaagttgataagttgatattgtgctatctcaattatcatcattacaatgggtttaatagcaatggatgttattattgtttaggtgggtaattgatatttcttgctaagggtgtcattatctcaatatcatataccgtatgccacttgtttggtccaagttgtataagatataatgttctctcacaattagacagcccaccttagcccgatttaaggcccatgtatatatctcttcaaggctggacagctggggcttgaattctaaaaaatttcttagtcataaatctgctgcatttagagattcttctataaaagaaacataaggtaagatatataatcattaatgacagaaactcttttttactcatccacaatgtagcaacttgcctttacctattaacggcggtacacagtcgtcaattgttcattggtcaagcttagcaaaaccattgagccacgtcagtttttttttgttggttcctttgcaatactctacgaacatcataattgatgagagcataggaagattttctacctaacaagggaaaaaaaagcaaaacgaaaaagacgaaccctaaagtaattttgcctatttttaaaaatttattcttttaatttcagcattatgccaaatttataattttgcgagagaattttaatttggggaatctttacatatttttcacataccctttccccacacaactcagtttttgggtcccacctttcctttcttattttttttgtcatcacaaacaaaccattgagataaaaaaattaaatccaaatctgcaatccatccagccacagacccgatcttgcattttcgcatcgacattaaaatggcaataaaataaatcattttttttttcttttcgaaaagaacaaagaaaaatgagaaaaggaagaaaaaagagatagaggaataatttagagggagcctcgtatataacaccattcccatctctctctctctctttctcctctatttcgatatttcttcttcttctccttctctctcccttcgtcattatctctcttctgtaacttctctttctttccctctctctctttcgctgcttctcttctgtatctgattcccttttttacgggagctgtagatttgagtagtgtaagcgtcgatg

SEQ ID NO: 3051 - DNA, 3000 bp, Unknown
  misc_feature (1)..( 3000): cDNA_ID_1819297_gDNA_ID_1620622_Annot_ID_162353 3000 nt of promoter + ATG
gaaagatgtcgattccgttagagccagtccgaagactcctctctcgtggagcggcggatctggaagtggtggcggctctgcttctccttccgccgatggattcgaggataacagtcgccaagctagctgctctacatctacaggatctggatctaaggtaactttctcttttccctatcgtgattttcaacttttgcctctcgatttagtcttctctctctatcttctttctctcaattacgaatccggtagctccggagagatggcaaatccgtcatctcgctggataatccgattccgatctggccgataaatctggatttagccgttcgtaattgagaagatccttggccgtctctctgtttttcttcattttttttcctaaaatccataaagtttagcctgacgtcatctctcgcacgcttcaattctcactagaacgtatttagtctgttttcttcaacttctaacaaattcaccggaaaaaattcctccgccgtgattcgccgatgacaccgtcggccggagccatcctgcttctaggttaaattcatctaatctccaaaaagtcaaagccactttaagcttaatttccttgttttctgctcattttttgtaattagaaaactctactaatcttctgtaacaaagcttaataagagacctgtttttctcggtacgcattgaaccggatcttgcgtggccggttagatgtggatttttagaaatcggtcaactttaattttgtcttgaggaataattaaagctccttttagattttgggggtagtacagcttaacagctagttggtcaaacgcgtccgcgttttattgaacgttttgatgctcgagacggtagcgttttgtgggttgaaagttgaaacgagtaaaatgatcttgtcggagagattggtatcacgtgatctttaaaagagtgatgacgatagatgacaatgcccatgacacggaataatcatgatgtggcatcaaatcctcactataaaaattctttcccaattatatatttgagattttttaattttatgctctatttggtttcttcgatatatttttcttacttgtttgaaatttctgttgtgggaaaagaaactttttaccggtatgttaaaataagatcttgggtattgattataaaagtaaaacagttgtcgttatcttcagccatttaatagttgactaatcaaatgcgtttttgttttgcaggtttttcccacaaacgaaatcaccagttgtttctccaagagattgaagaagaggaaggtaaatataaagtctcctttttgaatttcaagtacacactccaaaattcaaattttattgagctgatggttttttattcttttaatatttggcagtcatcttttgagcttaaaaatgaagagaacttgaagttgaaggagagacttgaccttgaaaaggtagattttcgttgctattctctgttttattatcatggttttcattgtattcttaaaaaaacccaatatttttccacaggagattgcaagtctccgagcaacattcgatgaacaaaaccttaggaaccaaaagctgaagaggattaaggtaacatttagattctccctaaccatctttacagtaatcagatattccagatcccttctctctatttgctggtctcatcgactcttgtgttttcttgtttcagcttgacttaaactcaggccgtgtcacaaacaagaaacctgttgatttgattcgtaaatcacaactcgagcggctacagggatcaaaatcttgcaaaaccagtgactcgcaaaatcaggggagtttcttcgtcctccctgatctcaacatggcgccatccgaggaagagatattgtacggaactagctaaaaactggcctatatgaagatttgcgatcgaattatagtgaagggaagaagggagctagagatgtcaactaagaaaagtgaatgtaataagtggtgtaatgaaactctcccgtcacattctggttttccgtttccttctttttttggggtaaaatgctcaattacttcttgattttttcttaggaagagggtgaaaattaggtttttactttttactccctccctccctccctctctgttttctttaatttgatgtgttagaagaaaaaatttgttttaaatagatggtgttatcaatttttaatgcaaaattaactacttttttttttctttctttctctttgtaccgatttaaaagcttttgttggaaattgtaaagaggaaaaagtaggacaactaatagactttttatgttccaaacattttcttcttcactattctccatacattattatattaaaaccctagtttccgctcaactaatccaagacaagaagatctatcaatctctttggacattcatttttctactatttaatttgaatttttataatataaacttgggaggtgtaatgctattggtgggttgtcggcgtgttcatggaaaaagattcgtttttaaatgcccaataaatttgagaaaaaattgccaacttgtttatgagcttattttctttttcatggatcccaagtcttttgtgtatagagattaaaaaaaaatgacattccttcatgtaaaaaagaaaaaaatatctgggttttaaaaatatctacaatgagtttaatggtaaatatacttatcataatttggagaataaagacctaaagaagaaaattacactctagaacagaagttttgtaagcaaatcattgctcacaaaacttgtgaattacagaattacaggctcttgtaggttgagttattttatgcttcattttggttacaggctttatgttgacattaaaacaaagagattgaagtagagtccaaaaaaaaaaaaaatatatataaatataaaattcaagattaattaaaaaatattggtcttcagagagataaataactaggggaaagagaaaacagtcttctcttctccgatcccaaaaacgcaggaaaacaatg

SEQ ID NO: 3052 - DNA, 3000 bp, Unknown
  misc_feature (1)..( 3000): cDNA_ID_2164733_gDNA_ID_1620622_Annot_ID_162352 3000 nt of promoter + ATG
ttttaaatgcccaataaatttgagaaaaaattgccaacttgtttatgagcttattttctttttcatggatcccaagtcttttgtgtatagagattaaaaaaaaatgacattccttcatgtaaaaaagaaaaaaatatctgggttttaaaaatatctacaatgagtttaatggtaaatatacttatcataatttggagaataaagacctaaagaagaaaattacactctagaacagaagttttgtaagcaaatcattgctcacaaaacttgtgaattacagaattacaggctcttgtaggttgagttattttatgcttcattttggttacaggctttatgttgacattaaaacaaagagattgaagtagagtccaaaaaaaaaaaaaatatatataaatataaaattcaagattaattaaaaaatattggtcttcagagagataaataactaggggaaagagaaaacagtcttctcttctccgatcccaaaaacgcaggaaaacaatgtcgtttaacagctcccacctccttcctccacaagaagaccttcctctccgacacttcaccgatcaatcacagcaacctccgccgcagcgtcacttctctgaaacaccttcgcttgtcaccgccagtttcctcaacctccctaccacccttaccactgcggattccgatctcgctcctccgcaccgcaacggagacaattccgttgctgatacaaacccacgctggctctcctttcattcggagatgcaaaatactggagaagtacgttctgaagttatcgacggagtcaacgccgatggtgaaacgatactcggcgttgtaggaggtgaagattggcggagtgctagctataaggcggcgattttaagacatccgatgtacgagcagcttcttgcggctcacgtggcttgccttagggttgcgactcccgttgaccagattccgaggatcgatgctcagctcagtcagttgcataccgtcgccgcgaaatactccactcttggtgtggttgttgacaacaaggaacttgatcatttcatggtaagtttcactttctaattttgcaaaattttaatgttttgaactgtgaacgattcagccatttatttctctttgattatctgagtatagcaaattcacatttttgtgtggctcattgttcccgcttctcgagtcttgcaatcgatatgatctttgcttctacttttttggttagcttgtaattcgaattatgaactttgtctgactcaaataagttatatttgttgcataaagcttcttctttgatgactaatagtttgtctgattcttgctgaaaaggactttgcatgtccaagagaaagaaagcataatctattttttgtaacgttctgtttgtatgtcttatggattggaatcttacctttgattattatgttgatgcagtcacattatgttgtcttgttatgttcatttaaagaacaactccaacaccacgtttgtgtccatgcaatggaagccattacggcttgttgggagattgaacaatcactgcaatccctaactggtaacgtcccaaatcattttttttttttgttattgtcttcttgctttatgtgtgtcttggttttatcggtttttctttgttctggtttgtaggagtttctccaagtgaaagtaatggtaagacaatgtcggatgatgaagatgataatcaagtagagagcgaggtgaacatgtttgatggaagtttggacggttcagattgcttgatggggtttggtcctcttgttccaaccgagagagagagatctttgatggaacgtgtgaagaaagaactgaagcatgagcttaaacaggtaattgcttgatcaagctgcaatggtacatcaaactatacaaaacacattgttaaatcatgttgctcggtttcttttttcccctgtagggtttcaaagagaagattgtggacataagagaagagataatgaggaagagaagggcgggaaagttgccaggagatacgacttctgtactcaaagaatggtggcgaactcactcgaaatggccatacccaactgtaaacaccttggccgagaagttttgttaccacattgtcaaaagcaaggttttaattcgtgatttggttttggaattgcaggaggaagataaggcaaaactggttcaagaaaccggtttgcagttgaaacagatcaacaattggttcatcaaccagaggaaaagaaactggaacagcaactcttccacgtcatctactctcaccaagaacaaacgtaaacggtaaaacaagatccgttctctttttcaaattgcgcaatttcattaaaccaacccggtcaagatcttcttttgtaaccaaactcaggaccgggaagtcgtaggtgacatagcggctaactagaggatggttctttgccatgtgaattcttgggaaccgtatatgaaagaaacgaatccggttctatgctcgtacagagtgtgttatttgtatagtggataccggttagcctatgaaaccggattctggagtccaaattgttgtttgtaacgacttagtagtttttggaagtgatctgtttcgttggtttgcgtcttgtaacgaacgcttaagcaagtgtgggttttttcttgtaaagtgtcaatatgttcgtttgtaatgaatgtatcaagcaatatttatcataattaaactagcttgaaatgtagtattacgatgttgttgtgttcgtctgatttctctcaccggttgatgcatggttacgttcggctcggtttttatatggttcaatttttaatatatcgataattttaaatgatttcacttgtattattaacaaagcccattggtatttggcccaaaatctgaatgccgacttaatgacttgtttcttcttccttcagcttctccaacgaacggcttttgttttagttttttttgcttacctttctctcgacttggtctacttttgttactctttgagttgggtgattatg

SEQ ID NO: 3053 - DNA, 3000 bp, Unknown
  misc_feature (1)..( 3000): cDNA_ID_3610126_gDNA_ID_1620622_Annot_ID_162342 3000 nt of promoter + ATG
atttcctggtctaacgctttccctctgcgtgccccgttccttccctcgcggttactcttccgttttatgtttttttttctgagatggtcaattttcccgtcgtctctgaattttccctttttctcttcttcactccaccgccttccccgaatcacttcctctgcctgatctaattcaatctccttcctagctcaaagaagtcaatttacacgagcagatctctgcactcaaaactcctggatcttcatttctgggcttcaatttagagtttttttatattaaatgggttggagatacaaagctggtctgttcttgattggcactgttgttatcatatgggtcacctccgctgaagttactcaggtattcattcattgtctcttcaattttgtttaaagctttcatcttttgaggttatggatgtttcatttggatcttattccattaggcttgttttcaatcatgttcttcgagctttgaattagcggtttgagtttgatgaatcaaatggcaaatgcaaattcagatctctgtttaaatggtttgataatttattgaatggtttgacttcaattttgaccaggatatctttacagcctataagcagccatttgcagtcacatatcttggagcttctcttatgattgtttaccttcccgttgcattcctcaaagactggctttgtcgatatttagatcgacgctcttccaaatccaataaaattcccgctttgaccgatgattcctcggttgagctcggttctcctttgaggcataaaatcattgaaatgggacttcaagggactataactaagaaagatagtgaggaacacctttcatcccatgaagaagaagatgagagacccttgatcggtaaagttagagaagaagtgcagactctgaaacagaggaaagagatcacgactaagcagattgcaatgtacggcctttacctcgcaccaatttggtttgtaacagaggtgaattttctttgatatgctcgttgtattgttttgatggtggtgcctgaaagtgtcctcttttaaaccttggtattgatatttgtttgctgtttttgatgatacagtatctgtccaatgctgctcttgctcgtacaagtgtggcaagtactactgtattgtcttcaacctcgggactgtttactctgttcattggtgtatttttgggccaagataccttgaacctgtcgaaagtagtggctgtatttgtcagcatggctggtgtggtcatgacgacgctagggaaaacttgggcttctgatgagtcgcaattaaattcttcactgtaagtttttcatcctaattcgttcaccatgcatctttttcttatatgtattcaaaagctcaccctgggctgcgttttaaattgatagctcaatttgtctcattctcatagcatttcttgattccatgagttttccagtttcatcaaccatatttttttaacgtacagttgatatttgtgtttagcaacggggaacgatcccttatgggagatctttttgggcttctctctgcggtctcttatggactttttacaggttagaaatgattaatctttaaaggtttagagtattagtgtgttggggaggataacctcattgatggcttgtacccttctgatattgacaacacagtgcttcttaagaagtttgccggtgaagaaggagaaggggttgatgtccaaaagctgtttggatacataggattatttacacttgttgctctctggtggcttggtatactaatatcttccattcatttttacaagtgtatcatccgagaaacataacatatgagacatggaaaagttgactcttattcaaaaagtttgttttttggttgtatgtttcagtgtggccattgacagcattagggatcgaaccaaagtttaccataccacactctgtgaaagttgatgaagttgtcttagccaacggtttcatcggaagtgtcctctctgactatttttggtatgttttaatgatttcagctattacaagataaagtggacccaacaagcaatgttgagtttagctacaagtgtcttgtttattgctaggctagatcctataaagaggtgtgtaattacttgtttagaaaataacttggctgttttggtgcttttgcaaccaaagggcactttctgtggtgtggacaactccgctggtagcgacactgggcatgtctctcacaattccgcttgcgatggttgctgacatgatgatccatggtcgtcattattcagccatttacattcttggctctactcaggtaactaaaacttatattccatcaacaacagagaatgaataatttttcctgatgctcaagaattagcatttggtttattttgcaggtgtttgctggattcgtaatagctaacatatcggatttgttctcaaagaagcttggattgtagcacatatgattctttttttttggttgttttgtggtatttctgggtagaaaatgtatcctagaagattcttggttggaattgaaagctaaaagggaattttccctgtttaatggatgaaagataagaatgtgattaccaacgtttttgattcccatgtgcacgtctttggaaaaagaaagtgcaaaccagagagagttgttgtctgttgagcaaagatgagtgaaagaaaaaatcaaattcatgtttgaactagctcgtatacatgaaaccgaactaataaccttgttggcatagataaaatatttttttgatctttaaaactccatcaaccaataaccttacgttgacagatatgaaaaaaattctatgttaatgttgttttattattctaaattaaaagccagtaattgataattacgattattggttcagaacgaaccttctttctgagccagaaagtttagttcgccttgttctgtctgtgtttcttcctcttcccctgaaatcgaacgatttataaaatcgtcgtctggctttcgacgatctgctgacgaagacc

SEQ ID NO: 3054 - DNA, 3000 bp, Unknown; identical to SEQ ID NO: 3048
  misc_feature (1)..( 3000): cDNA_ID_1819332_gDNA_ID_1620622_Annot_ID_162341 3000 nt of promoter + ATG

SEQ ID NO: 3055 - DNA, 3000 bp, Unknown; identical to SEQ ID NO: 3047
  misc_feature (1)..( 3000): cDNA_ID_1012056_gDNA_ID_1620622_Annot_ID_162340 3000 nt of promoter + ATG

SEQ ID NO: 3056 - DNA, 3000 bp, Unknown
  misc_feature (1)..( 3000): cDNA_ID_3092820_gDNA_ID_1620622_Annot_ID_162339 3000 nt of promoter + ATG
gtagaatttttagtaagcgtgatgtagccgtcttttcttttcttctttttctgtaacgatatttaaaccgtaaagtcgacgctttttattttttttggttcaaccaaacattttagtattttgatcatatatggatataaattccatccttttagttagtaaacatggtgttgataaaaacaaaattttatatttgaaatgctgctattatataaataaaaggttaaatccacctactataatttatttagctattattaggtggcatgacaagatgtcaagttggtgaatgaggtgcgtctggccttaactagagatgatacccatattttattttcggacgacaatttatgacacttgttgtatcttgttctcctatctttcttttctaatatttacattcgatttatgatcaacaaatggcttcaattgtaaaatgacaagaatttgtagggtcaacgacgtacaagatcattcaactgccgacttcagaagttggtgtggatatacgagagaggaagtcacataaacaaagaacatgaagattcaaagagttgtatgaacatatcagacaaagcaagcctgttcacttttccactatgtatgtaatttatagaacatgatgtcaacaaagattcacacacttcgcaaagcaatgagcttttacattgctctataaataagtatactttttcatatacgtgagttggaaacataagctttttaagccacatgaaaatgctcaggaaaacacaaggtttacaatcagatgaggagataaaaagtcgtggcaacgcgcagaatcgggatggattccttaagagacagatgcacttaaatgcaagatggtagagtaggtccgtggcagagaaaggccactgcaatgtatatgatcaccagtagtagtagtattaagaggaccctgcaagagacaaaaagggttaggaattaggaactatgttcgattcttaaaaaattctcacttgacattacaaatgtggaacttggggtgattaaagtactttttgctatagttaaatgtgttcttaggccaaaaactagttttagtatacagtcttgcaatcataatactgaaaattgtttactaaggttttaggaaacatacgtgagcttgcagtttctccaccagacgttgcttctaaaacgacgagcttgctttctgaaccggaatgtattcccctgcatattggcggttttatcgacaagaagctccaaacgttcacctctatctaggactttgtcaatgttttctatcatgacaccccgcacctatccaaaaccaaaaagaaaaaccaggatgtattgtcaaacagtgaagccaagactcagaaccatgtctctaaacaacttcacaatccgactgaacttgtaagacaaactcatcaaacctgattcatttcacccttaatacgattaatcctatcggcattaggatcattagagtaatagtcaatctgctgactgagaactctagagaattcctcattcattgcataagctagtgctgtatgaacagccctgccataagtccgtacgaatctctggtgaatatcctccaaaaaggcaaaaggaattctccctgacataaaaaagttttgacttttgagttagaaagacattcacatctctctaatgcacagcttctcggatataattgtgttgatgttatgtccaaaaaaatcaaattcattcacatcacaatataagaccaaaggtctcgaattcaataacagagcgatcgttcagagcaaaaaaggattagacttttgaattccactgtcaccaaagttggaaacttcctcaaaattagccatagaagtaaaagaaaggggaggacgtacttccggcggtttcttcggccatacagagaacggtgaggccatcggtgcgtttaacgtggaagacgtaacgatcctgagagtaggagacgttgctgtcgttgtctccagggaccttctcgaggatctgtttggcgatggtgctcgcattcgtagaggtggcggtgaactcagaaagaaccaccgtgccacgagccacgagggcgtacagaatcgccatctccgtcgtcgatccccctgccgaatcaacaaaactcgtgtaaggtcaacgaagaagaaggttttcccgcggaaaccgagccagccagacgaatcgctggatcaatcaatcagagagagagagagagagagagagaaccaattggcttctttttctctctgcatataattgaatctctttctctctctctcctcttggagtttagctggagctggagaccttttcgcctccgctgattacaaatatttaatttcggatagctacgttgatttatttttaaaatactgtattattataaggatcaaaatgaaattttgtcaaaatatcacgggcaaaactaagttagttctttttgttttgtcggaactaatttagttctaataagtaaaaaatataaatatgaaaagaaaacaatttgcttcagtttcgaaaatattgtaccgtgaattgttttataaggattattaatggttaacgctaaattagtttgatatcaaacttataagaaatacaaagaaaacaaacaaattctatcagtttcaaacaaatagagaaatctgagcaaaaagatcgaataattgtaatttatccgtggaagaagatgtgattttaaagtgtaaatttttacgaatatgaaggataaaatgtagggatgtgttcaaatcatcattaaatcagtttttttttttttagtgtggtagtgacgtaccaaacaaaaccaaaaagcggtctatttccttctggtttgaaacgatttgggtcaaaattgggtttcgagtttgaataagatatgagtgaataatatactaactttagccaaagacaaaaaaaaaaaaggaaaattaaaggcagaaaaatgaaaatgacatccaatgagctgagcctaaaccaaacatagccagagataagccttacaaaatg

SEQ ID NO: 3057 - DNA, 192 bp, Unknown
  misc_feature (1)..( 192): cDNA_ID_1819344_gDNA_ID_1620622_Annot_ID_162371 3000 nt of promoter + ATG
ttcattcacgcgtgggcctccaactctcacattcacaacaaatccaacagcaagattactaataaaaaggaagatgtggtcatcaaaccggttcatgatcgacgaaatctactggttaaccgggatgctgtccgagaaaccaatgctgcagccatttgtcatctgtaccagttgatcaaacaggcgatgatg

SEQ ID NO: 3058 - DNA, 3000 bp, Unknown
  misc_feature (1)..( 3000): cDNA_ID_1819267_gDNA_ID_1620622_Annot_ID_162370 3000 nt of promoter + ATG
attgagctcattcaatggttgagaaagctaaattcattcatctcacaataaacacgaaatatttcgatgtttacacatcttctaattaaactgttttatcagttaaaagtagtaatattggcttattgacaaaaaaaaaaagtagtaatattggctttagttacttttatctgaaacaaaatgtacaattgggccttagatgagtaataaacaatagaacttgggcccaaccctccaccgggatgtttaataactgtgtcttttagtgtggttattaattaaaaaattaaccccttttggtgtgagccaaagaaagaaaaatagattaaagtctttcatatacatcaattaaaaaatgttcgatcaattaaaacgagccatgatgaactaatcatatacatcatcatccatcgtgaaaagctagctgttagttaataattacttaataataagaaagaaaaagaaaatgattgttattacttattagtactgctatatactactccatatggaatagtaactgctattatctggcgttctagagttgacatttaaatgtcatagttttatttagatgtggaaaatctagtaagagtaatagagtaggaagtgattaggaagcaaccgaacaagaagcatattttatgaccggtgtggttagcccttgtgggagacaagattacctcaatttttggctaatcttgattttcctcctccattttattattacttattttctttctttttattattatttttatcagcatctttctctttaattatttttcttaaaattaaacattacaccaaagtgttgctgttaatttctcatatttaaatgtgaatagatatatactatatactaatatacatgtgtgtatcctatatgagaccataagccaatgacagtaggtattagctaatgacaagtgacttccaataacttattaagaagtagaatctttacagatttgatgtttacatggatcttctagaaaactgatttctttaatctctctaatgtcatctgcaactatttaacatacacacacacaaaataaaataaaattggaagagctaatgataatgatttgtattagaaagttgtcctttattttccaatgcattgcatcgaacatatgttgatgttcttttaaaatcgtaaaatctagttctgtattcttttattctaggtttatcaaggctttgtcacaagacaatgagaatacaacttttctctaattttcttcatatactaaataaattatcgtagatttgtagaaggttcttaggctagattcaaaaagtcatttaggatctctttctagatcttgcattttttttagtaaatcttatgctggtgatacttttattaaaccttatgattctaatttggaaaacaaaactaactgataacctattttacattaataaaaacgatgcataattgtaataatgttttatttttttatgttaataagctagccaaaacatattattgatccgaagtacgctattttctataagaaaaggagaggcacggaaatgaacacgctgtgtggttaatccaagaaatcatacaaaattaattcataaactataataaaatcattgggatcttattttgcacccaccaagcttgtaggctgaagatgcggatggaacccaacttcaagaaattcttgccttttgttttatggcttttttttgtcttgtcatagttatataaatgtattttgctaaatttaaacggacaatcaaataaataaataatatataatttgtagttaacaactaaattcaatgactaatatcatgtaacaatagacttgtgacagcagttttctttgttgacttcaaagtttaattcgagcgtacgatacatttggtcggtgataaatatcgtgctatgagtttaatttgttgacttgaaagttttataaacattgtgaaccattgtaacatgtgtttcttgattatacatattcctaaaattaatttcatatggtaagagtgtaaaattatccaagtaatggtgtaaattttaaaagtcttttttttttttttttttcatcaattttaaaagtctttctctgacgttaaaaatagtcttgtcttaggtttgaataatatcggcattagccattattggtcgttactatgggatacttaattttgctaaatctttcagaacctgtacgagataagcgaaaaagccatgaaccacggtcacgcgtgtctcgcacttcccaactttcaccatgcatgctctcactaaagcctgtctttttttttctttcttttacatattttaaaatcataataccataatttgcactaattcttatggtaaatccgttttatgagatactcaacttagttgtccattccttaagacacagattaaggaaagtattcaattctttttgaagttatggtaataactcaaattcttctttcctgccttgaatacttggtacaatatcacaaacatatctctaaattaattacatgatctgcagaatcatttacataaacactttcacatttttatccatttaaaaaaaaaaatattatgatcctctttccttttcaattaattatcactaaactaaaaaatattattcccacagtcaaaagaaaccaaactaatttaaaaaaggtggcgcgtgattatcacgctcaaatgaccgatcggttccactgaattttctcagagattctcctctgaaaatgttttttgtttttttcttatgtcaaaaagaaaatttaccagaaatgattaaaatttgaaaagagaattccataaatgagttaattcgccagtcttgaagatcattacagagttttcagaaaccatatgtagtcttagattctcttttgccaaagaagaaaattttactctgccatacaactttttgtctctttctctactaataataataatccgaactttgtttgttcttctacttcaattcataatctttgacggcgatgact

SEQ ID NO: 3059 - DNA, 3000 bp, Unknown
  misc_feature (1)..( 3000): cDNA_ID_1819281_gDNA_ID_1620622_Annot_ID_162363 3000 nt of promoter + ATG
ttgtcattgggcttctggcccaataggcctttgtctttgttactcacgacactgtcgttttgagtcttcgtttcgacttctccaaagggatcttgaagctgtctggattcagatcttgaaggtgatgtcggagcagtggaggtcatgctaatatcaacaaccaaacctgtaagcatatgagaagcttccaataaaacattcttaaaatttattttcaacaactgccaatgtattaaaaaaaagcaatctcatgaattgcctacacgctaattaggcgggcgaaatttgttttatgtgtatgtggtatggtatttgtttttcctcgccatcctttcctggtaaaaccaataattttttatatcacatataaagttacgtgctgaacgaaacaaccgattattattaagaatccatgttgaaatagagaaaatggattgtgtgaatagaaaaacaaaaacgaaaagtcgacaaaaaaaacaaaaaacagaaaaacccactaaagtcaagcgttttgtttcaaccatgttatagtttagaactttataatcagaaattaattccacgaaaatgaataaatgtcagcagtcaaaccagaccattaaaagaaacaattaccattaaaagatatattgactaacaaaatcaatacaaacctttgcgtccatctctgttatggacacagttgacaattacaaaaaccctccatcttcctgtctctctctatcatccatgacttttttttttctcaacaacaactaattattatccaaagttcttagataatgagattaatacatgctatttcttgcccaactaggcacaatagaataaagcttaggatcataattcaaaaatgaaagagactcccttgatactctgccaatgtgtgccctctcttggtatgaacacaaacttgacctcttcaaattgggggagcaacctctgcagatcatccatgacttaaactgcacaataattaaaataggaaacttaagttcatcaagagagaccaaaaatatcacaaaactcttatttataccatttctattggcaatatttaatagttttttataattaaaataataaaataaaagagaaaaaaagtaaaaaaattctcgcttgaatttttttgaaatactctatacaactcatagtgacattttttttttcaattggttcaatttttttttactaaaaaaaaaattttaattacttttttagaaattctttggggttctccttgatggaaaaagatataccaaaataggtaaagattcttgaacaatggtgtaccatctacgacttcaccgaagtgagctaaagcatccctttaacgttggtaatcagttacccatgacacacactggacatttaccttcatcactctggtcgtcctgagacttgaacagtttcttgtttctgttatcatttacaacataaggcccacttcttgcccacacacagtttattactcatcaatttctctaatatactattactctataacaacaaaaaagtaacattgtaatttgtacacatagcgtttgatctagctagttctatatgtagaattgatgttagcaagtgaatcaaaattttgcggagatgatgtttgaacatgggtttgttcattgtgttacccacacgaagccaatttgattgttcgtccagatccttgtaaaaagaacacatatggatcatttagtcgcaacaataaagaagatgtatcagagctacatatgtatgtttcacagtatttctcctctcgattaacaatgaactggtgcaaggatcacccgattcgttcttgagggaagtatcttgggaagcagatcgatttagaggcaaagagggctcaaaagaaatcgttgatgaaatcgctcaaggtctcgcttgaaggttcgcagtttcttcactaatcgtgagcctttttaaagttgcagtaatcgttgtatgaaacaagcgtgcacggtcatagtcatgctcgttttctcgaggcagcttgacaagagttaaattatggtgatggataattagtgtatttttgaggctgtctcaactgaactttcatttaatgacttggctagcgatacagaaccgtctagccacaaaagagagattattaaagtggaatggcgaggcaaatggtggtagtgtgttttgtcaaacggaaatagaaacaagagatcacctatttttctcttgttcatactctcatgcttggtcagctcttactatgaaatatatgctcggctctcgcttcacgacttgctgtgattctcttgttgccctatctacgaccttttcctctccacaacttcatttgtttgtgtttagatatgtctttcaactcactatacacaatctatggaaagaattaaatgccccataactcagagctcccacttctttttaaatcttgttctattaagttttcaaaattttctcggttttatgttgaatttattgtaaaaccgtttttgaattttaaactcatacaaaaacaaaaaaatataattagtgtattttaaattatttgtgttttaatatattttttattttatcttttaaaacatgttttttatttgagttattattatgaattcagtattataaagtcatatcttcatttcaatttttttttgaatataatgttatataatatttctaaacacaagtagataacgttggtcaatatttggttaagataaatggtggaaaaatattcagaaatgttcaaaaatgttcgaccattttttttatttcaaaatgtacgtcagtaactatcgattttttttgaccatatacaatttgcgacccccgcctttcgacgacttgcttttggtcaaacagcagtaagataggcgtatgtctcatgcttacatggtattgaaccgataatatgtgtgtgtatatatagagagacagactatactttttaatcattcaaaactagaaatcaccaaacacacatctcttttgcacgctcaaaccactatg

SEQ ID NO: 3060 - DNA, 3 bp, Unknown
  misc_feature (1)..( 3): cDNA_ID_3070677_gDNA_ID_1620622_Annot_ID_162336 3000 nt of promoter + ATG
gaa

SEQ ID NO: 3061 - DNA, 3000 bp, Unknown
  misc_feature (1)..( 3000): cDNA_ID_1819305_gDNA_ID_1620622_Annot_ID_47060 3000 nt of promoter + ATG
tcatgaacctcttcgttccatgcccgacaacaattgggcagactatatgcgcacaggtgttgtggcaattctgcagaaccgtgtgggtaagttagtagtttgtttggaacactggaaatggcatacccattaatggcattcttttcttgccagccctgaatttcatctacttgttatatgacaacaatcctctcaagatacttaagaaacctgtcttgttcatgtgtagcaccttccgaaaagcttcatgcgttgattctggctgagaatatgatgtcaatattgggtgaaaagtggcttctcggcggggtaaaattacccaatgttgatattccagctgataggtaaatacaacatctttgtattacactctcacttaacctacattttcctagtgacataaagattaatatcattctgatttcttttgtaggtgtcttctgttggtattagagtcatcgcatgttgaaatttctgtattgttaaatgatctcgcttacaagaagtatgaagctcctaaagataattcaactgctgaagacattctcttgaagcaacggtatctacccatcgtgttttcactggtagaaaagatcatcaaatatatatcatctgctggtgaaaacgaaggtataacttagaccttaatcatgttttattaatgtttccaatctactatcagtagtcagtactagcatattcgatcccttttctttcacctttctgttattctatgttattcctaaaatcagtactatataaacatcataagagcttttagttattgctcaaatgtctattaactccgctgataaacagtgtatacatgcgtgtcagccttttcccttcatgaaagaattgggatttacgtattgatctttgcagggactctatctgacgaagctgtcttccaaaaggtgattaaaatacttaatgagacagtaggagcggtgttcgaatatctcagagatgcaaaggtactatacatatatgataacatcaaactcttaggaatgtcttattgtgcttgaaaatgtttttcatgttaattctgtttcatacaggaacatggaattaagaaaggaactgaccttcttgcatctgtgcgagtgattggaaggtatagataatcactctttttgtttcttcttatatctctcgttcgatttatttttgtttaaaatgtataccggattgtgtttatgtaatcatcatttatcattcaaatttgtgtaaggacatggattgtatccttaccactttggcaggtactgaacctttttttgtgttttcaacagctatcttgcggaaactcctgttgcgtgcaaagagcaggtccaggatcttctggattatatgctttcagtgaagggcgaagatgaatccaggtttgaaggcatcctgacttgatatattggttcttttacaaagcttgtttgagtcatgcctcccaggataacttggtctgaactattttgttttgacagcccgtttttgtctacttgcttcttgctcccaatgctttgccaaataacaatgaacgcagaaggatgtaaactcttggcctattcaagaggcgatgtagctgtgagttactcggctttataccttctttatactgatgacaatatgtttgaacaaatctgatttacagctttcttatatctctcagtatgctgaaccaaaatgtatttcaagtgggtgtttatcttgtatataatcttataaggagctgactgatttttcaatacaggtcgttgaatgtctaataaaattgattgagcgctgtggtgagagtgttgatgaggatcgaagcatattcttggcttgtgatacaatcatgaatattcttttgaaggtactctcttccctaagataggacctgtttacattttgccaattgctaaaccctataatgacttcacgttttaaatgttgagaacagagggaagaaataagcccgccggaaatttcaacatttgccagtctattgaaagctttggcatattgggcaggtaaaaaaaaagatttttactgcttctgctgatctgcctactaatttcttgacaaaaatcgaagaccatgtttaatatgtcaatttctctgttccttttgtcacagatgggagtaatgaccattcggtagtaatgatggctgcaagcatatgctctctgatctttgatttcacatcagaagatgctttacaacttagcagaagctccctggatagtttggcccggctcgttacaagaagcttgtcctcaagtggccaggtataataatccgtgacttgtcatagagtctcttgtacttgttttggtagagagaattgcttgttagtgaactgttgcttaccgttgcaggatatgtctgataccgcggatcttcttgaaatcataagagcaggtttggtttcaacatctctctcacttttttttcctcggcttctctttactttttaaatcgataaacacaacaagttttcttcttgctctaattgtgcttgtatgattatggaacaggatactctcggtggataaatcgatttcccaccattatgaaacatcccgttgtgcaatagaaactattagatttggtctcaggctgtttcgagggagagaaatagtcaaaaaaggaaattttgttcagtttattagctccacgttgttgtattatatacacttgagattataattcatggtttctctatttatgatgcttccccaccaagaaatgagatacgatatatagatatttatgcaagtctaaaatttgacttgttatatagaggcaaatctaaaagataaggttccgattatgaaggattcaaatctttaaacgacgccgtgtttccatataacagtaaacagaaacaaacgcgtttttcgttggttggataaatcctccttataaataaacaaacctttaaggaaggttagttgtcaaaagaatctgcgaaaaataagagagagagagagagaaacaggatcattcattatg

SEQ ID NO: 3062 - DNA, 3000 bp, Unknown; identical to SEQ ID NO: 3052
  misc_feature (1)..( 3000): cDNA_ID_1819301_gDNA_ID_1620622_Annot_ID_47061 3000 nt of promoter + ATG

SEQ ID NO: 3063 - DNA, 3000 bp, Unknown; identical to SEQ ID NO: 3051
  misc_feature (1)..( 3000): cDNA_ID_1819297_gDNA_ID_1620622_Annot_ID_47062 3000 nt of promoter + ATG

SEQ ID NO: 3064 - DNA, 3000 bp, Unknown; identical to SEQ ID NO: 3050
  misc_feature (1)..( 3000): cDNA_ID_3070648_gDNA_ID_1620622_Annot_ID_47063 3000 nt of promoter + ATG

SEQ ID NO: 3065 - DNA, 3000 bp, Unknown
  misc_feature (1)..( 3000): cDNA_ID_1819293_gDNA_ID_1620622_Annot_ID_47065 3000 nt of promoter + ATG
aaatgtctgaatgttccatttgagaaatgtcctcatcatgtgacacaagtttattaggctactcaagttagcttagaattaagaagctagaacatgtgaaaataaatagaaaacaaaaaagaggaaacaaaaactaataacagaacgagaagttgaaaccttttggatccaattaaatgaatatcgatgtaattccaaaatgttagttcatgtgttaatgtttgaagatctagtacatatgaataacatttgaaatcatttttgtttcatgcaattacataactacaagggttttcatcacatattgctaattaattttgagtttagaatccaaaacatttaaccgaaaatctaataattttaaaaagggtgatttactcatctataagactaactaaaaaaatacgtactaaattatttacaagagacaattgataactagagtatgaattagttgtttagacttacccatgtgtcaaagtcatattgacaaatggctcggttataactgatttatataccaataattgcatacaagtttgtttcttaaataaatcaagcaatattcataagattgcatgtgtattttctgcgaaactattagtacgaattcgtggatatgcaaatttaatgactatgcaaagtaggtgagaatgtaatagcgattagaatagctagggtttagcctaccaaccatggtaatccagtttcctaattatcgttagtttttgaatcccattcatgcttttatctatttttcaaccaatcatgtctttttaccaacaaagcatttccagtctaagcaatatggtaggtaactcggtacgataaacagaaagataatttattattcatctataaacgaataattggttctcacattactcatacagaggaaaaaaagggatatacaaaccctctctaaattatatagttttgaattcactgttgtttatcaacaacatatataactctcttacccaattcttattattgttcatacttcatagacattaacatgtacgtatagtgattgctacaatgaatggtatgtacagatattgagacagacagtagaaagggatgaatcgagtatttattaaagagaaaggaaagggccaatctatgcctagtttcaattatgaaactcaacccatgaactgatttaaatactttacctatcggataagacttttaagggtctaaaatattttccaactatttttcatttgcaacaaaccttaaagtaatatgctaaagagatcttttccaaaggtggaatgatttttttgatctaaaacggcccatcaaccaatcttcggtccattatcctgacatgattatttgggctacatttttttaagtcttttgcagtaaattgttgaaccaacaaaaataaagagttggagttggacctagtagctgatctgctgatgtgttggtgatggtcgtcgtgggttcctgtcttataaccctagaaaccaagccacttcatcattctcaaattcaatgctttactaaataatattattatcgaaatcaaaatactaatttagacgtatataaatctagaagcaaaccttaggtgaggtcgaaacagagatgaccttttgcgtgcactttaattaatatcttattacataaaatgtcacactttgagtaaactttacattattctctcatccataataaataaataaagcatactgggttttaggtcaggctgacgtcagcagtttctttgtgtttcattttttttttttttgtaatctaacgctccagatttgttgtcttctccacgagccctttgttgttgttggtaatggagattttcgctctaagtcattgtggcttcttcttctttatttagaaaccaattcatcaactccttcgttatttctaaatctctttgccactacctcttgttgctgcaattgaattggctcaaatcttcttcacttggtcgacgtaaagacgactttgacttggtttttaacttcacttctccgtcgaaaactatcccttctcttccgatcgaatcaatcggctctctctccacacaaaccaaggtaagggttaaccctctccggtgattatgctctgataaatttacttgctcggccattagtgttcagaaacttggtgatttatgcatgtttttttttgttcaaagaccgtagatttcggaattaggattgtaaaaattgaacctttacatcagtgtttttacaaagttataagctttacttggaaatcagtggttttttgggtcaaccaaagttgaaagatttgaagaagaatgaaactagttcgatttatatatcattttattgcttcttaagaaagtgtcgtccttggttctttatgaatttccaattgcagccaaatatgtcatgttattcacctaatttttgtattttccaattgcagccaaatatcttctcctgttactggagacaaacctgcatacatttctgtcatctctgttaaggtattacatttagtttacttgtttacttaatgtagctgcttattacatttttttcttcaagtctatattcttctttcaatagcattaaaagttatgtgtatcctcagattagatcttgctgactcgcaagtttttggattatttagcggtttaataagaattatatcttccttgaaattgtgcctaggtagtggaatcgttgttagcctactgtagctcagataggtgatggatcatttccgttcaattgaataatttgactatttaaggtttgcacttagttttgtctacagaatcaattcatcctttttcacagtcaagatattattctcattatcactattgtagacttcttggacttccatacattcatcagtcaacttttcgatggtgcgtttttatcacagtggcacaattatttaagaggctccatctccactgcaccactgagaagtttcgtgtggacatgtctaagcttagaattggtttggttgaaaactgaggagatg

SEQ ID NO: 3066 - DNA, 3000 bp, Unknown
  misc_feature (1)..( 3000): cDNA_ID_1819285_gDNA_ID_1620622_Annot_ID_47068 3000 nt of promoter + ATG
acaaaaacaaaaaaatataattagtgtattttaaattatttgtgttttaatatattttttattttatcttttaaaacatgttttttatttgagttattattatgaattcagtattataaagtcatatcttcatttcaatttttttttgaatataatgttatataatatttctaaacacaagtagataacgttggtcaatatttggttaagataaatggtggaaaaatattcagaaatgttcaaaaatgttcgaccattttttttatttcaaaatgtacgtcagtaactatcgattttttttgaccatatacaatttgcgacccccgcctttcgacgacttgcttttggtcaaacagcagtaagataggcgtatgtctcatgcttacatggtattgaaccgataatatgtgtgtgtatatatagagagacagactatactttttaatcattcaaaactagaaatcaccaaacacacatctcttttgcacgctcaaaccactatggatacttccctcttttctttatttgttccaatccttgttttcgtttttattgctctttttaagaaatcaaagaaaccaaaacatgtaaaagctcctgcaccaagtggtgcgtggcccatcatcggtcatcttcaccttctcagtggcaaggaacagcttctttaccgaaccttaggaaaaatggctgaccagtacggtccagccatgtcgctacgacttgggagcagtgaaacatttgttgtgagcagttttgaggtggctaaagattgttttactgtgaacgacaaagccttggcttcacgtcctattactgcagccgcaaagcacatgggttacgattgtgctgttttcgggtttgcgccttatagcgctttctggcgtgagatgcgtaaaatcgcaaccctcgagctactttctaaccggcggcttcagatgctcaagcatgtccgtgtttctgagatctcaatgggtaattaaaaaaaaaaaaaaacgtatataataataattttcgatattgttaattttgttatgatgcgatattgacatattgtcacatgcatgcatgcagttatgcaagatttgtattccttgtgggtcaagaaaggtggttcagaaccagtaatggttgatctaaagagctggttagaggatatgagtctgaacatgatggtgagaatggtggccggaaagcgatactttggaggcggctcgttatcccctgaagatgccgaagaggcaaggcaatgcagaaagggcgtcgcaaatttctttcacctcgtcggtatattcaccgtgtccgatgcttttccgaaactagggtggtttgattttcaaggacatgagaaggagatgaagcaaacaggaagagaattagatgtgatccttgaaagatggattgaaaaccatcgacaacaacgaaaagtttcaggaacgaaacacaatgattcagacttcgtcgacgttatgctgtcgcttgcagaacaaggcaaattctcgcatcttcaacatgatgcaattactagcattaaatctacctgcctggtacatctttaactacacaaattttgatgttttttagatgaactagatatataaacctaaccaaattaactgggattttgtccaaaaattattgttttctaaaatacaaagttagttatataaacaagtttaggtggaaagacgtaaatgataacatgtttattttgtaagaaattacttcaaccttaaattgatgggattaggcgaatcctgattagatgatacttataagtatattgttttaatgtatgtcatataatgataataaattgaataacaggcactgattcttggaggaagtgagacttcaccatcaacccttacatgggccatttctcttcttctaaacaataaggacatgttaaagaaagcacaagatgagatcgacatccacgtcggcagagacaggaacgtcgaggattcagacatagaaaatctggtgtatattcaagcgattatcaaagaaacattgagattgtatccagctggtcctctcttaggccatcgagaggcgatagaagattgcacggtcgctggttacaacgttcgtcgcggcacaagaatgttagtgaatgtatggaaaatccaaagagatccgagggtttatatggagccaaacgaatttcgaccagagaggtttatcacaggagaagcaaaagagttcgatgtaagaggacaaaactttgagctgatgccatttggttcgggaagaagatcatgcccaggctcttcattggccatgcaagtgcttcatttaggtcttgctcgtttccttcaatcatttgacgtgaaaactgttatggatatgcctgttgatatgactgagagccctggcttaaccattcctaaagccacgcctcttgagattctgatcagtccacgtcttaaggaagggctttatgtgtgatctctgttccagaaacatatactatatgacttcaatatggtaattgaaggtgcattttaatttgtttttttaattttattttgaataaaacgtacgtttgttacgttgtgtacttttttaaaataaataaatgtggaaccaaatgtattctttaaaatatatgtattatttgatttcatctattgtgtaaaactttgtataatataatatatttgatttgacggcaaaaaaaacacaaacaaactgcattttcaattttgaactttgtaaattaacagaagcggaaatattttggggaaaaaaaaaaagaaaaaacagaaacggaagtaaataagctttttaggcatcgatcgaattttccaggaaaccccgagagaggggaagaagaaactgacgaagacgaagtcgaacccttaaaaatccggtagagcatccgattctccgttgctcgaaacctctcaatcgattttttaaaaatttatttgcgatgcattgagccgccgtcaaaagagagagagagagagagagagagagagagagagagagatg

SEQ ID NO: 3067 - DNA, 3000 bp, Unknown; identical to SEQ ID NO: 3059
  misc_feature (1)..( 3000): cDNA_ID_1819281_gDNA_ID_1620622_Annot_ID_47069 3000 nt of promoter + ATG

SEQ ID NO: 3068 - DNA, 3000 bp, Unknown
  misc_feature (1)..( 3000): cDNA_ID_1819267_gDNA_ID_1620622_Annot_ID_47074 3000 nt of promoter + ATG
gataggattgagctcattcaatggttgagaaagctaaattcattcatctcacaataaacacgaaatatttcgatgtttacacatcttctaattaaactgttttatcagttaaaagtagtaatattggcttattgacaaaaaaaaaaagtagtaatattggctttagttacttttatctgaaacaaaatgtacaattgggccttagatgagtaataaacaatagaacttgggcccaaccctccaccgggatgtttaataactgtgtcttttagtgtggttattaattaaaaaattaaccccttttggtgtgagccaaagaaagaaaaatagattaaagtctttcatatacatcaattaaaaaatgttcgatcaattaaaacgagccatgatgaactaatcatatacatcatcatccatcgtgaaaagctagctgttagttaataattacttaataataagaaagaaaaagaaaatgattgttattacttattagtactgctatatactactccatatggaatagtaactgctattatctggcgttctagagttgacatttaaatgtcatagttttatttagatgtggaaaatctagtaagagtaatagagtaggaagtgattaggaagcaaccgaacaagaagcatattttatgaccggtgtggttagcccttgtgggagacaagattacctcaatttttggctaatcttgattttcctcctccattttattattacttattttctttctttttattattatttttatcagcatctttctctttaattatttttcttaaaattaaacattacaccaaagtgttgctgttaatttctcatatttaaatgtgaatagatatatactatatactaatatacatgtgtgtatcctatatgagaccataagccaatgacagtaggtattagctaatgacaagtgacttccaataacttattaagaagtagaatctttacagatttgatgtttacatggatcttctagaaaactgatttctttaatctctctaatgtcatctgcaactatttaacatacacacacacaaaataaaataaaattggaagagctaatgataatgatttgtattagaaagttgtcctttattttccaatgcattgcatcgaacatatgttgatgttcttttaaaatcgtaaaatctagttctgtattcttttattctaggtttatcaaggctttgtcacaagacaatgagaatacaacttttctctaattttcttcatatactaaataaattatcgtagatttgtagaaggttcttaggctagattcaaaaagtcatttaggatctctttctagatcttgcattttttttagtaaatcttatgctggtgatacttttattaaaccttatgattctaatttggaaaacaaaactaactgataacctattttacattaataaaaacgatgcataattgtaataatgttttatttttttatgttaataagctagccaaaacatattattgatccgaagtacgctattttctataagaaaaggagaggcacggaaatgaacacgctgtgtggttaatccaagaaatcatacaaaattaattcataaactataataaaatcattgggatcttattttgcacccaccaagcttgtaggctgaagatgcggatggaacccaacttcaagaaattcttgccttttgttttatggcttttttttgtcttgtcatagttatataaatgtattttgctaaatttaaacggacaatcaaataaataaataatatataatttgtagttaacaactaaattcaatgactaatatcatgtaacaatagacttgtgacagcagttttctttgttgacttcaaagtttaattcgagcgtacgatacatttggtcggtgataaatatcgtgctatgagtttaatttgttgacttgaaagttttataaacattgtgaaccattgtaacatgtgtttcttgattatacatattcctaaaattaatttcatatggtaagagtgtaaaattatccaagtaatggtgtaaattttaaaagtcttttttttttttttttttcatcaattttaaaagtctttctctgacgttaaaaatagtcttgtcttaggtttgaataatatcggcattagccattattggtcgttactatgggatacttaattttgctaaatctttcagaacctgtacgagataagcgaaaaagccatgaaccacggtcacgcgtgtctcgcacttcccaactttcaccatgcatgctctcactaaagcctgtctttttttttctttcttttacatattttaaaatcataataccataatttgcactaattcttatggtaaatccgttttatgagatactcaacttagttgtccattccttaagacacagattaaggaaagtattcaattctttttgaagttatggtaataactcaaattcttctttcctgccttgaatacttggtacaatatcacaaacatatctctaaattaattacatgatctgcagaatcatttacataaacactttcacatttttatccatttaaaaaaaaaaatattatgatcctctttccttttcaattaattatcactaaactaaaaaatattattcccacagtcaaaagaaaccaaactaatttaaaaaaggtggcgcgtgattatcacgctcaaatgaccgatcggttccactgaattttctcagagattctcctctgaaaatgttttttgtttttttcttatgtcaaaaagaaaatttaccagaaatgattaaaatttgaaaagagaattccataaatgagttaattcgccagtcttgaagatcattacagagttttcagaaaccatatgtagtcttagattctcttttgccaaagaagaaaattttactctgccatacaactttttgtctctttctctactaataataataatccgaactttgtttgttcttctacttcaattcataatctttgacggcg

SEQ ID NO: 3069 - DNA, 192 bp, Unknown; identical to SEQ ID NO: 3057
  misc_feature (1)..( 192): cDNA_ID_1819344_gDNA_ID_1620622_Annot_ID_47075 3000 nt of promoter + ATG

SEQ ID NO: 3070 - DNA, 3000 bp, Unknown
  misc_feature (1)..( 3000): cDNA_ID_1819373_gDNA_ID_1620623_Annot_ID_47076 3000 nt of promoter + ATG
taaacttggtcaagatttgcttaaacactgttacttgccagttaaaatactctggttttgatcttagagatagaaaaccaggataagtttgtcatcatcatcaccattattgtgattggtttctctcatcatattttttttgcgggaaatactagaaaagttacaagaaatggggtatatgagtttcaggagtggtccatccattagatgatctgtctttgtttatgtgttgttgttttgtggtcctgatttgtaagagcaaagagtggaaagcaaaagggaatgatgatgatgatgagttttcttctaatttagaaagtgaagaatctctctttacttttgttgcttatgctttgtttctctaaatatctaagacatctcttccaagttttgacctctggatattctaaactaggctaagaatctttgtttcctttgtcttgttttgtaagtgaattttaggcaacaattggacttttcttaggttgtgagttaaacttgataaacatgcatgtgcttatatggttttgaatgtaaacataacatctgaaatgtttaagaaaagagaaatgtctaattaatatgtaagagttctcgttgagctgattatgttcttagtttcaatgtttaatctggccattgatttctaccttgcaggtacgccgtttcagatcttgacagcgatgttactattcatgttggcgaggtcacatttcacctccataaggtacatttttgtaatgctgataatagaagtagtttctactgagggattcttaagtggtacaactttttattagagatgtctcttttatgctcaatgttacattttcagttcccgctgctatcgaagagcaatcggatgcagcgactggtttttgaggcgagtgaggaaaaaaccgatgagatcactatactagacatgccaggaggatacaaagcgtttgagatctgtgccaagttttgctatgggatgactgttacgctcaatgcttacaacataaccgcggtgcgatgtgcagctgagtatcttgaaatgactgaagatgctgaccgcggtaacctcatatacaagatcgaagttttcctcaactcaggcatattcagaagctggaaagactcaatcattgtgcttcagacaacaagatctcttcttccttggtctgaagatctgaagcttgttggtagatgcatagattctgtttcagctaagatcttggtgaaccctgagactatcacttggtcttatacattcaacaggaagttatctggacctgataagatagtcgaatatcatcgggagaagagagaagagaatgtgattccgaaagattggtgggtcgaagatgtatgtgagctagagattgatatgttcaagagggtgataagtgttgtgaaatctagtggaaggatgaataatggcgtaattgctgaagctcttagatactatgttgcaaggtggttaccagaatctatggagtctttgacatcagaagcttcttcaaacaaagatctcgttgagacggttgttttcttgttgccgaaggtaaacagagcaatgagctactcttcttgcagcttcttgctaaaactccttaaagtttcgatcttggttggagctgatgagacggtgagagaagatttggttgagaacgtgagtttgaagcttcatgaagcgtccgttaaagatttgctgatccatgaagtcgaattagtccatcggattgttgatcagttcatggcggatgagaaacgtgtatctgaagatgaccggtacaaggagtttgttttaggaaatggaattttgttgagtgtaggaagattgattgatgcttatctcgctcttaactctgaacttacactctctagctttgttgagttatctgagttagtcccggaatcagctaggccgatacacgacggtctctacaaagccattgacactttcatgaaggtaaaacagagtttcttgtttctctgaaaagaatgaaatatttttggacatttttgtaatcggtgaagttggtttttgtaggaacatcccgaactaacaaaatccgaaaagaagaggctttgtgggttaatggacgtgaggaaactgacaaatgaagcatcaacgcacgctgcacagaacgagagacttccactacgagtggtggtgcaagttctctactttgagcagctccgagcaaatcacagccccgtggcgtctgttgcggcttcgtcacactcgccggttgagaagacggaggagaacaaaggagaagaagcgacgaagaaggtggagctgagcaagaaaagcagaggaagcaagagcacgaggagtggtggtggtgcacagctgatgccgtcgaggtcaaggaggatctttgagaagatatggcctgggaaaggagagattagcaacaagagctctgaggtttcttctggaagctcacaaagtccgccagccaagtcttctagctcgtcttcccgacgccgcagacattcgatatcgtgaatcggtggggagaaacagaatttgtaaagagaagctattatggttgtaacttattataagtgatcttaggatttgtggtagttaaaattaaaactgatgaagttgtgttatgtgtttctttaatcgtaaagatttgttaactgtttcattacatgactaatgttttgaatttgttgtcgttaactttaagcgattagtgaaagtgatggacgacatgttttgttgtttgtttgtcaatcattgttcattagtcatcaaaatattccacattagtgagactaaaactcagatcttatgggctaagctatgatctcttgggccttatgggctcaatcttgggctcataagtgatcctacgttttagagtttagactagttcaatttcgattgtggaaatgatctgacggctaggaatcaccggcggccatagcttgagaggcaaaacccaaaaccctcggaaacacagaggcgtcttctcgacggagagcgacagagatatg

SEQ ID NO: 3071 - DNA, 3000 bp, Unknown
  misc_feature (1)..( 3000): cDNA_ID_2160942_gDNA_ID_1620623_Annot_ID_47077 3000 nt of promoter + ATG
agtacagtagcagattagtccatgacattataaagaaactaatcgtgttttagaaaagccttttttgcatgcaaagtcaaatgttaggaaaatgcaaagtctgaccgactcgtgagcatctagaataacggaaacaaaagtcaaagtgtctctctctctctctctctcggctagcgggttccgttgggacggactacaaaagactgtaccggcgcgtcaattcacaccaactagtacgaagaagggaaacactgattacacgtgtcgagtgttcattcgttgatgtacaagtagcggaactaaagcaaacggagtagggaatgagtcaaagcaagtatggtggtgcaaactgctattgactgatgcagggaaatattgttttgttaagagattttttactattatctactactagtatataacaaaagattatgttttgggaaaattaatctagtgcctaagtttttgagcgaaaaccaaaaaccaggctatgactcagtttagccaatgtacttatttatgtagtgttggaatattatcatcatatgtgtacttacttacctttatcatatatagatgtatagaagcagatacatagggttaattaaagactacacgagacgagaattgagctgtacaatgctatagactatagactatatagtaattggagagatctctaatctacagagaaaataaagtactacatacttcattattacacacacattaaaacttaagacgtaaagaataaatggaagtgaataaagaaaggggataattaataaaaacagttgttaattagtaacattcaaacaacttagctggctaatttagaatatttgcaagctagattcccactcccttttctcttgttcccctacagttttttctcgcttccctttatatagaatataagtatatacataattgttcgagacaagttcgtcagaaggaaaataaatcatcatcattcctcatcccttcccgaagctgctctaaggaaagagatccactattactactactatacatatataactataaaaataaataaactttcattgagatttgagccaaacagagaagaagaagaagaagaagaagagaagatctccagcggatcagtccccgctttaaaagcattggcggcgtctgatttcatttctctctctctctctatctctctttaattccctcaaagacaaagcctttttctctatatatatatatatatctctctatctttcgccattttggtttttgcttctctctgtgtgtgagtgattatgatgatgggattatctttctaaagctttttgttttcctgaaaaattaaaaaagaaaacttttatggttcttcttctcttctgtgttggagttgagagaccaataaatgctgttagtaatggttagttgagatgagaggtaaaaagatcccgtagtccgaggagtgtttggtttcttgcaaaaggatagtgaggcaaaacatgggtttggtttctcttgtctcctttcattcatcccttttccattaatggtctctccctcttccaacaccaacctcttcttttattaactaacaaacattttctgcctttttctcctcttctcacttctctggttcttctgtgatttgatcggttcttctaaaaagagagagagtagaagcttcttaaagctgcttcagggtcaaacaaaagtgtcttccttttggtaaacaagacgaagaaatatgaagttcatgaagctagggtctaagcccgatacatttgaatctgatggcaaattcgtcaagtaagcataattttattttgtttttatcttattttttaatttgatgggtcaaatgaatcttctactatttctgttctctgtgtttttgttctgttctctcttctcttttctattcatttatctccacatgtattgcctctgtttagttcttgtatgatttctagaaacatatgtcccatcttctcttggttcctatcttttttaacacaagctattaaaaacagatttcagtgacttccctgctaaattttcatttgctctatatgaacagagatagctaaacttggtcaagatttgcttaaacactgttacttgccagttaaaatactctggttttgatcttagagatagaaaaccaggataagtttgtcatcatcatcaccattattgtgattggtttctctcatcatattttttttgcgggaaatactagaaaagttacaagaaatggggtatatgagtttcaggagtggtccatccattagatgatctgtctttgtttatgtgttgttgttttgtggtcctgatttgtaagagcaaagagtggaaagcaaaagggaatgatgatgatgatgagttttcttctaatttagaaagtgaagaatctctctttacttttgttgcttatgctttgtttctctaaatatctaagacatctcttccaagttttgacctctggatattctaaactaggctaagaatctttgtttcctttgtcttgttttgtaagtgaattttaggcaacaattggacttttcttaggttgtgagttaaacttgataaacatgcatgtgcttatatggttttgaatgtaaacataacatctgaaatgtttaagaaaagagaaatgtctaattaatatgtaagagttctcgttgagctgattatgttcttagtttcaatgtttaatctggccattgatttctaccttgcaggtacgccgtttcagatcttgacagcgatgttactattcatgttggcgaggtcacatttcacctccataaggtacatttttgtaatgctgataatagaagtagtttctactgagggattcttaagtggtacaactttttattagagatgtctcttttatgctcaatgttacattttcagttcccgctgctatcgaagagcaatcggatgcagcgactggtttttgaggcgagtgaggaaaaaaccgatgagatcactatactagacatg

SEQ ID NO: 3072 - DNA, 3000 bp, Unknown
  misc_feature (1)..( 3000): cDNA_ID_3070694_gDNA_ID_1620623_Annot_ID_47081 3000 nt of promoter + ATG
tgccaaacaaacatattgttagtattaaattataggaccactcaacattccgccgtgtcacatggaaaaataatgttagtaaacttatttggtatcaaatttaaatccatattttacatatgttaggaatgttaaaacgtaaaattgatagattctctatttacattagaaaagttcaactggtggtttggttcacgacatgaaccatggatccagttatccagattgaattagagttttgaatttggtacctcgatttggaaaggagaagttgtgggagggtatctctcgacaactttgccctttttatcaaccaagaatttctcaaagttccatttgatgatatcaccaaggaaaccaccagcattggatttcaagaacttgtagattggagctgtgcttggtccattcacatcaacctgaagaacataacttatcaaaactaattaaaagatatctccctaaactcaaaaaaacgagagttctttttttctatataccttgtcgaatatagggaactctgctttgaaccgggtgcaagcaaattgcttgatctcagggtttgaaccgggttcttgacctccaaattgattgcaagggaaagcaagaatctcaaatcctaaaaacgagagagacacaataaataagaatctcacaatcactgtgttaccttaattaaatttagatgtgtaaaaagcttactataacaagcacaccttggttcttgtatttttcgtacagttgagaaagctctgagtaatttgatgatgtcaaaccactgacaccgtgaagttaaaaaataaacttaaaaaaaaattcagatgcaaaaacttatcaaatagaaagaattcgaagaaacaataaaaacaatcaccatcttgacgcaacgttaacgatcaacaaaggttttcctttgaatttgtccagagaaacatcattaccatcgatgtcctgtttcaaaaaaacacaattatgtctccaaagtctaggttttaattaggaagctctcacatgtactacataattcagtgaggttgagaaaaatcatattttgacgacagaacaaattcttcaatttcgataacgaagaaacaaaaacctaattttcttcttcagataaattaaaagaaacatacctttacagtgaaatcgtgaacagacttctctgctgcagcccttgcatagacactgaaatttttagatttgactagaaacctatgactatttgacgatttcactgaaaccccattactcggattccgagtttttgatgttctggtggagaatctcaatgatgggccgagaaaagcggaagtaatcggagacggatttgcagcgaaaccattgaagggtgtagagaatgatgcgtaagagaaagccatatagaagcagaatctctctacaaagagttttttttcgttctactattatctacatatacaaaagtgttacacgttctaaggaaaagggagagctacttaaaaattaacgctaaatagcagcttcattaagaaattttaaattccatatccacaaatattacacccataaaaggtccataggtcacagggagaacacgttttccatattatattcactaattttgaaaagaagtaaaaatggcatttgacaaaaatgctgtacggaaaagctgagcggtgcaaaagctatggatttgatgaagactagtcaaagcttatcatgcaacaaagttgcaactatacgatattatttctcgagccctctttggtagtagtaatctaaatgattgataatacgataacacggagtaaatcatcacgtctaaaaagaggtggatgaatcaatctggaaggagattatgctattagggactccaaaatgaggttatatatacccttgtcatagactcacaaagagtgtttggattagacctgagatatggatccaagtatactcactattttcatgaatgttttactaaagtttacctgtcccaagtttgtagaccgattttttgggtgaagacgtgtttagttgtgaaacagtggtctggctaattgcaaagtgatttaggtgtacttgagaccaatacttttgatttggtagtagagtaatgtatggagtccgtcaaatcttgccaaatatcgcattgttgccatggtggaagatggtagccgtgtgtcttcctatgtgtgttgcatttattacttgcacatgtctccttggacccttgtgtggaggaaaaatagtaagttaccgttcatacaactgaaattttaggaaactttgacattatgatctttaagaaaatatatatatatatatatatatatatatatccatccacaaatagtcttacaatctactatgtatttaacttttcagaatttaatgaagacacaagacatgtatgtgtgtttgatatatcaatttactccataagactttgaaacatataatacagttgaaaattgcaatacagctaaaacaaatcataaagagtcaggtaatacattattgtattagtgttaagtaaaaatagtgtgttgtgctggcaagtaagagaacacgaacaaaatcttaagaactttcgttgcttttctaaggcaaaacaaaacagactttttctcttcttcttctttttggggctacgacaatctgaatttgatcccaaatcaaaactttcttcttcttcgtcttcctctaatcaaaactgtctcctaccaaaggtctttcctttctccagccagatatgtgaggaaaccaagcttctcgtacaacttcatcacctacttccttttgacgttttcaaatcttggtatgtttaaaactcttatcgattcagccctctctgttttggtttctgtttgtagattgatttcttaattagctctaaaagattaagatcacaggggtccattgtcaaaattctcttttgattttgtttttgtaatcaagaatagtttctttttttgattcatgaagaaatgtctaattttttcgttgcagagagagatg

SEQ ID NO: 3073 - DNA, 3000 bp, Unknown
  misc_feature (1)..( 3000): cDNA_ID_1819360_gDNA_ID_1620623_Annot_ID_47082 3000 nt of promoter + ATG
tgtttcaggaaaaagagaagtggtgtcgttagaccactcacagtgttaacatctggactagcggtaactatttgcttttcagatggcaaaaacttattctgcttgaattccatgtcacctgtcaagaaacaatgagtagctccaatcagagattgcatgtaaacaactatacaagttgcattgtttaaagaagaggttaccgatagctcgtgatagatttaagcttccattgactcgccctgcatgtataaagccaccagctttcaatatcctttctttctcagcttcaagatctggtttgtgatctctagaaagattataagcctgtagacaaaggacacacgttttgacaaaaaaattaaagacgccaaaaagtcttaatcaaacacttcaaaatggtattttacctgattctttctggatatcacacaacgtgagtcacctgcatttgcaacaaatagctgcttgtctctaacaacagctacgcatgccgtgctcccagaattaggtccagcaaaatcagaatgaggaccctgttttgacaacaaaagcacaaaccttagatcaaactttactgttgcttagtgatagaagcagtaatgcaggtagggaatatttacttcctcaaacgcccaagcatcaggtttattagcactgtccccacttcttggtgaccatataagcccttcaatcatcccactgaacttattgattttgtcaccaagtactgctaactctcgccaccctctttgtccttgcatcatctcatccattctacaatagccacaacgacaagacttcaatgcagaacttcaaacaaaaatagactctttttgctgtaaacttacctgaaaaatgctttttgaagagaagtccctacgtctccagctgcatacgcctcatcactaagaacctgctggtgtagatacttggcacagaacttagaaacaactttacctacaatagtagccaaaatcatttgagattccatgtacaacaagaacatgaatcaccaaaaaggttcagctatatcagtctacaagctcttaaaccaagttttaagccggagaaaatacaccaagaagacaaatgtttccttttttacctccatgaccatcatagacacccaagaaggaagtgttatcatcgagatcaagtattgcagcatgctaccaaagttataaaaaaaaaacattctttgaatcagtaaggaaacaaaatctgacaaaaagaagaaaggtttaaactttttgatgataatcactcacagcatcttccatggacgcacgccaaccttgcatagaggataaaccatatctgagtttatgattttcgccatcttctgagaacttgtctgtttttggagtacttagatatatacccatctctctctgcaacgaaaaaattagacatttcttcatgaatcaaaaaaagaaactattcttgattacaaaaacaaaatcaaaagagaattttgacaatggacccctgtgatcttaatcttttagagctaattaagaaatcaatctacaaacagaaaccaaaacagagagggctgaatcgataagagttttaaacataccaagatttgaaaacgtcaaaaggaagtaggtgatgaagttgtacgagaagcttggtttcctcacatatctggctggagaaaggaaagacctttggtaggagacagttttgattagaggaagacgaagaagaagaaagttttgatttgggatcaaattcagattgtcgtagccccaaaaagaagaagaagagaaaaagtctgttttgttttgccttagaaaagcaacgaaagttcttaagattttgttcgtgttctcttacttgccagcacaacacactatttttacttaacactaatacaataatgtattacctgactctttatgatttgttttagctgtattgcaattttcaactgtattatatgtttcaaagtcttatggagtaaattgatatatcaaacacacatacatgtcttgtgtcttcattaaattctgaaaagttaaatacatagtagattgtaagactatttgtggatggatatatatatatatatatatatatatatattttcttaaagatcataatgtcaaagtttcctaaaatttcagttgtatgaacggtaacttactatttttcctccacacaagggtccaaggagacatgtgcaagtaataaatgcaacacacataggaagacacacggctaccatcttccaccatggcaacaatgcgatatttggcaagatttgacggactccatacattactctactaccaaatcaaaagtattggtctcaagtacacctaaatcactttgcaattagccagaccactgtttcacaactaaacacgtcttcacccaaaaaatcggtctacaaacttgggacaggtaaactttagtaaaacattcatgaaaatagtgagtatacttggatccatatctcaggtctaatccaaacactctttgtgagtctatgacaagggtatatataacctcattttggagtccctaatagcataatctccttccagattgattcatccacctctttttagacgtgatgatttactccgtgttatcgtattatcaatcatttagattactactaccaaagagggctcgagaaataatatcgtatagttgcaactttgttgcatgataagctttgactagtcttcatcaaatccatagcttttgcaccgctcagcttttccgtacagcatttttgtcaaatgccatttttacttcttttcaaaattagtgaatataatatggaaaacgtgttctccctgtgacctatggaccttttatgggtgtaatatttgtggatatggaatttaaaatttcttaatgaagctgctatttagcgttaatttttaagtagctctcccttttccttagaacgtgtaacacttttgtatatgtagataatagtagaacgaaaaaaaactctttgtagagagattctgcttctat

SEQ ID NO: 3074 - DNA, 3000 bp, Unknown
  misc_feature (1)..( 3000): cDNA_ID_1819356_gDNA_ID_1620623_Annot_ID_47083 3000 nt of promoter + ATG
tctctgtaaaatacattttcaaacagagttttggaatcttttgagagattattttatggttgtttctcgaatataaaatagagtacatgcctgaataaacaatgtggcggcgtggagtaaattggatctgtcgatctaactacattttgtttgttattgttttgttttgtagcgaaaattttacacaaattcattatagaataatcaagcatcacgtcttgtaggtgtcatcatgattcatgaagcatttctacaaaaataatagagagaaagacacatatgagctgatttaacaagaggaaataaaaacaaagaagagtgttgttgcttcgccagatctcatcagcttctgaggtatgcgacaaatgtgctcagacacaatctaatataatgcatagtactcaaggtacgatgtgtcgttgtgtttgagttaactttttttttggtttggttggtggttttgttaaaagtaaaaaagccaaattggtctactaggcttagcgtgaaaagtattgttataaagttatagagtttgttagcttttacttttaccaattttatcagcttttttactattattatatggttaaattaatactgtatctttccaccttttttttggcttatgagtgagtactcatccttaaaaaacttgagtaagtttatatttttctcttttgttaaaagagtaatgcttatattcgatgtgtactttgtaaaaaccctacaagattttaaggatggtccaaatttgaaatagtacacgtctaaaataattaacaacataattgaaaggtgggagaggcatgtgggagtgtgagtgctttcattaaagacagtctactttatttaagttttgatatgatctactgttatggagaacactcttcttcggctactaaaagctgcactagctgtctctggatatcgacaacatacttatcttatctattgccgtttcatttctataatagttagttttgccatgctcgattaatctagattttacatattagttttggcatagtagtgttacttatactccttttctaataatacatttgaaatttgaatatcacattgtttatacttctagtatctatcctctttaatttttctggttaaatatacctgcccccttatactttaatgtgtaaacatgctacaaaatcatctcattcacattgttagagaatggtacgatatgaaacgtgtataagtctctgtaaccgcttaaacttgtcgctatcttcttccgtgggaatgcgaactcaagcaaattccccaagaaaagtcatctttgctcttcacatacaccgacacctactaccaccagtgcttataatattctataattttcaacattgttgtttataatttggtataagaaagtaatatgttttttttgacagaaaatatatgcttagaggggttttctataaggtcttattagaatatgatgacaacattttaacgtctttttttttctctatctgggtgaagactacctttgcgacgagtgagagaggaggtagctagcgataaagtaatttttttttttttttttcaagtacttagcaatcaaaatgtgctacctagcaaattatcactattttttagtaatgtttaatatttgcatacaaaccctcttatgggcttctcgacgatgctaggaatctgatttgggcctaatgttagattagcccgtttgtgtttcatatagggtttctgagcagcctaactattgggctgcacgcttgaggtttgagtaattctactaaccaagtgttaattagctatagacatgagagacaataggtaaataataaactggaggccctttaatatgtgtacatacgataacgatgactatattatacagtgttagtcctacaaaattcaaaacttatttctatgttttgggacaacatgcttaggaataaatgatttttttttttctttttcttaaaccgcttaatattttttctttcatccagtttttagttgttgaatcttatatttgatttcatgttaatgcaatatgaatcgttatagtttatggatctgttaacgataaatttaataatctatgtttctttttagagttctatctaggtctatattcccaacatcttaatataccaaatagtacatatgtagaatcaaaaaaacaatctaatatagaatcgtataaacttaatagtgacaaaatcttattaaaattgaatcttaccaaattcttatttttcttctttaatatgtcaactacaaatttctacatatatttgtttttcaggattttatcctttatactcatttttattttatttttcatatgcttcatgtgagtctggttgataaaaaagcaaataatactcacaaaatatataaaaatcggatatgaaagcaaataatgagctaacctgagtttataatctaaagtaaaatccgaaataaagggaaaaaatcgcaatactggatttccttgatttttgtattccatttttctataaaaaaattccataaaagagaaagagaaataaaaataaatgaagaaacacatctcgtcaaatagacgaccaactaataaattgccgtacaccaaatattaaatacatcccatttttttatttaaagattatatatatatctttttaacggcgcttgaggactctcctatttttctttacttttttttttctttagttttctgtaaactgttaagattgagagagagcgaacaaaaaaaaaaaaaagagagagcggagagaagaaaaaaaaccctagcgtgttgttcagtgactttggggggaaaatttctcgtagtttcttcgctaaatccgtcttctcatctctttccatttgtggaattcaatggaagctttaggtttttggtgctgagaattctctgttttcgaatctagggtttgtagaggagatctattcaattgtagatacgcaagagcgaaacgagtcagaaaactaggagaaggagtcatg

SEQ ID NO: 3075 - DNA, 3000 bp, Unknown
  misc_feature (1)..( 3000): cDNA_ID_1819348_gDNA_ID_1620623_Annot_ID_47085 3000 nt of promoter + ATG
gtcttccttcgccaacaaccgtacctcactcgccgccgttattttcttccgacagtctcctccgtcatcgttatcttcacgcgccgccgcagctgattgtaactctctgaccacgcgcttcaaaacctcaagagcttcctctttcttcatcgtctcaacatcagcttcaacttcagctagattcaacagatcacaaagcttctccgatttcttcgatgtctcctcgaacgctacgccgttcaacgccgcgccgatcgtattagctttcgcatctttcgatgatgcaactgttgacttcgccgtcaccgtcacgtaacttccttcatcgtcctcttcccggagctcgtgacggtaacgtgagctaccgccgcaactaacggcgtcgacgatctttctacggaatgtggatctagagaaggtgctccagagacggaaatggtagccggaagtagaagaagaagaagtggaaggagcacggtcaagaatgagagatccgatattattccggtgacatttagccatggttgtgattctccgatcagttctttaagcttaacctacttactacatatgcaccaccaacaagcaaagagagagtgcgaaagatttatatatatctttttatttttttgtaagaaagaattataattatttgtttgtttatttggaagcgaaaacagagcgaatgttgactgttgattacttctttttataaagaacaaaaatttgcagtacttattgatttatcaaagaataaaaaaaaaactgtgtttggatgcagtcttataataaatcgcggataagctattctatcaattattttaagtcaattctatatgcttttttcttcattgatgattttttaaattgataacgtttatgaaaattgtttttttttctttgaagagaaaatgtgaaagtacaagagaggggtgagtgaggccatcactaatttcaaccgttcaaaatttacaaaatgtgtgtcagggaagcttctacagttctacacaagtcccatcattttgatgatactaaatcagtagattgctactactattggggctttgtttatgattctttttctataacacacaatatatttcattttaagaaaaaagaatttctagaagaagtttatagctctaaaaatggtccaacaaaaccaccgagaaaccaaaatttaaatcaatgtttaggctcttctacaattgatttcagtaattttctaaagagtaagaacccctttggatacgtttctgtattatttatttttcgtaaggtttggttattttaggatggctctacaaaaaaaatacaataaacatctaaaataacttgtatcaattaaaaataaatatatgcaaatttcatgctgcacagtggacatccagtggaagtattcgagaatgatttaactgtgttgtgttgtttggtcagatcgctgctaattgctattctcaagtctcaaccttcttttactggtacgcactcaaagcccattatcaccgaaaacatttcggtggatattttaataattctctaattgataagcgtgattttatgtcaacttacaaggcttttcaaagcccaaaaagggccacaggcccaagcataaagagaaacattcacaccatatctattttaaagattaataaaaatgaacaaaactgattttaattgtaaaataacaaaaatttgctttcattgagagttgaactcaagacctcccgcttactaaacgggtgctctaaccaactgagctatgaaagcttttgctgttacaattaattaaaatctatataatactttgtaacaaaactttttttaagtgttagttaatttaaaaagcgttaatcaattgaaatgtggacctcttaaaaaaactaacaaatacaaaaatgcaccatttgtccatagagtattggaaactaagtaaaccatcttcatactattggtcacaaccaaatccctttccaatttgtaacggacgactaattttggttttgtggtcaagactcaagataatgctaatttttaaacaaaattacagtgcatgaatctaatctttatttccttcttcttttataacctttttcatacttaccatttgcatgcctctctttaatatttgttttattctatagaaacaaatcacattatattgcattgaatagatttttatttaagtttcatttatttgttttcagacacatatctttagatactaaagatataactaaatatttaaatcttatttctggtcaacccattcagacaaagaatcttaaataaaaaaaactttaaattaatttcttccctaaatatgatatatattttttaattatgttacataaatgtatatatacaatataaatttatagtttttttttggtaagcatataaatttatagtttgaccagtgtcaaggaaacttaataaatcaaacaactttttatactaataaaataaaataactttttgttttaatgatatttaaatatttaattattcaatatatggttattttgataattttattttaaatcatcatcgaatttcttgttgaaatttcaaaattgccgcgtaatcttaacggttttaggtacaatttcattcacaaaaaccactaggactcacttctaaaaatttctcacagccacaactacatctgcatccccttctggttacaaattaattcacctttacattgaaattgacaaaaaaaggtagtgttatctccataaaacaaaattaaaaggaaataaagaataatgaccactccctctctatatatataaacagacgtttatcatatccttaagaatcacccctcttgcgttttagctcccttgcattttcttcatcttgtacgctcctccttggtcttagattttctgagatatttctcttttcactctttcttgttacgattttatctaaaaatttaatgaatcatatttactgaccaaacacattgttgtggttttttcatgcagagaa

SEQ ID NO: 3076 - DNA, 3000 bp, Unknown
  misc_feature (1)..( 3000): cDNA_ID_2105406_gDNA_ID_1620623_Annot_ID_162413 3000 nt of promoter + ATG
tttatctgaatgtttacgatcttaccccaatgaatgtttatggttactggctcggaattgggatctatcactctggtctcgaaggtaaatcgttttttttccttctcgattctgggtttgattgttgttctaagattgcggagaaagatgagacaatagtaggtcaattttgttggattgtaatattaattgttgaaaaaatccattgtctgtattgttgcttggctttgtttgattctaaagtctgctttgatcgatgaaaactatttattgttaaagagtagaattgacttttggtcatagaatcgatttagagactaaatgtgttttgatgataacaacttaggagggtagagttttgtggccgttgtttgaacaatgactcagtcacacacacgccatacgttgttgttaatcctatattgaatgttctctcgtggttttggctattccttgtttgtagttcatggggttgagtatggatacggggcacacgagaaatcgagctcggggatttttgaggtggagccaaagaagtgtcctggtttcacattcaggaaatcgattcttgttggtgaaacagagatgaaggctaaagaagttcgaagctttatggagaaattatcagaagagtatcagggtaacaagtaccatctcatcacaaggaactgcaaccatttctgcaaccatgtttctttgaaacttactcacaaatcaatccctagttgggtcaaccgtcttgctcgcttaggtaacccaaaacttcctctacaatagaatctttcaggggatcaaataagtaatgttgtacattggtttcttttgaaccttcttaaggtttcctctgcaactgtgtcttgccggcttgcttgaacgagactaaagtgaagcgggtaggaaaagacgggaagctgctcttggaaggagaaaatacgaagaagaagaagaggaagaagaaaatacgaagaagccgatcaggtcctttatcttcgtcttcttcaaatgcaagattagataatactcctacacataacagatcaatatcaacgggtaatcctcctctttctgcttctccatcttgtcctttgagacctcgacttccttctgttgcatctggagctgaagatcaaaatcctccaagcgtaagcgtcaagacatgattatttttcattgtttgaacagctgctagttatatacttgtttatgaatgcgaaggtggtgcttgtgctttgttctcaagttatatatcctccattcgtttggttatacttggtataatttacttataggagaatcatgaatctctctctgtagatactaactgtagagtgaattcaacatttgtttgttatgttttgatgtaaaattttgaaaattgtacgaattacttgtttgaatatcaacaaatcgaagtaaaatagctaaatattttggaaacaacaagtgttttattttaaatttctaattaattcttaagcaataagtcccaaattttcacaaatagagtttttattaaaagaaaaaaaattgatgagcgtaaaaataaaaaaataatgaattttattttattttattacagaaccaggaagtggcataaaccctagtttgaccttttcagaacacaactcactataaatacctatcaaaggacactcttccgcagctacaacgaattcccctggaaccctaattcaccgttcctgtgaaaagctcgcatacataagatctgttctatttctcgctttttgtttctagatttcagtctttgctatttcattatcgttctggtttttatatttgttgaaatctgttatgtaattgaaactgttggctctgccattttgattgaagtgggattccttaggctttgattttggttagttctcagatttaggtttaaaggttcttgttttttgatttgaagcgttatagcaatcccaatgatgacttattaagattaaaaatgttaaaagtagtgactgatatcttttgatgaaattttagctctgagggatttgatttgttctttgtttccttcttacattccgttgttggacatccattgtgggttaatttggtgagtttttgcttttgcttgcttgatgaagcatattgatgcacacgaccttagctgcatcccaatgatgaatgatatgaaaaaaatgttaaaagtagtgactgattataccttgattactagtcaattctgagggattctatcagctaagctaaattcaatccttttgcgccatctctttgtttacttaactctctatgtgcccttcgatgattaataatatattaatggttaaaagtagtctgatatcttattgatgaatatttcaaatccgagggcttaacttatttcttataaaagttgtgactgatagcttgtgcacaatcttgttttcattcttggtatcatctaagagatacctcaacgccagcttctgcagtgaagtgcaatgtcgtaagtacgattccacccggcagaagaaatctctctcgattgcacttcatctgcagaagctggcttttttaggcagtgggagtgatttttttggcagaatatctccattgtattatgctcttttgttttccctggtgtgcttgaccatgatgaattcgctagtggttcacaattttgatagaatagttggattaaatggataacacagcgacaccatctattaatgatacaaccaactaaaaatgttattgtccaacctcaccaccaaatcatctttcgaaagctttcctttgtcttgttaaaatcaactatttaaagatgaagtatacaaagcttagcagtacttgttggacccacgtttgatatttttggggttgagatgtctgcaagcgtctttcttaaagtccaaaagaatgtgtgtgaaacgttgactttctgcaaggtttaccactgtttgtgcgcttagcttcgtttggagaatcttcttcttctctttctttgtagaccggctttgctttgcatatgagagg

SEQ ID NO: 3077 - DNA, 3000 bp, Unknown
  misc_feature (1)..( 3000): cDNA_ID_1819281_gDNA_ID_1620623_Annot_ID_162411 3000 nt of promoter + ATG
ttgttgtcattgggcttctggcccaataggcctttgtctttgttactcacgacactgtcgttttgagtcttcgtttcgacttctccaaagggatcttgaagctgtctggattcagatcttgaaggtgatgtcggagcagtggaggtcatgctaatatcaacaaccaaacctgtaagcatatgagaagcttccaataaaacattcttaaaatttattttcaacaactgccaatgtattaaaaaaaagcaatctcatgaattgcctacacgctaattaggcgggcgaaatttgttttatgtgtatgtggtatggtatttgtttttcctcgccatcctttcctggtaaaaccaataattttttatatcacatataaagttacgtgctgaacgaaacaaccgattattattaagaatccatgttgaaatagagaaaatggattgtgtgaatagaaaaacaaaaacgaaaagtcgacaaaaaaaacaaaaaacagaaaaacccactaaagtcaagcgttttgtttcaaccatgttatagtttagaactttataatcagaaattaattccacgaaaatgaataaatgtcagcagtcaaaccagaccattaaaagaaacaattaccattaaaagatatattgactaacaaaatcaatacaaacctttgcgtccatctctgttatggacacagttgacaattacaaaaaccctccatcttcctgtctctctctatcatccatgacttttttttttctcaacaacaactaattattatccaaagttcttagataatgagattaatacatgctatttcttgcccaactaggcacaatagaataaagcttaggatcataattcaaaaatgaaagagactcccttgatactctgccaatgtgtgccctctcttggtatgaacacaaacttgacctcttcaaattgggggagcaacctctgcagatcatccatgacttaaactgcacaataattaaaataggaaacttaagttcatcaagagagaccaaaaatatcacaaaactcttatttataccatttctattggcaatatttaatagttttttataattaaaataataaaataaaagagaaaaaaagtaaaaaaattctcgcttgaatttttttgaaatactctatacaactcatagtgacattttttttttcaattggttcaatttttttttactaaaaaaaaaattttaattacttttttagaaattctttggggttctccttgatggaaaaagatataccaaaataggtaaagattcttgaacaatggtgtaccatctacgacttcaccgaagtgagctaaagcatccctttaacgttggtaatcagttacccatgacacacactggacatttaccttcatcactctggtcgtcctgagacttgaacagtttcttgtttctgttatcatttacaacataaggcccacttcttgcccacacacagtttattactcatcaatttctctaatatactattactctataacaacaaaaaagtaacattgtaatttgtacacatagcgtttgatctagctagttctatatgtagaattgatgttagcaagtgaatcaaaattttgcggagatgatgtttgaacatgggtttgttcattgtgttacccacacgaagccaatttgattgttcgtccagatccttgtaaaaagaacacatatggatcatttagtcgcaacaataaagaagatgtatcagagctacatatgtatgtttcacagtatttctcctctcgattaacaatgaactggtgcaaggatcacccgattcgttcttgagggaagtatcttgggaagcagatcgatttagaggcaaagagggctcaaaagaaatcgttgatgaaatcgctcaaggtctcgcttgaaggttcgcagtttcttcactaatcgtgagcctttttaaagttgcagtaatcgttgtatgaaacaagcgtgcacggtcatagtcatgctcgttttctcgaggcagcttgacaagagttaaattatggtgatggataattagtgtatttttgaggctgtctcaactgaactttcatttaatgacttggctagcgatacagaaccgtctagccacaaaagagagattattaaagtggaatggcgaggcaaatggtggtagtgtgttttgtcaaacggaaatagaaacaagagatcacctatttttctcttgttcatactctcatgcttggtcagctcttactatgaaatatatgctcggctctcgcttcacgacttgctgtgattctcttgttgccctatctacgaccttttcctctccacaacttcatttgtttgtgtttagatatgtctttcaactcactatacacaatctatggaaagaattaaatgccccataactcagagctcccacttctttttaaatcttgttctattaagttttcaaaattttctcggttttatgttgaatttattgtaaaaccgtttttgaattttaaactcatacaaaaacaaaaaaatataattagtgtattttaaattatttgtgttttaatatattttttattttatcttttaaaacatgttttttatttgagttattattatgaattcagtattataaagtcatatcttcatttcaatttttttttgaatataatgttatataatatttctaaacacaagtagataacgttggtcaatatttggttaagataaatggtggaaaaatattcagaaatgttcaaaaatgttcgaccattttttttatttcaaaatgtacgtcagtaactatcgattttttttgaccatatacaatttgcgacccccgcctttcgacgacttgcttttggtcaaacagcagtaagataggcgtatgtctcatgcttacatggtattgaaccgataatatgtgtgtgtatatatagagagacagactatactttttaatcattcaaaactagaaatcaccaaacacacatctcttttgcacgctcaaaccact

SEQ ID NO: 3078 - DNA, 3000 bp, Unknown
  misc_feature (1)..( 3000): cDNA_ID_1819267_gDNA_ID_1620623_Annot_ID_162405 3000 nt of promoter + ATG
gagctcattcaatggttgagaaagctaaattcattcatctcacaataaacacgaaatatttcgatgtttacacatcttctaattaaactgttttatcagttaaaagtagtaatattggcttattgacaaaaaaaaaaagtagtaatattggctttagttacttttatctgaaacaaaatgtacaattgggccttagatgagtaataaacaatagaacttgggcccaaccctccaccgggatgtttaataactgtgtcttttagtgtggttattaattaaaaaattaaccccttttggtgtgagccaaagaaagaaaaatagattaaagtctttcatatacatcaattaaaaaatgttcgatcaattaaaacgagccatgatgaactaatcatatacatcatcatccatcgtgaaaagctagctgttagttaataattacttaataataagaaagaaaaagaaaatgattgttattacttattagtactgctatatactactccatatggaatagtaactgctattatctggcgttctagagttgacatttaaatgtcatagttttatttagatgtggaaaatctagtaagagtaatagagtaggaagtgattaggaagcaaccgaacaagaagcatattttatgaccggtgtggttagcccttgtgggagacaagattacctcaatttttggctaatcttgattttcctcctccattttattattacttattttctttctttttattattatttttatcagcatctttctctttaattatttttcttaaaattaaacattacaccaaagtgttgctgttaatttctcatatttaaatgtgaatagatatatactatatactaatatacatgtgtgtatcctatatgagaccataagccaatgacagtaggtattagctaatgacaagtgacttccaataacttattaagaagtagaatctttacagatttgatgtttacatggatcttctagaaaactgatttctttaatctctctaatgtcatctgcaactatttaacatacacacacacaaaataaaataaaattggaagagctaatgataatgatttgtattagaaagttgtcctttattttccaatgcattgcatcgaacatatgttgatgttcttttaaaatcgtaaaatctagttctgtattcttttattctaggtttatcaaggctttgtcacaagacaatgagaatacaacttttctctaattttcttcatatactaaataaattatcgtagatttgtagaaggttcttaggctagattcaaaaagtcatttaggatctctttctagatcttgcattttttttagtaaatcttatgctggtgatacttttattaaaccttatgattctaatttggaaaacaaaactaactgataacctattttacattaataaaaacgatgcataattgtaataatgttttatttttttatgttaataagctagccaaaacatattattgatccgaagtacgctattttctataagaaaaggagaggcacggaaatgaacacgctgtgtggttaatccaagaaatcatacaaaattaattcataaactataataaaatcattgggatcttattttgcacccaccaagcttgtaggctgaagatgcggatggaacccaacttcaagaaattcttgccttttgttttatggcttttttttgtcttgtcatagttatataaatgtattttgctaaatttaaacggacaatcaaataaataaataatatataatttgtagttaacaactaaattcaatgactaatatcatgtaacaatagacttgtgacagcagttttctttgttgacttcaaagtttaattcgagcgtacgatacatttggtcggtgataaatatcgtgctatgagtttaatttgttgacttgaaagttttataaacattgtgaaccattgtaacatgtgtttcttgattatacatattcctaaaattaatttcatatggtaagagtgtaaaattatccaagtaatggtgtaaattttaaaagtcttttttttttttttttttcatcaattttaaaagtctttctctgacgttaaaaatagtcttgtcttaggtttgaataatatcggcattagccattattggtcgttactatgggatacttaattttgctaaatctttcagaacctgtacgagataagcgaaaaagccatgaaccacggtcacgcgtgtctcgcacttcccaactttcaccatgcatgctctcactaaagcctgtctttttttttctttcttttacatattttaaaatcataataccataatttgcactaattcttatggtaaatccgttttatgagatactcaacttagttgtccattccttaagacacagattaaggaaagtattcaattctttttgaagttatggtaataactcaaattcttctttcctgccttgaatacttggtacaatatcacaaacatatctctaaattaattacatgatctgcagaatcatttacataaacactttcacatttttatccatttaaaaaaaaaaatattatgatcctctttccttttcaattaattatcactaaactaaaaaatattattcccacagtcaaaagaaaccaaactaatttaaaaaaggtggcgcgtgattatcacgctcaaatgaccgatcggttccactgaattttctcagagattctcctctgaaaatgttttttgtttttttcttatgtcaaaaagaaaatttaccagaaatgattaaaatttgaaaagagaattccataaatgagttaattcgccagtcttgaagatcattacagagttttcagaaaccatatgtagtcttagattctcttttgccaaagaagaaaattttactctgccatacaactttttgtctctttctctactaataataataatccgaactttgtttgttcttctacttcaattcataatctttgacggcgatgactatg

SEQ ID NO: 3079 - DNA, 3000 bp, Unknown
  misc_feature (1)..( 3000): cDNA_ID_1819344_gDNA_ID_1620623_Annot_ID_162404 3000 nt of promoter + ATG
agcaaggcagagttgaaatggctcaatcatacgatcaggtaaacaaacacattcctattttcgtggatatatagttacattaagaacccatattaacttatctttctccacacattttcagagtgttaatgagaagtcaggtgagtcattccagacatatttagatattcaaccgctgaatcgaatgccgagggagagctttaagcctctggaacctatcaatgaggaaataagcactaggctaagcgttgggacagatcatgatgtagagatggatgcagcggataacatcattgtgctggattgacatcaaaaatcattattacttctttcatgattgtgttgatcgttggctgattttctttactaagataccttttgctgatttttttttttttgtttgtcaaagttaccttttgctgaattttaattactaagttaccttttgctaaatttgtttgcatacagcgtagttgtcttgagttgcagagtatcatatttgtccatttatagtttcttaggtataaagcgtatatgaaccaaaatataaccaaatatattatggaaactaattgaaactgaagttatgatcatcttgggttttttcatcggataagtattagtttaaactagattgaatctactactcttgatcaaacaagcacacacaacttgaaataactccaaacaccatgagttcatagaaaatgatttcccactaatatctttgttaatgccaaactttatcattgcatgtcttttgcattaaaaatacttcatgggtgatgatcatcttcttttaattgaaccaaagaaacgtcttttgagctctctcaaaacccaagacacacatatgcatatatttatataaactgttgatttctctaatttagatatacatggaaagaacattccctaaccatatcaattaggttggatttgatcgtatttattgttctataggatatattagtaaaattaagaaacaaaagaaatagaaatgggaaatacaaaaagagaaaaagagaggagctgcagaaaacagggaaaatggtgggaaagaagagacaaaagagaaaggctttaaatccacgcttactccaacttccaaacatatacctacttctccactcttttccactttactcttttatacctatacccatcttatattatattacatgtacaaaaatattgttttcagttaaatctgcatttattctacagttcaacgcgattactgtagaataattttaagccaacgactgtttggaactaatttttcagtttgatacgagagcaataacaaaatttcaaagaaggtttttttggggttaaatgtcaaaccaaaactcgttttagacagtaaaaaatatatacgattaaactatagtctaatacatatacaaattttactttgcatatacaatttaattcttagtaaatccaaataagaatctaaatagatgataatgatcaaaatctgtatagagatgcacatagtaacttcgtgaattctaagtattagactaaattctcatatacagcatgcagatatgtcatatgcatgcatacacatttttacgcatttcagtccgtacgtatcgtgtatatacggtaacgatggttggatatacatgtgcatgtttcaaagttatgtacaccgaagggacaagctaggctgtgatgctcctaattcaagcttccttcttacgaatgtcaacttttatttaattttctttattgtggcctggccgaataatcaaagatataataaatatttagaggcaattattgattagtgtcctttaattctccttaaattgtttggtttttggtcggttggttccgagattttattttctgtgttaaaatgttactaaccaataacggttgaccctaattataagttctccaacaagatgtgaacttatttgctaattataaacgtgaacgctaaacataaacggaagatttatttggtttgagtttggcgtctgcatttacatgtcgtagtaatataaatttacattaaaaattaatgtttctatattaaagatgtgaattatttcgttttttcatgcacataaacgcatatgtattgtgttgaaactagacgaggctataatgaagacaactgttgtttctttttatctgcaacaatagtgtatatttgaccgttaatgtaataagttcatgataaggttgggaggatagcttccccgtgatggaggtcgtagggtttgtatgattgtgtacagtcttttcatttcacctagctaaccctattgacgcattgtgcaagtgtaagacagttcatacttcgtactactcttcaattatatatatttacaccacattatcaaccaaaatatatgtatttcaatccaactgtatactagacttttcgaaactaatataagattaatgttgaattatgttttcttcacaaaattctagcattagtacatttgaggtgaaaaaacacaaaattcatcctaatgaacacataaagaaaataaaattttaaaactcttcttcgtcaccgaatatttacaaataaaatgatatgtgtgtgtgtgaacctaatttaaagcctatgccaatgagcacatataggcttttgctctctttttttttttttttttttttaattatcacaatagcataaaatatgcaaaacggaagtacctttacaatcatttgtattcgaatttaaataaaaatgataaaacaccaccaatagtaagcaaaagataattagtgttgaaactaatcatccgtaagcatatagagcacttcgatgaaaattagagtattaaataaaattaaaataaaccctcaaaactatctgaagagacacatagagtggctccttggcatatgattaagctcccttaatttatcttctcgtatatatataggcattacacatcttacttattacattcacacacacccacattttacattcaactcttatacaatatgcccatgtta

SEQ ID NO: 3080 - DNA, 3000 bp, Unknown; identical to SEQ ID NO: 3074
  misc_feature (1)..( 3000): cDNA_ID_3092745_gDNA_ID_1620623_Annot_ID_162400 3000 nt of promoter + ATG

SEQ ID NO: 3081 - DNA, 3000 bp, Unknown; identical to SEQ ID NO: 3072
  misc_feature (1)..( 3000): cDNA_ID_3070694_gDNA_ID_1620623_Annot_ID_162396 3000 nt of promoter + ATG

SEQ ID NO: 3082 - DNA, 3000 bp, Unknown
  misc_feature (1)..( 3000): cDNA_ID_2160942_gDNA_ID_1620623_Annot_ID_162390 3000 nt of promoter + ATG
taaaaaagttgagccacataagcattaaggataaggtacttttaatattcctgtatttgagaccatatatcttttattgcgtggaacgaaatgttttctgaatcaagtattttggaagacgaaaagataacatgaagaatagtgaaataaaacaaattattctttagttgatgtttgtcgcagtcacaatgtcaaatgtattcaaccaactcgaagactttagatacggaggtaacagatcatataacgagttacatatgaccggcatataaggataagtcaaatttgtatatatgtgtacttatcttttaagcgaagacgcagacacacagcaattagttaccattgaaataattaagccactgggggaagcatgcatgcttgtcaaccttcatttactacttagtctacttagctttgggaccaatatacattacatctccataattacgttgcgactcttacgatacgtgttttgtgttcatattatataattgagcaattaatcacgtggaaacagctacggcacgtaaggaaaattgacatgcagaccccaccaagttacatactccgataaaaatggctaaaaacattaaaaccttctaaaccaaatcgggtccaatcaagatcttgactacgccatttttgttaatgtctcgagaaaattgaaaccacaagtagcaggtcaccttaccctctctttaagagaaaacaaacaaatgaacacacatgttttgatgatatgtctgtttatatactccaattttgttgacaataacttgttctgcataatccaaaagcgaataataagtatccatcctatccataaggtttagcaacaatctttaattagattattatactgaccgactgagtatactgtagcttgttgtgaacactatgttgatatgttcgattattttaatttgggatttttgtgagacacgagatattcatgggtatgaaaaatattcatagtgacatcaaaaggagaaactttacatgaagcttccattcagacaaaatgacgttcatataaaattaggacatttgcttttctaaaaagtaaaatctaatatacaattattagagtcatctcaactatttagaattagaagtatagttgatgttttgttttgttttgtcgagccgagttaatttcatctattatctgtggccatgcaatatgagtgtgattccccttataagtattgtgcatactttagttccacaattattgacttgtttgatatttctattatagtacagtagcagattagtccatgacattataaagaaactaatcgtgttttagaaaagccttttttgcatgcaaagtcaaatgttaggaaaatgcaaagtctgaccgactcgtgagcatctagaataacggaaacaaaagtcaaagtgtctctctctctctctctctcggctagcgggttccgttgggacggactacaaaagactgtaccggcgcgtcaattcacaccaactagtacgaagaagggaaacactgattacacgtgtcgagtgttcattcgttgatgtacaagtagcggaactaaagcaaacggagtagggaatgagtcaaagcaagtatggtggtgcaaactgctattgactgatgcagggaaatattgttttgttaagagattttttactattatctactactagtatataacaaaagattatgttttgggaaaattaatctagtgcctaagtttttgagcgaaaaccaaaaaccaggctatgactcagtttagccaatgtacttatttatgtagtgttggaatattatcatcatatgtgtacttacttacctttatcatatatagatgtatagaagcagatacatagggttaattaaagactacacgagacgagaattgagctgtacaatgctatagactatagactatatagtaattggagagatctctaatctacagagaaaataaagtactacatacttcattattacacacacattaaaacttaagacgtaaagaataaatggaagtgaataaagaaaggggataattaataaaaacagttgttaattagtaacattcaaacaacttagctggctaatttagaatatttgcaagctagattcccactcccttttctcttgttcccctacagttttttctcgcttccctttatatagaatataagtatatacataattgttcgagacaagttcgtcagaaggaaaataaatcatcatcattcctcatcccttcccgaagctgctctaaggaaagagatccactattactactactatacatatataactataaaaataaataaactttcattgagatttgagccaaacagagaagaagaagaagaagaagaagagaagatctccagcggatcagtccccgctttaaaagcattggcggcgtctgatttcatttctctctctctctctatctctctttaattccctcaaagacaaagcctttttctctatatatatatatatatctctctatctttcgccattttggtttttgcttctctctgtgtgtgagtgattatgatgatgggattatctttctaaagctttttgttttcctgaaaaattaaaaaagaaaacttttatggttcttcttctcttctgtgttggagttgagagaccaataaatgctgttagtaatggttagttgagatgagaggtaaaaagatcccgtagtccgaggagtgtttggtttcttgcaaaaggatagtgaggcaaaacatgggtttggtttctcttgtctcctttcattcatcccttttccattaatggtctctccctcttccaacaccaacctcttcttttattaactaacaaacattttctgcctttttctcctcttctcacttctctggttcttctgtgatttgatcggttcttctaaaaagagagagagtagaagcttcttaaagctgcttcagggtcaaacaaaagtgtcttccttttggtaaacaagacgaagaaatatg

SEQ ID NO: 3083 - DNA, 3000 bp, Unknown; identical to SEQ ID NO: 3070
  misc_feature (1)..( 3000): cDNA_ID_3092755_gDNA_ID_1620623_Annot_ID_162389 3000 nt of promoter + ATG

SEQ ID NO: 3084 - DNA, 3000 bp, Unknown
  misc_feature (1)..( 3000): cDNA_ID_3070698_gDNA_ID_1620623_Annot_ID_162387 3000 nt of promoter + ATG
aacaatatccaacttgaccaatatatctttattgttcgtcaactgtcatcgatctatatcactttacgtataggattaatgtggcgtaaaaagataaagaagtttggtccaaatttcaatatcaaacttctagtgatgagaaatttctatttggtctacatcggggaacagatcattccacttatgaatccccattactaattttccattcctattacagacgttttacgtagtagggaatctagtttattaatatacatatcacatagattaatcttgattgtttcgcaaattttaatggttttcggaaacaaaaagggggtacaaagtgagctttccgaaatagtgtagttcccagcatccaaatctctcaaaattccttccacaattagaacgattgttcgttcgttcgttttcacaatgtatctcgacctcttttagcaagagtttgctactaaactcgaaccaagtggaaacatgtgggttttgcaatctaaattgaatttgttttgtcaaaaaaggttcttatatttagtacactgtaaaaaatttcgtttctaataacataaatacctagtatagtgtaatggtgttcagagttagcatgcaaacttgtgttaggaaaggatatcaaaagtctcttgtttcaacaatttttattttatattcaaaaattattatgatttgatctttcaagttgattcaattcatgaagatcacataaagcttcttctctgaaatgaatgtcacatggaataattatgtattgaagagcaaaaaccgcatatagtaacctagcttaaaccgaatatacccgaagtcaagactttaatgagaatcagactaaatcctgaatttatttgaaaacaaatcatatgatttggtcttcggtccggtaaaaaaactcagataagtttgaaaacaagttttaatatttatactatatgattccgtcttaatcaaaattgtcaacttacatcaataaaatcaaaactcattttaactagattctaagaatctcatcgaacaatcgatctttgtaaatcttcatggaatagtggttagcatttgtatcattgagtttgaaagaaacggaataattaaagatgacactaaattcacaactttgaacaaacaaacaaaaaaaagtgacaagaaaaatagaggtcggtgtcggagccgcccaaggtggcaacttgttcacacctcataataaaagcttctcacaagttggaagtcgcggtcgagtccagtcaagattttgttgcccttttcccgtgtgggctcaccaccctctttgtcttcttctccccaaaaattttccacgttttttgtttcactctctcaatttatttatattttttttgtcggctcatatttaatttgtgttaattaacacttccttgattagaaagtttttttgtaccgacttaaatttatcatgcaatgtgattggtcgctttcccaaaacaatctctcaacgacaaaaaagtagtaattagtaattaaatacattatattttgttgttaaatagtactcattctatttcaaaatataaaatatttaagtaaatatcacacggttaatgaatttaaatatataactcaagtatagtactaaaaagaatactttaacaaacaaacagaaacctattgtacagtaaaatatcaatcagtgaattattaatcaaatagtaagggaaactaggatataatagaaaaagaattgccgacctacaaatcagagtcaatggtcaagcaagtcaagggaaagttcgtaattgttatggatctggagtctggacaaattaaaaaaaatttgttaaatagaagaggatataaagggaacacagatcctacatattgaaatttatgtatgacgtccaaatttttcttcagcatgggacactgccccgccgaaattattgatttttcggatctttcttctacttgcttcttttttgtttgcttttataagttttgcatagctaattcttaatttcttatcatttatttctagttggtagagacttataaattgaacgtttcaagtctttggacggtatttgagatttcttgtaatttcacttgtaattgtaccacctaacagtgactaaagcagaataaattacgattcgtatacaacaaagtattcaaatttctaaatgtggatatattattgattttattttgggaaacatgtttatgataatcacctatatctcctctatagtctactagaaacgatatttgtcaccttcatcgtacaagactataatgtataattctatccataatgaacgatctagtttttaacatgtactatagagatgaatgattacgacagtaaatttaacccatgcatacgaaaatacataccgatagatataacacaattcagaatgttttacacaatcccatatttttagccaatcagtgtgattttaatagacagctttctatgtcttgttgtgctttttcttcttctttttttcccaaagtctttaatgtcttctggactttatagaagacagctttttatatgttatcttcactttcgaacgactttccttcctaacatatcccaaaacctatctctttaatttattcctatcgtacttacagcttttattaaaaaaactttcttattttaatcactaaacaattaataaaacatttatttatgatttttcattttcgttaaagctcttttattaaaaacttaatcacaacaaatttattaatcttaaatttgaccttaggataaaatttatatattaatcttatatctgttatacattaaataaactttaatttctgcgcaacaaactaatttattatttatttcttgtctctgtctttgtagttttagtataaataaagccattttgctccgaggaacttctcattcagtcggaccaacttgtgaccgaagaaagcaaattgagactacgcaccaactagtcctttggtttgtatcttaagataaaggtttctttt

SEQ ID NO: 3085 - DNA, 830 bp, Unknown
  misc_feature (1)..( 830): cDNA_ID_2107050_gDNA_ID_1620623_Annot_ID_162384 3000 nt of promoter + ATG
ataaatcgtctgagtcggattatacttcgttttttcataactctttttcagatacaagaatcggttgtttaagaaaaaaagaaaaatcgctgtttaatgaatcattttaccaaagaacccatgtagactatctatatctatagtattataccatgtggcttggatcgggtccgaagtactataagcctaaggcggaaaatcttttggttgagagaattgagctaaaatatcaatccagtatataaaaaacatataccgtatctctattcattataagttggttaaaaccattcccaaactcatgataatcactctctcaccaaaaaacaaaaatcaaataaactgatatatatatatataagaaaaacttgaacatttcctcacattgttactctagattttaaaggtgatagtgatacaatggctgataaatgtgctaaaatttgaaattaatttgtccattatgccgacatccatttataagcttttaacatgatactagaatcaacaaataaatatttttattattttatttggaaactattaatgagtacacgatatttacatttacataaattggttgattggttacctgaattttggtagaaattgcccacagaatattcggataagtatttcggtttagccaaaagcagtgtcgtcttcttacacaaaaacaacaaaactccaatcgtcctccctcgtcctgaatccatccatcatccactctcctcttaaaaatcctatctttgtggtttgcaatctctcccacgacgcgcttcatcattcatggctatttgaatctctcttctctctctctatcaaatatg

SEQ ID NO: 3086 - DNA, 3000 bp, Unknown
  misc_feature (1)..( 3000): cDNA_ID_1819344_gDNA_ID_1620623_Annot_ID_47086 3000 nt of promoter + ATG
ccgttgacaacaagcaaggcagagttgaaatggctcaatcatacgatcaggtaaacaaacacattcctattttcgtggatatatagttacattaagaacccatattaacttatctttctccacacattttcagagtgttaatgagaagtcaggtgagtcattccagacatatttagatattcaaccgctgaatcgaatgccgagggagagctttaagcctctggaacctatcaatgaggaaataagcactaggctaagcgttgggacagatcatgatgtagagatggatgcagcggataacatcattgtgctggattgacatcaaaaatcattattacttctttcatgattgtgttgatcgttggctgattttctttactaagataccttttgctgatttttttttttttgtttgtcaaagttaccttttgctgaattttaattactaagttaccttttgctaaatttgtttgcatacagcgtagttgtcttgagttgcagagtatcatatttgtccatttatagtttcttaggtataaagcgtatatgaaccaaaatataaccaaatatattatggaaactaattgaaactgaagttatgatcatcttgggttttttcatcggataagtattagtttaaactagattgaatctactactcttgatcaaacaagcacacacaacttgaaataactccaaacaccatgagttcatagaaaatgatttcccactaatatctttgttaatgccaaactttatcattgcatgtcttttgcattaaaaatacttcatgggtgatgatcatcttcttttaattgaaccaaagaaacgtcttttgagctctctcaaaacccaagacacacatatgcatatatttatataaactgttgatttctctaatttagatatacatggaaagaacattccctaaccatatcaattaggttggatttgatcgtatttattgttctataggatatattagtaaaattaagaaacaaaagaaatagaaatgggaaatacaaaaagagaaaaagagaggagctgcagaaaacagggaaaatggtgggaaagaagagacaaaagagaaaggctttaaatccacgcttactccaacttccaaacatatacctacttctccactcttttccactttactcttttatacctatacccatcttatattatattacatgtacaaaaatattgttttcagttaaatctgcatttattctacagttcaacgcgattactgtagaataattttaagccaacgactgtttggaactaatttttcagtttgatacgagagcaataacaaaatttcaaagaaggtttttttggggttaaatgtcaaaccaaaactcgttttagacagtaaaaaatatatacgattaaactatagtctaatacatatacaaattttactttgcatatacaatttaattcttagtaaatccaaataagaatctaaatagatgataatgatcaaaatctgtatagagatgcacatagtaacttcgtgaattctaagtattagactaaattctcatatacagcatgcagatatgtcatatgcatgcatacacatttttacgcatttcagtccgtacgtatcgtgtatatacggtaacgatggttggatatacatgtgcatgtttcaaagttatgtacaccgaagggacaagctaggctgtgatgctcctaattcaagcttccttcttacgaatgtcaacttttatttaattttctttattgtggcctggccgaataatcaaagatataataaatatttagaggcaattattgattagtgtcctttaattctccttaaattgtttggtttttggtcggttggttccgagattttattttctgtgttaaaatgttactaaccaataacggttgaccctaattataagttctccaacaagatgtgaacttatttgctaattataaacgtgaacgctaaacataaacggaagatttatttggtttgagtttggcgtctgcatttacatgtcgtagtaatataaatttacattaaaaattaatgtttctatattaaagatgtgaattatttcgttttttcatgcacataaacgcatatgtattgtgttgaaactagacgaggctataatgaagacaactgttgtttctttttatctgcaacaatagtgtatatttgaccgttaatgtaataagttcatgataaggttgggaggatagcttccccgtgatggaggtcgtagggtttgtatgattgtgtacagtcttttcatttcacctagctaaccctattgacgcattgtgcaagtgtaagacagttcatacttcgtactactcttcaattatatatatttacaccacattatcaaccaaaatatatgtatttcaatccaactgtatactagacttttcgaaactaatataagattaatgttgaattatgttttcttcacaaaattctagcattagtacatttgaggtgaaaaaacacaaaattcatcctaatgaacacataaagaaaataaaattttaaaactcttcttcgtcaccgaatatttacaaataaaatgatatgtgtgtgtgtgaacctaatttaaagcctatgccaatgagcacatataggcttttgctctctttttttttttttttttttttaattatcacaatagcataaaatatgcaaaacggaagtacctttacaatcatttgtattcgaatttaaataaaaatgataaaacaccaccaatagtaagcaaaagataattagtgttgaaactaatcatccgtaagcatatagagcacttcgatgaaaattagagtattaaataaaattaaaataaaccctcaaaactatctgaagagacacatagagtggctccttggcatatgattaagctcccttaatttatcttctcgtatatatataggcattacacatcttacttattacattcacacacacccacattttacattcaactcttatacaat

SEQ ID NO: 3087 - DNA, 3000 bp, Unknown
  misc_feature (1)..( 3000): cDNA_ID_1819410_gDNA_ID_1620624_Annot_ID_47093 3000 nt of promoter + ATG
gcgatgtctttggctacacggagacctgcaacgccaccagaacagccaacaaagtagagcagaacacggtgtgtgtcaggactgagtccaagccccttggccaggtacaagtccccaccaggaagacgagcttcgcttgaggagacatagacaacgtgagttatgtcggaaatagaacgtccccagttcttgatgcaggctctggaggcttctactgccatctcggtcactgcatcgttgcagatgtctagacgctgcgtcactgtggatcctccttcaatggcaagttctgggtacttcttgagaatctcctctgacatcacaacataccttgtcttcaccgttgttgtcttgcctgtatatagtaaacgaacagttcaaacaaacctcagttgctgttgcaggagcttacagaatgagataaaaagttgaaaacagaggttaaaatgaagagattacagagacgagtaagtttctgtttgagttcagggtcatcacacttggtggttttgaagtagccatcgactaagtactcttgcattactagctggtgaggaaaggcttttcccagagcaagaattgtggcttttcccgggtttgatttcttctctgaacccaacactgcagcatcgatgcttcccatttgtatctgtttgttgaagactcaaatcttgggtctgtaaataaggttcaaagtgaaggcatatatatacactgcagcttttgcagttttgtgacctgcatattgtgcggtatttctgtctagttgatatttggtgaagagtaggtgtgagatttagaagcttcatgtttattgcattggctctttctaaaatccaactccagttctttgagatttttttcttgatacatagtctttaggcttagttaaaagccaacacaaaggtgtgttatagttatagttgttttgtacatcttcacacttaaaaagaatgaaagagaaactaactaaattttttcttctgttaacatcaatcattcgaaattgatattaaagaattatgactctgttgttgggtatcaaatttgctgagtttctacatgtatgatggatcatcaatagaaagacagcaaaaagaaatagaggaacaaatgagaaaaggtgaagagttgaaatttctgctcaaacctattccctacctacgccctttgcttgaatcttcatatgctttcttcgcccaatgcacatactgaacagatgaaacttaatacgtatgacttgttagaggtctgagagacatttcccactgatgaagtcaatcactttggtaagtgactcatcaagtttggcagtgactgcagctaagttctccaaaaattcttcagaagttggtctattgccatccacaatatcagtcacaccttttattagaatcgtaggcactttaaagatatcagccacataggccactgctgctccctgaaatgccaagaatccgtaaataagtcgtagtaactgataaagacacaaagacaaacacatagtatggagccaggtacatcaacacaggaaacttatggattgttgacctccatatctttaactgtagcatcatttgctgtgatggattcttcgtcatgtggagacatatccatagaatcgccagtggataatcttcccacctgggaacattgcaactaaatcataaatctaccacttatgcaaaccatatcaagaaataaccaaaatcttgcatgaggatcaaatggtgaactcagagcaactaataaagtatacacctttaggttcagctcctttataaggttgggtgtggggaaggtgttccgcataccaacaccatatatatcaaggacctgcagaaagtataaaaatgtttaggaaagggcaaaaatatatggaattagaatgcaagtataacactcaagaacatcaggtttactttgcaactcatactgatacatgaacaatacaaaggagcacttacaggaacaggtattcttctgtcatggaaagcaacagtagagacaacataaacatcgctaatacatgctcctttggcctgaaaagaccatttaaaaacaaggaagggtgttcattatttctgacacataagaggcatgaaacgagaactatgtagagaaatttgtaatgttgataccttaaagccaccagcggttcccgcattaatgattaagtctggttgaattgctagaatggaagcataagtcacgagtgatgcaggaactgtgccaacactctcaacccctgaaaaacgaattaacatcaagaacttcacaaaacatcttgaaacactatttcacttacaatcacttaaccacatggatacacataccaagagttgaatcttttccaggacacactatattgatgttcaagtctttatacattcccttaaacataatccaagtcacctcttttggaaacctacaaaaaagctatcacatttgatttcgaatcaaaataaaaaattgaaagaggtcaaagaactcacggagtattaacttcttcaacgaggcgtaatctgttgatcagaggctgagcttccttttgcatagcttttaatacacaaacccattagaagaagaaaaaaaaatcacaattcgagaaatagtaaagacaaaatagtaccaacgatgaagacgatggtagaaatcggccgtttctctacctgacccataacaccttccatagcagcgtctgagaatccgtcgccggcgattcgtcaagatcaaatttctagatttcccccggaaaacaaaaacccggatccgacccgaatcctatccactactcggacccaggcccaataaaattttagcataattaataaaatatgttttttttaatataaacaacgttgacgacttgacggccgtttatgccacgtaagcaaggggtccacaatgcgaagaagagagtcgttcgttatttcatatcctcacttccttctctgaagctttatcctctaatcgttttctctctaagcctctccaatg

SEQ ID NO: 3088 - DNA, 3000 bp, Unknown
  misc_feature (1)..( 3000): cDNA_ID_1819403_gDNA_ID_1620624_Annot_ID_47096 3000 nt of promoter + ATG
ccattattactcataaagatcaaagtctctcactttctcactcagatctaagaaagctgaccacaatcagtgatggtaacgactttggaagtctttccagaatcagatccaactttctcaatcgccttcacgacgtccaagcctttaacaacttgtccaaacacaacgtgcttaccatctaaccacgacgtcttatcggtacagatgaagaactgagatccgttagtgttaggaccagagttagccattgagagaatcccagctcctgtatgcttcttgataaagttctcgtccttgaacttagcaccgtagatcgattcaccaccggttccgttcttggcggtgaaatcacctccttgacacatgaatccgggaatcacacggtggaagatcgatcctttgaagtgaagtggcttacctagctttcccattcctttctcgccggtacagagagcacggaaattctccgccgtgtttggggttgtatcagcgaaaagctccatctcgatccgtccgatgggagtaccgctgagactcatgtcgaagaaaactctagggttcgacatcttttgggagatttggaagagagaaatcgatgaagaagattgtgaaagtgatgatgacaaattagggtttttggagaggttcttatagagaggatttaatttctaaaacggtgaatctgaaaatggaaattatgttggtgaccgttgatttatgacacgtgtagagctgtgatgatatggaaattaaccgtggttgaatcggatctgactagggttgaagtcgcgtggatcctaggctcctttccataattgatttgattctttttagatggaccgacagaattacggcgttggagtttaggtgggccgactccaaaagcctaaagcccaatatcttattttaacattacaattttttggtgtatgattgagcatttttttgccacaacactcgttatccgattctattgacactcccatttaaatcatttaggtagtgattatctttctgcacgtgaacgcttgtatgatgggatatttactggattcacgatcttattttcttcgaacaatgatcttacttatgacttgcatagttacattaacgtcgatttacttgaaaaacaaataaaaagtagaataatgagggaggttttgagctgaatattcacttttgtttttgcttatttcgcttcttttatacaattcactctttttctttctttttttgcttattgaccttgatccacttcctttacatcggttggtagactatgaccactcatatccttcaaaataagaatgttggagacaaagataagtaatgattaaagccttaaacaaaaagaaagccagaaaatgtaagtaatgatttgcgttgaatgagactaattatgccttgggtgggattagtagattttactttttactagattaggccactttgtttagtttggcaaagtgatttgattattttcatgtcacatcaatatgtgaatccaaagtccaaactgaaaaaaaaaaaactaagtacgaagtcatcatcaattcttaaacatatggtttttggatcagcgactcctaacaatggtctatagccggaatctttctttcaacaattttcatcatattttatacactattagtatcacactactgtctagattcgaataatcttaagttcttaacaaaagaagtatttatgtccctaaattccaaaagtaaaatcaaatcaaagcatcgcaaaagaaacttttggagttgtccaatagacacaatcattttagtaatcttaaagctagtaatattctttctccaacgttagcaaactatacgaccttttcttagtgtcattatcaacaacaatgactattactaattttgaaggacaaacttgccaaaactaaaattcaaagttttaaaaaacaaaaattcagaaagaaacaaccaatatgcagcaggctgcgcagggcacgagatccactgccaccgcacacgtggacaaccaaacattttactcactgcaaagatactctctcacgtcactaaaaattatttaacttgtaattatagtttagtaggtaaatcgcaaaaaaaacattttaataaatcaaattacaaataaaatgcatacaaaaagcaaacaacctccgtgcaaatcatatcatatgcatggcttaaagggtttaggcttcaccttcccgatcgctagagttactgtgctagtctctatcttcccatcacagtcacatctcgtccgtacacgtggacccacatcctctttaagctcactagctgattgatatcgtcttatacctttggccgtttcgtctctctctctctcgtttaattacttgtacctatcaactcagtgatactctcgcttctgagagagaagagagaaagcgaagctcgtttcgtatcgtcttctttctcttcatccgacgctggattcataaggttcgtgatctatctacgtcttcctctggttatgaacgttacggttgatgaagttatttttcctgctttgctttcaccggatctctccgcgtgctttagcttgacgagagttttgtttccgatcgtttctgtgcgtgatatcgttaaaaccgagtcgaaatctctccggtttgttttcttgttctttgtgattacatggaatccgacgtttcgatgttcaatttctgttgttcgtgaagtttctctgttgtttgtgttctgatttgatccggtttacattaatcttgtatagaacagtcttgaaggaaggtttgattacatttttcaactgaggatgcccaatccagtttgtctataacctgtttacacgtttgatcatgacattgttttggtgttgttttccttcaatttcttagtgaattatagaagacctctgttctgtattgcgagctaaatggatctgattgatttgtggaaatgcagggcattgataattggacttgttggttaagatttgaatcaacctggagctatg

SEQ ID NO: 3089 - DNA, 3000 bp, Unknown
  misc_feature (1)..( 3000): cDNA_ID_1819400_gDNA_ID_1620624_Annot_ID_47098 3000 nt of promoter + ATG
aaccttatgaatccagcgtcggatgaagagaaagaagacgatacgaaacgagcttcgctttctctcttctctctcagaagcgagagtatcactgagttgataggtacaagtaattaaacgagagagagagagacgaaacggccaaaggtataagacgatatcaatcagctagtgagcttaaagaggatgtgggtccacgtgtacggacgagatgtgactgtgatgggaagatagagactagcacagtaactctagcgatcgggaaggtgaagcctaaaccctttaagccatgcatatgatatgatttgcacggaggttgtttgctttttgtatgcattttatttgtaatttgatttattaaaatgttttttttgcgatttacctactaaactataattacaagttaaataatttttagtgacgtgagagagtatctttgcagtgagtaaaatgtttggttgtccacgtgtgcggtggcagtggatctcgtgccctgcgcagcctgctgcatattggttgtttctttctgaatttttgttttttaaaactttgaattttagttttggcaagtttgtccttcaaaattagtaatagtcattgttgttgataatgacactaagaaaaggtcgtatagtttgctaacgttggagaaagaatattactagctttaagattactaaaatgattgtgtctattggacaactccaaaagtttcttttgcgatgctttgatttgattttacttttggaatttagggacataaatacttcttttgttaagaacttaagattattcgaatctagacagtagtgtgatactaatagtgtataaaatatgatgaaaattgttgaaagaaagattccggctatagaccattgttaggagtcgctgatccaaaaaccatatgtttaagaattgatgatgacttcgtacttagttttttttttttcagtttggactttggattcacatattgatgtgacatgaaaataatcaaatcactttgccaaactaaacaaagtggcctaatctagtaaaaagtaaaatctactaatcccacccaaggcataattagtctcattcaacgcaaatcattacttacattttctggctttctttttgtttaaggctttaatcattacttatctttgtctccaacattcttattttgaaggatatgagtggtcatagtctaccaaccgatgtaaaggaagtggatcaaggtcaataagcaaaaaaagaaagaaaaagagtgaattgtataaaagaagcgaaataagcaaaaacaaaagtgaatattcagctcaaaacctccctcattattctactttttatttgtttttcaagtaaatcgacgttaatgtaactatgcaagtcataagtaagatcattgttcgaagaaaataagatcgtgaatccagtaaatatcccatcatacaagcgttcacgtgcagaaagataatcactacctaaatgatttaaatgggagtgtcaatagaatcggataacgagtgttgtggcaaaaaaatgctcaatcatacaccaaaaaattgtaatgttaaaataagatattgggctttaggcttttggagtcggcccacctaaactccaacgccgtaattctgtcggtccatctaaaaagaatcaaatcaattatggaaaggagcctaggatccacgcgacttcaaccctagtcagatccgattcaaccacggttaatttccatatcatcacagctctacacgtgtcataaatcaacggtcaccaacataatttccattttcagattcaccgttttagaaattaaatcctctctataagaacctctccaaaaaccctaatttgtcatcatcactttcacaatcttcttcatcgatttctctcttccaaatctcccaaaagatgtcgaaccctagagttttcttcgacatgagtctcagcggtactcccatcggacggatcgagatggagcttttcgctgatacaaccccaaacacggcggagaatttccgtgctctctgtaccggcgagaaaggaatgggaaagctaggtaagccacttcacttcaaaggatcgatcttccaccgtgtgattcccggattcatgtgtcaaggaggtgatttcaccgccaagaacggaaccggtggtgaatcgatctacggtgctaagttcaaggacgagaactttatcaagaagcatacaggagctgggattctctcaatggctaactctggtcctaacactaacggatctcagttcttcatctgtaccgataagacgtcgtggttagatggtaagcacgttgtgtttggacaagttgttaaaggcttggacgtcgtgaaggcgattgagaaagttggatctgattctggaaagacttccaaagtcgttaccatcactgattgtggtcagctttcttagatctgagtgagaaagtgagagactttgatctttatgagtaataatggtgtcttttgctttcggttgttcttcctcttaccttaatggattattctgtttagggtttgagttttcgtttcagagtttgtaacaaaacccttttgtgttttctggggtttgaaataattatgagcttacccaattgcttctttgtgtttttgcttctatgaacaagtagtaactgattcgtcttctgattcttcaactgaatcgtgaatcttgtaagactgactagaaaaaagaagactttgttacacgcaaatctgtttaacaggaaaaaaaatacaatctttttgaggagatgattgataaaccttagcacaactctcaatcttaaattcaatcgtttcgtctcacaaaagctacataaatgaacgtcaaattttcatacttgtatgagttaaaaaatgtaatgcaagtaaagtacactcaaatatgtaacacagtttggttgattttcgttaacgatgttatcaaatctcgtttagtaaagcaatcgagttattggcgttgaccattttcctttctctttctctagcc

SEQ ID NO: 3090 - DNA, 3000 bp, Unknown
  misc_feature (1)..( 3000): cDNA_ID_1819396_gDNA_ID_1620624_Annot_ID_47099 3000 nt of promoter + ATG
aatttttaggcagtggccattaatgagcggccaatcaaaaaatgactgaaaacagttgaaagtagaagaaagagtgggaatagattgttagacaaactaatcattccttttaaatgtgctctgctatcttacaggttggatttacgaacgaagggaaaatattggcgttggaccttgaaatctacaacaatggtggaaactctatggatctctctctttctaatcttgaacgtgccatgtttcactcggataacgtttatgagatcccacatgtgaggatcgttgggaacgtttgctttactaattttcccagcaacaccgctttccgagggtttggagggccccaaggtatgcttataactgaaaattggattcagagaattgcagctgagctggataaaatccctgaagaaatcaaagtgagttgaatattttctaaagatactcatctcctgaaagtttgtaggaatctgtcctccttttgtaagtttagtttaatgtttcctggtgatatttactttaggagatgaactttcaagtggaaggatcgatcacacattactttcagtcacttcagcactgcacattgcaccaactctggaaagaactgaaagtatccagcaacttcctaaagactcgtagagaagcggacgagtttaatagtcataatcggtggaaaaagcgtggtgtagctatggttcccacaaaatttggcatatcctttaccacaaagttcatgaatcaggttatctttgtttgatgtgaatccttttctttcaaatttagttatctgtcgaggaactgaaaagattaagctaaagcttccttggaaatctcaccattgcactaccgttcaaagctagaatctgaattttgagatacttaatccaatatataattaaacggctgtcacaggccggtgctcttgttcacgtttacaccgatgggactgttttggtgacacatggaggtgttgagatgggccaagggttgcatacaaaggttgctcaagttgctgcaacggcctttaacattctccttagttcggtttttgtgtcagaaacaagcaccgacaaggtacatttaactcggttacaagcagtggacttttggccaagacgtagtcagacaaaactgttgttgttctctcttatcatttctgtggtctcttaataggttccaaatgcctcacagtttttgctctcttgtcgttttgattgccttgtaacaggttcctaatgcgtcacctactgctgcttctgcgagttctgatatgtatggtgctgcagttttagacgcttgtgagcagattatagcaagaatggagcctgttgcatctaaacacaatttcaacacattctctgaggtattctttctttcttctagcaatttgatataaactcagaagattttgatgaacaaaactctctttttctctgagtgtatgtagctagcaagtgcctgctactttcaacgtatagacctatcagctcacggttttcacattgttccagaacttgaatttgattgggtatctggaaaagggaacgcatatagatattacacatatggagctgcctttgctgaagttgagatagatacattgactggtgattttcacacaagaaaagcagacataatgttggatctcggatattctcttaacccaaccattgatattggacaagtgcgcaatcttctctcaacatcctacgcttttagctgttcgttggccttttgcaatgtttaaaatccaagaaaatcatagagaaaagtgttatttctgaaattcaccatttgcagatagaaggagcgtttgtacaaggactaggttgggtagctctagaagaactcaagtggggagatgcagctcataaatggattaaaccaggaagtttactcacttgcggacccggaagctacaaaataccttccatcaacgacatgccgttccaactgaatgtttctcttctcaaggtatgcaactataggaacaagctgtttaaattggtagcaacacatttgaaactgaacatgagattatactcagggtaatccaaatgcaaaggcaatacattcatctaaagcagtgggtgagccaccgttctttcttgcagcatcagccttctttgcaataaaggaagcaatcaaagcggctagaagcgaggtaggtctcaccaactggttccctctggagactccagccactccagagcgtatcaggatggcttgtttcgacgagttttcagctccttttgcaaattcagatttctgcccaaagcttagtgtttgagctttaaactttaatagaggggagaaagatggatcaatccattttgtcaaagtcatatatgtaagttacttccagtctccaaatacatgatgtaacatgatacatgtttcttcaaagcagcaactttgttgactaaatgcgcgcgccatcgagataaaatatcagattttttttttctgaacaacctctaacttcaagtgagcaaagaatgtgaagcagttatgctgagcaatgcaagacgcttatcatcatcatatatcaaaaccaaaaataaaacaaacaatatcatcaaaatttcttttaaagtaaatcttaagacaagacaataacacactagtcataactaatcagactacaatttataaacgaaacataatcagcaaaattcagttaaacaaatatataagtggcattgtaaaaacatcatataggcttcaattgttttactttgttcaaacttaaatttcgttctttctattttgggttctttacaaaaaaaaaaaaaaaaaaaaaaaaattgactgcacaagtgatgatgatgaagatgcgtattcattcggtggatgctatcggaaaggaacacgaattttattattaaaaaaggaaaatgttattccttttttgcttctcttgacttggcgtaatcaacttcgccatcttcgtttttgtttcgatcccaatcgagttttctctcaatttgagaaatg

SEQ ID NO: 3091 - DNA, 3000 bp, Unknown
  misc_feature (1)..( 3000): cDNA_ID_1819392_gDNA_ID_1620624_Annot_ID_47100 3000 nt of promoter + ATG
ttatctcattcctcaaatcctgagctcgagactctcgaaccgcaatctttgtaacactctttgccacatcctgcaaacaaattgcaacttttaatactgttcacttaatgaaagaagtaatcatcttactacagagattactcacctcagctctatatctaagagactcgacagcattttcggtcaacaaaggaaagggtgtgataatatcaatatccttgttcttgtcgcttgctaagaaggactttatatcttcaaacccttccatctcatcaggagaaatctgtgccaaataaagcagagcattagacttgcaaaatttaaagagatcatgccaaacaacagtattattagacgagaaactcacaagagaaacggaagatccgctgctatatgctctccctgtacgcccaattcgatggatatatccagtaacactttgaggcatatcaaagtttataacctgtgcataaaaaaggtttaagggaaggttaagagtatagagcaaagaaaagaaggattcttacaatatcccaagcagcaaagagtacaaaaacaaagaaaagaaaacccccttagcaaaagtcaagtagcataccgtgtgaacttttttgaaatcaattcccctaactacaccgaactcagcatctagctttggtttgctacgcttattatttttcttgttctccttgttagcctcacctttagcctcttccttttgttttttagtctggctattatcatccgttgcaatcaagtaatcgaaaagtcctgcattgaattgctgtatacaaaaaaatatacactgattaattatgaaacgcagctgcttccggaaaaactaaatctaggtgcatgacttggtgatgtacctcaaggatatgaagtcgagaattctgaggcaattccccgtttaaaattgcagacttgattccaaactggaagaaacaaaacaaaagactaattcaatattattattacaggtacagtttttagaatcggaatgctcgtataggtgcccacaagttaccttttccaagaataatttcaacctgaatcccatgtcaattgtattgatgaaaatcagaattttcttctgaacaacctctagcttcaagagagcaagaatgtgaagcagtttatcctgagcactgcaagagatctaagacaagataatacacttataatcattaatcagacccagaaatgtgaacttataaaaatatctaagcgaccgaatcatacccaaaactgctgaacattacttgggacggcctcttccttgtcattatcttctgtcaaggtcaaaacgattgggttgtgcagaatcaatttcttcaatttttcgacatcagagctaaaaatttgcaaaaatattattcagttaaccatgcaagacaaacttcggagaaaaatatgagtctaaacagaatcattattatcgatatatgtctaaccttgtggtagccgacataagaaggcattggcaacgccttgggattattgatgttaccgaccttagattatcttcatatccatatgacaacaaaagatctgcctgataacaaaaatattatcaacatcaactctcaaagagaggaggaataaaggaaaaacatgatagatataaccactaagaaatgcttaaactacatgttcttccaagaaaatcaaatcatgagacttccacttaaaagagtgactactaaaacaacctctaacaaagccactattataattgaagcacatatatcatacctcatcaagaaccagaattgaaagtgattcactgacagcagtgggctctaaaactccggcagcaaaacatttcggaatacaagcaggtgtggagacaagaatctcaggcagtccagccaatgcattacgctgcaaatgaaacatcaaaacaaaattagaaaaaaacaatggaatgctttcatgatgagaaatgcaatactaaccatatcagatgcagacatgctactagtcaactgcactgcttttagctgaactctacacagctcaataagcgatgaaacctctgtgtaaacctgtatttttccaaatcaaacaagatttcccatcaattactgaaataaatgaaagtaggagagatatgaaacaatggtccaaaacaaacctgctgacatagttctcgagatggaacaagaataaatgcagaaggagcaagcttcttcttgctcacagaatctgctgaaaatagcttctggagcaatggcaaaaggtaagccaaagtcttacctgaaccagtctttgccctagcaaccacatcttttccttcctatataagaacaacagagacaataaatcatcagtcccaagattatataagtagccacgaaactcaaaaaaaaggtagagactttctattatcattaccagaatgtaaggaatggctgattgctgaataagggttggtttctctataccctttttagttagggcacgaattagacgagaatcaagccctagctcttcgaaacttttaggtgcctcttcttctttttgctcttcttcttgttctctgtcgtttctctgttcctcaacttcctctgctttctcaacttcgtccaccacttccgagttcacatcctccacaggttttaacttcgtcttacccatggaatatgaaatttccgagtttgtctggtcgaataggtttgaaaagcggcgcaggaagaagatgaagaagtgaagggaaaatagtcgtaaaacctcctccgccgcgtttcctctgttagactgttactgagttttttcaatgtcccagacctgattgatgactccaatattgggcttattttgggctacattcttctttatgggcttaataattgggcttttctattttttgtcgaaaaatgaaaacaaaaaaaaaacattttaaaaagagaagattttgcaattattggatttttgccattattggatatttgccattattggataacagttattcgtctgggttcagtgaagatg

SEQ ID NO: 3092 - DNA, 3000 bp, Unknown
  misc_feature (1)..( 3000): cDNA_ID_1819388_gDNA_ID_1620624_Annot_ID_47101 3000 nt of promoter + ATG
gtttttgcattttcatgtgtatccgcgacaagcacaccaatgacctgaaatacaagattagcttagaaataagggaacgaaagcagtacatgaaaactttttaaacttatttgacgtaacaaaatcaatacatgctcctttacttttctggtatcacttcttctaagatacagataaactaaaagttccccattgaggtttattttcttacttgtcccacacacgtgaccacgtctgtagcaaataattcttcgtcggcaacaattggtccaatcatattattcccgggaacatctttggcaagaaacagaccaacaaaaccagatgaagatttggctgccgaatcatcaactgaaaggatgcgggcatgtggaactttacttagcactaaagcagcatgcaaggtacaaggcggcaatggggtatcatcagtatattctgcttcccctgtgacctagatgaatatacaagagtgttgagatacactctatggaccttcggcgagccaacagatggaccaaaatacctgcattcttgccgaaagatggacctctggcaagccaacagatgtaccctgttttactgtctcatagtcttgttttccaattctagagaaccgaggaacaagttgcacagctgacatatgcgagggtggaaaggtctctatagtgggatttacattatttacatgatgagtaacccataagaaaaatttaaagaagaagcttagggttagagatttgcgaaactccaccattcccccaggagcaccttccttaatcaagacatcactctgtatgaccttaagtgcgtcttgcagaagacatttattccaattcttaccaattagaagttcctcagtgtttcttgcacgcaacgaaagaggagccacaccaccataaacaatagatgcatcagaaacaaacaattgttgccctttctcttcaagaaacacacgcattccaccattgacaatagctatatcatcatccctgcgatgggcctgcttaaattctttcacatactctaaaggccttgtccatggaaggaataccgacaacaagatctcgttgcttcccatatccactttacgatagccaaggaagaaatcttttgcaggtatagatctaacatctccattgcagttgattatccgaaactctgctcttgaagccatccaaagaggatttaaatcagatattggactagctgtacagatgtttccaccaatgcaagcaacatttcttatttgtgtcccagcaaaccacttcagctgttcgataaaagccttgcatgctgatgtttcatgtgcaggacgctcctttactaccttcctgaataacctcaggagttcagaaagtctcaaagctgaaccaacctctatcccattgtcattgacattcaatgcgttgagttctgggacttgagcagcagagattagcaccggatactgtaacctctttagtctcatttcgattcccacctccgtgttaccaaccagtagttttgcatcaggaaaatttgctttgagttcaagcaagttctgaagacttacgggtctataccaggtaatcccctcatttccccctaactttaagggagctaacttcctcagcagaagttcagggggaaaaataagctccttatctgtatacttagctccatctatatcactataagagattgactgaaatctatcttcattacaagtagctgcttcacttgttgtttttgatccacaagaacaaggtttgccagtagatggacaaatatttgaaccgtcctgaaggctaagtgaagataaaccactgtatagagcatcatcagattttgcaaaaacccgaaacgcatcaatgatgggtctataaccagtacaacgacacaaatttcctgcaaggcattcttcaatctcctcctcagaaggtgagtttttacttgacctcaacaaggcatacatcgacatgacaaaaccgggagtacaaaacccacattgagaaccatgcgaagatgccaatgactcctgagagaaatagggagaattaggatcgcagaaatgagaaaaaaaaaatctggaagaagtaaaaccccacctgaagagggtgcaagccaagtttccgatgaccaactccttcaatggatattacatgcatcccttctacagagtagagaggtgctaggcaagcgttgacagcataatgcctgcaataaaagtttccggtatgaacagtataagaaggcctaaacttaagcaaagcagatgcaacctatgagagaaaaagatacgcacacacatgtctttgactctcggtcataactagacaccatcacggtgcaagacccacaaccaccttcgccgcatccgagctttgtcccggtcaatcctaaatctaaaggaaacaaaaaacgttttcaagaatcccaccacacaacaacctaaccctctaaattttgctgcattgtacaatttgtggcttctctactctatctaaacttagattagatataagcatttgaagaaatcaataatatagagttaaaagcacctctgagatattcgagaagcgtcatgtgagctaatccatcaggcaaaactctacgaacaccattaacgtacattattgcctccatgaactcgttctgctccatcttcactgaacccagacgaataactgttatccaataatggcaaatatccaataatggcaaaaatccaataattgcaaaatcttctctttttaaaatgttttttttttgttttcatttttcgacaaaaaatagaaaagcccaattattaagcccataaagaagaatgtagcccaaaataagcccaatattggagtcatcaatcaggtctgggacattgaaaaaactcagtaacagtctaacagaggaaacgcggcggaggaggttttacgactattttcccttcacttcttcatcttcttcctgcgccgcttttcaaacctattcgaccagacaaactcggaaatttcatattcc

SEQ ID NO: 3093 - DNA, 3000 bp, Unknown
  misc_feature (1)..( 3000): cDNA_ID_3073035_gDNA_ID_1620624_Annot_ID_162459 3000 nt of promoter + ATG
cttgtcttctcatctcctacactagcaacactttccccacggttagctttaaagttctcttcttttactttgatttcgtgaaattttagcttggtgaagttggttttgttgttgaagcttatgagttggatttagtcacaagtatttgttaggttttcttaaagtcttcttctttctgctaccttagtgaatgtactgatgtgatctttaggatttgagagactcagagattcatgtaccgtagcaatgttgttgatctgtttaatgatcttagaaagagtgttaggtaactttctgtaaggagattttgtagctgatgttttagtggaattttctatgtgacaggattatgtgccaactgtgttcgataatttcagtgccaatgtgattgttgatggcaacactatcaacttgggattgtgggatactgcaggcaagttgttaccttggatttttttgtcttttgaatttcctcctcttccagagagtcatttgtgtttttgacttggtgaaacagggcaagaggactacaatagactaagacctttgagctatcgcggtgcagatgtcttcttacttgcattctcacttgtcagcaaagctagctatgaaaatgtttctaaaaaggtttgatctgtggtcttctcctgaaacttctttcctgttttattcagtttacattcagtgattctgatagaatacatttggtatcttgcttttgattcttagtgggttcctgaactgagacattatgctcctggtgttcccatcatcctcgttggaacaaagcttggttggttttttcttagctcaactcttaatcgcctgattatcgggggttttctgttttggggaactcttctgatattttgatgactgagtctcgtacagatcttcgagatgataagcaattctttgccgagcaccctggtgctgtgcctatctctaccgctcaggtacctttctcattatctttctaaactgaatcctaggtgttaatattctgcatgtttcatattttgatggtatcaaaacagggtgaagaactaaagaagctgattggggcgcctgcttatatcgaatgcagtgcaaaaactcaacaggtattaacctgagagtcaatatctttatctaatctttacctgtctaaaaccgccaattgaatctgctgatgattcctatatctgttatctgttcaacagaatgtgaaagcagtgtttgatgcggctatcaaggtcgttctccagccaccaaaaaacaagaagaagaagaagagaaaatctcagaaaggttgttctatactctgattcaacaagaagaaaggaatcaacaggagaattagagctataagtatttgttttctcctttttcataacttgtttacccaaggaatcaaaaatctgttgtttgtagtctgaaaatgacaaaagttgaagaactagtaacaagtatttgtattcttgtttgcattttgatctgtaaatataccacgaatccttgatttctctgtttcctagattcacaccaattgtcttaaggattatgttccaaacctaaagacaatgagagcttacacgcgcgaaccaatgagaatgagagagcacttgtctttcttggacaatagtatctaaaccagcttatttgaaaccttctgaatgagccagagtgtcttccatacatatcaattccacatagacctaacctgatctttagactataatcttcaatgatttcagaacctcaaaacttttgattttacatttttaatcaaatttatttgatattcattttgcttattgactagacgttttccccttggagataatagaatgattgattttaactctcaccggaaaagacaaaaaaaaggaaaaataaatcattgattaaataaaatttatggtgaataagcttggcttctctttaccaaacatatatgtttgttgatcaatctctttctttgcgttatctgccccttgatttagacccacgtattattcgattcctaaactaattgaaatgattagatatgtgtcatgacgtttagtgaactaatattcacctaatatgtctttcaatcacttaagaatttgcattattcttgtgaaaaacataaattcacatgctgctagtaaaatatgttaacaaatcaattaaacatcagaaaataataactgagatcttcataaagaaagtggaagtttttttaaatatatgaagaagaaaagtgcgtagtgtgcacgggacttagttcatttaattctcgagccattgccgtacggaggaggctgccttcaaggcttaagtcgaggcgtgttcgttacgtttaacccgcaatagccggtggctacacactcacaaatcccctttgactcaccggatatcgacggtttcccgctattttttcccctaactaactttttttccttttcttgtaaaactcttaaaaacaaaactcggtgttgtctctttgtttgctcactccttttctttctctctctcgccgacactttcattctcacttgtgttcgtacgtaatgttcttgatccggtaggtttttatttgattataaactcatttcatttaacaaattgagtccatctctctatgattcacccataagatgatagaagaagatcaacatttacgtctgagataaatcatgtcctttaatgtatatttgtttattttctggtcaatcatcgatctttcttagtcgtagcagttacacaatgctgatggtacatggcggcagattttcgattcttattatttaaagaccaaatttaataatagatgtatgtacaacgagttttggtatcactatcttgtccggtaatgctcattgtttatcttttaaatctacgtcttcttctgcataattgacacaaatcacttgtttcaatggagtttttgtttgtttgatttcctctgttacttatgcagcaaaagaagaaattgagtttaaaggagaagtgtgagaaggaagtttcaggaag

SEQ ID NO: 3094 - DNA, 3000 bp, Unknown
  misc_feature (1)..( 3000): cDNA_ID_2173052_gDNA_ID_1620624_Annot_ID_162457 3000 nt of promoter + ATG
ttctgaaatcattgaagattatagtctaaagatcaggttaggtctatgtggaattgatatgtatggaagacactctggctcattcagaaggtttcaaataagctggtttagatactattgtccaagaaagacaagtgctctctcattctcattggttcgcgcgtgtaagctctcattgtctttaggtttggaacataatccttaagacaattggtgtgaatctaggaaacagagaaatcaaggattcgtggtatatttacagatcaaaatgcaaacaagaatacaaatacttgttactagttcttcaacttttgtcattttcagactacaaacaacagatttttgattccttgggtaaacaagttatgaaaaaggagaaaacaaatacttatagctctaattctcctgttgattcctttcttcttgttgaatcagagtatagaacaacctttctgagattttctcttcttcttcttcttgttttttggtggctggagaacgaccttgatagccgcatcaaacactgctttcacattctgttgaacagataacagatataggaatcatcagcagattcaattggcggttttagacaggtaaagattagataaagatattgactctcaggttaatacctgttgagtttttgcactgcattcgatataagcaggcgccccaatcagcttctttagttcttcaccctgttttgataccatcaaaatatgaaacatgcagaatattaacacctaggattcagtttagaaagataatgagaaaggtacctgagcggtagagataggcacagcaccagggtgctcggcaaagaattgcttatcatctcgaagatctgtacgagactcagtcatcaaaatatcagaagagttccccaaaacagaaaacccccgataatcaggcgattaagagttgagctaagaaaaaaccaaccaagctttgttccaacgaggatgatgggaacaccaggagcataatgtctcagttcaggaacccactaagaatcaaaagcaagataccaaatgtattctatcagaatcactgaatgtaaactgaataaaacaggaaagaagtttcaggagaagaccacagatcaaacctttttagaaacattttcatagctagctttgctgacaagtgagaatgcaagtaagaagacatctgcaccgcgatagctcaaaggtcttagtctattgtagtcctcttgccctgtttcaccaagtcaaaaacacaaatgactctctggaagaggaggaaattcaaaagacaaaaaaatccaaggtaacaacttgcctgcagtatcccacaatcccaagttgatagtgttgccatcaacaatcacattggcactgaaattatcgaacacagttggcacataatcctgtcacatagaaaattccactaaaacatcagctacaaaatctccttacagaaagttacctaacactctttctaagatcattaaacagatcaacaacattgctacggtacatgaatctctgagtctctcaaatcctaaagatcacatcagtacattcactaaggtagcagaaagaagaagactttaagaaaacctaacaaatacttgtgactaaatccaactcataagcttcaacaacaaaaccaacttcaccaagctaaaatttcacgaaatcaaagtaaaagaagagaactttaaagctaaccgtggggaaagtgttgctagtgtaggagatgagaagacaagtctttccaacagcaccgtcgccgacagtgacacacttgataaaccttgaagcactcatctttctctccttcttcaaacttcaaaaaccctaatttgttcacgaattggggatttttgactaaagagagagagagtgaggttctttaaagagaaagaagacaaagaaatagctgctgaaagtctctcccagactagagtcttcctaatttttactactcatcctcacatgcacctcaatttcttggtcttcttcttccttttttttcttctttttactaaaattttataaaatagcatttcttcttagatagtgcgtttcccaacataagaccctacaaaaatttatgggatgaaaattataataataatttctatgtacttttttttttttttttttttaaacttcgttttcatctaatactatgcagcccatatactaaatgcctaaatctatacatatttagattgatctttaaatatcaataaaaaatttagctaaattttgactggtttagaggatttttccgatgtgtcattaggattatacaactatggtttaaatatcaataaaaaatatagctggttttacaatgcaatatgattggagtgttaatttttattgatcagcctcctttggatacatattcttctgttacatgttaaatgataatatttttgtcccggtatgttgaagtaaacattaaaaatgtacatacaacttctctaagaaataaatgttgagacactaaaaaaaacgtgaacttaaggtcaatatttaatatttttataaccaatcacggtataaaggcttaccttttgaatctgtctagctagttattgaccgttaattttaaaaacacttattgaccgttaaagaatctgttatggggacccaaaaaaaacgaatggtaatttcactaatttgttatgttatgtccaacataataggcgaagaatagggtgaaaccaacatttaaaaatagcaaaaacaaattaaaaaaaaaaaatcgaaaaggaaaaatgaagagagtttcaaagttacaacggtggattctatttcagacgcgtaaatttctccggaaacctgaaaacctgagtgcgaaacattctcttatatcatcctcttttctgaaagcttgttatttgagctctccttgttttttattcctccgacaaggacgaggttccaagagaacttagcttcttgttctacgtacgacaccaaaaattaattcaaaaaagaaaaagaagagagttcaatg

SEQ ID NO: 3095 - DNA, 3000 bp, Unknown
  misc_feature (1)..( 3000): cDNA_ID_1823602_gDNA_ID_1620624_Annot_ID_162455 3000 nt of promoter + ATG
ttctttatgatttccttgcttaattaagtttcaataagataagaaagtgttgttatgtgttgacaagttcagtttgtggtggcaggatgaagatgcattcttcagagactacgcggaatcgcacaagaaactctctgagcttggtttcaacccaaactcctcagcaggcaaagcagttgcagacagcacgattctggcacagagtgcgttcggggttgcagttgctgctgcggttgtggcatttggttacttttacgagatccggaagaggatgaagtaaacgaaataggaagtaaaacacgaagcaacgatgctcttatttgggtattaaagaaactattaatcgtctatcgaatctattttgctgctacaagattctaaactctttgaatccacgattctactgtttagtagtaaaaaagttaaaaagtcaatattttgggtccgtgattcatttttgcgatatttgttcattgcaatgttcgtttcacttattaattagtaccaaagaaaaagaaaaaagaaagaaacaaagatcggtcgatatctaccaaagtggggacataacctgaaacttgacctaacctggtagtggtaggtttagttaggtaggaaacttctactaagaaattaaaattaaatttttttttgctttcgtattttcattaaagaagataatatatgatgttggttgccagttacctaaatataggctcgggatgacatgtaatggacgcaaagtagcaaatagctttattcaagttgacataaaagaattgttgttacgtaaaagaagtgtactgtattttaacagaatgtgaaatcacctaacaataacttatataagaaactaaaagaaagaaacgcatgtcttctaaatttggcaagaacgaaggttttgtaacttgtaagtagtttaaataaataaaccatacatttttaataattaggaaatatatgttacatgttgcactttgtatacattctaaaagtcgtataatgtacctatttttttaagatttgtttggtgtgtgtgtagataacaaatcacatgtcaattctatcccatttctattttcttcgttattaaatatacaaatatgtcggtaggagttcagagtaaatgtacaccatgaaatctaccaaactcttttaagattgtctttcaggtatcaaacaaactttcaccaataaagctttttcccttttccaaataaagaactccaaacaagaataaaaaccacaatcattattcgatatgtttttatcgatacttatttcaaaatatccccttacctatttacaaaagcatttcacgaatgtttttcttagagtcgtcgtattttcatatatactgatattagcttaattagctcgtgatgacagcaaaattcttgaatattttgtaggccatggtctttgtaacttgtcaagaacatagatacgtcggataaattcatagatatcaattcaaatgataagctagcttacgaaaagcgtttctcaagaaactatgatttttttctaagaattagttggtcgttacgataaataagaaaccttgaattgatggaaaagaagataaggaattaattaagagattggtaaaatggtagttgagaaagtaaaaaggtcacgtgttagggcaaatcattaatggaagaaggagaaagcaggtagaaatgcactctccattttcattacattacaaactccacgtgaggtttcaccgattgtaggaactcctgattttgtgttaattactcacaagtaattatcatatagcgcgtagctaaatattagtataggatgtaggttttacttatataatgctatatctcactactttggtgaagagaaaatggatattaaaatttaaacggttgatacattatctgaatagttcttatatatacgaaacgatttgttgagatatgttttaacacttcttaaaggaagtaggataaagtggaaggtcacgaaccactccccatattgcagccaaatctacaccaaaccgtacccaaaaatgaaattaactttccctcaaaaccaaccttgtttgtgtcttctagattaatcctccaaacttttgattaaccaaaaaaattatcaaactaacatgttctccttttttctttagaaattctaacgaatttatctttatactgatttgaatatacttaatttggtcatttggatgccctttacaacctccttaccaaactcactatggcaaatatatactattttccattgtaacataaatgtccataatttgaattaaattcgttgcagtacgaaaccatccaactttgtccaaaaacaaaatccttataactatttactttaatgtaaatatatcctctacttttgtttttacaaccctagctcaaacaaatttattatttgcgatataaaatcatatcgaacaaactcgatgattttttttttcttacgttattaatgaaactaaaatatagaaaaaaacaagatgaaccaaattttcacctatctaactacttaaatataatatgattaaatttggtaaagtttgaaaagtttctttaggaaatgtgaaatattgatcacagtttctattgctaaaatcaccaacaaaacgcatgtcgccattcataattatggtttcacacctacaactaggctaataagtaaataagtagacaactagactcaggtttgaaaaaaccataaaagccatatagcgttttctcattgaaactgcgaacacgatcgtgtgaatgttgcagtttctagttttgatacaaacaaacaaaaacacaatttaatcttagattaaaaagaaaaaagagaacggagcccactagccactccttcaaacgtgtcttaccaactctcttctagaaacaaattaggcttcaccttcctcttccaacctctctctctctctctctttctcaaaccgtctctccataaagccctaatttcttcatcacaagaatcagaagaagaaagatg

SEQ ID NO: 3096 - DNA, 3000 bp, Unknown
  misc_feature (1)..( 3000): cDNA_ID_2132959_gDNA_ID_1620624_Annot_ID_162453 3000 nt of promoter + ATG
gtgtttaaagctgggcctggaagcatctgtagcttttcacttgaggtttttctagactttatttatatgatttttagttcactctacttcagttatgtagatatatttattatgagttgaattattgtatacattctatcattattttcacctcttacgtatgatacaattctgacatacataaacatccaaaagtatcaaaacaatttgccaactagttcttactattcttctactcgcttttccgggagaaaaaaaaaataaaaaaaaattcgttgattaacatttttaataaaaaaaattgttcctgaattatgcctttattagttgggttaaaatataattatattgacatatctaattaaacctctttacactcaaatcaagacctacaatttcacaagtttaaggttgggattactcgatatatagaatgaaactattgcaacaaaaaaaaataaaaaaatgaatgaataggattgatggtgtgataaaagaagagatgaatacaaagaagaaacgaacacaagtattgtgaacaagtcaaagcctaactattgaacaactttagaagacaagccaccaaatgtacaaacaaatcctcccaataacaaactacaaaagagaaattaatcaattagaaatcataagacatatcgacacatgctaatggtattatctacttacacctcatcaaactcgtgcatgggctattgttatccacatatgtatacagtcatggttatgtcccctcaatctcttccagcttgagaactatttgtaaaccactagtcaattatttcatattcagttcatagatagcctataaacattacatattatatctctagagataacaaaggggagcaggaagtgttagtactgtcgaccttatgcgcccatataattcttccatagctttagattttagtgtttgggctattttaattgcacccgaataatgacaggtaggggtccatgcaaactcatattcatgtgcatatcatcataaaatatccaaaaatctatcttatctatataacttcattgaacaaaacatatatatattcatgcagacgtatggcatgatacagttaatggtctgaattgctcaacgtaaaccatacatgcactagacagtttcatgggaagactaagattttgggactgcaaaattcttcttggaattgtgtagcggctttcaacgtatctttaggttatattcggtgaaccctttatttaccggcacagaatattacggttgatattcaattgatcaaacaatgtgaattagacgtctaattattgatggtcgccatatgaatatcttcttcttccttttccaaaccaacaccaacatcttttaatcgatagaagtgtcaattcgagctcgactctcacatctaatgcgtcattataagattgaaaatcagagacttgaagttttcgtttaggaacttaaaatgaagtttataactattgcttaacgtttttgttgttcatcccaagaaataattgacgttttcaagttaggtttttccaacccaatttattttattatccaataatattataaattctctagtgaaatttcattccttagcttccacgcaaagggtcgcttgagttttgagtaacacaagattggagagatcaatgagaatgttggcattggatccaatcctactatttgggaccagcttcactcgattcatcgcgtcctatttttgtccgtttacacatcttcggatcattcaattcttgtttaatcatcttcattagtaataacgttgccactttatttttaagacggatttatcttctgcaactcccaaattcatattcgctaaatcttctctaaactcagcataatagttaacttgaaaaagaaaaaaacgaaaacgataactaagatggtgaccactcgcatggtttagtgatgaatttagttaaaccgtatgttaatttccttggttaggctcttcaaacagaaattcgaaaacgatatcaaatgctccatgataagtttatgatttcttagcattgtctaatctaagagactagtaagaacatgaaaacaatattcgttaaaccaagtggtaaaacaactatatacagtatgtgtttttcgattataatgttgttaacttttaagattattatattttatattatttcttaaaatatgttgaggtttaaaagatttcttttcagaaaaggattaatgtcttcagcaatatatgctagtaatttactaagtgatattttgcaagtttgttggcaatatttaaccttttctgaataaaataaattcaatattaagaaacaaaattatatacatatagtagtatttaattgttatctatttttaaattatatgtgaataaaacaaagcaagtgtaactgtgtaattataacattggtacacgcacgggaaaaaacacagctagcaaattgaaacgttaatttggtaaagaagaaaaatattttatttttaaaaacacttaatatagttttaattggtgattttcccaattctgaacatatatatgatgataagttttccatcccaagttgttttttctcattagtcactggaaacattaattaccagcaatcagtagttactttggtattccccacacaaattcaaatttaaaagaaataattagtagtacttcttatgactgttttttttactgaataaaaaagaactatatataggttgttcttaactataaccactaaaaaaaggttctaaaattaattttaaaaagaaaaatatatgaagttaacttttatatattacacatcaaattccaatttcaggggctggtaatttggtaataattaaagaaactcaatggcaatgatttaagcacttctttatataagtccaccaaactacactgatctcctcaacaccacacacagcaaaacaaaaagctctctacactcaaaatataacgaaagaacaagaagacatcatcttagctcact

SEQ ID NO: 3097 - DNA, 3000 bp, Unknown
  misc_feature (1)..( 3000): cDNA_ID_1823608_gDNA_ID_1620624_Annot_ID_162452 3000 nt of promoter + ATG
gaaagaccttttttgacataaaaagggtcagatgaaagtagttgcttgagagttttgttatcatgttatgaagcagtgaccagtgagccaaagttgctatattgtattgatattctgttagaatcatattccaaatctacggcaaaaaaaaaaaaaaaaaaaaattcgaaagagttggaaaaaagttctagttacaaatatttctctaattacatctcgggactgataccgactagtgcataccacaaaagaaaatccaatattgtacttaccaatgaaatggaaagtgatagaatgtttacccgctgagttacttcatcaaaaaatggtcgtatacattgcgcgcgcaattacatgcaacatgtctttgaccgtaaatatcacattaaaatagaatgacagtcactttctgatataatatattaatatacaccaaccagcatgactaggatcaaggtgtacaacaattttttttttgaatttatcaaattcacacaaaacatatcgtgtacaactctaacgtacgtttcacatcggctaagccttgtatttctttatttgtagcttgtacggaacatttatagcttgcaacactgacaattttgcagattagttgctttgttctgataaagatggtttaagaatttagttattccgcggtttactttcgtatggaatacagcagataccacaatttaaggtaccaacttggaaagagtcattcggatcatcggatgagacaactattttcatcgaccaagtaaagaatatttcatcgatcggtttagttttgttaaacataattgcagtatatgtgtgttaaccgtcaaaaattagagtgccaataaatctttttttactctaccaattaaaaaaataaaaaaataactggaagtgaagaaaatatcatttgcaaaataaattaaataaaacgtaacgtacgctaatatggaggaggaatttcggaatttcatcagttctttttttgaagcttatcgacaccgcctgacggctttgctggatgaaaatatagctggataacatttatttttaagaagaacaaaaagtgtaataattatgtgttgtatagcgattgtaattcatgttatccttagccgcctccttattattatgtaagcaatattttctttggcaaaatgaagttctaataatctaatccaagaaaattcgtaagttactctatcctgtgatacaaattcagacacgcatgaataaaggagattaaaggttgcatgtatctttaaaaaaccatcatttctttcaacgggttaaaaatgagttattcacaaataattgttttgcattgcataattagattgagttatatatgttattcgattccgtcaggtttacatgatcagatcagcagacaaaagattaaccaaaaaatgaacgtcggtggattacagattgagaaacaaaaatatgttcaacaaagtcgtgttgtatttgacagcttaaaccacttgccagatgtggttaatgataagagcgatgtatatttgatggggccaatccgggattttatacagtaagtgagtgataaggatatgtttctttctatcagctagtgcataaatattgtgggctaaattatcacaaattgtcgaataagtgatatgatttgtgggcgaggttatcacagattcacaatttgcttatcacaaaagatatttttttgtttgttttagaaaaacaaattatttgtatggtatcacaaaaagacatttgtgtatgttaatgttgtaggattccaaaaacgacttcataataataatataatgatcattaacaaagaaaatgtggcaacggttgagaatgaaggacaaaaatatttaataaaataaaaaagataatagcatgtactagtagcaaacaacataaaagaaatgagtaactatcgctttaattaaaagtgggactaaacatgtctctagactattgaaatattcttattgatttgaattttcttattgtaaagataactttgaaattcactctttaattattttcttaacgagtttttggaatggatccgaatgtatatatatatattgatttgtgtttctatttatctaagcttgtggtaactttattggcgatggttaataaaaaacacgttgggtgcgtatatgcaatattcttgatactcgaattcattcctgaacatgagatattaagataaacgacctactacttcgtgattaaaaaacataagttaaaatttaaatgtccgaaggaatcatagttaagtgacagcatttaagttgtctaaaaattgccatttgccactcgcatcaatttgtaattttgcaaagtgcaattttatgtctcaagatttgtttcgcagtaagtaatgaaataacataatcaatgttctaacaaaatatctcacctaccagccacacgagtgtcaatttagtttacatttgaaccagagacctaaaagtttgaactaccaaaataatgattttgccgacaaaataggaaaactaagaaagtagtaatgaatatcagatatctgtttcttcagatcaaagcctactaaggaacgcaaaaatatataactaaacaaaattgcgtaaatttagaaacagtgattaaaagcccatatttgattcaatagtaattgaaaacagcataagataatggcccattagccgttatttaggcccgttatcatatcacaaaacaaaacacgaatcatctacgacgaagacctgaaaaaacacactgcaattgagatcgatttcgactgtaagtgaactttgattgccgcgaagattactcaaatcgccggacacaagtttttcagtgaattccattggcatagaactcgagagaaagagacacagagagagagagagatctaacaagagtcaaagtttctgactttttcgcattctttttgagatcgagttctgtttttgttggcgtgtgagatgaattcttaagaaggaagaagaagaagaaggaaag

SEQ ID NO: 3098 - DNA, 3000 bp, Unknown
  misc_feature (1)..( 3000): cDNA_ID_3593514_gDNA_ID_1620624_Annot_ID_162451 3000 nt of promoter + ATG
tactagtacatgctattatcttttttattttattaaatatttttgtccttcattctcaaccgttgccacattttctttgttaatgatcattatattattattatgaagtcgtttttggaatcctacaacattaacatacacaaatgtctttttgtgataccatacaaataatttgtttttctaaaacaaacaaaaaaatatcttttgtgataagcaaattgtgaatctgtgataacctcgcccacaaatcatatcacttattcgacaatttgtgataatttagcccacaatatttatgcactagctgatagaaagaaacatatccttatcactcacttactgtataaaatcccggattggccccatcaaatatacatcgctcttatcattaaccacatctggcaagtggtttaagctgtcaaatacaacacgactttgttgaacatatttttgtttctcaatctgtaatccaccgacgttcattttttggttaatcttttgtctgctgatctgatcatgtaaacctgacggaatcgaataacatatataactcaatctaattatgcaatgcaaaacaattatttgtgaataactcatttttaacccgttgaaagaaatgatggttttttaaagatacatgcaacctttaatctcctttattcatgcgtgtctgaatttgtatcacaggatagagtaacttacgaattttcttggattagattattagaacttcattttgccaaagaaaatattgcttacataataataaggaggcggctaaggataacatgaattacaatcgctatacaacacataattattacactttttgttcttcttaaaaataaatgttatccagctatattttcatccagcaaagccgtcaggcggtgtcgataagcttcaaaaaaagaactgatgaaattccgaaattcctcctccatattagcgtacgttacgttttatttaatttattttgcaaatgatattttcttcacttccagttatttttttatttttttaattggtagagtaaaaaaagatttattggcactctaatttttgacggttaacacacatatactgcaattatgtttaacaaaactaaaccgatcgatgaaatattctttacttggtcgatgaaaatagttgtctcatccgatgatccgaatgactctttccaagttggtaccttaaattgtggtatctgctgtattccatacgaaagtaaaccgcggaataactaaattcttaaaccatctttatcagaacaaagcaactaatctgcaaaattgtcagtgttgcaagctataaatgttccgtacaagctacaaataaagaaatacaaggcttagccgatgtgaaacgtacgttagagttgtacacgatatgttttgtgtgaatttgataaattcaaaaaaaaaattgttgtacaccttgatcctagtcatgctggttggtgtatattaatatattatatcagaaagtgactgtcattctattttaatgtgatatttacggtcaaagacatgttgcatgtaattgcgcgcgcaatgtatacgaccattttttgatgaagtaactcagcgggtaaacattctatcactttccatttcattggtaagtacaatattggattttcttttgtggtatgcactagtcggtatcagtcccgagatgtaattagagaaatatttgtaactagaacttttttccaactctttcgaatttttttttttttttttttttgccgtagatttggaatatgattctaacagaatatcaatacaatatagcaactttggctcactggtcactgcttcataacatgataacaaaactctcaagcaactactttcatctgaccctttttatgtcaaaaaaggtctttcgtctgaaccgaaaatcaaaccgagttggaagcttctagcaaagataatgagccgtactagtcacaactcacaagtcacactttcgaatttcaaacttcaattgaagatccgaatatccactgccgtagtttgtacgatactttcactcatttcatgttgtcatgtgtcgtacaacagtttccagtttcccattattatttaatgtttatttattaatatttggactttaattacggcaggttatactatatggtatgatagaatattttcttcattccactggattttgctaattatatatatttattccaaatcacaattttgatttatcgtcattacaaaaactaaaaagtaatgaccaaaataaaagatatgtaatttcagatattccgttctaactattctattctcttcctgattccattaccaaacactgagagacaaataagctactggccgctaattggctatcgctctctttacatcttcgaacataagcaatagttgaaaaatataactttactaaaaaaatacatatttttcgttaaaaaaaaccttgtggtcgtctatatactattctaataagtaaaaaaaaaaaaaaaaagtaacggaagcatgaactttcatgcctggaagaaactactggccaaaaccatccactaaatacaactaatgaagtaatcatcctagttgagcatattgtaatcatcacattcaagaaaaatatcccatggagaacaattttgcattatataaaaagttaattccttgtcgacttttatataacacaaacaagaaggagcacatcgtaaattcatcaccgcttctacaccttcaccgtacgtgtctctttcgtactttctcactatttgtcattctaattataaagtacaaaaaaatcaatagtttaattattaaattaatattaaaaataaatactttctactaaaagtctaaaatattataacatcgaagttgcgaaaaataaaataaaataaacgtaacatttcacctttaaaaccgtacgcagagtgctcaacgaacccaaacacactctaaaaatatcttctttctccttcttcttcattcttctcaatatctcctaatg

SEQ ID NO: 3099 - DNA, 3000 bp, Unknown; identical to SEQ ID NO: 3092
  misc_feature (1)..( 3000): cDNA_ID_1819388_gDNA_ID_1620624_Annot_ID_162447 3000 nt of promoter + ATG

SEQ ID NO: 3100 - DNA, 3000 bp, Unknown; identical to SEQ ID NO: 3091
  misc_feature (1)..( 3000): cDNA_ID_1819392_gDNA_ID_1620624_Annot_ID_162446 3000 nt of promoter + ATG

SEQ ID NO: 3101 - DNA, 3000 bp, Unknown; identical to SEQ ID NO: 3090
  misc_feature (1)..( 3000): cDNA_ID_1819396_gDNA_ID_1620624_Annot_ID_162445 3000 nt of promoter + ATG

SEQ ID NO: 3102 - DNA, 3000 bp, Unknown; identical to SEQ ID NO: 3088
  misc_feature (1)..( 3000): cDNA_ID_1819403_gDNA_ID_1620624_Annot_ID_162442 3000 nt of promoter + ATG

SEQ ID NO: 3103 - DNA, 3000 bp, Unknown; identical to SEQ ID NO: 3087
  misc_feature (1)..( 3000): cDNA_ID_2173042_gDNA_ID_1620624_Annot_ID_162439 3000 nt of promoter + ATG

SEQ ID NO: 3104 - DNA, 3000 bp, Unknown; identical to SEQ ID NO: 3098
  misc_feature (1)..( 3000): cDNA_ID_3593514_gDNA_ID_1620624_Annot_ID_47105 3000 nt of promoter + ATG

SEQ ID NO: 3105 - DNA, 3000 bp, Unknown
  misc_feature (1)..( 3000): cDNA_ID_1819545_gDNA_ID_1620626_Annot_ID_47133 3000 nt of promoter + ATG
agtgagaataagaagattaaagagaagatagcaacgtgaagtgaagaagaagccatagatgccgatagaaacatagtattgagtagtagagaagctagttgcttggagtgtagtgttaggaatgttgttttggaaattgctgagttatgaggaggttcttgtgaggttttatagtggtgaaaattcgaaaactagccgttagattatttactttttgttttgttgtgaaaaaagaagaattttgaaaaggtaaagaaacgttaaatgtttgttactgtagccgttgcgagtgatgtaaccgttagagaaaatttgaaacaatgtaattatggatactgacatttgttgtgtgtgtcaggcaaaactatgagtgtttctcgttgtctcgcttttaattttgacaaaataattgttcgtgaataaacgtagtaaacaaagtaaaatctagtcattctatttggtgatggtgacgtttgggtattgccgtattgggcctattagctattggggtgatacgtatacacacctttacattttcggatatatttgttgagatcactcctggcccaaagaaaatagaaattttcaaaaattttaacaaggaatttacgttgttcttcttttttcaataaggatttcgaatcaacagagcaaggaccaagtgctaaaaccaattatcaattgagttatcttctttataacatttactagaacaagacataagctcatctatgactatgagaggcgtgtttatacaagggatttggtttaactaatagcaagaatggctcatgagtttaccaactaacgaggcatcaactcatttactcagctacatgatccgtttgtgcaacgtttcccactgattgagactattgtactgacatgtctagcatcaccccgtaaactatagtattgtttaggtgaatttggtctccctaaccatatatagggacatgaagaaaatgtcttgtgcagtttgtcagtcatattagtgtattatatcttgttacctccaataatgtcatatattggaaaacttgagaagtgatcagggccgatgaatgaaacattttttttatgtaatttggttaaaaagtgtaacgaaaaaataattaaagtgaaatctacttttcaaaatcgttaaaatgttttttgtgaacttcaaaaaatataaaaaatagcttacttttcatttaaaatgtctaaatttaatgtaaatattaaattagaaaaatgaatttatacatataccaaaaatcccagttttattttgtatgtgaccccaatattcttaaaaccaattaactttttcgacggaccaagtattccgtcgatttggttcaatatatatgtaacgaaccataatctacctttcgcggttgaatcggtagctaaaaaattatttctaacaaatataaaattacaaaaattgtatttttccattaatgacttaaaaacaaactatgatatctaagtgtgtactcattcaaagattatttaatttttttaaatgaagtcatggcaaaaggaaataaattgcaaattccgagtttaggaaagaaaagaaagcaaatcttaaataactcaaaaaagaatattggaagacatgtatcatagtcctaaacaaagtaacagatctttgggtcctcctttcttttttttcccttctatctgaaatccgacatcatcctcaatctctgtctgaatttctcaatagctatatcatcttcttcttggtcttagaatcaaagaaaaaccctagttcctcttttcccaagataaccaaactctctctcttctctctctgcatcattccctttcttctttctcgcatgtgcagagctatcaaacatctgttttgattgaaagctaagtttccaattccaaaacggaagaaattgaaagtgtgtatgtcaagacaaaccaccaaactacaaaagaaacaaaacccacatcgcattgttccttaaagacccagcaataagattatctcacgcttccttctttcttcctgacatttttctcgtttttgttttctccttatttggggtttttcctgcaatgtgggtcgcatttggtcataagtgattatttctagggattgtgtgacctctctgcttttttgagttaagcatttaaagaaacctctcaatggcgttgtttagaaagttctttcacagaaaacctcctgaagggttgcttgagatctcagagagagtttacggtatgctctttcttcttttaagtgatgggtttagggtttgctttcttatccttgctcttctttgggctttggagtattgatttttagaaagtttgagtttttaggtcttaagatcagattttgataagtgtagtgtcctgttttagtttctagttctttttaggcttgttgattgaactgaatctaacatttgatagactaagattcttgatgggtgagatttagttcatggattctgttaactatccatgagcacaggctcaggctcattggtggaaagtctatctattatagcttaagatgtctcattctcaaagaattgtcaggaaacagtttcttttgtatggtcactgggttgcatgatttctcaaatccttttgcttgtcttatcccttgctcttagagtattaaattttagaaagtttgaatttttaggtcttaaaaatcataattttagcctaagtttatagtgtacttcttgttaggcttgttaattgaactgaatctaacatttgatagcttaagattcttgatcggtgagatttagctcatggatagatttttcaggttttgtatgttcactgtgttgcatgacttctcaaattcgtccttgtcttatccatgcttagctctgagaaatagactattttagtgagaaagatacaaaagattgctctataagctgcttacgaaatataagattgctctataaggttgctgaactttgatgtttttgtattacagtctttgattgctgcttaaccacggatatg

SEQ ID NO: 3106 - DNA, 3000 bp, Unknown
  misc_feature (1)..( 3000): cDNA_ID_2993331_gDNA_ID_1620626_Annot_ID_47135 3000 nt of promoter + ATG
ttttctgcagcagctctagcttggacagtgaaaggacgagacttgaagagaaacccaggattaattggagattttagagaaaacccattactcagattcgcgaaattcgatattccggtggagaatttcaaggaagggacgagaaaggttgctgaggaattaggtctagaactgttgacgactgtagagaatgttccgtacgaagaagatgaagtagtcatggaaaccatttttggttaccggagacgagtttatgttcgtcttctttcgaccagtgttacacgttcaatagtgaaaccgagagatgatatagtcgagacacgacgcactttatatcatgccaaaatacacattaactaaaaaaacaaaaaaaactaaatttttggaccataaatgtgtttttaattttatttactttacaaaaaatataatgatatttttcttcacaatttgttttcaaattcgttttggagacataattggaatttgttttgcagtatagttggattttttgcagaattcaattggagacaaagttggatttttttatttacaaaatgcttattagatttcttatgattacttaaattctggagcattttattctatgaaattactgcaaaattatatttattttatgattatttatcttctgtagtattttatatgaaatcactgtaaaattctatttaattttatgattatttatatgctgcagtattttctatgatttatggtagggttttaaattaaaatattagatgatatttttataatgaaaaattttccttaatatttttgcttttataattttttttttttaaatgggacaaagtaagtaattaagttgagtggtgcaaaatccacgttcattcacgagagcattttggaccaatttgaggcacatatttaagtgttatgatatctatgttcttgtcccaaaaattaaatggattttgttttggactatgtttcatcctcaaatttttgtttagttccttggttcaatccttatcctaattattgtctctggttacaaatatgtcgcactcaaacgaagagttataatctaaccggtggcaatgcctatccattattattattttgtaatatatattggaaatgttgggccacataaacaaatagataagatgtgacagccaaatttagttttcttattagtactttagtagtatactcattagaagctacctctctccattattacaatatcaatctcaaatgttgttctatataacatgtgtttactatagaatatctttattttgttcaatcagtatataacaattcccttttcgaaattgaagctaaggaggttttatgcgatgagggtgatacttacatgctcaccgaattcactcccactcgttattccgattcggtttttcttcgtgaagcgaggctcttaaagtatctgcaccggtgatcaaagtgaagtgtcttaagttagattaaaattttaatcaataaattgtaaaaatattaaacccaatcaaaaagtgacatgtaagtaaaaagtgtctttaacatatgtttcttctcttttctcctttcacaaatatttcaaatttatattaaaaaaaaatagtataaacactcgttaatataatcgatggaggtgcttttagaagacgtcgaagctatcttcaccaacatgggtctaggaagacctctctcgagagttccttgcctcattgaaagtcaaaaatattatatttttagctatttaagatatttaaatgttaataatgttgtaatacaatatttaagtcgtaaatatttgatagaccacataattatttttgtgcttcaagcctctcaaaactaaggaccggctttcacttggagacaaaaaatcttctgaagttcctttttcttgtatttttttcttccatttctattacttcacatacctaagtgcaaaaattgattgtatcatgaaactatgtatgttcgatataaaaacagaaatcataaattttgttaaatgccaggtaaaaactagcatatgttaatttgtttttgcaatttatcctaccataatactctttttctgtttaaaatttttaatatacttttagccaacgacaaaaccagtttatatgaaagttaagatgacaaaatactaatggtctacatatagcaaatacacaactagttaaattcttctgtaattttgctgtttacaatgacgattacacacattcttaaagctgtgatgacgaatcagagaaagctttaaacagctgtaaagattacacatctcaagttttagttaagtaagttattaacaagaaaaagttttgaaaaaagtaaagacctttaatagttttcttttctcggacaaaacaataaataaaaagaacacactttttttatcttttgtccttaggatttgattgtacatacatctgatctcaagtgatttcaagtggttggttctgttccttttctcgtccccgatcaagtttcttctcctaaactccagaatttggtcttgaagatctctaaaggctcttcctttttgttcatttctctacccagatatgtaagttgctagcttcttctgtcataactttaatatctgaatctttttccgatccaaatagtcaaatattcgcatctaggtcaaatcgattcaaaaccctttttgttgattgatgtgctaagtagttctgagttgattaagtctatcagtttaagagaaaaggattgtgtaagattatgattcgtacaagttagcttctttcttgattaggtccactgtgaatcatgcacacgtttatgaggaagatattagattgtgtaagattctgattggtttgatggtttcaagttagtttctttgttgattattgattgctgagtagttctaagttgattatgtcaactctgaatcatgtacaagtctatgagctagaaaatgaattgtgaattgtggagctaagaatgatgttgttgttttggctgaaagcgatg

SEQ ID NO: 3107 - DNA, 3000 bp, Unknown
  misc_feature (1)..( 3000): cDNA_ID_1808527_gDNA_ID_1620626_Annot_ID_47136 3000 nt of promoter + ATG
tgtcttatcatcaagatcaagaattgcagcatgctacaattgaagcaagagatgtgatcagtcaggtagtttgatactaatcaacaaggaaaatataagattatgttttgactaaccgcgtcttccatggtagcgcgccaaccttgcatagacgataaaccaaatctgagcttatcattctcaccatcttctgataacttttcagttttcggagaacttaggtatgtacccatcgctttcagccaaaacaacaacatcattcttagctccacaattcacaattcattttctagctcatagacttgtacatgattcagagttgacataatcaacttagaactactcagcaatcaataatcaacaaagaaactaacttgaaaccatcaaaccaatcagaatcttacacaatctaatatcttcctcataaacgtgtgcatgattcacagtggacctaatcaagaaagaagctaacttgtacgaatcataatcttacacaatccttttctcttaaactgatagacttaatcaactcagaactacttagcacatcaatcaacaaaaagggttttgaatcgatttgacctagatgcgaatatttgactatttggatcggaaaaagattcagatattaaagttatgacagaagaagctagcaacttacatatctgggtagagaaatgaacaaaaaggaagagcctttagagatcttcaagaccaaattctggagtttaggagaagaaacttgatcggggacgagaaaaggaacagaaccaaccacttgaaatcacttgagatcagatgtatgtacaatcaaatcctaaggacaaaagataaaaaaagtgtgttctttttatttattgttttgtccgagaaaagaaaactattaaaggtctttacttttttcaaaactttttcttgttaataacttacttaactaaaacttgagatgtgtaatctttacagctgtttaaagctttctctgattcgtcatcacagctttaagaatgtgtgtaatcgtcattgtaaacagcaaaattacagaagaatttaactagttgtgtatttgctatatgtagaccattagtattttgtcatcttaactttcatataaactggttttgtcgttggctaaaagtatattaaaaattttaaacagaaaaagagtattatggtaggataaattgcaaaaacaaattaacatatgctagtttttacctggcatttaacaaaatttatgatttctgtttttatatcgaacatacatagtttcatgatacaatcaatttttgcacttaggtatgtgaagtaatagaaatggaagaaaaaaatacaagaaaaaggaacttcagaagattttttgtctccaagtgaaagccggtccttagttttgagaggcttgaagcacaaaaataattatgtggtctatcaaatatttacgacttaaatattgtattacaacattattaacatttaaatatcttaaatagctaaaaatataatatttttgactttcaatgaggcaaggaactctcgagagaggtcttcctagacccatgttggtgaagatagcttcgacgtcttctaaaagcacctccatcgattatattaacgagtgtttatactatttttttttaatataaatttgaaatatttgtgaaaggagaaaagagaagaaacatatgttaaagacactttttacttacatgtcactttttgattgggtttaatatttttacaatttattgattaaaattttaatctaacttaagacacttcactttgatcaccggtgcagatactttaagagcctcgcttcacgaagaaaaaccgaatcggaataacgagtgggagtgaattcggtgagcatgtaagtatcaccctcatcgcataaaacctccttagcttcaatttcgaaaagggaattgttatatactgattgaacaaaataaagatattctatagtaaacacatgttatatagaacaacatttgagattgatattgtaataatggagagaggtagcttctaatgagtatactactaaagtactaataagaaaactaaatttggctgtcacatcttatctatttgtttatgtggcccaacatttccaatatatattacaaaataataataatggataggcattgccaccggttagattataactcttcgtttgagtgcgacatatttgtaaccagagacaataattaggataaggattgaaccaaggaactaaacaaaaatttgaggatgaaacatagtccaaaacaaaatccatttaatttttgggacaagaacatagatatcataacacttaaatatgtgcctcaaattggtccaaaatgctctcgtgaatgaacgtggattttgcaccactcaacttaattacttactttgtcccatttaaaaaaaaaaaattataaaagcaaaaatattaaggaaaatttttcattataaaaatatcatctaatattttaatttaaaaccctaccataaatcatagaaaatactgcagcatataaataatcataaaattaaatagaattttacagtgatttcatataaaatactacagaagataaataatcataaaataaatataattttgcagtaatttcatagaataaaatgctccagaatttaagtaatcataagaaatctaataagcattttgtaaataaaaaaatccaactttgtctccaattgaattctgcaaaaaatccaactatactgcaaaacaaattccaattatgtctccaaaacgaatttgaaaacaaattgtgaagaaaaatatcattatattttttgtaaagtaaataaaattaaaaacacatttatggtccaaaaatttagttttttttgtttttttagttaatgtgtattttggcatgatataaagtgcgtcgtgtctcgactatatcatctctcggtttcactattgaacgtgtaacactggtcgaaagaagacgaacataaactcgtctccggtaaccaaaa

SEQ ID NO: 3108 - DNA, 3000 bp, Unknown
  misc_feature (1)..( 3000): cDNA_ID_1819534_gDNA_ID_1620626_Annot_ID_47140 3000 nt of promoter + ATG
cctcgaatcataataaaagttttgatgcctaaagacggagatcatgtacataacagattttttatgggtatctagaagcccaaaaacattaaattaatggataaaacaactgatttgggcctgagccgtatcattcaagtaatacttctgataccagtctctgatgacatggcagcttgtgattagttgggaaaacgtgtttttgtgggaaaggagagaaaaaaaaaatcatttgctcttctcttctctcctcttcactgcctcttgacccgattcttcttcaatggaagcgagaatcatcctccaaattaagacttcttggaaccctaatcgcaaattctctcctactcctttagatctatgccggaggcgcttatcttatgtttttctatatttattttcgattttgcaactaatttttttttaatgataccaacaccgatctcaccattgaaaacagatttatatcagtatcataaaaaatctcaaacaataaacaaactttaaaattaatagtaaaaaattgttagtgatactctatgagtaccaactatgtgcatgctccaaagcccttgctttttgggtttcaacccagatctgggtctagatgcaaatatactctcgctttctagatttgagttttatcgaatataccttctgctttaaatatcttttatttggagaagttcttcgattatatggataatctgttctcgcgtaagcgaacgaaagttcaattcaagatattctttagatactttggtatatgtggaaaactaaaactttttttcttttttttaagtcatcgatcgaacaactttggagatacatgatttagcagtcaataaaaagtgagatctaattcatagctaaggcttgagtggattgtcagagtagagatagttcaagtgatttacaaaccataattttcacattttatactgatggtccttaaaaacaaaaggattaaacgtctagtgttgcttggattcttcaacttcaagatggaacaaccaatattttaggtcttcaaaccgtcataggggcgtttcctcccttcgtatggagttgcatatatttttattggttgggtcaagcacaaataaggatcattttattttttttcgaataaggatcattattacttctctcgtttgttacaatttcaataaattactgcaaagagtaaaacaaccatctccaagggccttctcttccgagttgcaagaattcgagttactataagagaagactcattcaccggtccgaagaaaagaacgtttaggtagatttgttagcaaaacaagcttaactcattaataatttaatactattgtttcatttatcagcacttatgtttctttgttggtttgataatatacataattgatataatatggatttctttgttcgtgaaaaaagatttaaaatttgtggatttcttcccttatataagtgacattgcgtatttttttctaagaattactttaatttttaaatattactgccaactgttctatacttctattgactgaatattaatacatacatgcattgtctataagttgagataacatagaaaggaattagctaacaaattcttgaccacccaactttacgttacttttgaaacaggtccacatcaacaaactctccaaatacattgtaataactttaaatgttccctataaattacttttgcttttattgctattaaggagttagttaacatttcatttagatattatttaattatttcaaaatctttcttcattttctcctttcttacctcttatatattccttcttaagtatatctaaaagtgaaaagtttatacattactatatatttagcagtaatgttgtcgtattcatgttttgagaaaatctagtctatataaataatgcagagagaggactattaaaaccagtttaaaagaaagaagctcacaaacatctccgagaaatttagctctcttgttgtagtttggttttgtaatacgaagacgaaacaaacccaaacatttgtctggtgggataaggatcaggatcaggatcaaggtacacttttgttataactttctagtttgcaaacttttttttacttgaaagattcattttttctcttgggcacgtataattgattattttatggcgttttctggttgattaacttttgtgttgtatgaattatttatacatttatctaatgtgatgtgaaaggagtttttttgtgtttcaagtgcagtgacatgaaaaacacctatcacattaaaattaataaattttgatatgcatatgacaaatatttagatatatttttgttaccataaattttgtacctatatttgttatttttaaaaagaccatttgaacttccaaatgttgttaaaataggtaatacttaagcggggttatttgcctcgtcctgttaacctgctaaagtatacaactagaaaagtcttgacgagttatgtttgagttacttgattcatttcttatacgcttgaaatctaattattattagcttatatatatatataagtatttcttttgttgtaaaaaaaatgataagaatttttttgtcaaagctatatagttcttttcgagttgtttcggccactcgagttttggttggtaatttgattaatgtttcaaaatactatgtgtatatatatatattcagggtatttttgattattaaaaaaaaaattctctacttttatgcatactattcagtgttaggccaattttatatatttatattaaattggttaaaattataaagattgtgttatgttgatatgtcaagttatgttttcactcgtacattatctatcataacattaaatattcaggcataatatactatactatcatattcatatcaacttttttttttttcaatctttgattgtagggtgaaagacgaatttgtgggttataaaacaaaagctcaaatttcactatgacccgcagcagaaagttcttaacgaaaaag

SEQ ID NO: 3109 - DNA, 3000 bp, Unknown
  misc_feature (1)..( 3000): cDNA_ID_1819530_gDNA_ID_1620626_Annot_ID_47141 3000 nt of promoter + ATG
ccgcaaatatatagagaaagacccagctctagagcgtaggtttcaacaagtgttatgtgttcagccctctgttgaagatacaatctcgattcttcgtgggttaagagagcggtacgagttacaccatggcgttactatatcagatagtgcccttgtttcagcagcagttcttgcagaccgctacatcaccgaacgctttctgccagacaaaggtatggacattggacttgcactttccctgattacaaccagttttctttgggaagtgtttgaccatagtatttttttctaagatgaatgttcttttttcagctattgatcttgttgacgaagctggtgcaaagctgaagatggagatcacttctaaaccaactgaactagatggaatagatagagctgtgatcaaattggagatggaaaagctttctcttaaaaatgatactgataaagcatctaaagaacggctacagaagattgagaatgatctgtccacgctcaaacagaaacagaaagaactcaatgtccaatgggagaaagaaaagtcgctcatgacaaaaatacgttcgtttaaggaagaggtaaaatctttctcaatcactatgccttttcgacttaacgtctcataaaaataattttatacaagacacactgcagtttcttgttctaaattcgtacttttagtggtagtacttgtggtggttgctttcgttgttggtatatgtcgacgttaatgtcctccgtaacattttctatgttctatgttttacagattgatcgagttaacctcgaaattgaatctgctgaacgtgaatatgatctaaaccgagctgctgagctgaagtatggaacacttttgtccctccaacgccaattagaagaagctgagaagaatctcacgaatttccgacagtttggacagtcactactccgagaagtggttaccgatcttgacatagcagaaatagtaagcaagtggactggtattccactatctaatcttcagcaatcagagagagagaagttagtgatgttggaagaagtgctccaccatagagttattggtcaagacatggctgtaaaatcagtagcagatgctatccgacgttcaagggctggtctttctgatcctaaccgcccaatagctagtttcatgttcatgggtccaacaggtgttggtaagaccgagcttgccaaggctctagcgggatacctttttaacactgaaaatgcaatagtgagggtcgatatgagtgagtacatggaaaaacactcagtctcacggcttgttggtgcaccacctggctatgtcggttatgaagaaggtgggcagttaactgaagttgttcgcaggagaccttactcggtggttctgtttgatgagatcgagaaagcccaccctgatgtctttaatatcttgctacaactgctagacgatggaagaataactgattctcaaggaaggaccgtaagtttcaaaaactgtgttgtaattatgacgtcgaatataggatctcaccacatacttgagaccctccgcaacaatgaagacagcaaagaagcagtttatgagataatgaagcggcaagttgtggagttagcaagacaaaatttcaggcctgagttcatgaacagaattgacgagtacatagttttccagccgctggattctaacgaaatctccaaaatcgtagagttacaggtaactaacccttttaaacccactttgttttttcagaatctttgttcttctaaagacattagcttcatgttattacatttgtgtaatgtgcagatgagacgggtgaagaatagcttggaacagaagaaaatcaaacttcagtataccaaagaggcagtggatctccttgctcagcttggctttgaccctaactacggggcaaggccggtgaagcgagtgattcaacagatggtggagaatgagatcgctgtcgggattttgaaaggagattttgcagaagaagataccgttcttgtcgatgttgaccacttggctagtgacaacaaattggttatcaagaagcttgagagtaatgcttcagctgaagaaatggccgcttaattgcacaaacaaaattagacgattcggggtttagcgtttataactcttttgttctgtcttttgtagattcgtactttagtgttgctctctcttctaactcgtacggaatgtaatgttttgaggattatcttttgccgacaaaagtaaatgggaacacaccgacttattcctccgttagcatttgaaattatgaactttatggagcttttaaggactcacgtaccaatgtggtactattagaatttgtcacagatctgattttcaagtaaggagattacaaatcttacaaaatcaaaattgaagaaacgtttttgacttggaataataatttttttaaccacgttctcatgtcgctagaattgaatcggatattcggatccttctctttaatagcttccgacattgaagtatttgtttattcttaagtaagtttcttattaattcgtgtgtctgatatttaaacgagttagtattcttactagtgataaagtattagttagggactgagaaatgtcggtcgtgtcatgcaatgagggaaacaacctggtacatggagtctaaacaattatcgttttcttagaattgtacttttgaaattgcgaaatgagcctacaaattataatcaaaatttagctatatttttactatttgaatgattgaactaattttgatatacgttcgttatgttcgtcaaaactacccaaaacccgactatatataaatgtgaaacttctaaattctcaatcttaaaattaaatattctctagatctccacaatattgtttttgtaaaatattcgataaatctctttaaaatcattttggttcctctgttttcgcttccaaacagaacaaactcttttctctctccctctctctttcttgcttcctcaagctctatagaactgatcggcgataatg

SEQ ID NO: 3110 - DNA, 3000 bp, Unknown
  misc_feature (1)..( 3000): cDNA_ID_3022153_gDNA_ID_1620626_Annot_ID_47142 3000 nt of promoter + ATG
aacgacatattaaattagatgttgttattaactattcatgtattcgcaataatgtgaatcatgtattatactatccgtgtgaaaacgatacgtttataaattagggtatatagagatgattaatattttatatatacacgttttacttagaagttcatgacaatatattattctatcgatttcaaaatattttactttggcttaaccagctgggatatcaaaaaacaaaattattttacaatatatatcattatagtttattcacttctaacttgttacatcctactattacgttaaatacaggaggcatgaagccttcactatatataaacagcatcgcgaggttagaagatcttacattatacattctaacattggtaagagatggcaaaccaaagaaaaccaatccttcctctattacttgaaaagaaaccagttgagcttgttaaaccctcaaaacacactcattgtgaaactctttccctctccactttagacaacgatcctttcaatgaagttatgtatgcaacgatttacgttttcaaagccaatggaaagaacctagatgatcctgtctctttgcttaggaaggctttgtccgaacttcttgtgcattactaccctctttcgggcaagctgatgagaagtgagagtaatggaaagctccagttggtttatctgggtgagggagttccatttgaagtcgctacatcaactctagacctctcctctctgaactatatcgaaaacctcgatgaccaagttgctttgcggcttgtacctgaaatcgaaatcgactacgagagcaacgtttgttatcaccctctagctttgcaggtatgttttcattttctagatgtattgaaagttatagatttccaaaatattataacattgaatatattatcaatacataatcaagataatatattgttcactttgtttcttttgtaggttaccaagtttgcctgtggaggattcaccattggcaccgcattgacacacgctgtgtgtgatggatacggtgtggctcagatcatccatgccttgaccgagttggctgcaggaaagactgagccatcggtgaagtcagtgtggcagagagagcggctggtcggaaaaattgacaataaaccaggcaaagtgcccggtagccatattgatggttttttggccacctcagcatatttgccaactactgatgtcgtatgtcattttgtcaagcttattttatactctctccgtatcaaattaatatcatataattaaagtaatgattcagctattaatatcatattaagtgatgatttagcttattagaagatcttgcaaatatttatttttgtaataattaggttaatgatttttatttatttattatccaacaggtcacagagacaataaacattcgtgctggggatataaaaaggcttaaagactctatgatgaaagaatgtgagtaccttaaagagagtttcactacttatgaagtacttagttcatacatatggaaattaagatctcgagccctaaaactaaaccctgacgggatcactgtcctcggcgtggctgttggaatccgacatgttttggacccaccacttcctaaaggatactacggtaacgcttacatagacgtctacgtcgagctaactgtgagagaactcgaagaatcatcaatctctaacatcgcgaatcgtgtgaagaaagccaagaaaacagcctatgaaaaagggtatatcgaggaagagctaaagaacacggagagattgatgagagatgattcaatgttcgaaggggtaagcgatggattatttttcttgacggattggaggaatattggttggttcggatcaatggatttcggttggaatgagccagtgaatttacgaccattgacccagcgggagagcacagtgcacgtagggatgatcttgaaaccttcaaaatcggatccatcaatggaaggtggagttaaagtgatcatgaagttgccacgagacgcaatggttgaattcaagcgtgagatggctactatgaagaaactttattttggtgataccaactaactttattttggtgataccaactaactttagttggtgcctgaatgattttctatgtctgttaatgtcttaatgaatgcttttcatttgatgtcagtgaataatgggtaaatatattcacgggtgaatatatgtaatactcaatatgttcatgtaatacttaatctgttcatgtcatgaataatgaataaagaataatacatatatatgtattgataataaattgatttgttgtgaaatataatgaaacaagcaaaattttcttaaacatattacaaaaaaagggaggttttcgagcaaaactagaattaataaaacaaatgcaacttggtttactactataccaaaagactcaaattgctaaactgaaccgaaaatcggtttaggtattagcctgcctatagaaaaacccagtggtggatcatcactggaaacttctcgatgaaatgactttcttctacaaacttctttttccctcttctccaagcttacgcttgtctccatgtaaaaaacctccgtcgtcttcttcctcctccttcataaccctaaaccaaaaaccctcatttccttcaatcttcttactcacatggcgctaaggagattatcaaagtctgtttcgtcagccatcaaagctcaatacactctctcgagaccctctcctctcctccgttctcgctctctctcttcctctcctcactacacctctattggccggccaacaaattcattcatcggaaaaatcaataactcttctatcactcatgcgactactactcatggtcaactcttccctctttcttctccgcgacgcttttgtactaccacagctcaggttcgtgctcgatttcagtgttagttgctcaattgtgaacttggaactgttaattttatggtttagtgataataggttaatcaaaatgagtttacggagatg

SEQ ID NO: 3111 - DNA, 3000 bp, Unknown
  misc_feature (1)..( 3000): cDNA_ID_1819518_gDNA_ID_1620626_Annot_ID_47144 3000 nt of promoter + ATG
agttcgtacaatagctactaaacaactcgattcatcaaactctataccacatgagcaagatcgactaaccttgtgaaagagaacgagagagaaattggaaaaaaccctagccaaaattacccataagaataaacaattgagcatcgaaatgtgagtacccagaagtcgaattaacaatctcttaccgcaatatcatgaaaagatcaaaactttacaaaacccaaacagtttcaaactcagtttgtaacgaaaatttgaaagaaaggaagagaaaaatagtaacttgagaagtaatttgagaagtcgaaagcgatattactagtcgaagatagagtaaaaagtgaagcagagaagagtgtggaagagaaggagaagacgaacctttgaaatggttgggatctgtttttgcagaagaagaaagtaatccgaaacgaacgaaacttgaaaattcagacaacacaaatgatttctaacatttagcttaccaattttaacttatggttattattaactttaatacacttcttaaggtataaaatatcacctctaattaaattaccttctcaatatcattattttttcacacacaaaaaacttacttttttgtttgaaaaaattataattacttctaacttataaaaataagtgtcaaaaataatgacaattacttttcacttacccaatattgttattatataaacttagatatttttaaatatttaagtttatttaccttttcccctcaaagaggctagaggaagatttaacatgctttgcttggtttcgctatttatcatggagctgaaatctcttgacgtgggttcactccttgttggtgctaattatggagaagattttgagacaaggtttaaaacaatattgaaggaagtatatgcttcgaatgggcaaacaatcttgttcattgatgagattcacattgttattggtgcaggtgctctttctttttttgattcagattatacattaatagatgacctttttatttatacacaatacttgtatgcatttttttactctgaccaagtaaaacgttttgtataaatggttttgatgggtggtaactctataaaaatgatttttcatctcattagaagaatactgcatcgaacaattattgaggattaacactggagatgaacaattatgtctactaagtatttcttgtataatcttgtgtctctatactaatgagttattactcttgtgtaggagctacttgtggaggcgtggagcaatagaagcgagcaacttcttgaaaccgttgcttagaccaggtgagctgagatgcattggtgcaactatgtttgttatatccaccttaacttatttagcttaaacttaaccaaccaaacccactaacacttgtggggctataattcacttacggcccaatggccttattacaaaacacaaatccaactccgttcttatgttggatttgtgtcgttgactcttcttcctcctttggtcagtggtcacgacaacttcttattctcttcttcctcctttggtcacgacatcttcttcttctcttcttccaagcttggcttcttctcttttcttcatcttcttcttctcatgaagctttcttcttcttgtaggatttaatctaggattcaatctccaacgacattgaccaaaaatatatagagagatatccaacgctaaaacgtaggtttcagcaagtgttatgtagtcaaccaactgtcaagaactaattgcgtagcccttacaatatgtaataacaattgtagcttaaattacatgctttgttttcagattttaactattaaatttttggtatatttctttgaaattttttggatagttcacaaacacattaccatatttaaatctgaattattatgtgacatcaatatatagtataacaaatgatgatgaactataatttaatcgtatggatactagcataaagcttataaaatgcgtgctccggtgttattacacgtggtccaagttcgactatagaatacaatacaaaggacacaaaatcttcatgtacaatcaaaaattatcaaccccatatcttatagttggaaacgatccaaaataggttatataaataaaatatataaaatatgtcaagtataacggtctcacatcacccttttggcttttggggaaatatcggatttatagaaaaaaaaaaataataataataattaaaacaataaaatatttggtctgaatcttttttgagatactgttgtatcataacaatatcttttagagtcattcaacatcaatccacatgtattgcactggaacatgcattttaataaggttctatgtttgttaaattatgcagtcatgtaataatcaaattttatgataatgtctttgtaaacgctataaactaaaaatttataatagttacatgtgtaaaaaatgttgtcgcttaaccatgtcatatatatgttggttggtatacgtggatatacgatacatataattggtgtagttagctctcattttttcttttgttttgtacattatcgtcgtacgtcgactttgtatactactttatactccgtcaaactaaaataacttaaaatataataaaattgtattcattatattcacagaaaaataaaaatgttattcttgtaacaaatcaaactaaaaaaaagggaaaataagaatgactaaatgtttatgaagacgaaagagagaaaacatttttgtatttttattgacattttttagcagtcaagatgttagggtgaggaaatgaaaagttaatagaaacatgtatagtaaaagagacattttttcttgattgtagatagtgaatgtacgagtatactatcaccattagatttaaaaaaaaaaaacattttgcagaattattcataaactaaaatttagaaaataatgtaggagttaggtgaaccgcttatatataataaagacccaattagtaagtagatcaaacacaaatcaaatcagccatacatg

SEQ ID NO: 3112 - DNA, 3000 bp, Unknown
  misc_feature (1)..( 3000): cDNA_ID_3031914_gDNA_ID_1620626_Annot_ID_162487 3000 nt of promoter + ATG
tatggttatcttaatttgtttacaaaatatggttattcagttaaatcaccctatactatattgtccctctacaaaaattaggtattttcttaaatcttgactttgggggagttggatattttcgacgaagaatatcaaaaatctaaaaagacatgttttggatatgtaaaacaaaatttagaaaagtatcttatatataaggtatgttatctccaaaaaaatgtaatagtagatttgcatttctagtcaatatgttgatattaaacaccaataaaatagtcaatgcactaattaagttgccattttcatgcatcaaaacacactatttaaatattgccatccaccataagattttaaaataaagaaaacattcaaaacatcacgttcttagaacttaaaactaaattgacaaacacaaaatttcaagctagggatatgtcggcatcaaaagcaacaatgctcattttgttcgctctctttctttccggtaagtcttgattcctctcatcttcttttatataaatgaaactgattagaaacatagcttgattccagtcaaattttattttaaaaatgaacagacatattgttggtgagcattcctagagctgaagctcagttgatagttccatgcaagacatcagaacaatgtaaatcgattcgatgttctaatggaagcgcacaatgtgtgaacaaacaatgccaatgtccaagcctcaaacagatttactcggtgacggatgtgtcgtgcaagacggtctctgattgtgttgcttctcatcaatgcccgactggtttatctgcttgtattgaaggaaaatgtatttgtttgccttagtatgttcaaattatattatttaatatatacctacaagttaatttttaaaaagtttagttttatagatattaatttgaattcgtttactatggggaactctatcgacataaaaaagaaatctaatcgtagtcaacaaggccagagtatatgttggtaacgtactctatttactttctaatattacacaatcgactactacgtgatataaaagagacatctctacaatgataatgtgaaatattcattgttgatactttacgaaaaaaccatagtttcgacatttatattaattatgtatatattcatcaaagttatgttaaccaacataaatttcagttacaatcaaattttttgttgtaatatctaaggctgggtaaaatacccggacccgaagatccgaactagctcaaaatatctagatgaaaaatactaggctttttcttttgaaaaactaaatcagcgaatgagattaaccaatgctaccgacggctaacttatcgataacatttttcttctcttatctcgatgaaagatgatctctcgaaaccaaatacacaagacttcataatctagtccgtatacgccaaaaaatgaacctcataaaacacttcttgatgcggcgaaaacaattgatgcataatggagcgcctataaaatccttataaaagaatctaatctcaatcagtttcggaaatttggagacaagaagcgaaagctaaccatcttgataaacatcaggaacaagaatgacacttgatcgaccaggttagcatccacaaatggggctttgttagcttaggtaagacaacaaagagtgagtgcgaagacaaaggttggatgaaggctaacgagaaaccactttcaagctaagcctgtggcatcgaaactatagggagcacctaagcgataactagatttgggttgggagaaggcaaatatcaatggctttattattgactaagcacactgtcgatctagcaaatccggcaaatcctcattgcatgagccacaaaacgaatagatatgaaacgcttgaccgctttcgcatagaacacaacttcacaacccaaaataacaagagaaaatctccagacgaatacaaaaaaaacaaaaaaaactctgcatctcctatgatttaaaaccaagaaactaaagcagataagaaaaggagaagccactcacgacattgacgagaatcgctgatcacagcaccagagtgacttcccagccacaaaactggaaatgagctaggattctactgttgtttgagtgaaagagcacacactttggttaaaatgacattagatcatcgttctaaccacctgccattgctcttttaattatataattaaatttgatttttataaaactacaaaatctcttgtaattttcaaatttattacctttttaatccaaagcgatccaaaaataaatgtaaattgaagaatagcaccaaaaattgataaaattataataatttcgtaatttaaccaaattatcaccataatcactttggtaatttctaaaaattactttaacttcgataacataattactaacatacaaattaaaatcaaattttgtaaagagtatcaatcttccattacaactttagacttcaaccattaccatacaaccaaatgaaactgaactatttgtatataaaaattattctattttggttccaatataaataaaatatctagtttacattttttctgtgtttcttctaattatatagatttagttctataaaaatacaaaacctctaagtaattttcaaatttattatatttttacccaaaacaaccctaaaataaatgcaaattgaagcgtggcactgaaaataaaataaaaatatcttaccatatttaaaacaaataaccagattcagtgaattaacagaaacggatggtcaagtcgacaagacaaacaagtgctaaaagaacacaacataactcttttgcttaagcctcaaaaaattgtcattaacccaatttcccagaaacttcaaaaacagttgggggaagaagaagaagatgaaacgacgaagaacccttttataaagtctcaatcttctaatccaagatctgccctttttcagattctatctcaaagctttcctcgatcttgtgatgtattgaagccggagactgagagag

SEQ ID NO: 3113 - DNA, 3000 bp, Unknown
  misc_feature (1)..( 3000): cDNA_ID_2143028_gDNA_ID_1620626_Annot_ID_162485 3000 nt of promoter + ATG
gaaagagttttgatgcacgctcaagcgtgtaacgcacttcccaatctcaagcatgcttgctctctctaaagcctgtctcatttttaaaatccaaaatattgttttgtcaactaatttaaaacagttttttttttagaaagctatttaaaactgtttcacaagatacacttttcgaatattcatagtagtttttgaaaccatactccaatcaatctgattacttgtaattaaagtatggtcttgtaatattaatttccaaaggtgtgattttataaaattcaaatttaaggcgataacaaaacttttgagcttactttatccattgagaggcaagttttcctacgcaacaacagttgacacggaagtattagaacacaaaaatagtaaattcaaaggattcttctatcaaaatataagcttccaactcaaaactaattggtaatgagtgaagaacgttatatcttataaatattacttaagattatactaacttctaatatgtgacaatatctctaatacgatccttctaaatgatggcttttctatccattagtcttgatatgtttgggcatagattagtggaccgatgtggattgggttgactatatgcagatcggacactgataccatattagattatgggcttccaactcaaaatcaatcgggaatgagtaaagagacttatatcttatatataactgcttaagttcctactaaactttcaacgtgggacgatatctctaatatcgatcaattcaataatttcaaccatgccgaaagctaagacgattatgagaaaaaaattgttttcttatacgccgagctggaaaaatgatccacgacagtctatcatttctatgccaaattatagtgaaaaataaagtcaagatgtaattaagagacatagtgtttatatttttggaaaaagatcaaaaggatgctaaaatttgaataccagataccgttacgatttggatatcagtggagtccgagtgcaattgtcagtttactatcttttgtaccatatattttagagcgtttttcttaacgttatcatatatttcgatagcgtttttctaagaataatgatatagtcgattttaagagtatgtacaaaaaacataggctactttatggtttctacaattgatttgctaagtcaattttatcatttgcttgtacatcagtgcatgaaaggagaaaagggaaaaacagtaaacagatatgtattatctacatgaatggacatatcttagacctcgtgaagtaccttaaaaacttataggagaaagagggttactacttactacctcatctagacctcgattacgcgatcaaagcaatactggatatcagatagatgtggtcttatctatcaaaattgtttagtccgttttcgagtttgggacaaatctccttagaaaccagctagaatggcttaatctatatataagataataataagtttaacaccaagacttgccgaagttaagttacatgtaatgctacgagattctctgatacatatgttataaagtgaagttaaaacacttttctcaagaaacacacttacataaaaattagtcacgaaggtaaacaagtgctaaaaaaaatgaagggtcttctccaacaagaaagaccgttttaacactactacttggggttcgtaaattaatacaaaatcctggaataaaaccatttatcatcttatatccaaccaaacaaattaatataaacactgttaaaaaataagaaatgaaatttaaattaatgatagaaataatcgaattaggtgttttgatttttttttctgtgactacaatatatttaaaacccaaaattttacaaaaatcgttttagtaaatcggtttaaatctgaaacaaatgctaaggaaagtatttaacagtgattgacattatggaaataatttaattttttttgtccgtttaacagttggacaatactagattaacaagaatcaaaatgtatctccacaataatgatgcgatataaatgatagtataaaccaaaatctttttacttaaacactttcctatctctaacataattactttttaatttcccccattcaaataacacctaagtattattttacctggtttttactttttaacacaatttaattgcaaacaagtagtgtgttttattagtttaaactttaaagtctttagactagagagaggaagtggcaataatactaatccggttcagtcactaaaccagtgtacaatatatggttggtcctacaaatgataatttttgataaacctaaaaaaaatggtgtattatatatcacctgaggatagggatacaagtttcttttagggtggaaatccttatatataagtgtagggactactcaccaaaatcaaacaactcacttcaatttgtaacggtttaaactcggtacaatatgcggattttgattcggtataatgacattaaaacaccactttaacaaaaaccactagacaaatattagtcatttcggttcagtttcgtttaaaaattacgaattttcgtataattgagtttattattccgtttggtttaaaagaaaccatacaaaacaaaacaaaccaaactaaaccaaattggttatgtttcaaagattctttctaagtctctcaataaaatgttatttgttttgtaatgtaaagaaaaaaaaaagaattgcagaaaaagagtggatagtgttaagaagatgatcacacacaatttccatagccatttatagatagctagaagagctaaagaagattcctttttttaactctgctggaaaaatctttttgtctctctctctaaatctaaatattatatactactactctctctctctagaccccattcacatatttaatctttaactcatttctccatcgacgttcttgcacatcccactttctctctttcttcaacttgcaaaaaagattaaaaatccaatctttcgtttctgggtctgttgaaaaacgatg

SEQ ID NO: 3114 - DNA, 3000 bp, Unknown
  misc_feature (1)..( 3000): cDNA_ID_3070714_gDNA_ID_1620626_Annot_ID_162484 3000 nt of promoter + ATG
tatacatgtttctattaacttttcatttcctcaccctaacatcttgactgctaaaaaatgtcaataaaaatacaaaaatgttttctctctttcgtcttcataaacatttagtcattcttattttcccttttttttagtttgatttgttacaagaataacatttttatttttctgtgaatataatgaatacaattttattatattttaagttattttagtttgacggagtataaagtagtatacaaagtcgacgtacgacgataatgtacaaaacaaaagaaaaaatgagagctaactacaccaattatatgtatcgtatatccacgtataccaaccaacatatatatgacatggttaagcgacaacattttttacacatgtaactattataaatttttagtttatagcgtttacaaagacattatcataaaatttgattattacatgactgcataatttaacaaacatagaaccttattaaaatgcatgttccagtgcaatacatgtggattgatgttgaatgactctaaaagatattgttatgatacaacagtatctcaaaaaagattcagaccaaatattttattgttttaattattattattatttttttttttctataaatccgatatttccccaaaagccaaaagggtgatgtgagaccgttatacttgacatattttatatattttatttatataacctattttggatcgtttccaactataagatatggggttgataatttttgattgtacatgaagattttgtgtcctttgtattgtattctatagtcgaacttggaccacgtgtaataacaccggagcacgcattttataagctttatgctagtatccatacgattaaattatagttcatcatcatttgttatactatatattgatgtcacataataattcagatttaaatatggtaatgtgtttgtgaactatccaaaaaatttcaaagaaatataccaaaaatttaatagttaaaatctgaaaacaaagcatgtaatttaagctacaattgttattacatattgtaagggctacgcaattagttcttgacagttggttgactacataacacttgctgaaacctacgttttagcgttggatatctctctatatatttttggtcaatgtcgttggagattgaatcctagattaaatcctacaagaagaagaaagcttcatgagaagaagaagatgaagaaaagagaagaagccaagcttggaagaagagaagaagaagatgtcgtgaccaaaggaggaagaagagaataagaagttgtcgtgaccactgaccaaaggaggaagaagagtcaacgacacaaatccaacataagaacggagttggatttgtgttttgtaataaggccattgggccgtaagtgaattatagccccacaagtgttagtgggtttggttggttaagtttaagctaaataagttaaggtggatataacaaacatagttgcaccaatgcatctcagctcacctggtctaagcaacggtttcaagaagttgctcgcttctattgctccacgcctccacaagtagctcctacacaagagtaataactcattagtatagagacacaagattatacaagaaatacttagtagacataattgttcatctccagtgttaatcctcaataattgttcgatgcagtattcttctaatgagatgaaaaatcatttttatagagttaccacccatcaaaaccatttatacaaaacgttttacttggtcagagtaaaaaaatgcatacaagtattgtgtataaataaaaaggtcatctattaatgtataatctgaatcaaaaaaagaaagagcacctgcaccaataacaatgtgaatctcatcaatgaacaagattgtttgcccattcgaagcatatacttccttcaatattgttttaaaccttgtctcaaaatcttctccataattagcaccaacaaggagtgaacccacgtcaagagatttcagctccatgataaatagcgaaaccaagcaaagcatgttaaatcttcctctagcctctttgaggggaaaaggtaaataaacttaaatatttaaaaatatctaagtttatataataacaatattgggtaagtgaaaagtaattgtcattatttttgacacttatttttataagttagaagtaattataattttttcaaacaaaaaagtaagttttttgtgtgtgaaaaaataatgatattgagaaggtaatttaattagaggtgatattttataccttaagaagtgtattaaagttaataataaccataagttaaaattggtaagctaaatgttagaaatcatttgtgttgtctgaattttcaagtttcgttcgtttcggattactttcttcttctgcaaaaacagatcccaaccatttcaaaggttcgtcttctccttctcttccacactcttctctgcttcactttttactctatcttcgactagtaatatcgctttcgacttctcaaattacttctcaagttactatttttctcttcctttctttcaaattttcgttacaaactgagtttgaaactgtttgggttttgtaaagttttgatcttttcatgatattgcggtaagagattgttaattcgacttctgggtactcacatttcgatgctcaattgtttattcttatgggtaattttggctagggttttttccaatttctctctcgttctctttcacaaggttagtcgatcttgctcatgtggtatagagtttgatgaatcgagttgtttagtagctattgtacgaactatctcttgatatagttgtaaaggttttagattgggaacaaaaaatttcactgtgatgtttgtttaggtagtagagttcaattgtgtgaaactctaatttcatagtttgcttaagtctcagaactagcactgagtctattgttatatgtgttgtttatgtaagtttgttgttattgatgggagatatgttttgtgtgcagaaa

SEQ ID NO: 3115 - DNA, 3000 bp, Unknown; identical to SEQ ID NO: 3111
  misc_feature (1)..( 3000): cDNA_ID_1819518_gDNA_ID_1620626_Annot_ID_162481 3000 nt of promoter + ATG

SEQ ID NO: 3116 - DNA, 3000 bp, Unknown
  misc_feature (1)..( 3000): cDNA_ID_3022153_gDNA_ID_1620626_Annot_ID_162479 3000 nt of promoter + ATG
ggttttagacaagagataaatctgaaaattagttacaaaagatgcattgaaaatgtaaaacaatattgtttttgaaaaaaaaactcaaaaccgacctctttgtgaaatagagggagtagtgtttaatttaaagaacaatttctcttaaaatcaacctatatataattcaattaaactcaatgatctataaactatcagttttgtagtcttaacttagataactaatgggttttccaaaataaaataaaattagataattgatagtgttaagcaagagacaatataatatttttcaacaatgaaaagttcgtttagctgacgctatatcaagttaattcatgtgaaaacgacatattaaattagatgttgttattaactattcatgtattcgcaataatgtgaatcatgtattatactatccgtgtgaaaacgatacgtttataaattagggtatatagagatgattaatattttatatatacacgttttacttagaagttcatgacaatatattattctatcgatttcaaaatattttactttggcttaaccagctgggatatcaaaaaacaaaattattttacaatatatatcattatagtttattcacttctaacttgttacatcctactattacgttaaatacaggaggcatgaagccttcactatatataaacagcatcgcgaggttagaagatcttacattatacattctaacattggtaagagatggcaaaccaaagaaaaccaatccttcctctattacttgaaaagaaaccagttgagcttgttaaaccctcaaaacacactcattgtgaaactctttccctctccactttagacaacgatcctttcaatgaagttatgtatgcaacgatttacgttttcaaagccaatggaaagaacctagatgatcctgtctctttgcttaggaaggctttgtccgaacttcttgtgcattactaccctctttcgggcaagctgatgagaagtgagagtaatggaaagctccagttggtttatctgggtgagggagttccatttgaagtcgctacatcaactctagacctctcctctctgaactatatcgaaaacctcgatgaccaagttgctttgcggcttgtacctgaaatcgaaatcgactacgagagcaacgtttgttatcaccctctagctttgcaggtatgttttcattttctagatgtattgaaagttatagatttccaaaatattataacattgaatatattatcaatacataatcaagataatatattgttcactttgtttcttttgtaggttaccaagtttgcctgtggaggattcaccattggcaccgcattgacacacgctgtgtgtgatggatacggtgtggctcagatcatccatgccttgaccgagttggctgcaggaaagactgagccatcggtgaagtcagtgtggcagagagagcggctggtcggaaaaattgacaataaaccaggcaaagtgcccggtagccatattgatggttttttggccacctcagcatatttgccaactactgatgtcgtatgtcattttgtcaagcttattttatactctctccgtatcaaattaatatcatataattaaagtaatgattcagctattaatatcatattaagtgatgatttagcttattagaagatcttgcaaatatttatttttgtaataattaggttaatgatttttatttatttattatccaacaggtcacagagacaataaacattcgtgctggggatataaaaaggcttaaagactctatgatgaaagaatgtgagtaccttaaagagagtttcactacttatgaagtacttagttcatacatatggaaattaagatctcgagccctaaaactaaaccctgacgggatcactgtcctcggcgtggctgttggaatccgacatgttttggacccaccacttcctaaaggatactacggtaacgcttacatagacgtctacgtcgagctaactgtgagagaactcgaagaatcatcaatctctaacatcgcgaatcgtgtgaagaaagccaagaaaacagcctatgaaaaagggtatatcgaggaagagctaaagaacacggagagattgatgagagatgattcaatgttcgaaggggtaagcgatggattatttttcttgacggattggaggaatattggttggttcggatcaatggatttcggttggaatgagccagtgaatttacgaccattgacccagcgggagagcacagtgcacgtagggatgatcttgaaaccttcaaaatcggatccatcaatggaaggtggagttaaagtgatcatgaagttgccacgagacgcaatggttgaattcaagcgtgagatggctactatgaagaaactttattttggtgataccaactaactttattttggtgataccaactaactttagttggtgcctgaatgattttctatgtctgttaatgtcttaatgaatgcttttcatttgatgtcagtgaataatgggtaaatatattcacgggtgaatatatgtaatactcaatatgttcatgtaatacttaatctgttcatgtcatgaataatgaataaagaataatacatatatatgtattgataataaattgatttgttgtgaaatataatgaaacaagcaaaattttcttaaacatattacaaaaaaagggaggttttcgagcaaaactagaattaataaaacaaatgcaacttggtttactactataccaaaagactcaaattgctaaactgaaccgaaaatcggtttaggtattagcctgcctatagaaaaacccagtggtggatcatcactggaaacttctcgatgaaatgactttcttctacaaacttctttttccctcttctccaagcttacgcttgtctccatgtaaaaaacctccgtcgtcttcttcctcctccttcataaccctaaaccaaaaaccctcatttccttcaatcttcttactcacatg

SEQ ID NO: 3117 - DNA, 3000 bp, Unknown; identical to SEQ ID NO: 3109
  misc_feature (1)..( 3000): cDNA_ID_1819530_gDNA_ID_1620626_Annot_ID_162478 3000 nt of promoter + ATG

SEQ ID NO: 3118 - DNA, 3000 bp, Unknown
  misc_feature (1)..( 3000): cDNA_ID_2142994_gDNA_ID_1620626_Annot_ID_162473 3000 nt of promoter + ATG
aatttttttggtgtttgtcgacaaaatatcaatactacaattaatttttgtcctactgttacaccttttagttttaacttgggtaagtgagtcgttggactaaaaatcacgatgattatgtggtcaaatatgtgtatcttggtgtatatttgtattttctgtgattaagatgattgcatctttaagacatatttgtagctttaattgaagtcaatactgatatttctgaagagattgggaaatttggaagacatggaatattggtgaactttgtttctgactttaatgatttcagagttgttggttccagctttattagttcgcttcatttcatatattcaaaaaaaaaaaaaaactttcctttctcatcaaatctattgatagttctaaaataaaacgcaaaatcaaacacatttgtacatcattttaataaagaatgttcaaatgagagtaatgtgtattatattgtaacatggaaatgcaattctaaacgcaaacgacaaactctgatcgaagaaatgtgttaattgattagggaattgtcacggagatatatgtaggaaatcaaaattgttaacgaagtgtctttcaaaatatatcttcacaaatacacagttcgtaaatgcgtaattatttttaatctaacagttcgttctgtcacatggatctttcagaccagtacagtcgtcctttgcaaagatttatcaactttctaacaaaaagagaagctacagaaagtagagaaaattttgtacttttgaagtaaagaaaaaaaaaagaagtagacaaaattgtgtaggattcttcacggtttttgcattcttctttattaccaagtcttcaatattttcatttcaataaaacttcccctttcttacaaagaactcttattttccatttttcttcacatttttccttgcaagatcactcattttaatttatgtaaatgatagaatttgaagatccatacttcagcaatctgtttttcttggcatgttgagtttttatcaacaacaccaattattattttattttctctggttcaagaaattgtctaagctccattcaaacattctgtacttatatataaagtttacatcatcacatattgtgcatcaaatagcaaaggttttggcaacatacatataatatgaatcgtgcttgtacacacacacacactcatgtatatatatgtatttattgtttacccttgaacaacatttttaggtaagggggtcttctatcatcaggaaaacataaggtagatgaggtaacatctttagattcgttcgaagtagaactcctatgcatttgatcaaattgttttctaattaagtaatgcaacatttaaaccatgtgcagcacaaacgatggcttatttaggtggatttgcaaatcttttcactctttagggcatattccaatcaactactgcttgaaatttgactgatcaatgtgatgcaaaattcacggcatggcttgttttagcagctagtttcgacaacctaatcacccgaaaataacaaacaatcggaaatgcagcgcgataagtagatatatgtctgtgatcacccaattagccacaaaatagtgtactatgtttgtgatgttacccttttactcttcaattttaaatacatatctcgttatagtatttttttttttttttttttttttttttttgggtaaaactcgttatagtatttcgttagagtattaacatttgtgtaaacataattgttgtcattaatcgtgggtccaaatcatgacacatcacaaagtttcttggacttgttatacatgttccttaaaatgattagttatatattatcttaataatcctgatctttaaatcgaacaaatttagatttagcttcttttttttttgttaaaatttagatttagctttacaagatgtacctttgattatgatagaggaaaataacagtatcccacccaaatacacggttataatgagattttcatgtatgtagaaaaatcatcaaattgtaagaaaacaattggaaaaattgagtgtgttgttttgagtagcaaaatatgaagaatccatcaaaccaagaaattagcaaagatgtagaaaggaagatttggtcgatagattcacggacgtattagaaatgaccactttccgatacaatcgtcccaactaggaaaagagtcaaagcttttcgaaagaaattaaaaattcctctatgaaaaataagtcaagaaattgttttaaaaatatttaagggccaagtagaaaaggtcacatcttgccttaccaaaaaaagacagttcattgaaattttatcgggacaagtttactatttttaattaatgcgtatctacttcaaaacatgcgtagcattaacggcgattccacgtcaatttcatggcgtccacaatttttgtataaggataagagagttacttttatatttttaaaatctattctgaaaactttaagaacttatttacatgaatacatggtcagaaatgtgcgagaccattgtttaactggttaaaaaaaggatttatttacatagaaatggatttaaatcacctgttacacttttattgaaatcattctcttatgatcattgcatcgtaactcgagatatttatttttcatgctttagtttgttaattatatctagttttatcatgttctataacccttttttaggcactcaacataaatagcaaaccccgatttagttcaattcgcgaatcaatttcgtcttggttattcttttggctttggtcgtatttaattatgctagctgccagatcttaggcacatcactttgtttagataagattagaacatttcttcacagttcacttagtcgtcacatatcaaacaaagtagacaacattataaataaaaaaattccacaaataatttctgcttatatatatagatatgtaaccaaatcacaaaattccacataattagtctcacatatacttgtaactagtcagacaaagacaatg

SEQ ID NO: 3119 - DNA, 3000 bp, Unknown; identical to SEQ ID NO: 3107
  misc_feature (1)..( 3000): cDNA_ID_1808527_gDNA_ID_1620626_Annot_ID_162472 3000 nt of promoter + ATG

SEQ ID NO: 3120 - DNA, 3000 bp, Unknown
  misc_feature (1)..( 3000): cDNA_ID_3070726_gDNA_ID_1620626_Annot_ID_162470 3000 nt of promoter + ATG
agagaaacccaggattaattggagattttagagaaaacccattactcagattcgcgaaattcgatattccggtggagaatttcaaggaagggacgagaaaggttgctgaggaattaggtctagaactgttgacgactgtagagaatgttccgtacgaagaagatgaagtagtcatggaaaccatttttggttaccggagacgagtttatgttcgtcttctttcgaccagtgttacacgttcaatagtgaaaccgagagatgatatagtcgagacacgacgcactttatatcatgccaaaatacacattaactaaaaaaacaaaaaaaactaaatttttggaccataaatgtgtttttaattttatttactttacaaaaaatataatgatatttttcttcacaatttgttttcaaattcgttttggagacataattggaatttgttttgcagtatagttggattttttgcagaattcaattggagacaaagttggatttttttatttacaaaatgcttattagatttcttatgattacttaaattctggagcattttattctatgaaattactgcaaaattatatttattttatgattatttatcttctgtagtattttatatgaaatcactgtaaaattctatttaattttatgattatttatatgctgcagtattttctatgatttatggtagggttttaaattaaaatattagatgatatttttataatgaaaaattttccttaatatttttgcttttataattttttttttttaaatgggacaaagtaagtaattaagttgagtggtgcaaaatccacgttcattcacgagagcattttggaccaatttgaggcacatatttaagtgttatgatatctatgttcttgtcccaaaaattaaatggattttgttttggactatgtttcatcctcaaatttttgtttagttccttggttcaatccttatcctaattattgtctctggttacaaatatgtcgcactcaaacgaagagttataatctaaccggtggcaatgcctatccattattattattttgtaatatatattggaaatgttgggccacataaacaaatagataagatgtgacagccaaatttagttttcttattagtactttagtagtatactcattagaagctacctctctccattattacaatatcaatctcaaatgttgttctatataacatgtgtttactatagaatatctttattttgttcaatcagtatataacaattcccttttcgaaattgaagctaaggaggttttatgcgatgagggtgatacttacatgctcaccgaattcactcccactcgttattccgattcggtttttcttcgtgaagcgaggctcttaaagtatctgcaccggtgatcaaagtgaagtgtcttaagttagattaaaattttaatcaataaattgtaaaaatattaaacccaatcaaaaagtgacatgtaagtaaaaagtgtctttaacatatgtttcttctcttttctcctttcacaaatatttcaaatttatattaaaaaaaaatagtataaacactcgttaatataatcgatggaggtgcttttagaagacgtcgaagctatcttcaccaacatgggtctaggaagacctctctcgagagttccttgcctcattgaaagtcaaaaatattatatttttagctatttaagatatttaaatgttaataatgttgtaatacaatatttaagtcgtaaatatttgatagaccacataattatttttgtgcttcaagcctctcaaaactaaggaccggctttcacttggagacaaaaaatcttctgaagttcctttttcttgtatttttttcttccatttctattacttcacatacctaagtgcaaaaattgattgtatcatgaaactatgtatgttcgatataaaaacagaaatcataaattttgttaaatgccaggtaaaaactagcatatgttaatttgtttttgcaatttatcctaccataatactctttttctgtttaaaatttttaatatacttttagccaacgacaaaaccagtttatatgaaagttaagatgacaaaatactaatggtctacatatagcaaatacacaactagttaaattcttctgtaattttgctgtttacaatgacgattacacacattcttaaagctgtgatgacgaatcagagaaagctttaaacagctgtaaagattacacatctcaagttttagttaagtaagttattaacaagaaaaagttttgaaaaaagtaaagacctttaatagttttcttttctcggacaaaacaataaataaaaagaacacactttttttatcttttgtccttaggatttgattgtacatacatctgatctcaagtgatttcaagtggttggttctgttccttttctcgtccccgatcaagtttcttctcctaaactccagaatttggtcttgaagatctctaaaggctcttcctttttgttcatttctctacccagatatgtaagttgctagcttcttctgtcataactttaatatctgaatctttttccgatccaaatagtcaaatattcgcatctaggtcaaatcgattcaaaaccctttttgttgattgatgtgctaagtagttctgagttgattaagtctatcagtttaagagaaaaggattgtgtaagattatgattcgtacaagttagcttctttcttgattaggtccactgtgaatcatgcacacgtttatgaggaagatattagattgtgtaagattctgattggtttgatggtttcaagttagtttctttgttgattattgattgctgagtagttctaagttgattatgtcaactctgaatcatgtacaagtctatgagctagaaaatgaattgtgaattgtggagctaagaatgatgttgttgttttggctgaaagcgatgggtacatacctaagttctccgaaaactgaaaagttatcagaagatg

SEQ ID NO: 3121 - DNA, 3000 bp, Unknown
  misc_feature (1)..( 3000): cDNA_ID_2993328_gDNA_ID_1620626_Annot_ID_162469 3000 nt of promoter + ATG
gatgcaccgggaaactgttcccttaactgactcattatgcggctcacataaactctgtaatcttcatcttccaacatatccgtggttaagcagcaatcaaagactgtaatacaaaaacatcaaagttcagcaaccttatagagcaatcttatatttcgtaagcagcttatagagcaatcttttgtatctttctcactaaaatagtctatttctcagagctaagcatggataagacaaggacgaatttgagaagtcatgcaacacagtgaacatacaaaacctgaaaaatctatccatgagctaaatctcaccgatcaagaatcttaagctatcaaatgttagattcagttcaattaacaagcctaacaagaagtacactataaacttaggctaaaattatgatttttaagacctaaaaattcaaactttctaaaatttaatactctaagagcaagggataagacaagcaaaaggatttgagaaatcatgcaacccagtgaccatacaaaagaaactgtttcctgacaattctttgagaatgagacatcttaagctataatagatagactttccaccaatgagcctgagcctgtgctcatggatagttaacagaatccatgaactaaatctcacccatcaagaatcttagtctatcaaatgttagattcagttcaatcaacaagcctaaaaagaactagaaactaaaacaggacactacacttatcaaaatctgatcttaagacctaaaaactcaaactttctaaaaatcaatactccaaagcccaaagaagagcaaggataagaaagcaaaccctaaacccatcacttaaaagaagaaagagcataccgtaaactctctctgagatctcaagcaacccttcaggaggttttctgtgaaagaactttctaaacaacgccattgagaggtttctttaaatgcttaactcaaaaaagcagagaggtcacacaatccctagaaataatcacttatgaccaaatgcgacccacattgcaggaaaaaccccaaataaggagaaaacaaaaacgagaaaaatgtcaggaagaaagaaggaagcgtgagataatcttattgctgggtctttaaggaacaatgcgatgtgggttttgtttcttttgtagtttggtggtttgtcttgacatacacactttcaatttcttccgttttggaattggaaacttagctttcaatcaaaacagatgtttgatagctctgcacatgcgagaaagaagaaagggaatgatgcagagagagaagagagagagtttggttatcttgggaaaagaggaactagggtttttctttgattctaagaccaagaagaagatgatatagctattgagaaattcagacagagattgaggatgatgtcggatttcagatagaagggaaaaaaaagaaaggaggacccaaagatctgttactttgtttaggactatgatacatgtcttccaatattcttttttgagttatttaagatttgctttcttttctttcctaaactcggaatttgcaatttatttccttttgccatgacttcatttaaaaaaattaaataatctttgaatgagtacacacttagatatcatagtttgtttttaagtcattaatggaaaaatacaatttttgtaattttatatttgttagaaataattttttagctaccgattcaaccgcgaaaggtagattatggttcgttacatatatattgaaccaaatcgacggaatacttggtccgtcgaaaaagttaattggttttaagaatattggggtcacatacaaaataaaactgggatttttggtatatgtataaattcatttttctaatttaatatttacattaaatttagacattttaaatgaaaagtaagctattttttatattttttgaagttcacaaaaaacattttaacgattttgaaaagtagatttcactttaattattttttcgttacactttttaaccaaattacataaaaaaaatgtttcattcatcggccctgatcacttctcaagttttccaatatatgacattattggaggtaacaagatataatacactaatatgactgacaaactgcacaagacattttcttcatgtccctatatatggttagggagaccaaattcacctaaacaatactatagtttacggggtgatgctagacatgtcagtacaatagtctcaatcagtgggaaacgttgcacaaacggatcatgtagctgagtaaatgagttgatgcctcgttagttggtaaactcatgagccattcttgctattagttaaaccaaatcccttgtataaacacgcctctcatagtcatagatgagcttatgtcttgttctagtaaatgttataaagaagataactcaattgataattggttttagcacttggtccttgctctgttgattcgaaatccttattgaaaaaagaagaacaacgtaaattccttgttaaaatttttgaaaatttctattttctttgggccaggagtgatctcaacaaatatatccgaaaatgtaaaggtgtgtatacgtatcaccccaatagctaataggcccaatacggcaatacccaaacgtcaccatcaccaaatagaatgactagattttactttgtttactacgtttattcacgaacaattattttgtcaaaattaaaagcgagacaacgagaaacactcatagttttgcctgacacacacaacaaatgtcagtatccataattacattgtttcaaattttctctaacggttacatcactcgcaacggctacagtaacaaacatttaacgtttctttaccttttcaaaattcttcttttttcacaacaaaacaaaaagtaaataatctaacggctagttttcgaattttcaccactataaaacctcacaagaacctcctcataactcagcaatttccaaaacaacattcctaacactacactccaagcaactagcttctctactactcaatact

SEQ ID NO: 3122 - DNA, 3000 bp, Unknown; identical to SEQ ID NO: 3114
  misc_feature (1)..( 3000): cDNA_ID_1819514_gDNA_ID_1620626_Annot_ID_47145 3000 nt of promoter + ATG

SEQ ID NO: 3123 - DNA, 3000 bp, Unknown; identical to SEQ ID NO: 3113
  misc_feature (1)..( 3000): cDNA_ID_1819510_gDNA_ID_1620626_Annot_ID_47146 3000 nt of promoter + ATG

SEQ ID NO: 3124 - DNA, 3000 bp, Unknown; identical to SEQ ID NO: 3112
  misc_feature (1)..( 3000): cDNA_ID_1568553_gDNA_ID_1620626_Annot_ID_47147 3000 nt of promoter + ATG

SEQ ID NO: 3125 - DNA, 3000 bp, Unknown
  misc_feature (1)..( 3000): cDNA_ID_1819608_gDNA_ID_1620627_Annot_ID_47153 3000 nt of promoter + ATG
aaccgagcaatttaggatgggatcaaacctcgtaaatggggcaggttcgctcatagttatggacatggccgtagaaagcaaggtctactttgtacttctgccacagtttttgtaggctttctcttcccataggctcttcaaaggttccttctttgccataccaatcattggtggaataaccaaggacacgatgagctataaaaatgagccaaggctgagtctttctatcaacagtggcaagacaattctcaatgaatttgtattgctccgtgccttctctccaatcgtgttcactgtctgctacacagaagcgaaacattccataatctgttttgtacctgcccattcaaccgaaatttgtaagataccgttctgaaacttgcaagaaaatgtcaatggtttaactaactttaccagaatttagctctgttctcagcaggaaagtagaacatggtctctgcaggaacaccacactctcctccggagtctgtaccggcataaaaagatccagtgtctggccaatcacgctcatggttgccactgcagtgaagaaaaggataacttaaagcactgcaagagtagagagtagaagcacaatgttgtagattttcttgttgactaacctggcgatcatgtagggtacagtagaagcaatgggctggacttgagctgtgaactgatcccactgggagagatacccattggaataagtgagatctccaatgtggaaaacaatgtcaatgtccttcaagtccttgatgacttggtctgttgtgttgagggaaccaggctggtaatcattgtactcattcgagccatctcgctcaccctgaaacatatttcaatcaaggaaaatcattttagatattagtctgagagcgcatggagatcataatggcctaaaagagacgataccatacctttcccatgtcaccaaatattatgacccgttgtttcgagtcttgtccaggataaggagaggacacaaaggtgtaattcttgctccaaattgtggaaccattgaccaagtcatggcctagcctgtatatgtatctgtaaaccaaaggattgagagttacatgtatgaaactatattagtgctcctggattagacgataaagaagcaaactaaagatttcatactcgcggtttggccaaagttctttcaagaaagaagtatggaagaaaccaggatcacgccaaccaacgccgcgagcaggattacctgtgtaaacatagcatgcatccacaaatcaaatctctagaatgatccagatgagtagtttcagatattccaggactgctggctcagagatcacagcgaaacaggacataccacacatgctgtttctgttaaaggtcaatgttccagctggtgatcttctagctggaagtccctttgcactccattcaatgaaaggaacagcctcatctatgttgtacccactagtccatgtcacggtcatctatcaaagatagaaaaataagcaagttttagctaaagatcccaaatattgtatagctgcttcagaagtctcaaggccattgagtggaaaaacttacttcgtcccaattcttccctaatgcaagacgcggatagacaggtgctttaggattgaagaaagctacaggattcgaaaccccgagaaggtgtggctgtgatattcaaaagatcaataattaagtccacttgatatacaaaatactaaactgagaaaaactatagttataacctacctcttgaactccattggaaaacagtgcaaaggagacatcagctctctgatttataatctggaacttgagagtcacattcccggacttcatgtaatctggatgagaattacaatacatgtactgccaaatagaaattaaaaggggaatgttacaccgggacttaaaaaaaaaaaaaaaatcactggtaaatatgtaataaaccaaaccttgatgggagaagagcatatgtaaggagttttctctttgccaccacttgttggccaacagttacccgaactaacaaacaacaaagacaagttaataatgcacaaatggcacgttcacaagttaacaaacacagatgcagattagaaaaaatactcgaattttgctggagagaaaactcctatccaatcatctgaagtgggcttggggttggagatagcaagatttacccattctgtatcttcaccctgtaagatcaaagtcatgacatcaataacatatctatttaagtttggtttttgtgataattacgtgaaatcaagaaaacatattcaagtctatcatacaatttttttgacatttaaaaaaaccatctcttaagagttaatatatatctgtcaaacaagaatctgacaagaacaataatatgatgaaagaatttgttattggaacctgggaaccaagaacttgaggcgaagcgtgaagtttgacagaactatctaaagcaagacttgtttcgtaaacattaatttgagcaagtgcttgatctccacgaccattggcatgatccaaacataagctcgagctgaacagtgcgagtaaacacagaagcacacctaaaactctagccatatttttttttgtttttcctttgttgtgactgagaaacaaaaccagaaaggtatatatatatatattataatcaggatatatctaggaatcccaaaattgattcatgtctatcgaattaaacaaaatcaaatattttctttcaccgtcaaatctttagtcaggaatattctaacagtttctttttaatattctaacagttttttcttaatgatagttcatactgttttaaaaacaaataatgataacggaaaaaacggattttcgttttattcagacttatgtacattaggctgatccgggtcggaccggctttgaaccggaaattaataaagcttgattgttaaatttggcaaccgtggcttcggtttcaatcgcgctgtaatcgcatcactaattcgggtcactttggaaagaaagaagaagaag

SEQ ID NO: 3126 - DNA, 3000 bp, Unknown
  misc_feature (1)..( 3000): cDNA_ID_4262337_gDNA_ID_1620627_Annot_ID_47155 3000 nt of promoter + ATG
ttctccgtccattcccaaattcaagctatcaattcaacaaagctttgctctaagaaactagaatttgcgtgtataattttactggatttatctatgaaaactggagctttcgataaacctagtcctcccactgggtcgattttggtcaactctctcacagtgtttgccaaaaaagcaacggaggtttctatttattttatttctagtaaaatagaaaaagaaaaaatataaatggtatgtttcgatcgccggttggatccggtccgaccgcatatcagttgattaatacaaaatttaatacataaattatacaatagttttacacagttttcatatgttctacggtcataattcataaacctagtctccactgaatcgatgtttggcaataatcataattcatgaattgataaaaatatttttgaaatactaaaaaagcgtcgacggtcaaattggtttgagtctttgcatggcaacaatgtcggattgtcaccggtgcttttgtaagtcttaactttggtttgataaatcaagtaaaaaagtagtatctgttttgcaggttaaatactgaaaatttacaagagttttcacctcttttgtttgagtaatcatctatatcaaaatattatgaaataagtaatattataaaaagacatacctgcgaaatcgtgaaaatagagtttccttgtccaataaaatgttgttcattctcctttagtcctttctctgcacaattctgcaaatgttcaaacactggtgaatataaagaaacatatttaattctctcaagaccattgaacgtcttattttctatcgtttcatttgcctctcgctctctttaatttaattcggtggtaatttttctagtggcatgagtcaatagttttttgttggtttaatgaaacattcaatgaacatgttacgtgtatcggtgtatcattagttacattgaactttgccgcttgtaatttaccatcgaatttttgtaataggatgatgaaaactaggtgaaacgctattggtattgggtgaaactctatttcttgataattttctaccaatctcatagtgtttttattgtggtcaaacaagaacacatctcacattttatatcgggacattatggaatttgtagtcaactaaaatttaaaagttcaaacatacaataaaaaaaaaaaacaattttaattaattttcatttcagtaaagcgttttgagacacttatatattaataatatttggaggagaagagagtaaccataaactacaaacatgagtttggtcgccagtttgcaactcatcctcccgccacggccgagaagcaccaagttgttgtgctcattgcaaagcccaaaacaagaacaagaactctcttctacttctcctccaatctctcttttaccaaaactaatctcttttgctcttgctatctctctaacttccttttcccctgccttagccattccttctctctcctcttctcagccactcaccactcctttcacccaatccaagttcgtccagaccggtcttctcaatgggtttgttcctcttctcactctgatttctgctctctaaacaaagctaatctttattactctcttttttttgtagcaaaattaggccttgcccttccacgaacccaggatgtgtatcgacgaatccaacctcatcttccttctcttttccattgacgatcccagaaaccgatacacaggatcccattgaggtatatttcctcctatcttcatcaatttagcatcgtttctgattatttgttcaacgcagaaactgaaagaagcaataatgagcacccagaagaaccccaagtttgtggttcttgaagatactccctatggtaaattatttctcaccacaattggatttttaaatgattcccaccaaggatttgaggaaagatcacacacaattgcatttgcagggaggtatgtggaggcagaggtagaaggaggaggatttagcagagatgtgatggagtttttggtgaagcaagatgtggttgcttacaggtgtatggccactaaggttacctttgtgtatcctttcaccactgcttttggagactccaagggacaagaagagaggttgaagaagctcatcgatcagcttggttggtatgctcctacctttgaatctatggaataaattgcaagtaatgtatattttgttcatcactttccaacttactactacttgagacattaatatgagtttgtgtttgtcctttgagaaccaaagaaagctatacaactttttcaattgaggagctaggtgatgtgtgttacaatttccaaatgttatattgtaccaatgtcaagggagaggagtgtattcaaccacatcttttagaattaatgattttgtgttaaaaggacaaattctatgtatacaatccatgaatgttaaaagtccaatgatatctggtattcttggttatagatgtacacgtctctcaaggttattctggtgtacttgatcttgacttgtcttttaaatggttaggtgtatataggaatattttgactcaaaacacaaaggtgtgtacatgttatagatctatggttttgattgaaaatctcaaaaagcttttaaaaatcatatcaatttctatatattcattcatttgaaatcactaaaattttaaaatcattttaaaactcaccaaaacctgatgttatccaagatcaagaagggaatgttactcagctagtgcctagtgccatagccgtttaaaatgggctttggtcaaaaaaagcaacgcgagcccactatagttttgactttgctgacatggcacaactccgtggaggatcggtctgtgattggttcttcaatatccatgtgacgttccctctctctctctttttctatatatcttctttgccgtaatttttccgaagactcacaatttgtttttcattcagaacaaataataaaaacgaaacacacaaaaaaaaaaaaaaaaaagaagggacatg

SEQ ID NO: 3127 - DNA, 3000 bp, Unknown
  misc_feature (1)..( 3000): cDNA_ID_1974121_gDNA_ID_1620627_Annot_ID_47162 3000 nt of promoter + ATG
taccctaacgtctaataaataacaagtactctagcctcttcgttttatgattcctctaggaaaagttaatgttacggcccaatcactttttttaacagcccaaacaacatatattagctccaaatatcattttttcccctagaatattctcaacctattgtccactcaaaacgtgacaaatggaggtctaaagggagaccatacttgactcattttagagctaggatcagacagagtagattttttgccataactccttgtaaatgtattcacatttcattcccaagaaaaatagactgatgaagaaatatatcagatatgacaaggccgtgtcgtttaggttacgtaactctacaaggtttagggtctcaatataaacacacaaagcagatagaagaagcaaaccattcacaatcagacaatgacatctctccatacgttactcttctcttctcttcttttcttcatcgtctttccaaccttcacgttttcctccaccttattgtttcaggttcgtctttagttttgcttctttacatacacagactctacacactcacttattgggtttctttcaattgtgaaacagagtttcaattgggagtcatggaagaaagaaggaggattctacaattctctccacaactccattgacgacatagccaacgctggaatcactcatctttggcttcctcctccttctcaatccgttgctcctgaaggttccatttctgctttactctttacacattcacataccaatcttgttactcacgcaatcttcattcctcaggttacttaccgggaaagctatacgatctaaacagctccaaatacggttcagaggcggaactgaaatcgttaatcaaagcgttgaatcaaaaaggaataaaagctttggctgatatagtgattaaccacagaacagctgagaggaaagacgataaatgtggatactgttatttcgaaggtgggacttccgatgatcgtcttgattgggatccttcctttgtctgccgcaatgaccctaaatttcccggtaccggaaacctcgacaccggaggagattttgatggagcgcccgacatcgaccaccttaaccctagagttcagaaagagttgtccgaatggatgaattggcttaaaactgaaatcggattccatggttggagatttgattatgttcgaggttatgcatcttccatcaccaaattatacgttcaggtaaatcacatatgaattctcaaatatcagacaacagtattagtatataagaaacataggttgagataattatttactattagtatatataagtatcataggttgatagggttatttactactatttagtatataagaaacataagtcaatgcaatcaataagaaatatataagaaagttcactactgattatgtgataaattcctctgtttttggatacacagaatacatcaccggattttgcggtgggtgagaaatgggacgatatgaagtacggaggagacgggaaactagactatgatcagaacgagcatcggtcgggtctcaaacagtggatcgaggaagcgggtggtggtgtgttgacagcttttgatttcaccaccaaagggatcttacagtctgctgtcaaaggtgagctttggagactaaaggactcgcagggaaaaccgcctggtatgataggaatcatgcccggaaacgctgtcacattcatagataaccatgatacattcagaacgtgggttttcccttctgataaagtcttgcttggatacgtttatatacttactcatccaggaactccttgcattgtaagtatcattttagtatgtagctatactatttacaactacaatcttgttgatatgttatttttgttgcagttttataatcattacatagaatggggactaaaagagagcatctcaaagctggtggctatcaggaacaaaaatgggattggtagcacaagctctgtaacgataaaagcggcagaggcggatctctacttggctatgattgatgataaagttatcatgaagattggaccaaagcaagatgtgggaacacttgttccttctaattttgctttagcttattcaggccttgactttgctgtctgggagaagaagtaacgcataactcgaatcataagaaaagtaatcgaatgtatcttcttcctttttaataaaacattttggcagtatctaaagatatgtataatgaaatataaaatgataaagaatacctaaataaaaagagcactagtggtgttaaaggatacaactccagtgaaagaaaagagttcaagtgaagaagtgtcaacttgtagaaataagtattggaaagtttccatcgttttgttttgttgcatacaactaatatattatatattggccgactcgtataagatttggagccctactaaaatcagaattatgatgtcttaaccacacaatactgccaaaatcagaacgaattatattattgtagaagaagaaaaaaaaagtatggtgggaagtgggaacagttagacaggtaaattcgaataaaacgacagcgtttttggctaggacaataaaagttgaagacgtcggcttgagaagaagtagaagtgacgacgaaaagaaaggggaaaaaaaaaaggaaggaaaaaagtgaaaaccgtcggcttgagaaggaactttgatatttggtgactcttgaaaaaagcaagctctttcttcttccttctttcgcttttttcacacctcaaaatcaaagatccgaaacacgatttcggaggaagcttcgattctgtgtgtttgattcttcctcttttttgttttttgtttttttgttctatcccgtttcgaagcgagctctgattctcgttcctgtctactttttttcagacctattttcagatctgaaatagttgtgtttgagaagcgggattggtgatcggagctggaatttggttggtaatcggaggtcagagagaagtcaacggatatg

SEQ ID NO: 3128 - DNA, 3000 bp, Unknown
  misc_feature (1)..( 3000): cDNA_ID_1028908_gDNA_ID_1620627_Annot_ID_47166 3000 nt of promoter + ATG
attcttaaaacgatgtcgtttttaagttatagcatcaaatacgtgttattttgactcagcaaccgtaacagttgactattacccattatttacgattttgaattgtgcagtaactgtaaagtccagatataaaattcaaattttttgaagtttgaatatgaattaatcctataatttattcgcgtatgaaaatatacttaacagattttaaggatatgaaaatactttttacttcatatgcatatgtatatacttgtttgaactttaaagtcaatggagaaaatacactagaggttacaggtgctgccgctgcaatgcaacatgtcgtttatatagtaactgatagaaactatcaactaaagtctcatcactaaattttccttaaaacttattacattactcactactacacaatgcattaaaaataacatatttgaaagtatattgtgtatgctaatttttgatgtgtacttaaatctcattattggtatataagtaaagaactttaaaaactaaagataggcagtaaaacaaatcatacataaaatttacgttgaaattagtttgaatcaaatttgcgatctacagttttcgtgtaaaactaatcaaagaaaaacgattcaaaataaccaatatattttgaaatgatgattaaaacttggcgacaaatgaaataaaaataaacaatgggaaaaagttttgtgttgttgaccaattagagaccaaaagactggtttttgtagtaaaaagcagattacgtacaaaacaatttagcgggtgggtatatggaatttaggttcagaatattttcttccttttaggattagggtttgtcttgcaatttaggatgttattggacatctgttcaattatggataggtgggaatagggtttgagtctcacatataaatccttgaattttccactaccatgtacatctatatatgaaacttcataaagtccgatttaacaagtttgcagtatggcgagatctgttttggcatcttagaaacaaagcttaacactaatacaaaaataaatattcgtcaagaacaagagtagatgacaaacaagctaaaggaggaggaaaacaactaagataactagcaaaagatagcatttcatactacaagtataaggtaaaaataataaaggcacaaaaatacccggagaaggcatttcttttgggtctcttcaggtgtctcactcttaaacttcttgatcatcttctcattctcaaaggaggtgtcgctctagtctttacctcatacattcttttgttcattttctctttcttatttttttttttttttcaactttcgtttaatgtggagatttaatatgtaattcttatctaaaagataattaactttttgcttatgttttgcttatttttagtctttttttttgttaatatagtttctttgtttttgtttatttatttttaataattgtagacaaaaataattattaggtttttaaattagtttgatgtttttaagcaatatagttgttggcggcggaggaatacatgtactgaagataaacacagttaaacctttttagtaaccgaaccgacccatttggattgagataaaatacaatcgaatagtttgagtcttagattgggtttggtttgggtcggtttgagttcggttgggttgggtcggttcggttaaaatgcccacccctactttcccatcatccccttgacaaattaataaccaaattagtcataatccaatctttcaacatgaaaaccggaatatgagggtcaaagcggacccattaagagaaaaggtgggtcagttgacacaccttaaatctacaaataaagtttaatgcatgaaatttgttaaagagataatagctaagttggtttatcatgtgtcattgacacccccattatccaagttcaatccttccctatgtactttttcgtaaaaaatttctttttatatattaaacgaaaaaactattgactcaggtaaaaatctttcctgggtccgccggtcaacgaggaggaaacacgacggaatgagagagagaagttggtggcctaatttttgtaggagaaaaaacacacagaaagaaaagtaaaatgttgacaaaatggggttgggaaattgagaataaaaattcaaagaaggcatgcatattgcaataataatgtgcgatttgtcaaacaagtggggctgtgagagagagcgcgtggtcagcacgaagaagaagcaggtacagagttttatcaccagctatctatctttggtttgttcttaaataataatcaaacgccatctctctctattctctatctatcttctccacgttactaccacctaacctctcatccaccttttctcctttaagcatatttcatttcatctccgaaaggaattgtatcgttcctcacacacgcctctcatctcttatccgtaagttttgtttctcttttctctattgatgtacccttttgcccatatttgtgcttgtgaactcgcatttgatcgtttatgctagatctggtttgggtttagtcgtttagatgctcgtcaagctccctttgaatcactagtgctcttagactcttatatttactgatttggaattttgtaattcaaaagtccgagtcttttgatgaacccccgtgccgaccacacgattgctttcaatttgggcttcttcttaattttggtgaactattgaggatttttgcaagtttctgtgtgaatcctagagtagaatgactcaaaaatgatttcttttgattcaattatatgcgattgttaatgtctttgaggttctatgatctggaattagattttggtattatcttagtatatcaaagcttagatgatgtttctttagcatgtaactactattgtccatataaattgcataactcatttaactttcgagcattctctgcgtctcgattacttatatggttcctttgtttgtttttgttcagattcttgtccttttttcagctcaacaaga

SEQ ID NO: 3129 - DNA, 3000 bp, Unknown
  misc_feature (1)..( 3000): cDNA_ID_2107558_gDNA_ID_1620627_Annot_ID_162532 3000 nt of promoter + ATG
aatctcctcttctctttgatatttcttcggatttcgcttatgtcctgaatctcttgaagacccaattgaaaaaatctcaactttttttctcccggcgtttccggcgatatacaatgcggattctcgtgaatctcattctcttctccttgattcctctggcgttctccaatgaaaactccagctcgtatctcattgcgcgaccattgatcttcgaaacccagctcaagaacataaacgacaatgtcaatctacattgcacgagctggagattcgcggcggagacaaacaatctcgctccatggaaaaccattccagctgaatgcgccgattacgtgaaagattacctgatgggtgaaggttacgtcgtcgatgtggagagagtctccgaagaagctaaggtttacgcgagcagcttcgaatctaacggtgacgggaaagacatttggattttcgatattgatgagacgttattgtcgaatcttccttattacatggaacacggttgtgggtaatttatcttaaatctttcattttacaacattgctataaaaagttggttccttgataattgtatagatggatttgtctttttactatgtcgaattagttaagatttgaggtatgtgttgttgtctgtctttttctttgcttgtttgtctatgtatgataaatgtgaatgtttgttctgtttgggaatttgcaggttggaagtttttgatcattcaaagtttgatatgtgggtagagaaagggatagcacctgctatagcaccaagcttgaagctttaccaaaaggttatacatttggggtacaaagttatcttgcttacagggcgtagagagaaccaccgggttatcactgtcgaaaacctgcgcaatgccggtttccataactgggacaagcttattctgaggtatgcatactctacttttggacctccattacaatgtagctcatacagtttttaaccaactattgatctggatccatggttgtggtaacatgacgttgtttgatcttggattgtaatcttgggtttgaatggatgattgacgctttggtttgctgcttaatgttaatagatcgttggatgatcggaacaaaacagcgaccatgtacaagtcagagaagagagaggagatggtgaaagaagggtataggatcagaggcaattcaggtgaccaatggagtgatttgttgggttctgcaatgtcagaaagatccttcaaacttccaaatccaatgtattatatcccctgaaggggatcaactagaatcaggaggcaattcaggttactaaatggagcaacctactgtttttgaagtttgggttgccatgtaatcacttgcaataaatatatgtactaatgactgcatcggcttgcgtgtctaaatttgtagcttattgaaaactttttgtggttaaagacgaatccagttaactaacataagtttaacaaaacaagaccttttccatatatagaccaccgttaccaacttacaaagaagccaaataaagtacaacacaacacttgcaagttacaaaaagagaggaaaaaaaacatggtaccatttgacaacatatagaaacacacataaacattacttataacaaaaagattcaaactcggcttttattatctccccctgatcaaattctaaacactttattcctcataaactaactccccgacattggagttattggactatgacgatgacatcagtggggtaacttaagtagtgtgctggccaccacgagtacggtcacggtcatgttccccaccagtatgttgctgtccgtagtactgagctctgtctttcagatcctgagctttgcttcccaacttcatccttgcactgtccaacttgtctgatccctgtgggtgctctcccgttgcgtacctattcacaatcaataggtatcataccaagcattttacctatatagatgatatacacagacacattcaagctagctaggtcaaatttcgtatttagttaaccaaatgttccctagaatttgcaatttcttattgttacatttgttattcgaccaaaaaaattgatccaaagctactggctcaacacatgcatgcacatattgcacaaaattatgaagtaagatgataaatgtgtgcttacttgtaaatccaagagaaaacggttatagcggcaatgccaaaccctccagaggaaagaaaaccggtgatgaggagtgcaactgtgatgagagccgggacaaggattgggctgaagataacgagcagaggtgttgcaacagtcaaagctatgacagttccaacaagggtaaggctggagagaacaaggagggaaccaccagctgtgacagcagttgcagctttagcaatctgcctagacttggagtagtcagatcctcgtccggacatctggtactggtctcggtctcggcccatcatcgggtactggtctctgccgatgatatcgtgatgggttcctctagctgtatccgccatttttttgttcttgtttactagagagaatgagattttgaatgagagattgatcaaaaagatgtgtatatattttggaagaggtaggagtgtttgttagatatattaagaaaggagacgagaagtcacgtgtcaatggagacatcatgcaattgtaggccacgtgttaatggcgtcaccatgcagccgctgcatgtgttaacgagaggagtctattcaaagacacgtttgttttttgcctagctcagaatgtggcgttggcatcgaaccgaaacataaaacgcaaaacgaacctttgggctcgtcagtatgggtttgggccttcaatagattccttctatacggcccacatatccactattggcaacaaaattagaaaaatttaggatttagttttaaaatttgttccgcgacattctagaacaatgaagaaaatggatacaaataataaatctatctgcctcttaaaagttccaaatttcaccacgtcactgctttgataatg

SEQ ID NO: 3130 - DNA, 3000 bp, Unknown
  misc_feature (1)..( 3000): cDNA_ID_3071670_gDNA_ID_1620627_Annot_ID_162531 3000 nt of promoter + ATG
tctccgaaatttcatactcattcttttgtcttcttaaggtgatattataaagagaagggcttctcatatacagcaaatgcctcgttagcgctcaactgtggttcctgccgaagcaaatccaatataccaacatatcttgtcaacaatgcaaatcaattcacataatcttgctacaaaaatcattcactactatatcaattatatatacatcaagttatatttagaatttataccgatttaattttccattagacaagactaatttcgtgactttaattagtatttccttacatattttctaatcgatccctattatgaattttctttttataggtgagaactacatcattttggatctctaatatctaatgtaaaaatgtgaaatttcaaactaatgtttttgatgtattgaagatgtatgaccaatcattaaaaaactaaaatatgttggtccatgaagatccttctaagttggagatagccataacaatattgcaatattatatgagtgagctctaatgatcataattgttcatgataattaagtttagataaaaataattagtatagatgaatggatcacctgagttttttgaggggcttggtttacttcctcttcctcatcaggaggagaagcgcctaagatgagcaaaccaagaagagtagagagaaaatcagcacctcccacttccacaagctctctacctttgtttttgtcgaagatctcatgaaccgttgatctcattgcattcagcaagctcccataagtcatcccgtggccacgttctatggcctgaatgaatgcataagtcattgcccccgtccatgcgctccctgacaattgctgtagtgcacacacgtttctttgtgaggagtacttttagaatgaaggtatggggtaattactataagactataacatctcggtgaaactataaaatgtggatggtttgactggacttgctaaatactatcaaaagttgtttgaaatctagagagattatttatatggccaatagttgggaatgtaccggagtgtcagccgaggtctggtcatcatcgcagcctgtgaaggagaagacttcaccgccactcgtacctttccacattcctgttttaggccgatggtcttcccattcatagtttccgagcctaaaacgaaggatcaagaaaagaaaaaaaaatgggttacatgtgctatgcataagcagtttcttatttgtgttagttcatagggtatagggtttataaccaatataagaactatatggtctccatttgttttttgtttttttaaacatttctacaagctatcgaggtctgcatacacacgtacataacaagaagtcaataattattgaattcgtacctgtccattctacaaagataaggtaagtccatgacggtaccactatgacaagcgtcgacgatggcatggagcttaactccataagggagcggccgtacgattgtagcattgatctcatcgtccacgatgacacctgaagtcctgtggtccaccgggagaagagtctcatcgaagccgtcaacctcgtcgccgttgtcgtccatctggttgttgccgtgaccggagaagtgaaagacgagggaatctcccggtttgcagctaagaacaagccaatgcatcgccattgttatgttgttcttcgttggccatctcattgggtccgcttcttcttctacaacattttgacacttttaacattacttttacgtgttacacaaattatgacattttatgatatagaataataccggtgagcataagaatgcaagattcagggaattggaaacgcttcatcaacatgaacttcatgcagtttgcgtcattgatacatcctttgagttcgtcctttgtgttcttgtaagaaaccccgactatcaccgctcgcttctgtccatgtaccggcggtggaggacccggcggcgcgtggttgaatggagacgatgctggaggcgcgtgagtgaacgggtaagaatctggaggcgcgtggttgaatggagacggtgcatgcggcgcgtgagtgtacggagaaggtgttggcggcgggtagatgaaagtggatggagccggagatgagttggggaaaggaaaagggctcgccgacgcgtgagattggagacggggctcgggggcgatgagagtgaaggcgtgacaaatggcgcagcggattcgggtggctccgggaggaaggtgaagcggcgtacgacagctggagcagtccaccagcaacaacattattttctataataacccaaaactccttttcttttctcgggaaatccaatttccacccaaagtttcttgaaagttgcagattatagcctttagtttctgatgctgggaaaatcatcaatgatcaaagcattggaactttagaagaagatgccaataaggcaaggaagaaaattctttcgacgactttaagcttatccgctaatgtattcgtcaagacttttgtttgatgatcaaatgaagtcgtctcaacttgcatatatacaacccaagttaaattagcaagttgcgaattataattgttccttcattgcagaagtttggatttgatagtgcgaatgaactaattagaatgtagttgactttgattctaatgagtttgcttgacttttatttataattataattttaccaaccatactagtcatatgaagctgttcttataagaccatcgacatggttaatgtatgtggaggacatgacctttttggaaaacttaagtatagtagactgtttctatatacaaaaaagactgtttagaaaagaaaactcttttgaaaaaaaaaagaaaaaaaaaaaaaaaaaattcattctcgaaagcaaagggcccagatgggccataggcccaataatatcatctatggagaaaaagggggtttcgttgtctctaggttttttcagtctgactgatttcagtcatttcgaattttcccacactttctcgacgaagatcaagggggaag

SEQ ID NO: 3131 - DNA, 3000 bp, Unknown
  misc_feature (1)..( 3000): cDNA_ID_1819565_gDNA_ID_1620627_Annot_ID_162528 3000 nt of promoter + ATG
tgtctttgtaaggatattgattcatttttttgggcaaatagataatcaattcaatgctatgttttgtctgaaatgtgcagcttcaattacaaagaatggctgcttcaagtgctgtcaccgcaaactacgtcctcaagccacctccattcgcactggtactttcttatgataaagattgatattgtcggcaaatgtcattttgttttcgttggactatagattttgcttttctattactagatgatataacttgttgctcccacaaagccctaaaaatatcttttcatcctcgtcaaaggcgttacaaatgattttcagctattattaacggaaaaccaataccaaaaaggcgttacaaatgaactcctctaattcatatttgaagaaaataaaaatcgaatcaatctacgcattagtgtttttcccggaaattaattgtaggaacgggtcaagttgggtggtccatattgggtaaaggccgtgaatgttctagttggtacgtactatccgacatttgtcaaatgggaaatttgggtatggccataggggttaggtatgggtcaacatatctgaaatgattttgaaaccatagctttcatagaacattgattcttaattgaccctcaattgaactagtgaaaatttgttgtttttgtatacaaaaactatctcaatctgacccgttactcaaactacactaaactgtccaaatcatattactttgtaagaaaattgttacgttgtgtaatgtcaatgttagattcataaatctttaactagtatatgaccactcctagttcaaattcagatgttccttggtctgatattttcgttccttctagtggacctattggttgagtcatgagtgagagcaatagccaatatgatgaaatgtttttttgatataaaattggaaaggatgctttggagccgcatatgagcaaacaaactctggagtttcactggggaaaacatcacagagcttacgtggacaacctcaagaaacaggttcttggaaccgagcttgaaggcaagcccttagagcacattatccacagcacttacaacaatggtgatctcctccctgctttcaacaacgctgctcaggtgataattaacaaacctatttttagtttgagattataaaatgggtgtgtgattggttagctgatgatccattggttatgtttataggcgtggaaccacgagttcttctgggagtcaatgaaaccaggtggtggaggaaaaccatcaggagagcttcttgctttgcttgaaagagatttcacttcttatgagaagttctatgaagagttcaatgctgctgcagccactcagtttggagctggctgggcctggcttgcttgtaagtgtttcaaatgtttaagagctttagataaatatattaacttcttccttactcttatctcaatgctttcagattcaaatgaaaaactcaaagtagtgaaaactcccaatgctgtgaatccccttgtgctcggctctttcgtaagtttttcattaaggaacttgaatacacaatttacttgattaaatatcaccgtagagttaatgcaaatccttaacttttaatcttggttaattttcttgcagccattgcttaccattgatgtctgggaggtaaataaacacttttatagcttgtttgtcttaaaacctattttctttcttacaaattttattgataatttttgttttcttttgctacatgaacagcatgcttactaccttgacttccaggtaacagcttattcataattgttagcaacaaggttttcttgagtttctttgtgttgttgattgtttcaatctatttgtatatgagcagaaccgaagaccagattacataaagacattcatgaccaatcttgtgtcttgggaagctgtaagtgccagacttgaggccgccaaggctgcttctgcttaagcaaatttctgaacaatttgacttcagtgacagtgagttctgcatcaccgaagtctcttataaaatattggtcgctgtaataaggacacagctctcttgttgtgtatgtgtcacagagttcttcattttgcttgtgtaatgaacaattaaacatgctcttttctgagtgtgtgtgcgttttgtgtgtgtcaagtttttcatcgtctcctttattaaactcaaattggcacctaccatcagtaattcatagtttggcatggcccattattcaattggacatttatagttgtaataacgtggatgcccctgtcccattaaaaaatcacaattcatcaccatagctgttaacaaatctcgcattgctgtgctaaaaaaatgagaaatattgatataatagatcattttgatttttggataaacaaatcagtttacaatgttaaggtggaagactttagacttgaactaaaaaacaaagatgttaactgtaacagggtaaggacgttggtgtttactattttgatattttgacgttggttaggtaattgacttagagcttttgatagatgaatgattaacaaaggaattagaagatggacaaccatgttggaagaattttgaaatattacatttttaatacttaggtgttaattgtctgatgaggttttgtattcgggtctttaattaatctaccaatgaagagagttgaccaaaaaaggcaaaaaaaaattgtgggccagtcggcccatgtcttattttctttgaatatgtttagcttatttatctctctgtatacatgttggaatatattttgtgcgttatctaatatagtggttgttgattgtgatggtctgatggacgtagccgtttatttaaaaagaataactaagcgaaaatttcaggtcgtctcgtattacatgccaaagagtttctaaatccgccagagcattgacttgagatgcaagaaacaaattatttcgtttaatcatcattttcctggctcccccgttttgtttccctttgagattgtccgttaaaaaggggacgaaccaatg

SEQ ID NO: 3132 - DNA, 3000 bp, Unknown
  misc_feature (1)..( 3000): cDNA_ID_2999601_gDNA_ID_1620627_Annot_ID_162526 3000 nt of promoter + ATG
actgatctctcatttgaatccaactcattatcattgcagttagacatgcttcaagaagaaaacgataatataatggataaggtcagtgtgaacgctctctttatctctaatgtaggttatttgtttgtgtttgctgcctttttgtacttgatgtgtatattcttgagttacatatgcagcttcagcgcgctgaagaaagacgcgaagctgcagaagcaagggctaaagagcttgagaaacaggtgtttattatatccagtacatttgacttttgtagacatgtttatatacaatgttgatggttacttttaagcttggtatgacttacaacaggttgcttctctaggtgaaggagcaaattttgatgtcaagctcttgaagaggtttgattttctcgtctttattatatagcctttgttcacaaaattgggttttcacgaactttgcgctgatccctccaggaaagaagcagcattgcgtcaaagagaggtccgtaatgcattcatatctaaaggatgttgttgcatttgttcttcgcaatatacatgtcctttattcttctgctagcttgtgttggcagttgctttgacagtaaagttattgaaaaggagaaacataaatctatttgcaggcagcattaagggctgctgaacagaaaagagatggaagaaatagggaaactaatgcccttagctcagaatttcaggtacaatgctctggtaaccaatactcaagctggtactaaacagtagtttactagactttattgtataaacctttcaacttgacaagggaacaatcatctcttctgtgttgtgttatgatcagagtttaaaagatgaagcagagaaatccacggaacagctccaggaggttgaagctgaaataaagtctcttcggacaatgatacatagaacgattttgagtcaagaagaaatggtttgcttacaatctaaactagaattttgtgcattgacggtttaactccaccttctttgtttcatttaactatatgattgaccaaccttgcaggaggaagttgttctaaagagatgctggcttgctcgctactgggaattagctgttcaacatggtaagagaatttttctctcgtaaagatacaattgttttatcctctgttgggtattgacctgcaatgatggatatgatgaagtaacctgttcttctcatgatgatgccaagggttcaaatggttttgaagatctcataaattggtcctattatgattaaaacatgattagagcatatgcatgtttcccattcacgcagtgtacttgtccactaaactgtatactgacatggagaacaactatgtgatccccgctagctgatcatttgcccttatttggaaatgtttacttatgcatttcattgggtcactcttaggaatatgtgaagatatatccacatcaagatatgaacattggtcagctttagctcctcttccctctgaagttgtcctttccgctgcccaaaagtctgaagattcctggcagacaggtttgatcttcaactatcctgccaatatttcccacataatcatttagtttgagtatataaaactaattggtaaaatcacatctcgcaggtggtagcgatcgcacttggagcaaagtcatcagtaatttcagtgatttgaatggagaagggaacattgagagtatgcttgctgttgaaacgggattacgagagatagcatccttgaaggtttatgcacacattttgatctgtttattactaaaaaaaactgtttcccagaaaatacacatctcattcatatcatttcttgcacctcataggttgaggatgctgtaatgcttgcactttcccggtatagacagacaaatgtggctcgacaagccgtcactggtaaaactatatctaaaactgattggcacatataaatactgatgtgatgttatacaacagacactcatctcatcttaatatccagatcccagggtgcaaggggaacctaagttctccgaaacatttggtgagtcacatccttaaactgttttcgttactatctagacagagtatcatataagtaaacaagcctctcaacaaaacctgttttcttgttcttcttcatctatattgtatttgaatcttatgactaagcaggaagggtttattctgaattttgaatgcagagttgagtcatgatgagcaacaagatattctctttaaagaggtaagttacatctttaccgggagagtttagcttttacttagcaggatcatatacattaactcaaaaaacatatatacatggtgtgtataggcatggctgctgtatttctggaaaagagctaaaattcatggcgtggaaagtgatattgcggaagagcgtcttcagttctggatcaaccgactcgggcaacattcatcttcacatgatgcaattgatggtatatttattacttgaagctaaatcagttaaagtaaagaatctgattccttttgtgtttgctgggacagtggaaagaggaatgagggagctaaggaagcttggaatagaacaacaattgtgggaaacatctcgtaaagaactcatcgactcctcttttcttccttcttattccgtttctgactacaatgacgagtgaccacctctactctcctctttgcctccaattttctttattcacgacacacgctcacataaacatacacatacacacacaaaggtaatcaaaatcattttttcctgctcgacaaagcttagaagaaacacaaaagaattcatactacatctgttttgctttcagactgtgttccaattgttgatatatgtttggcttccatgttgttacttgtataatactcttcgttacctcacccaaataacccaaatacaggttttttgagaacaaaaagctgaatttcatatagttaggggcaaaaatataaattttatatagttgagggcaaaactagaaagtttgtgtataaaaaaggtcgaaacgttaaaat

SEQ ID NO: 3133 - DNA, 3000 bp, Unknown
  misc_feature (1)..( 3000): cDNA_ID_1441291_gDNA_ID_1620627_Annot_ID_162524 3000 nt of promoter + ATG
ctctattatcatcaaatctccttcttaaattttttttttttttttttgaaacaaatggattttattaaaaatacaaaaaaaattgtatatttggattacgtcaactcttacaattttgctagtctcatagaaagatgtcatacaatgcttgcatgtattgcttataacagtacgtgtgcttttgttatttcttttctagtattgtaattgcgtcgtacaagaaaacttataagatgcgtcggaattcgaaataaaacaaataaggttggaatgtatcacatgattttcatacgtttttacaatttctgataagtcccccttggtatgatggtatcgactttgttttcagaaagttgagtttgtttcttttccgaaaactaacgatgtcaaataatgtgaattcacaacatatataaaaaaatgataagaagagagcttaattttgagcgagtgttacaaattaattaaaaactgtgtctagtttaacacttaaaaaaattgcaatttaaatgataactacccctggattattttcataacaattttgtacatgaaagaatttaagataatatattattttaccaaattagaaaagctaaaaaaataagtactataatttgttgtatttagtgaaagaataaatgttgctgggaaaaaaagtgaaagaataaatgctttgggtatataccttatattaaaaacaaaacgaaaaaaaattaatgatatttgttaccatatatattatatacaatctataaacagaaattaagataatttatctgaaaagtgttttcaatgaggaaaataacaataaacagaaaaaatgaggtgtatgtacaaagatttgttaccaaatttaaagtattcaaacagaaagtacccatctgtttaggcaaaggattcgatcatcaaacgtcctacaatatcttgttttgcgatctcacccacaaatttatttcctataaattctcttcctctgtctgatctcttctattcaagcccacttcttttctctttctcttgtcttcgtggagttttcggatcttacacaacaatatctttgtcttactgtatttcttgtcctttttcttcttacctttctaacaattattaagaagagtaaagcttgaatttaaataaaaatgatgggagacaatgaaggaagaagaactccgttattgaatcttggggttcaagtatcgatgagagtgttaaccatcggagctgcaatggcctcgatgtgggtcatgatcactaaccgtgaagtcgcatctgtttatggcatcgcttttgaggctaaatacagctactcctctgcctttaggtatatatttttttaaatttattctccttttctatcatcatctacttcttattttatgaaggtgcaatgatctagttattgaaataattcatatatgatacaacgaagcatccatctgcatgaaatgtcatcattcacgttgaaaatatgaagaaaacagatcacacattcggtagaaaagattgaaaagatgaacacatttttctaaaaaaaaacatccctcacgtatgatgtaggaagaacaacatgtgggacaaatcataatttggcatttttcattcatcgatatgatcatctttattgaaagtaagagatcgagtgattaaagtgtatgatttgatgtttgacaggtatttggtgtacgcacagatagctgtctgcgccgcgacattgtttacgcttgtatgggcttgtttggcagtccgcagaagaggacttgtttttgcactcttcttctttgatttggtaactatattacatgtttttgatctaaacattttcatttctatacgtgaatactctttatcttttaatttgaattagcatgttcacaaattatataaataaacgttttgagatgggtttgatattttgatgtacagcttacgactttgacggcgatatcagctttctctgctgccttcgcggaaggttacgtagggaagtacggtaacaaacaggccggttggcttccgatctgcggttatgtgcatggttattgcagtcgtgtcactatctccctcgctatgtccttcgcctcttttatcctcttgttcatccttacggtcttaactgcctccgctgctcgtcattactgattttcttacattttatatcatacaattcaattccttctactccaagataattcagtctttgttatatataattggatttcatgagatgcaaaattgatttgatataatgaaatgaaattgtatgattacttgcatgtatttatctttgagatcacttcttctgttctttgctgtgcttaattagtctcctatttgtttttcttggagaaaatctaagaaacaacaaagtattgacaagaaagaaaacgaaattaagatcttggtaatcggaagagcatttttctaaaacgtataattgtacaataatccttctgccaccaaaagagtgataacatgtttcaaacatgcatagataaaacataatcttattaatgttacatatctcttcacaaaatctattcttccacatatttctcctaaatagggttttagcagagccaacagaaaataaaatgcatacgatctcatcatcactgtatgatggatttccaaaagagaatgttacatatatacatcatcataattcataacatttgcatcagaccaggctcaactagatgcaaaagaaccaagatgggcccgttgaagtaacttatattttggactgggcctgtcacttggcaactgtgggacccacatgaacatgtgccgaagataggcctgaatctccgagaacaaacctccgccacaaaaacagaagacttgttgcttgcgtatcataatacgacgccgtatctctacttgctcgaacaaacccaaaaagatacatatcaagagattaaaccttatccaactaagagaagccatttttattttttttgggtctctgagttgtgtattgagcttcatctccttcaa

SEQ ID NO: 3134 - DNA, 3000 bp, Unknown; identical to SEQ ID NO: 3128
  misc_feature (1)..( 3000): cDNA_ID_1028908_gDNA_ID_1620627_Annot_ID_162522 3000 nt of promoter + ATG

SEQ ID NO: 3135 - DNA, 3000 bp, Unknown; identical to SEQ ID NO: 3127
  misc_feature (1)..( 3000): cDNA_ID_3091785_gDNA_ID_1620627_Annot_ID_162517 3000 nt of promoter + ATG

SEQ ID NO: 3136 - DNA, 3000 bp, Unknown; identical to SEQ ID NO: 3126
  misc_feature (1)..( 3000): cDNA_ID_4262337_gDNA_ID_1620627_Annot_ID_162504 3000 nt of promoter + ATG

SEQ ID NO: 3137 - DNA, 3000 bp, Unknown; identical to SEQ ID NO: 3133
  misc_feature (1)..( 3000): cDNA_ID_1441291_gDNA_ID_1620627_Annot_ID_47168 3000 nt of promoter + ATG

SEQ ID NO: 3138 - DNA, 3000 bp, Unknown
  misc_feature (1)..( 3000): cDNA_ID_2999601_gDNA_ID_1620627_Annot_ID_47171 3000 nt of promoter + ATG
cttcagcgcgctgaagaaagacgcgaagctgcagaagcaagggctaaagagcttgagaaacaggtgtttattatatccagtacatttgacttttgtagacatgtttatatacaatgttgatggttacttttaagcttggtatgacttacaacaggttgcttctctaggtgaaggagcaaattttgatgtcaagctcttgaagaggtttgattttctcgtctttattatatagcctttgttcacaaaattgggttttcacgaactttgcgctgatccctccaggaaagaagcagcattgcgtcaaagagaggtccgtaatgcattcatatctaaaggatgttgttgcatttgttcttcgcaatatacatgtcctttattcttctgctagcttgtgttggcagttgctttgacagtaaagttattgaaaaggagaaacataaatctatttgcaggcagcattaagggctgctgaacagaaaagagatggaagaaatagggaaactaatgcccttagctcagaatttcaggtacaatgctctggtaaccaatactcaagctggtactaaacagtagtttactagactttattgtataaacctttcaacttgacaagggaacaatcatctcttctgtgttgtgttatgatcagagtttaaaagatgaagcagagaaatccacggaacagctccaggaggttgaagctgaaataaagtctcttcggacaatgatacatagaacgattttgagtcaagaagaaatggtttgcttacaatctaaactagaattttgtgcattgacggtttaactccaccttctttgtttcatttaactatatgattgaccaaccttgcaggaggaagttgttctaaagagatgctggcttgctcgctactgggaattagctgttcaacatggtaagagaatttttctctcgtaaagatacaattgttttatcctctgttgggtattgacctgcaatgatggatatgatgaagtaacctgttcttctcatgatgatgccaagggttcaaatggttttgaagatctcataaattggtcctattatgattaaaacatgattagagcatatgcatgtttcccattcacgcagtgtacttgtccactaaactgtatactgacatggagaacaactatgtgatccccgctagctgatcatttgcccttatttggaaatgtttacttatgcatttcattgggtcactcttaggaatatgtgaagatatatccacatcaagatatgaacattggtcagctttagctcctcttccctctgaagttgtcctttccgctgcccaaaagtctgaagattcctggcagacaggtttgatcttcaactatcctgccaatatttcccacataatcatttagtttgagtatataaaactaattggtaaaatcacatctcgcaggtggtagcgatcgcacttggagcaaagtcatcagtaatttcagtgatttgaatggagaagggaacattgagagtatgcttgctgttgaaacgggattacgagagatagcatccttgaaggtttatgcacacattttgatctgtttattactaaaaaaaactgtttcccagaaaatacacatctcattcatatcatttcttgcacctcataggttgaggatgctgtaatgcttgcactttcccggtatagacagacaaatgtggctcgacaagccgtcactggtaaaactatatctaaaactgattggcacatataaatactgatgtgatgttatacaacagacactcatctcatcttaatatccagatcccagggtgcaaggggaacctaagttctccgaaacatttggtgagtcacatccttaaactgttttcgttactatctagacagagtatcatataagtaaacaagcctctcaacaaaacctgttttcttgttcttcttcatctatattgtatttgaatcttatgactaagcaggaagggtttattctgaattttgaatgcagagttgagtcatgatgagcaacaagatattctctttaaagaggtaagttacatctttaccgggagagtttagcttttacttagcaggatcatatacattaactcaaaaaacatatatacatggtgtgtataggcatggctgctgtatttctggaaaagagctaaaattcatggcgtggaaagtgatattgcggaagagcgtcttcagttctggatcaaccgactcgggcaacattcatcttcacatgatgcaattgatggtatatttattacttgaagctaaatcagttaaagtaaagaatctgattccttttgtgtttgctgggacagtggaaagaggaatgagggagctaaggaagcttggaatagaacaacaattgtgggaaacatctcgtaaagaactcatcgactcctcttttcttccttcttattccgtttctgactacaatgacgagtgaccacctctactctcctctttgcctccaattttctttattcacgacacacgctcacataaacatacacatacacacacaaaggtaatcaaaatcattttttcctgctcgacaaagcttagaagaaacacaaaagaattcatactacatctgttttgctttcagactgtgttccaattgttgatatatgtttggcttccatgttgttacttgtataatactcttcgttacctcacccaaataacccaaatacaggttttttgagaacaaaaagctgaatttcatatagttaggggcaaaaatataaattttatatagttgagggcaaaactagaaagtttgtgtataaaaaaggtcgaaacgttaaaatatgataaagaaactggtctgtgacataccgcattaagatgggtcccatagaaatcgaaatgtggatcgtctccttccctatcttatccaggataacgataacaacactctctctctcactgcaagagcgcgaaacagagtaaggctcactttgttttagctttctcctctacttcgata

SEQ ID NO: 3139 - DNA, 3000 bp, Unknown; identical to SEQ ID NO: 3131
  misc_feature (1)..( 3000): cDNA_ID_1819565_gDNA_ID_1620627_Annot_ID_47172 3000 nt of promoter + ATG

SEQ ID NO: 3140 - DNA, 3000 bp, Unknown; identical to SEQ ID NO: 3129
  misc_feature (1)..( 3000): cDNA_ID_2107558_gDNA_ID_1620627_Annot_ID_47176 3000 nt of promoter + ATG

SEQ ID NO: 3141 - DNA, 3000 bp, Unknown
  misc_feature (1)..( 3000): cDNA_ID_3091891_gDNA_ID_1620628_Annot_ID_47181 3000 nt of promoter + ATG
caccaacctagcttcaagatcctgtctctcatcgatcgcgtgttactcctttctaaaggaaccattgtatatcatggaaggcttgacttacttgaagcattcttgctctccaagggattcacggttccttctcagctgaattctcttgagtacgctatggagatacttcagaacatccgtgatccctacgaaaacgccaacattgctcttccagaccactgccctgaaagtaaaaaacagaaccaaaaacagagcattgttcgatataaaagctcgagaatcaccgaaataagccttctctctagcaggttttggaagatcatataccgtacaaggcagttgcttctaacaaacatcttagaatctcttgtagtcggtcttgtcttaggcactatctaccttaatatcggaactggcaaagaaggaatcaggaaacgatttggccttttcgcattcaccctcacattcctcctctcctccactacccaaacccttccaatattcattgatgaacgacctattcttctccgagaaacctcaagcggactctacagactctcctctcacattcttgcaaacactttggttttcttgccatacttgctactcatcgcaatcatctactctgtctcactctatttccttgtaggactctgcttttcatggcaagctctcgcctactttgtgctcgtaatctggatcattgtcctaatggctaactcttttgtacttttcttgagctctctcgcacctaactacattgctggaacatcttcagtgaccattcttcttgcggctttcttcttgttctctggttacttcatctctaaagagagtcttcccaagtactggctcttcatgtacttcttctcaatgtacaagtatgcgttggacgcacttctgataaatgagtactcgtgtctgcacaacaagtgcctggtctggtttgaggaagcttctgtgaatagctgcttagttactggaggtgacgtgttagacaagaatgggcttcatgagagacagaggtggtttaatgtttatatgttgttagggttcttcgtactatatcgtgttttgtgttttcttgttttgcttaaaagggtttcgggttccaaaagataaatgcttttcaatttcttaagcttaattttatatataagggattttcttgtttctgtagacttcgtggtatatacacaaagaagcaaattaattgatggatgaacacaaagaagcaatttattgatggatgagttaatgaaagtataaattcctttatttttttcgttttatacattgttctatcatgtatttagtgtgtatatccatgagcttcacatacattcataatgtcactagaaaaccaagagaactatttgatgtactatctagccttctatgattgggttacgtgtgcagggaatatagagaatctactggattaagagatatttgagccatgttcgtgtatcttctaacttggccaaaaaaaagagatcgtcacgggtctacatggtcttcacctcctctggaaaaccatatcagtttatacattattgttctaaatgtatgtacaaatataaaattaaaggtttatttaaaagttcagttgtgatttggattcatgatcttgattgttttatcatttatgttagtggccgtgtcttaaagcgatgttaatattcatgatttcatctattattgttgcagatcctagactttactttgggtacatcaatttatacgtctgcttatccaaaaacaaacagcgagctactttttttttttggtcaataacaatgtaaaaaaaaattgttttggttaagaagtaggcattcacgatgttgacaaacaataaagtagaaatcaataaatagttgtgctcaagttgacatacaaaatgccacatctcttttgtattcatgggttcacggacatgcaacttcattggtcgcccgtgaacatttttgtttagcaagtaatttttgtctcgaccaagctggcttcctgactcagttataatccaaattcattttttattactaacttcaaaggtttactcaaaaatttaaaattcatatgtatatcacgttttaatcttggagtttgggaacttgaataggatatatgtgttgggacgtccgtcattggtatccggtttcaaacttgagaaacaaggaatacgtttcttgagaagcaaggtttacattaccacctaatctacttaacatactccatcagcatgtctttaagattgtgttcctcagcttgagtcactgaatcaatatgcaagcagctttgttcgcccactacaaaattggttctgaccgtgatgtacggctggagaaagcaacatgagttgttgggaccaaatacttgtgtctccaaaaaacattgacgtctacattattttatgacaaacttgtccgttgacttcactaggtggcgagtgaaggagtaagattggattgagtaaaaatttaagcctagcatgaaatctagcgccgaaaccttaatgagtgaagatcatatagatacacaaatcctagaatgtgactgtaattgaatgattcacttaccaaactacaagattttaaataaaatctcaattctcaaattcataatttccaactatggtgttttagtggttgcaaattaatctgttagtccaagaacaagaatttgaatcatcctactatgatttaattcattgttggtcattattatgtgaattttttttctaggtcagcctatgattctcccgttaacagaagaaaattcactatgggactccgaaatctaatatggaaccggttaaccatctaaccggaccatgtaaaggccagctttgtagcaaataattattagattatcagcccaataaaagcccaaatccgtaatatataatctaatcgtcttttatccgcagaaaaccctattgctcccctttgctcaagctcagtgcctctttgcagcgaaagctcaaccaacaagacgatg

SEQ ID NO: 3142 - DNA, 3000 bp, Unknown
  misc_feature (1)..( 3000): cDNA_ID_1819646_gDNA_ID_1620628_Annot_ID_47187 3000 nt of promoter + ATG
agtgggttaaggagcagtcgtatctcctctggttagcccaccatgttgcatagcttgcgatctttacgtcccacaccagtggaggcaaacctgttgggaatgaaaattttcatatcaatatacaacattactaataatttaatttgatatcacaattatgttaacaaatgttatttaattgttcgtttctttagtgtagtccatttccttagaacatgtatgtaatatataaggtctcaaacaaaacaaaatatatctggtttaatttctttgtatctagaaaacatcaaaatacggatatatttttgttaatattctatatatatcctaatcgtttttatcttgtagtttcttatgaataggactacatatgagtatgacaacaaaaattacaaagatatatcataagtgaccgtttatgttgtttatggtcatgcatagtcttataactatgaccacatcgggtcttaattctatttatagttaatatatgaaagtacctagaccgcctcggacagtattatgtggatcaagaaattgttgttcgaacgagcccgtgggtggttggtatgtgggaggaggctgataaaggataggtttggggctgggagttgggagcggctggggctttgcaacgtagggaggagggctcggggttataggtcgctgtgggcggtgccggtaatagtctgcatgaacggcttggatggcgaccaagaaaagggcgattgcgaaaactatggcttgggttgatgttgtggtcgccatctgttttcttcgtggagtggctccaaagattttgttttggatggtggtagaaaatgatttgatgagggtgattatttatatgtttaagttagtgcttaattaattatgacaatgcaatttgggagtcaactagaagtggcttacatgttcgattatggttaccacttaccactttgtttcgctttagtaaaagcgagagagttgtagtcttgtagatattttaaccatgcaagtaggtattttatatacattttttccttagactaaagatcaataacagagattaaattttctaacggcaatattataagaattagtaataaaaagaaatattatcattaaaatataaaatgtgaggtttatgatacattagttggtctttagaaaaaaatgtttgtcgactaaaaaaaaaaaaaatagattgaatgtagaaatttcaacagagagaaaaagggaaaaaatgtctatttttcaataccacttttcaaaaaggcccctccctaaacttctaattattagttgttttttttacttaagtattactgtaataggtttcctggaacaaaaattgttataaaactagattttaacctgcggtataccgcagggacaatttattttttaaattagtatatataaaagtttgcaaattaaatttatttataaaatatttttattttctagtttacaattgttattaagtaacgtcctctcaaacccgtcccacaaaaaaaaacccgcggtacaccgctaatttaaatatataattaaaataaatattttacgggattgcaattgtattttggtttgtcaaacaaatatttgttttaaatagttgccaaaatctagttcaaattttggagaaataagatttattggatagataaagaatgtatttaggtgtgttttgctctttttaagggattgcaattgtattttggtttgtcaagcattttttgttttaaatagttgttgaaatctagtttaaattttggagaaatctgcctgacatatgagattagaatatatttgaaatattttttgtttgttaatcaatttattactaaaaaaaaacaataattaaaagttagtgacagccattgtaaataagtgccaactacagaatttatttcacaaaatgcctacaaaaatgtatatgtagattttatacaaaaataattgacaaaaggcaataaaatagaattgatcagctgtaaaagaaaataatcagaaaacaaaaaacacacaaaaatcaaacctaaaatatgacttataaagtttcatttttaatcaactataaaaccaagtatgttctgacaactccttagtaaaaacttataatttcgtaaaaacaataaaaccgtaccgaaatctggcttaaatattttaaaattttattcaaccaaatcaacatattgtaaatatagtaaaagaaacaaggagaaatggatataaatttattaaaataaaaagcagcactacgtggaacgtacggctgttattttatataccatcggaaaaagtcacatttgagaatgtcgtaagtcccgacacgtgactagcacggcaggtctaccgtagataagcgtagacctcagcacaccgtaccacataataaaccacactcaaactcagtccgaggttgacccatttaccaaacaaaacagagaatcgcagagcaaactatagactacacaaaacacttccgtcaccggcgaatttactcaggcggtaatctcaccggacatgtaattctctctttccctttctcgcaatttattattctgtttgtcaccgagagagtctacgcaaagtcttctgcggaggatttgcttacgggatttagagtttttctgtagtctgattcatgtacttgtgttgttcgcagatctcagaaaagagggtttttttattttctggaggtaataatattatgaagaggaatttcgagaggaacgatgacgacaagcctgagcgaaagcgtcctgctcttgctaggtgagtttctctgattttaaccagattgtttttgaaagtttcttagtattaaagactttttctggtcctattgctttttgtctgcgcagtgtgattgttgaggctctgaaagttgacagtttgcagaagctttgctcgtctttggaacctatcctccgccgagttgtaagatttgcttactctgtttttgttgtatttgttctcgtctctttgaaaagctagttatgtttaggt

SEQ ID NO: 3143 - DNA, 3000 bp, Unknown
  misc_feature (1)..( 3000): cDNA_ID_1819642_gDNA_ID_1620628_Annot_ID_47188 3000 nt of
actgtttttttcagttctgtattttctccgaaacgaattggaggtccagatggccggaacttgcagctgcatttcaagtctagattatctctccctttattcactggaggaagagtggaaggagagcaaggtgctactatccatgttgtattgattgatgcaaacacgggtcgtcctgtaacagttggaccagaagcttccctgaagcttgaggttgttgttcttgggggtgactttaacaatgaagatgatgaagattggacccaggaagagtttgaaagtcatgttgtaaaagagcgtgaaggaaagagacctttgcttactggagacttgtttgttgttctcaaggaaggggtaggcactttgggtgagattgttttcacggataattcgagttggattagaagtcgcaagttcaggcttggtttgagggtaccctctgggtactgtgatggcatacgtatacgtgaagcaaaaacagaagctttctctgttaaagatcacaggggcgaatgtatgtgttttcttttcttgttctctttttgccttgtgcttgccacttgttttcttctaaatcaacatgttgttggattggttatgtgtagtgtacaagaagcattatccacctgctttgaatgatgaggtgtggaggttagagaagattggtaaagatggggcgtttcataagaggctaaccgctgcaggaatagtcactgtggaaggctttctgagacaattggtcagagattctacaaaattacgggctgtgagtgcctcctattacgtcaagctcattgttgttggatgagaacattcattcaatgctcatgagtaattatgattatttgatatttgtctagattcttggaagtggcatgtcaaataagatgtgggatttgctagtggagcatgcaaaaacatgtgtcctaagcggtaagctttatatctactatactgaagattcaaggtctgttggcgttgtattcaataacatctacgagttaagtggcctcataactgaagaccaatacttatctgctgattcactctctgaaagccaaaaggtctatttcattctccttattttcttacacttatttgcctcatgatgtttggtatattgttctggaaaactctgatttacagatttttgttttggtgatgtgtgattatatagttcagttctgttatatatatgcggtagtgtaaattttttggtgtttaaatctgaaaggtatatgtggatggactggtgaagaaagcgtatgaaaattggaaccaggtcgtggagtatgaaggcgaatctcttttaaacttaaaccagcctgagaggttggatatttctcagactgatcctgtaacagctctggcaagttactctacggtgcctcttagtcagtttcctgaattcgctatagaaggttggcaaatcagtcccttgtaatattactaaatctcaaatcttatgttctttgttctgtatcataagtttatattctacttctatctttactgcagggtataatcaaacgctgacaacagccctacctcataacccacaagcacaatttgattttgttccccagcaagatcagtttatcggaatacagcaacctcaaactcaaaccaacatagagaatgaaaatgtaactaggttggttcttggtcctccacaatcatccacaggtgggtaccaagacatcaaatcttctgctgaccaggaaaatcttaatcctttcgaagactggacaaacctaagtgagaatgactttttctcggaggaagagatccggcaaacaagccatgacttgttagcgaatgaggacatgcaacagttgctcttcagcatgggaggtggcaaaggagaagatggttttactttcccatcgtttatgcagaatacaccaatgatgcagggatatgatgaggagggccgtgggcgatcaggaaaagcggttgttggatggctgaaggtaaaagctgctatgagatggggattcttcataaggaggaaagctgctgagaggagagcacagattgtggagcttcatgataataacgatggtaaatgaatagtcaggttgcttgctagtgtatagaagccatgtacagtttagggatgtataacaacatcacttaccgatatggatttgcttgatttagcttattagacaagaatataatcgatgaaccatgagaaatttgaagactaaccttcagcagcaagacaagaagctgattttctgtctctttaagtttcaactttcaacttgcagatatattagaagactgactaagtatgggcctataagcccattaatgtctctactgaacgcccaacttgtgaaaaacatgtctctcatctcaattttgttttcttttcacatcaacttaaagctacgagaaccaaacaagtgatgtttttggtcaaacaggacgaaacatgtatacataaaaagaggtaattatgttcgataaacataggtataaataaactataagaatttgttacaacattctttagatttgatattaactgctgtttacatttgaagaactcagttagttatttaatattttattttatagggtctagaaattacttgcgtgtggggactgatcaccgattctaaagaaggctcatcctttggataatagtatgaaacttgtcaataaagataagtcatcacaagtagggagatcttagctgtgttccatacgcccatctagaaaaagcgacgatggtcaagattaaataactgtatttgaaaaaccaaaaccgcgtcaccaactccaaagccattaccattagccatcactttccatcttccagctgttcgaatcaggacgcccctttttcttcaccaaacccatcggccgataacgaaccttcctctctgactgcctctgctcttactataaatacaaccaatacgacctcatccaaaacccaacaaacctaagctcaaagcccaccaaaaagaaaacaatcacttagca

SEQ ID NO: 3144 - DNA, 3000 bp, Unknown
  misc_feature (1)..( 3000): cDNA_ID_1819638_gDNA_ID_1620628_Annot_ID_47189 3000 nt of promoter + ATG
ttggttcttggtcctccacaatcatccacaggtgggtaccaagacatcaaatcttctgctgaccaggaaaatcttaatcctttcgaagactggacaaacctaagtgagaatgactttttctcggaggaagagatccggcaaacaagccatgacttgttagcgaatgaggacatgcaacagttgctcttcagcatgggaggtggcaaaggagaagatggttttactttcccatcgtttatgcagaatacaccaatgatgcagggatatgatgaggagggccgtgggcgatcaggaaaagcggttgttggatggctgaaggtaaaagctgctatgagatggggattcttcataaggaggaaagctgctgagaggagagcacagattgtggagcttcatgataataacgatggtaaatgaatagtcaggttgcttgctagtgtatagaagccatgtacagtttagggatgtataacaacatcacttaccgatatggatttgcttgatttagcttattagacaagaatataatcgatgaaccatgagaaatttgaagactaaccttcagcagcaagacaagaagctgattttctgtctctttaagtttcaactttcaacttgcagatatattagaagactgactaagtatgggcctataagcccattaatgtctctactgaacgcccaacttgtgaaaaacatgtctctcatctcaattttgttttcttttcacatcaacttaaagctacgagaaccaaacaagtgatgtttttggtcaaacaggacgaaacatgtatacataaaaagaggtaattatgttcgataaacataggtataaataaactataagaatttgttacaacattctttagatttgatattaactgctgtttacatttgaagaactcagttagttatttaatattttattttatagggtctagaaattacttgcgtgtggggactgatcaccgattctaaagaaggctcatcctttggataatagtatgaaacttgtcaataaagataagtcatcacaagtagggagatcttagctgtgttccatacgcccatctagaaaaagcgacgatggtcaagattaaataactgtatttgaaaaaccaaaaccgcgtcaccaactccaaagccattaccattagccatcactttccatcttccagctgttcgaatcaggacgcccctttttcttcaccaaacccatcggccgataacgaaccttcctctctgactgcctctgctcttactataaatacaaccaatacgacctcatccaaaacccaacaaacctaagctcaaagcccaccaaaaagaaaacaatcacttagcaatggcgatgatcagttactccaccattgtggttgctctgcttgcttcttttatgatttgctctgtttccgccaattttcaacgagacgtagagataacttggggagacggacgtggacagatcacaaacaacggcgatcttcttacactctctctcgacaaagcttcaggctcaggattccaatccaagaacgaatatttgttcggtaaaatcgacatgcagatcaaactcgttgccggaaactccgctggaactgtcaccgcttactatgtaagtccatttcctttagtgttttcttaaagttcacatattaagagtgattaggctaaatgttttttttgtttggttctacagttgaaatcccctggatctacatgggacgagattgactttgagttcttgggaaacctaagtggtgatccttacacacttcatactaatgtctttacgcaaggaaaaggcgatagagaacaacaattcaaactctggttcgatcccactagtgatttccacacttactctatcctctggaacccacaacgcatcatgtaagtccaaaattataaaaaataaatcacacttactcttttgaatctaatcttgtttgttttttctatctattcagattctccgtggatggaactcccataagagaattcaagaacatggaatctcaaggaactctgtttcctaagaaccagccaatgagaatgtactctagtctatggaacgctgaagaatgggccacaaggggtggtctcgtcaaaaccgactggtctaaagctcccttcactgcttcctaccgcggcttcaacgaagaagcttgcgtcgtgatcaacggccagtcttcatgccctaacgtgtcaggacaagggagtactggttcgtggttgtctcaggagctagactcgacgggtcaagaacagatgagatgggtacagaataactacatgatttacaattactgtacggacgctaaaaggttccctcaaggtcttccacgcgagtgcttagctgcgtaaagcttttaaacaaatgatccaaagccatgaaaagtaatactattctttgattcatcttataaagtatctgatgtttggttacatctgttttttatttattctatgtaagtatatttgtattcgaatattgatcaatcactttaccaaaataaaacatttgaacgtacgatcagaaaagtttaagtcatagacctcaacgaaaagtaaaaacgaaaaagttactgtacattattttctgagattcttattattgattcctaagcataattaagctataaattatatgctattagactattaaataacccaatgttttatcaataagtagaatccttcaactcttctaatttataaatggccttttgatctaaactaatgtctagcacaaaaaaagaataataataataattgttttggtgacacagaaataatattccacgaacctgtctatgttgaaccgtgtaaggtcgaataactcgatttaaatattattacatacaaagtttaagactaccacgtcgataatgtgcctccacgaaactctctttatataaccacttatttccacttcatctaaatccatcgacaaagacttacctctcacggcgagaaacaacagagaatcggggaaaa

SEQ ID NO: 3145 - DNA, 3000 bp, Unknown
  misc_feature (1)..( 3000): cDNA_ID_2049489_gDNA_ID_1620628_Annot_ID_162583 3000 nt of promoter + ATG
caaatgccccttttcgcgcttggcgtctcgcaagccttagtttcctattacagtggttgggatgagactcaaaaagagatcaagaagatcgctatcctcttctgctgcgcgtccgttatcactctaattgtctacaccattgagcatatctgctttggcactatgggcgagcgtctcactctccgtgtccgcgaaaatatgttcagaggttcgtctcaaactctcaatgcaagctttaaataaatgataaatttaaaattcttcagaaattagagatcccaatttttattatcatgtgatacttattctgtttttggtttaatagcaatcttgaagaatgaaatcgggtggtttgatgaggtggacaacacaagctcaatgttggcatcgcggcttgagagcgatgcaactttgcttaaaaccatagtggtcgataggtcaacgattctactgcagaacttaggtctagttgtgacctcttttatcatagcatttatactcaactggcgtctcactcttgtcgtcttggccacatacccattggttataagcggacatatcagcgaggtaattaacgcaccgttttgccacttttaaaaattttcctttatgtttatgtttacgtttgtgtttttgttgtatttgtagaaacttttcatgcaaggatatggaggagacttgaacaaagcatacttaaaggccaacatgttggccggtgagtctgttagcaacatccgcacggtcgctgccttctgtgctgaggaaaagattctagaactttattcaagagagcttttagaaccttccaaaagttctttcaggcgtggacaaattgcaggacttttctacggtgtctctcagttcttcattttctcttcctatggcctcgccctctggtatgtctctatgtatatagaagattgtaaattaataggcctagggttcagaccaataaagaataggcatagggattcaccggttttaaatattgaattgtcaattgtttgatttgataggtacggatcaactttgatggacaaaggattagcgggcttcaaatcagtgatgaaaacattcatggttttgattgtgacggcgttagcgatgggtgagacattggctctagctccggatctgctgaaaggaaaccagatggttgcgtccgtgtttgagatcttggaccggaaaactcagatcgttggagaaaccagcgaggagctgaacaatgtggaaggcacgattgagctcaaaggcgtccactttagctacccttcgagaccagatgttgtaattttccgggactttgatctgatagttcgtgccggaaagagcatggcgctcgttggacagagtggatctgggaaaagttctgttatttcactcattctccggttctatgacccgactgctggaaaagtcatgatagagggtgagtgcacttgacttagacctatgaacacaaaattcttgcgtttcaagaaataactaaggtttcttggatcaaaagacagtagttgtttagttgaaataaatttgtttttttccctcttacccaaattgcaggaaaagacatcaagaaactagatttgaaagcattgaggaaacacattggtcttgttcaacaagaaccagcacttttcgccacaacaatctacgagaacattttgtatggaaacgaaggagcatctcaatctgaagtcgtcgaatcagctatgctcgcaaatgctcacagcttcattacctctctcccagaaggttactctaccaaagtcggtgaacgtggagttcaaatgtcaggcgggcagagacagaggatcgctatcgctagagccattctcaagaatccagcaattctattacttgacgaagccacaagcgctttggacgttgaatctgagcgtgtggtaggtttctttaccattagactttgtaaaatttaatcacaatggactaatgagtatacaacgaatgaatattgttaggtacaacaagcattggatcggttaatggctaaccggacgactgtggtagttgctcacaggctatcgacgatcaagaacgctgacacgataagtgtattacacggaggtaagatcgtagagcaaggcagccaccgtaagctcgttctaaacaagagtggtccatattttaaacttatcagtcttcagcagcagcaacaaccttaaattaagtactatactttatttattgaaaaactctttttatttttatttttgtggaaaatattgatcatatactcatttgatgtgattatcttaatcttcttgatttaccgttggtaaaaaaaaagttacgaaatccaaaataggaaaatgttctgaaacgttggctatgtattttcacccaaatttggatttagttatttttgagcactgtctttatcgtcagcacgtttcactgcgacattctccaaaggaaatgatcaacaaaaggacaacttgattggtttcaggaatctccagagttcatcatgtcctactaaatgacaaaaccctttacaaaaagggagccatcaccacaaataattaaataaaaccaagtcaaattaaaactgtattaactatttcaccaacaccaagttgaagttttctaattactattttttttttttgtcaaacatcatctttaatatgttataaatcgtttgcataattttgttataatttgtttgtattatttggttataaaatctcccacctttttggttatttcacacatcttttacttatacaaaaatctttcctgattttaattaaataaagctaaaacactttagtaatacaagtaaaattaaaaacaaaacaaaaaaattcgggaaaagtatttggtgtgataaattccctctccagcttctcggtgacacagatattttgcttccaaataaaacgagtccggtcactggcgctcactgacttcgtcttcctccatctccgatccattggtttaacaagcgcgtgagggccagatagaccgagaatc

SEQ ID NO: 3146 - DNA, 3000 bp, Unknown
  misc_feature (1)..( 3000): cDNA_ID_1820850_gDNA_ID_1620628_Annot_ID_162582 3000 nt of promoter + ATG
aaaatatatctcaaacatactatttatagaaaatcccaaccgattacaaagcagctgatcggtgtgtatttacaagtaatgtgtgatttttttttttgaaaaatcgtgaattaaaaggaatcccaacgtgtgaggtgtgactctaaagtctgaataaagttgacgatccataattttcttatgtttgccgtcgattgtgagaattgagaagcatatgtggtttctcttctaagagttaaaaataccgtgaaataaaagctatattaattcatatgttttatcatatatcttcgaatatcagcattagaccttattagccagctcaagtacgtcattttcactgatataaatgcaaattaataaccagatcgtgcccaaaacgaataaattattccatgcatgcagttgcatcattattttttggtatagtataaagttgcatcattatacttcgcattaattttccaccacgcattccctcctaaataaaaagaattaaaattgtcacatccatctatatcaacataagcaagaggttcgagttggaagataaaggagatttttttttcttttccatatttcatctatttggaatggtgctgtcaaaatatctatcaagataatttacaaaatatgatggtgaacaataggatgtggttgttttcggttatccttatagcgtcttgtcttcttagattcaaagcggtgataatagtcgcggccggagcggtggccataattgcgtttgatgcggcgatagtttggttaaaggtctcgttgatgtttgaatgccatactttgatgttattctttccttttagtttgttattttatgttcttgtacaaaaaagttattgaattgccaaagaaatcttttctatatctataagttcaatatcgaacttcagaatataaaaaagaaacaattgatatcaataacattcaaaataattgaaattaataaacagtgattctaatttagccatttacaagcaaacttaaaagataaaggtgatctagatatattttaaatagaaaatggaatcatataatgaattttttgaaagtttcaccatagataagttgttgaaaacacatggtgagttttttactcatcaatgtcgtatatatgacttaaaaaatactttcttatatccaaatataaagaaaaagcaattaggtatgtaacgatgaagcaagattaaattgaaattaaattgcaacaaataaaatttgatagaaaaaaaaaatagtttttaccaaaacgaaaaagcaagattaaaatatgtggaaaaaacgtcgaatcaggagaatatatgagatgactctcagacatcataacacatacatacgtagtaatatattaacaactgcgtcgaatcgtaagacttggtcacttcagtacatgactaagcatcattcgggaccagccaaaaaacatgtatgcttcaaaaccagaccccaccacattataagctcatctcagtcatcaccacaaccaacgcaaagaattcttcttcttcttcttcttgacttggcgttttttcttctaataattttaattttaattttattttcaacatattcaagtaattaataggatcgacttgttggaaattgtttaagttctacttgttgaatattgtcaatttatttggatcatgttatttaagttctacttgttccaaaaagatatgaaagctaattggaacagaaatttgtctagtttcttaaaaaaaattggaaaatattattttaacgtatattttttcagatatatttcaaaacataataaagaaatattttgatgatataaatttatttaggagatgtatacagtcttaagtttttcttacatgaatttgagataaatcttttcttcttgaactgattaaagagggtatcaatgtcttattgaatctcaatccagcggacatagatcaaaagtccaaagcaacaacatgtgaacgcgttttgatataaatacaatcattatccattaacacgaacttccttttttacatcatttttaacttcattgtaggggcgacgtgttgaagtcttgaataggggtggacattttttggtttatttttagagagtttggatttggtttcattttcccaaactagagtttaatagagttctgaccgaagttatttatttggtgcagatcagtttattagatcattcatcaatttcttattcattatttcatatttctaattttttttatgaaaattatcgatggaattggtttcccaaaattttgtattaactcgtattttcataattttctctttaacaggttatacaaatagtagttgtcaactttacgtaaattacatcaaattttaagtaataaattttaaaattctagatgttgttaacaatgacaaacaaatttatttagtgacagcatttttattcagttagtgtatacacttttgtttttgtcaaagactataaacttaaaacatttaaatatagataggagtagttgaatcatctttgtaagtttgactattacaaaactgagtcttaaaagacattttatattaaaagatacctcagataagcaaactcttttacacgaaaatagacacttgttcctttcaccatttattatccctcccttaccgtgagcaagctaacgagccgagaaaactacgcacgtaccaaattaatacttcaagtaactactaccatttaccaacataattcggtaaaaaaactaaacaaaaatccaaaatttgggagtgatcaaactttattaagagagttactaactagggtcacacacacatacatacatagagcttcacaccaaacaattctcgctgaaaccaataaacttggtcttatgtcttctttcatttaatgtatatctctctcatcttcttcctctctaaccactttcctcccttaatttctatccctatatttattttcctttcattttcctctccaactaattacacacacttgaagctgaaaaaa

SEQ ID NO: 3147 - DNA, 3000 bp, Unknown
  misc_feature (1)..( 3000): cDNA_ID_2049863_gDNA_ID_1620628_Annot_ID_162579 3000 nt of promoter + ATG
ttttaagtcatatatacgacattgatgagtaaaaaactcaccatgtgttttcaacaacttatctatggtgaaactttcaaaaaattcattatatgattccattttctatttaaaatatatctagatcacctttatcttttaagtttgcttgtaaatggctaaattagaatcactgtttattaatttcaattattttgaatgttattgatatcaattgtttcttttttatattctgaagttcgatattgaacttatagatatagaaaagatttctttggcaattcaataacttttttgtacaagaacataaaataacaaactaaaaggaaagaataacatcaaagtatggcattcaaacatcaacgagacctttaaccaaactatcgccgcatcaaacgcaattatggccaccgctccggccgcgactattatcaccgctttgaatctaagaagacaagacgctataaggataaccgaaaacaaccacatcctattgttcaccatcatattttgtaaattatcttgatagatattttgacagcaccattccaaatagatgaaatatggaaaagaaaaaaaaatctcctttatcttccaactcgaacctcttgcttatgttgatatagatggatgtgacaattttaattctttttatttaggagggaatgcgtggtggaaaattaatgcgaagtataatgatgcaactttatactataccaaaaaataatgatgcaactgcatgcatggaataatttattcgttttgggcacgatctggttattaatttgcatttatatcagtgaaaatgacgtacttgagctggctaataaggtctaatgctgatattcgaagatatatgataaaacatatgaattaatatagcttttatttcacggtatttttaactcttagaagagaaaccacatatgcttctcaattctcacaatcgacggcaaacataagaaaattatggatcgtcaactttattcagactttagagtcacacctcacacgttgggattccttttaattcacgatttttcaaaaaaaaaaatcacacattacttgtaaatacacaccgatcagctgctttgtaatcggttgggattttctataaatagtatgtttgagatatattttattttttccttccacactcacccggagatcgcacattgtctttttaaaagcatctaaatttgaagaaagaaataatgagtcaaaaactaactccatgaaccaaggagaaaaacactctccgtctaatccaaaccataaccaaataggcttatatttacaaattccacttctggcaccaaaatttgcagaagaataaacacaacttttcattgtctttgaagagaacataagccatggattctttaagaggccaaggtgggattcagatgcttttaactgctgaacaagaagccggacggattgtttcagctgcgaggaccggtatagtctctttctcctttatggcttgttggctctaatagtaagattttggttttgaatccttttcagcgcttttcttttctttttgtatggacggatcgatgatcagcaaaactagcaagaatgaagcaagcgaaagatgaggctgagaaggagatggaagaatacagatcccgattagaagaagagtatcaaactcaagtttctggggtaagcaacaccgaaacaaaaccggctagtgagatatcttgatttgtactcatattctttaccttttgtttcagacggatcaagaagcagatgcaaaacgtttagatgatgagacagatgtcaggattacgaaccttaaggaatctagttcaaaggtctccaaggatattgtcaagatgctcatcaagtatgtcaccactactgcagcatgattctcactacaccgcccccatcgtatcttattctcctgataataaaactgttatgattcttcagctctagttttttggtccgcgatttctaatagagccaaatacatagtccattggtagagaaactcataaatatatggaaactaaaacaaacattagatgaaagtatcattgtaaaaaaaagaggaggggatcgaaaacgaaactaagtacacaagtgatgaattttaaacataagtacaaaagagaacatgcatgcatgataaatgcaatgtttggtaaatttgtatcatattcgtactcttgagcattatgtggacattcgtaaacaaactgttaacttgttaatgacattcactaagataaataaatgagcatttggaacaaaacaaggcaaccaccgtatgaactaccgtccgagtccgacacattaggtccatatggcgtagctttgacattgcgctcaattttgtaaacgtataaataataataaattcctttatttaaaatgacactacatatgtaaaattcaaaatatgtttaatcaggtaaaatagtttttttttttttttaaatcagattgagtaatggaaaatttgagattgcattacctttcttttttttttttttttttggacaaagattgcattgcatatcttacaaaaattactggatttcattttgacattagctatgtataaatcgataattgaggcaaatgatgattctataccaaaataaaagaaaagtttaataactggcatccgattataggaggaataatacgaaattagtaaatgagatgtacaaatttcgatataaatttactctgataaattacaaaaatctatttaaaaataataatcaagattccgttacgcacgtaatggtgaggcaagagagagatagagagtagcattgttgaaaagtctgttattggtgttctgtttgttgttaaggcgactaacaacagagcatatcaaaaacttggtcttcgtcttcttcatccttatcttctcttttctccatctctccgtcctaaccaaatcatttcacaattccggtgatcgccggaattatcaagaaatttatccagattccgatttatcgctagatg

SEQ ID NO: 3148 - DNA, 3000 bp, Unknown
  misc_feature (1)..( 3000): cDNA_ID_2991550_gDNA_ID_1620628_Annot_ID_162576 3000 nt of promoter + ATG
attctctagtttagctaaacttaattggaagtaaagtttattgttgctgatatataataaaatattttcatgtttaaaaatctaaatatagttgaatggactctttaacaagaaagtaaatattggcgtctataaggtcaagagatgtggcgtaatgactacttttgagcaaatcagtggacaaattaagactttccaatctttcattggtcaagtctaaatataaatgattggatttctaagtttcatttcctgtttttaggctcactcgtggactttttttaatttctttcctttgccatatttataaaataaaagagagagaaagaattttcaataattttcaacaagcaaagttcatgatggggaataagcgaaatctcggatttgtgatcttcttctgggctctggtggttgcagtagtagccacggccatcgagcatcgtcgcaatgagaggactaaaggcgtcaatggtcttgacaagatcatcatccgcgaccgtcgtggccgatctgctgaggtactcactcttacggtttggtttagatctattgattgtgtcatttacatcaaaaaacttggcttcaaaacatcttttggatattgcatgatgcagattttgtttctttgtttattcaggtttacttgtatggaggtcaagtcagttcttggaaaaatgagaatggagaggagttacttgttatgagtagcaaggtaacttcagtcagattcactctatctccttttaggatcatatgattgctacaaatattgttctctgattggctaaaaatattgttctctgattggctgtatctgcgataatgtttttttttttgttttgcttttgtatgtgcaatagttgactaagtaaattatgcaaagatgaatctttacatcttctttttttttgttttgaatctttacttcattagaggcttgtaaatgaatagataagtatagcttaataatctgctttgttctaaagtagtagtaattttatgtgtgtgtatgagttccaaagcagagtgatctaaaacatgtgttacgtattgtgcaggctatattccagcctccaacaccgattcgtggaggaattccagtattgtttccgcaagtatgtgtttatagaaaaaaaaacttttctttgttgttgaagggtatagttttgttaatgaaatgttttttatggaagtgcagtacagtaacaccggtccacttccctcacatggatttgtaagacagaggttctgggaggttgagactaaaccacctcctttgccatcactttctactgctcatgttgacctgatcgtaagatcatccaatgaggatttgaagatctggccgcataagtaagattcttgaaacatctctctctctctctcattttcaacattttttcagatatttgattaggaatattttacataaaatatggagactgttttttaatctatgtatccatttcaggtttgagtatagactgagagtagcattgggacatgatggagatttgacgttaacatctcgtgttaagaatactgatacaaaaccatttaacttcacatttgctcttcacccctacttcgctgtttccaatatcaggtaatccaaggagtcataacttcacgttgatatctttttttttggttgtgttggtgtaagtgtcattgaatcagctggttgttgtattcagtgaaatccatgtcgaaggattacacaacttggattaccttgaccaacaaaagaacagaacacgtttcactgatcatgagaaggttataactttcaatgctcaagtaagcctctttccatttgccaattcaaatttcaacccttttattattttagtccatcactaaaaaaaaacacaccttgcaaaaaaagcttgacaggttgtacctaagcactccagatcaactaagaatcgtggaccataagaaaaagaagactattgttgtacacaaggagggacaagttgatgccggtaattacaaatttagatttgtaaacatacatagacatagacacagtcacacagaaacagattgttttagtagtactaatgatggatcacttgtaattacaatgtgcagtggtgtggaatccatgggataagaaagtatccgatttgggagttgaagactataagcgttttgtaacggtggaaagcgcggctgtcgcgaaaccgatcacagtgaaccccggcaaagaatggaaaggaatactccatgtttctgtggttccatcaaatcggaaagcttgaccctataaaagtcttgcattcatcatcctcatcctttaaaaaaaaaaacttaaaactgtctttattaaagtatacttaatgttcccgagagacatcacatggtgaacacaaagttagttgggttccaaactggactcttgaccagttttattgttttgtaactttagcattcatgaataaaaaaagtgcgttaattacaataattgttaaatgtaattaaataaaagtgcgttaactacaataattggatattggttatttgcaaaattcatgttcttaaatcatcagtctaaacaaaaaaattagattagccgaagatttcttcttctacccttgatgatactatttgggatgggcttgcttagatgtgccgaatccaattctcgtttttgggtctatctatatttgggctgggctttataagaggcgaagcccatgtcgaacaatcaatttttttttaattttatatttcttttgggagtctgttctgtcgtattgattaataaagtaaaaaatcttagccacaaaattaaatcatctccaagacgtatcaatatcatcatcaatccaccaatgaaaagttctctctttttttttcccactcttactctgttctcgctacagaatctcctgggaaaaaaaaaaaagaaacttgatccacccgaattccccaaatcttcacaatttctggaaactctctcgatcgtgaagcagaaaagtgaggttccaa

SEQ ID NO: 3149 - DNA, 3000 bp, Unknown
  misc_feature (1)..( 3000): cDNA_ID_3071205_gDNA_ID_1620628_Annot_ID_162575 3000 nt of promoter + ATG
ttggtgagaccttatggaccaaacctgatacattttctgcttgaactgattagattggatattaactgtaatccacctttaacagatgatgatgaaggaccagtatggaaactatgtggtgcagaagatattcgagacatgtacggctgatcagcgtttaacattgttcagccgagtgagaatgcatgcatctgcattgaagaaatacacatatgggaaacatattgttagtcgtttggaacagccctctattgaaggtatgaaattccccaatgtaagtcaagttcaaaagtgaggtgaataatcacaatctttaggaacaaaagggctttgctgttataccatataagctgaaacagggcgaagtacacaatcaaatatattttctatgctaaaaaatggtcggtgaatcgctcaagaatgacatgtcacatgtgcatatagaaatgtgtggtagcacaagactgaatagaataagatgggattggtagcacaagactgaatagaataagatgaggattggtatatggatcaggaagagttacacattgtgtttgttgtttctgcagaaaaccaagaattgaggagatgagtggctcttctgatttcaagacagtgggctgactcagattcactcaatacaattcgctttttcatgaaagctggatattcattgggaaggtcttagatgattgtgaaggacatcgatattgttgtttacttggaattttatcatagccgttgtgatgattgtgtggcatgttctgtaaatattcataactgtatcagtagtttacttcagatctgtaactggtttgtggaatttcacatggtattcgaaactttctagatactagagaatattattattgaagccaaacattacatgctaatcctgaaatagcctcctcttcctcaaatttcatgagctacagattcttatcacatttcaacactgttttgagactttctttcattcatctgacatgaggagccaaagtataggatcgaaagagaaacttgtcattactcacgaaatataattgaaagcagtgtagcatatcacacttgacaatggaagaaacaccccacacaaaaatggaaagctcaaaccaacacctccaaaatactatttcaatcttaaccaaagagatcgaatccgaagtctccttcttcctcttctgattcttctttcttcttctcatcttccttaggggcagctgcagcttcacccgcaccacctccacttgaggcagctcctccagcagagaatcctccaccaccaccaccaccaacaattacctacgccacaagaaattgattccaattgataaaaattacaatgcaaaacaggaattatacacaaatattgatttgtactagtttccggagccatgtaaactaaagtcacctactaaaacagagaaggcaaccaaaaacaaattgagtgatttagctattacaaagctgtaacctttaggtatcattgttaacctataaaacaagctacattgacgcaaaatcacatttgatgcaatgataagagaactatagtgagccatgacacttgtatcactgatcaacgaccataattactgtgaatgaatcattcatctgaaaatgcaagctctgattctcacacagtattgccaatttcaaagatgcacgatctcaaactgtaagcttgttcgagcaagagagacttatacctggaatacggcggaggtaggggagacaagagaaaacgaagactgaacgccaccggaggaatcagcggagagagatacctgaacgagcttacgctggagctcgtaggtagaagaagctgaagattcaagttctccttcgtgttgcttcgcgctccacgcgccgcctccattcttgcatacgaatgtgaatactcccatcttcttcaatgtctgctaaaatcgatggcgatagtgagagatttctggaaaaagtgacgatcgagagtggttttgtttttatatacgatgatgaacgaaagctcaaaaagaagttaagaaccctagttttttggaggtctctgagtaaaagactgttttacccatagtggacttataggtcttaaatgggccacttttgagagtaatgaatatatataggcctagagtgaatagcaacaacccaccaaggttctttcacttctttgaaaaaccaaaaaagcaaagatcaacaaaatttatcagattctacgagagtcatttcctaacacatgagatgatgagattattagagtatcacaactctcaactatgtttttccataaactatgcatcgcaccattcaccacatgatattgtaactcttaagtctaagccatgaaatcaacattgaagtaaaagaactcacatagtaaattggttttctattggtttatattttaacaaaattatactgtactcatgtcatctttatgtcaccaaatcacaaactaattttctacttttaaaacaaaacatctaccaattccaccacatatcctaaaaactgactcaaatctctcaaaatctaaaatttcctaaattccacaaaatcatccataatctttaatcctccttagttatgatatcaaaaaaccattttattttaagtatctaatttccttgccataaattttattctctagtttagctaaacttaattggaagtaaagtttattgttgctgatatataataaaatattttcatgtttaaaaatctaaatatagttgaatggactctttaacaagaaagtaaatattggcgtctataaggtcaagagatgtggcgtaatgactacttttgagcaaatcagtggacaaattaagactttccaatctttcattggtcaagtctaaatataaatgattggatttctaagtttcatttcctgtttttaggctcactcgtggactttttttaatttctttcctttgccatatttataaaataaaagagagagaaagaattttcaataattttcaacaagcaaagttc

SEQ ID NO: 3150 - DNA, 3000 bp, Unknown
  misc_feature (1)..( 3000): cDNA_ID_1819626_gDNA_ID_1620628_Annot_ID_162572 3000 nt of promoter + ATG
caagtcttccttctccagtgattgaattcgaaaacaagagagtacttaattaattccagcagtctattttctccaataatttcttgttagtattaaactagtgatataaaagttcccaaagaatctaaattttgttttggattggagttggcttcacgaccttttttttttttttaagttttagtattcattttatatgaatggaatggggcaatggaaagaaaaatagtccaagtgggtctcaaaaataaacgaatttagctctgtcaatcgcacttgtctcttcatgtcattcgccggtttgctccttccacgacggcggacgatctgcttttcgacattactgtcttttaattttcttttagttgcctatttttcgttgttgttgtccattacgccattattacttttactaaacaaataatattcaaaaatataacaactaaaaaggccaattgtttttaatgacccctaaatttgagaaattaggaaactggccatttgaactttgaagcgcctagaaataatgagctgcctgggaggcagagctacattacacagtgcggctgggcatctttttctgaggttaatgggccaagtggtccggcccgtataggcccttaaccaaaaaaaagaagaaagaaagaatcgtacatggaagtttgaggtgtctcttagcatcatgagccatagtgtacaaatgcatcaaaagattagactaaaaaagagttgtacgaatagtgtgatataagcagaatattcgtctttgaaacatcttatcattgcccaatttggatatgattcggctagtgaaatatgggtttatgtttcatcgaatagtagacatttatcttatgaaaagtgcattagcataaacgaatatatggcttccttaagaattcgttgtatttgtatctgactaatggagatttctttgtgcaagtagagtattgtttcttttttgtgtgtgcgggcatgtacttgtaaatgacttgtggaaatttcattattcaagtacaaatacaaagaaatttccattgattaagatgttggatagtagtagctagttcttttttcccttcgaaaaaattaaattaaatggaagatagatacatagcatctgctcggatattagtatgttgaagcctcaaaagggcctaatccaaacatcgcaattcatagtaatttagagtatgaccaaagtcaaccaatataactatctaaagttatttcagtttttctaattttcacatctataaagtaggaaaatgatttggattagtataaaactagcaaaaaagaaaatttaaattgtagagtttgtacctataagtgtagaccattaaattttgttctgcatctgatcaaatctatacaagatcaatattaatcctatacgaactataaatcatgagaaaatcctcccggaaaaagtaatccaaaagaaagattatgaaaataggcacactgagcagtaatcaaaatctgttttatcagatgagaaattgttctaatataatggatcaagattaaactccacacgtctcaggttttagtcgacaccatttttctttctgattttggacaagagcaaatcagcaaaatgtgagtgagtttctatggttttgtcacaaaacttttgtgtgtgggctcgttggatacacaaacaaagtcaaaggttagaaatttattgagttttgggtatttccggttttagttatgagtcacatattctttcacaaaattcagacccacgtttttagcaattgaattcaactttttgagttttcgtctgttttactttctcaatataaatttttaactttgatactatatataaatttttaatataatatgtaaacttgttgtacatgtttcagttatacttagtgttttaacaaataaaatacactcagtcaatcaaaaatcaactgagtttctaatgttaaaggagtatttatttttgtaattcagttaacacttctaatcattttcatgaaaagctttaaacatatgcttttagttttcaacaaacatattacaaaagctattaagttaatcttcaaagttattaagctaataacttataaacgatattttacacataataatgttagttgtagttagactaaccatgacttaatcacccaaagagaaaacaattctagaagactagaaggaacatagaaaattaaaaaatgatatttaaagaaagaaagtaataaaaatttggtaaaccgataatgaataaaaagtcaaactccataaacttcgcggaaaaagaaaagcaccgtaatggtggaaatatttttgccattaccggaaaaaaatccaaacattttaaaaatcccactgacttagccaaagatggtcactttttctctctcccccttgtctctctgagcaccagaatctagggtttcttcacagtgaatctttttttttttttttgcttcctcctcaataatcgccttctcgtaagtcaatcactctccctctcgtcacttctgctccctatgttaaaaagttcattcatttctgcttttctagggtttttttttgggatttcaaagtctagatttttcttctctgttctacttacactctgtttcttctctctttatctctctgcctctcttttgggtttctctgtttttttcttttaatggaggaccatttacatggtcatgtatttctatctgcgtggagatatttcgtaggctttaaagttttgtgcttgtttgtttatatgttctttactttaaagttctactctgttagtactctgtctgcggaattagattactggtagggatgtaaaaaaccttgaggaaaatggtagagattctgattagaagctatatatcatttgcttattccatagtggattgatttagcttgtttaaattccagttctttttgtgatagtccctttcttatttcattggtgataaatttgtctttaggtacttgtgtgaaagctcccttctttgtggagaa

SEQ ID NO: 3151 - DNA, 3000 bp, Unknown
  misc_feature (1)..( 3000): cDNA_ID_1819630_gDNA_ID_1620628_Annot_ID_162570 3000 nt of promoter + ATG
ttctttctttaaatatcattttttaattttctatgttccttctagtcttctagaattgttttctctttgggtgattaagtcatggttagtctaactacaactaacattattatgtgtaaaatatcgtttataagttattagcttaataactttgaagattaacttaatagcttttgtaatatgtttgttgaaaactaaaagcatatgtttaaagcttttcatgaaaatgattagaagtgttaactgaattacaaaaataaatactcctttaacattagaaactcagttgatttttgattgactgagtgtattttatttgttaaaacactaagtataactgaaacatgtacaacaagtttacatattatattaaaaatttatatatagtatcaaagttaaaaatttatattgagaaagtaaaacagacgaaaactcaaaaagttgaattcaattgctaaaaacgtgggtctgaattttgtgaaagaatatgtgactcataactaaaaccggaaatacccaaaactcaataaatttctaacctttgactttgtttgtgtatccaacgagcccacacacaaaagttttgtgacaaaaccatagaaactcactcacattttgctgatttgctcttgtccaaaatcagaaagaaaaatggtgtcgactaaaacctgagacgtgtggagtttaatcttgatccattatattagaacaatttctcatctgataaaacagattttgattactgctcagtgtgcctattttcataatctttcttttggattactttttccgggaggattttctcatgatttatagttcgtataggattaatattgatcttgtatagatttgatcagatgcagaacaaaatttaatggtctacacttataggtacaaactctacaatttaaattttcttttttgctagttttatactaatccaaatcattttcctactttatagatgtgaaaattagaaaaactgaaataactttagatagttatattggttgactttggtcatactctaaattactatgaattgcgatgtttggattaggcccttttgaggcttcaacatactaatatccgagcagatgctatgtatctatcttccatttaatttaattttttcgaagggaaaaaagaactagctactactatccaacatcttaatcaatggaaatttctttgtatttgtacttgaataatgaaatttccacaagtcatttacaagtacatgcccgcacacacaaaaaagaaacaatactctacttgcacaaagaaatctccattagtcagatacaaatacaacgaattcttaaggaagccatatattcgtttatgctaatgcacttttcataagataaatgtctactattcgatgaaacataaacccatatttcactagccgaatcatatccaaattgggcaatgataagatgtttcaaagacgaatattctgcttatatcacactattcgtacaactcttttttagtctaatcttttgatgcatttgtacactatggctcatgatgctaagagacacctcaaacttccatgtacgattctttctttcttcttttttttggttaagggcctatacgggccggaccacttggcccattaacctcagaaaaagatgcccagccgcactgtgtaatgtagctctgcctcccaggcagctcattatttctaggcgcttcaaagttcaaatggccagtttcctaatttctcaaatttaggggtcattaaaaacaattggcctttttagttgttatatttttgaatattatttgtttagtaaaagtaataatggcgtaatggacaacaacaacgaaaaataggcaactaaaagaaaattaaaagacagtaatgtcgaaaagcagatcgtccgccgtcgtggaaggagcaaaccggcgaatgacatgaagagacaagtgcgattgacagagctaaattcgtttatttttgagacccacttggactatttttctttccattgccccattccattcatataaaatgaatactaaaacttaaaaaaaaaaaaaaggtcgtgaagccaactccaatccaaaacaaaatttagattctttgggaacttttatatcactagtttaatactaacaagaaattattggagaaaatagactgctggaattaattaagtactctcttgttttcgaattcaatcactggagaaggaagacttgttggtttcaccaaaaagtctcttcttcaatttttttaattcagaggcagtagtagtacactcagatataaaagaaaccaaaacgatcggaatcttcttccacttgttcttttaaaagattaaagcttttttttttctcttaaagcaaaaaaaggaaaactttccctctcgcgtctctctcttttgacctcacattcgctgaatcactcttctgggttttttttttttttttttttctttgccctagatcttaaagacaaggaggatcaaattatacttttttgagatctgggttcggacaaagattctgtctttctgcattctctaccgtttcgattcagctcgaggtaaacttttatttgactctttttgactgagaatgctcgttagtcattacagtgtctttttgttgctggagggttgaatctgggatttgtagcttttgatttttgtttggtcggagaataaatcacgagacttattagacttgttaagcttgtccgtgtgctaaagagtgttttctgaggaatgtcctgcactgcccgtatcacgggaacaacgtgcattttgcttattgcttctgtctgaagcagttttcttcttaagattagtttgaaacattacttaatctctccgtgttttccggaatctctaatctcggagagagtctttgttcttcatcaggcaatgccaatctaaaaggagtaggtgaaaaaagattcaatttttgtatgcctatcaattagaaaggagaagaggggaggtggttagattggtttcaatg

SEQ ID NO: 3152 - DNA, 3000 bp, Unknown
  misc_feature (1)..( 3000): cDNA_ID_1841306_gDNA_ID_1620628_Annot_ID_162569 3000 nt of promoter + ATG
gagtttttttttttaaaagacagaaaaaacaaacattaatttcttttgttattttattttatttgtgaagaacaaaagatgaagttcgtcttaggatttatgatatcaagtgttcttaatattttttagtatgtaaaattatcagtgaattgtgaatattttgcatgaaatagaaactgatacgatacatataattaagaagaatcttactatatatgatttattagtaaaaattccaacagtttataaagttatgctagcatgttgcataggtttcaaaattcatgttaactacccataagatatcagttacatgtattatagtattgatgttttgtattaatgctaaaaatatttggctcttgtgtttgttagtagcttagtattaattagtagtgttatctccgtaggtaggtacactatactatgcatgaaagtgaactgtgaaccctccaactattacttctctagatagagtattaaataactcgaaaaaaccttttttcattttatacaaacacccatttatttatatttttgaaatctatgagaggtattaactacgtactgtttaagtagtaaaattaatcataccatgtgcaactaagttttttgggtaaattatacaccacttgtaacttatacagatggtataatcaaactctataaaacagttgaacatttatatttcgtacaaatcaagtcattttccaattaatttatttagattatgatgtttagcttaattatttttcttcgatcgtaaagctgccacctcagctgaacctaccaagatcacaactccaatgttacggcgagatggtctacagcttcgtcggtcaggatctgcttggggaatgcagccgccgtgatcttcccattgaacggctcaaatcagtggtgacgtggaacatctccacactccgtccggtggtctttggcatgtctccgtacaactccgttctcggcgagactcaccacgtatcgaacggtcacatcaacgtcatcgccgaacaagtataatcatttgtaatataatcattatttagtcattacaactataaacgaaacatagactgatatatatacatcgttaactcttaggtagtgcatcatcctccggtttccgctcttcatgcgactcacgaacaagaaaatatcgacgtgacatggtgtcaatatttcactcctaaatttcgtggtatgtttttttttatcattttagttttgtagttaaattgttctgctacatcccaaattatctcaaaaccaagtctttttgttgttgttgtcaaacctcaaaaccaagtctagttttgagtaatccgtccaagaacgaacaccaattcgaatatgcatccggtttacactttcaaaccgaagcatctcgtctttgttcaaagttcaaacatatctaatttctgcatgtactcatttaatggtccataaggtactcacgtggacgttgaggtaaagggtaaaagggtaatgaagcttctgaatcatatagagacttatgagatggaccaaccgagactaataatgagattcttaccggcgccgggagcttactgggccggaaaagtgaaaataaagtgtccggagactgatctcgaagctgagttacatttgatctccgattcattcattgaaagattcagaggcaacaacaacagatcaataaaaggaaagatctttgaatcttcctctggtaatcagctctacaacatttttggccattgggacaggtaaaaaacatagtcgttattacagctcttaaaaaccatcattagctttgaatgatgtgatacgcctcccataaatatgtttcagaacggtaatggcgaaaaatataaagactggtgagctcgaggtcatttacaatgccaaggagaatatcacaggactcaaacctccaacagtcaagaacctggaggaggtaacggagagcgagtcgacaatggtgtggagtgaagtaagtgaaggaatactgaagaaagattgggaaagagcaagagaagctaagatagttgtggaggagaagcagagagcgtctttaaaacagagagaggcttctggtgagtcatgggttcccaaacatttcttagtggtcaaagacggtaaagactgggattgttcaccgctacagcctacggttcctccggcgccactcgtcatcacataggagcaaggacgaatcattcaccggtttcaagattccaaaactctatgttgataattataggttttgaaattataaataaatagaaaaataggttgatacttgataatgacatatccgtcaataagtattaaagatgaatgatgttttttgtcaattcatttgaggttgaatgtgtgagtgatacgtcaggcttttgagaaaaagagttcttaaatactatatgtctatatgagatttttcacctatgtaataacagaaaatattttgtttttcctctacaaaattatttataatccattaaatttgaaaatgaagattcaatctacttctctgttattcgatggtgaatttgcatgtattaaaataatctgtgttaaaataataaatcaatttcatctccataataatttaataatagttaagcattagggcaaccttatttaaaagcattaagcgagccttaaatgacgaaaacatggatctaacgagtaacgactaacgcccctccgatcgaatcaatagttaatgctaacccaactctctattttgatatcctatctatctttctagctagctatatagatggagcaaaaagattgatactactagtaattgtcactatatgtactacttagtacgtaagtcatagctccttggctcttttcttaaaaataatttcttttccaaaagtaacaacctcaaatggtaattacttagtgtgagtcattgactttttggtaaagaagtgaatcatacacgtagattaaatttacagatctaatatttttggttgtgtataggcagaagaagagaaa

SEQ ID NO: 3153 - DNA, 3000 bp, Unknown
  misc_feature (1)..( 3000): cDNA_ID_2049449_gDNA_ID_1620628_Annot_ID_162568 3000 nt of promoter + ATG
ttctcggtaacttccttgtcttctttgatctcttgcttttggttaatttgtgtaactgtcactgttgttattacaagttttttttttttttgttcttgttccatgagttctctgtttgttgattggaaaataaactgacaaaagtatagtatgataggagactgaaactgttctaaatttggaaactttaagcatatggtttcttattgaaagatctgtctcgttgatcctgaactctctcccagtgagcatagcgtatgctaaacttgtctactgtttgcagacacggagaagttttacacggaggtccaggaaaagatacttgctagatacaataaaacatttgattggtctttgaaagcaaagatgatggggagaaaagccatagaagctgcaaggcttttcgttgacgaaagtggaatcagtgactctctttctgctgaagatttcattgtagaaagagagtcaatgttgcaagacctcttccccacaagtgacctaatgccaggtacacaatccgcattgattaggccattctttcttttcatatatatatatatatatgtctttaaattctgtttgtttagtttcatttgaatcagcctctgatttattctctttgagtcactaatcactgaaagagacaagctcttagctcttctacttttcgctgtatccaatattcttcctctaatgcaggagctagccggcttcttagacatctccatgggaaaggaattccaatatgtatagccacagggtatctctttctgtattagcacatgctcttcttatagatcactgagagtgcaaatggctttttcagcttctttttataaatttatggtttatggcatatgttatctgatttagctactttttaatgcagtacacatacacgacattttgatcttaaaacacaaagacaccgtgagcttttttcgcttatgcatcacgtagtacggggggatgacccagaggtgaaggaagggaagcccgcgccagacggctttcttgctgcatccaggagatttgaggtacagatggtcactaaaactgtacttatcaaactaaagcaccagctattagcatgtgtttccacctttgagaagtttgtaaaccaatgttttccctcttctttgcggatttcataggacggtcctgtagatccacgcaaggttctcgtgtttgaagatgcgccttctggagtccaggcagctaaaaacgccggaatgtaagtggatttcgtgtaacattttccaagttctcttagctgatgagctattagtggttcagttctgactggtgtgtgtgcaggaatgtaataatggtaccggattcaaggttagataagtcctactgcaatgttgcagaccaagttctggcctctctgctagatttcaaaccagaggaatggggcttaccttccttccaggattcacacaactaaaacaacaaagctttcagggcaacgttatcctcaagctaacgatacttgactcgttaactttgattctttaagcctcttacgctatacgagaaagattattgcaaattatagattcttattggggtaatttaaaacaatatatttatgttcgtgatttgttttcttgattcatgaatttgtaattgttatccagaccgttaagtgtgactttggtgagaatgatattagaatgattgttgtgagtgtgggttacattcgaaggtcataggcttagattttgcgggatgtcgttaacagaacttgaggtcaactttatagtcggtagccaagttcataagcaagtctttgctactattattgtagaaaccgacatgattggtacatgacattgaatgttaaaatcaaaaccaatcacatatctctattctctaccaaaccaaattgcaacttatctcttgtaagaaacttcaatgattgcaacgggcgaaaatattgtctcacttttttattttatttgtgtcgtccgcaattaacttactcacataatcggaatccaagttagcactaatacaaagtatgtctttatgtagcaatgttgcatcgttttcaaagaagtgttattcattgcttactttcgtaatgatgattttttcccactcgtttgtcgttactatttactatcaatgatttataaatcatcgttaatgaaaatttagatctattttagtaatagatttgtttggtttagtacaagggattgtgaaaaagataaatttgatgattaaagaggacgcaaagtttggcgagtctttactctatatagagatagggtctaagcattcacatgcacttatgaaccgtccaacatcaacgttaataacgtgtgattcgtatcaaagtttacatatatttggcaaactttaatttattatcttgaaaactatatgtttcatttttgccgttttgagtaaagaatcgtacacccatcaattttcagatatatatgagccaatccataattaatctgattgattagagagaacgttataaacatctttaagatcaacagtatattattggttgaccaaaaaaaaattattttgatggtgaaagtcacataaatcaagtataagttcttgtcaaatttaaagtaatctctacgaataataatattggatacatgaatcataatttgtgatggtataatatatggtacctttcccgtgcaaaagaaattgagtcattgaagtgttaagcaatagtttgaagtttttatattgaatattacaaagtcaaaagcccttaattacatcatacacatcaagtcatgaaatacatataatatcacacatcaacttgatcattcataaagtcttacgttccatcttctctacaggacaagagtctcccaagatatatatacccactaatacccaaatccatagacacaatctccctctatatatccatttctccaaacgaaaacaaaaaaaacattaagccaagaaccgcatatacgaaccaagaacacatcatcgttagttctaatt

SEQ ID NO: 3154 - DNA, 3000 bp, Unknown
  misc_feature (1)..( 3000): cDNA_ID_1443622_gDNA_ID_1620628_Annot_ID_162565 3000 nt of promoter + ATG
aactcctaatgttatacatgttgtggcagctatcgtcaaaaggcacggcatgggatgagattgacttcgagtttttgggaaatcgcacaggacatccttacactatccacaccaatgtgttcaccggaggtaaaggcgaccgtgagatgcagttccgtctctggttcgatcccactgcggatttccacacctacaccgtccactggaaccctgttaacatcatgtgagtatatagtctatcaggaaaccctaaattgatagtaaattatacaatataatccagtatattaacaaacgttttattaattagttcatttattatcaattggtttttatataataagcttatgaacattgacagcgtctaatctcatatatttcctcttttgatgtgatcccttacattgagcactataaaaaaaaaaaacgagttctcttgacatctatagacatatttgatatatatttcttgacattcatgttggtttcttgtgtctgaagcttccttgtggatgggatcccaattcgggtgttcaagaacaacgagaaaaatggggtggcttaccctaagaaccagccgatgaggatatactcaagcctttgggaagccgatgactgggctacagaaggcggtcgcgtgaagatcgactggagcaacgcaccattcaaggcctcttacagaaacttcaacgaccaaagctcatgcagcaggacatcaagctcaaaatgggtgacttgcgagccaaacagcaactcgtggatgtggacgactctcaatcctgcccagtacggaaaaatgatgtgggtgcaacgagacttcatgatctacaactattgtaccgattttaagagattccctcaaggcctccccaaggagtgtaaactttgattctattatgggaattttcaagcatttttctttccgttttgtttcatcttgtgatgttactttgatttattttgttctttcttttggtgtttctgagatacgatattacatgtatacgtattcttcctgagaaaataagaagttgtattactcgataatacattttatctctcaatgtggtgtgattgtttattgggtttggcgtacaatgaaagctacatcaatgtgctttagaaaaatgcatacgaaaagaaaaacacaacaatcaaaaacccgtgaggtaactaaattatctccatttacaaatatactaacaatactactaatttattgctaagctgtcagctgtcacgaccatgataatgaaaaaaaaaatcatctctgttttcttctaaactttagagtttctcgaattttcacatataataaaaataaccaacagttatggtactctgttgggtgaagatttgctatgtggatatgtaaaatgcttagagtctttacattgtgattttagtggctggttagtggttattaggttattacaaacgcttttatctttgtacatgatcttcttaagtagttacagaaatctcaacttttcttaaactaaacgaatatctttgatttttattttctttacatcactcttattgggtctaactcactgtaaaattcctgcatgtttatattatgaaattgagaaaatagtaaatatatgttttaatttcaaagtttaatgaacgcgttggttggtccaactaactaatagggcccaacattaaagactttaagacccacatttaggaaatgaatttggacagtccaatttaaagcacagaacgtgtctcaatacttattcagtttatttcttcgacaatgatttttcaaactaaattgctatttttgatattcaggatatttcatttcatataattcagttgcattttcaggatttacaaactttgtaattgtctcctcataatgtcactttttccttcattccatccaatttgtcgtcaaagggcaataaaaataataatcacaatgctaaattctgataatcaaatctcaacaaaatatgactcaaatcaaaccctgttgattggaccaacgaattagacacttgagctttagctcctgtgattttaatgtggtatgcttgcagaaaatttcttaccaaaatgtcaactcatctccgagattaagcgtactatttgccaatacccgagtactcggagctaaataatagaaaaagaaaaaaagaatacatatctcatgtccaaacaatattttatatacttatttcatgacaaaaatcaggaacaaattaaaattttacagatataaaataggtccacgcaacaaacacacgttaagtttcattaggtttagattattgaataagatgcagaattgtcattttcaatattgattagtttctggtttaagtcaatatcacctggtttagagccactcgtgacaatgtataaaaaaattacgtaccatctctatatccaaaactagagacagagatgtgtcgaccatgaaactgtcttaagaactatgacaatttggtcataggcatagcctaggcaaaaaaacttcatttaaaaaaaaaagatcaaaatgtttcgattataaaagattcgtaaggttatataaaatacagaaagcatgagatataagttttctcaatattacaaggttattctcaaataattcaaacgaagattctcgtctaactatcacttttagaggataaggacagaaaattaaattagaaagtcctgacggaccaaattcattagacgcagttggctaatcatacattcaatgccaatggagaagtccaactgtatttcatttcaatcttactcatacaactatacaagtgatctgcaaattgccgcgtacatatatgaataagaaaaatacattaaaattttatatccacctgccaaatcctttcaacgccaaaccattcccctatataattatatatacaattacaaattttatgttacagtcttcatttattcgcgtaaagatttcaaaaagtagtgaatatattcttgtaggaagctgcaggggttaaggagagaaaaggg

SEQ ID NO: 3155 - DNA, 3000 bp, Unknown; identical to SEQ ID NO: 3144
  misc_feature (1)..( 3000): cDNA_ID_1819638_gDNA_ID_1620628_Annot_ID_162563 3000 nt of promoter + ATG

SEQ ID NO: 3156 - DNA, 3000 bp, Unknown; identical to SEQ ID NO: 3143
  misc_feature (1)..( 3000): cDNA_ID_1819642_gDNA_ID_1620628_Annot_ID_162562 3000 nt of promoter + ATG

SEQ ID NO: 3157 - DNA, 3000 bp, Unknown; identical to SEQ ID NO: 3141
  misc_feature (1)..( 3000): cDNA_ID_3091891_gDNA_ID_1620628_Annot_ID_162555 3000 nt of promoter + ATG

SEQ ID NO: 3158 - DNA, 3000 bp, Unknown
  misc_feature (1)..( 3000): cDNA_ID_2049474_gDNA_ID_1620628_Annot_ID_162554 3000 nt of promoter + ATG
tttttattactaacttcaaaggtttactcaaaaatttaaaattcatatgtatatcacgttttaatcttggagtttgggaacttgaataggatatatgtgttgggacgtccgtcattggtatccggtttcaaacttgagaaacaaggaatacgtttcttgagaagcaaggtttacattaccacctaatctacttaacatactccatcagcatgtctttaagattgtgttcctcagcttgagtcactgaatcaatatgcaagcagctttgttcgcccactacaaaattggttctgaccgtgatgtacggctggagaaagcaacatgagttgttgggaccaaatacttgtgtctccaaaaaacattgacgtctacattattttatgacaaacttgtccgttgacttcactaggtggcgagtgaaggagtaagattggattgagtaaaaatttaagcctagcatgaaatctagcgccgaaaccttaatgagtgaagatcatatagatacacaaatcctagaatgtgactgtaattgaatgattcacttaccaaactacaagattttaaataaaatctcaattctcaaattcataatttccaactatggtgttttagtggttgcaaattaatctgttagtccaagaacaagaatttgaatcatcctactatgatttaattcattgttggtcattattatgtgaattttttttctaggtcagcctatgattctcccgttaacagaagaaaattcactatgggactccgaaatctaatatggaaccggttaaccatctaaccggaccatgtaaaggccagctttgtagcaaataattattagattatcagcccaataaaagcccaaatccgtaatatataatctaatcgtcttttatccgcagaaaaccctattgctcccctttgctcaagctcagtgcctctttgcagcgaaagctcaaccaacaagacgatggtatacacatactctgcttctactctgtttctctaaatttacatatttactgaatgtaatggaaggaattatccgagtattaattgtgatcttgttcgtccttttatcagattatctcagagaacaatcgcagagagatctgcaaataccttttcaaaggtttgtgagtcatgctctctttcatttccttctattttcagctagtggaaccaggtttaagctagttacatttctctagggatcttcgaatctaagcttgtagtgagaaacaattgcattgaaatgtgaaaagatttatgcttgctttcagctccttttaggcctacgattttagatatgaacttgtttataaagtagtattgtaaggttcagagtaattggaatgctggatctaacaatgtttgttcataagttataattcttgaagagtatgatagattggtatataactgttgagggatttattatctagtactgtactcagttgtctagagaaagaatttgtgtggatactaaatgatcatatcttactgggtttcgtagagggagtatgctttgctaagaaggatttcaatctcccaaagcatccgttgattgatgtaccaaacctgcaagtgattaagctcatgcagagtttcaagtccaaggagtacgttagggagacatttgcgtggatgcattattattggtttctgactaatgaaggaattgagttcttgagaacttatcttaaccttccttccgatgttgtccctgctactttgaagaagtctgctaagcccggtggtcgtccctttggtggcccacctggtgatcgccaaaggtagtttcatctttaaatcccttgacctgtccggtctgagggattggctaatttctgatattgttttggcttttgttttcagaggaccacctcgctctgatggagaccgtcccagatttggtgaccgtgatggataccgtggaggcccacgtggtggtgatgagaagggtggagctccagctgatttccagccgtctttccaagtaaatcttcgacttactaatcactcctagtttactgagcctatatgccttccacttactaatcactcctagttaactgtgccaatatgcttcgtttaaagtcttttagctagttgatgaagagattgtctaacagcgtgttgtatgttggcagggaggtggtggtaggcctggttttggccgtggtgcaggcggttacagtgcagcagcaccatctggttcagggttcccttgaaaaatttgttgtcatattgcgacgatggaaggacagttttgttttttgttctagttctgtttgtgtaatgcaaatctggaatctataatctatctattaccttcaccttggtttaaacgaacaaatcctgtagtttcaggattagtgtcaaaattcatgtttcttactctatctgtcatggaattaggtttgcctttttaagaacaagaagagggagaccaaatctgtcttctttagtaatctagtgtggtaaaatattgaagtggaaatgtgtattagagaattcgtcttaacttctacaaaagacaaaagggattcaatgctaaattggaatttgatccaatttctttctagtctaatctttgaacaatatccttacaagaaattttttatcggacatagcgcaactctttctttaacgttgaacaataaatccaacttcgtctagatgttagtgttccaagaacaatccacttgatacctcaatttcgtctgtgttgcttccaatacaacatcttgtttcttagattgttgacaaaaaagttgagcttctttctaaacatattaaagggccgtttaagaagcccatcagaaagaggttaaagggcctgtccaaaatagaaatttgaaatcctctctgtgagacgaagggtttacactaaggcggaataaaccctaaaccctagctgagtagcttcttcctccccaattgctatttctctgcctccgtgtgctgagaaccagaacgaaaccctagcaaaatatcgccatg

SEQ ID NO: 3159 - DNA, 3000 bp, Unknown; identical to SEQ ID NO: 3154
  misc_feature (1)..( 3000): cDNA_ID_1976739_gDNA_ID_1620628_Annot_ID_47190 3000 nt of promoter + ATG

SEQ ID NO: 3160 - DNA, 3000 bp, Unknown
  misc_feature (1)..( 3000): cDNA_ID_2999612_gDNA_ID_1620628_Annot_ID_47192 3000 nt of promoter + ATG
caattaacttactcacataatcggaatccaagttagcactaatacaaagtatgtctttatgtagcaatgttgcatcgttttcaaagaagtgttattcattgcttactttcgtaatgatgattttttcccactcgtttgtcgttactatttactatcaatgatttataaatcatcgttaatgaaaatttagatctattttagtaatagatttgtttggtttagtacaagggattgtgaaaaagataaatttgatgattaaagaggacgcaaagtttggcgagtctttactctatatagagatagggtctaagcattcacatgcacttatgaaccgtccaacatcaacgttaataacgtgtgattcgtatcaaagtttacatatatttggcaaactttaatttattatcttgaaaactatatgtttcatttttgccgttttgagtaaagaatcgtacacccatcaattttcagatatatatgagccaatccataattaatctgattgattagagagaacgttataaacatctttaagatcaacagtatattattggttgaccaaaaaaaaattattttgatggtgaaagtcacataaatcaagtataagttcttgtcaaatttaaagtaatctctacgaataataatattggatacatgaatcataatttgtgatggtataatatatggtacctttcccgtgcaaaagaaattgagtcattgaagtgttaagcaatagtttgaagtttttatattgaatattacaaagtcaaaagcccttaattacatcatacacatcaagtcatgaaatacatataatatcacacatcaacttgatcattcataaagtcttacgttccatcttctctacaggacaagagtctcccaagatatatatacccactaatacccaaatccatagacacaatctccctctatatatccatttctccaaacgaaaacaaaaaaaacattaagccaagaaccgcatatacgaaccaagaacacatcatcgttagttctaattatgaagaaggatacatgcaaggaaggatcatcaatctcgagaaactcatcggtgggatactatgatgaacggatgccagagggtgttccgttcgagtgggagatgcagccagggactcccattaatactcaaccacgggaggttgttcctccattaagtcctcctccagctatgctcagcctcggcctccccaagccatccatctccatcgaagagccaaagaactttgtgtttccaacgaagctgaagctgcggaattggaaacatcttcattgcaagagatatttttctagattgactaacaaaatggttttgtcttcaatttgtttgtaccctgataaacgctacatgtggaaaaaatgaatcaaacgtatggaaatgggccggggtcgggcaagattttttttataataataacaattttttaaaaaagttgaggacttataggcctattgacaaagattttctagtaaaattttctatcataggttttaccatctaaacagctagcgtttgcttttatgttgttctaaatctgttaacagtgtttttaaaaagtaaaaaaaaaatagtttatcagttaaacaaagtgaaccaatttcaagttagctgcgaatactacttagtagtactacgattattgttaatatcagaaataattgtttatcaaataaagaatgaaagttgttaaaatctctgatcgtgtattttttgtcaacgaaatgttcgtattaactgaaacagaaatgtcaagttatacgtcgtcttcattaactctgtctctgaccaatatgtgtcgaaataatcatgttctgatttgtttgtcagaaaatcagcggatcggaacctctgtccgggggagaggctgcttggtttatttgatacttttatcatttccttaatcatacccccttcattttctgaaactattttcttacatttcttttgtttcataattgactgcaactctccaagtattagtatcaaatgtaaactttcataaaattaattttattaatcgctccagtacacaaaaacctacttttaacgtgaaacaaacatcttacttagttaccactacaatcatctaactaaccctatttactagtatttgtttttgttttattctacaagattttgaaagtttctagacatgaccaaaccggattctaacaaaaccgactaaactaaactcttaactcttaagtgaactaaaccgactaaactaaagtcttggaccattcccctaagtgcaacacaaatcggccacgatctaagcgaacgatgagatattaaatgacgaaaagatggacctaacgaccaacgcctcctccgaatcaatagttaatgcttacccaactcttttccttattttaccatctctctctgtttgcattgtttatatataatatgatcggagccaaaaggtagagaactatcacttcggctaattgtgatgaagagtgttttaaatcattagtttttgaggttttcagattcgtttcatacattgaactcactggttctttgtcaaaagaaactatcataaaaaagattcagaaatagcgtttccttcaacagcttctcaaatggtaagtggattattctctatcaaacttgtaattacaaaaaaaaacttttaacaacgtttaataactttcaaaaacttcacaaattaatgttttaattttttaaaaaacttctcaaatgtaagggtgaggcatagatagtttatacttgtaatcataatttagtttttaacaattctaagttctaactgttagagattgtacactctaattctgatttatcgtaattttgataaatcctgaattctaactgtaaaaccctaatatagcggattttagacgtgagaaatggtgattataaattgagttaggtttcaacaagaaattagatgcttagttttgacttatatattcaattatttttgttgtgtataggcagaagaagaa

SEQ ID NO: 3161 - DNA, 3000 bp, Unknown; identical to SEQ ID NO: 3152
  misc_feature (1)..( 3000): cDNA_ID_1841306_gDNA_ID_1620628_Annot_ID_47193 3000 nt of promoter + ATG

SEQ ID NO: 3162 - DNA, 3000 bp, Unknown; identical to SEQ ID NO: 3151
  misc_feature (1)..( 3000): cDNA_ID_1819630_gDNA_ID_1620628_Annot_ID_47194 3000 nt of promoter + ATG

SEQ ID NO: 3163 - DNA, 3000 bp, Unknown; identical to SEQ ID NO: 3150
  misc_feature (1)..( 3000): cDNA_ID_1819626_gDNA_ID_1620628_Annot_ID_47195 3000 nt of promoter + ATG

SEQ ID NO: 3164 - DNA, 3000 bp, Unknown
  misc_feature (1)..( 3000): cDNA_ID_1819623_gDNA_ID_1620628_Annot_ID_47197 3000 nt of promoter + ATG
gtgagaccttatggaccaaacctgatacattttctgcttgaactgattagattggatattaactgtaatccacctttaacagatgatgatgaaggaccagtatggaaactatgtggtgcagaagatattcgagacatgtacggctgatcagcgtttaacattgttcagccgagtgagaatgcatgcatctgcattgaagaaatacacatatgggaaacatattgttagtcgtttggaacagccctctattgaaggtatgaaattccccaatgtaagtcaagttcaaaagtgaggtgaataatcacaatctttaggaacaaaagggctttgctgttataccatataagctgaaacagggcgaagtacacaatcaaatatattttctatgctaaaaaatggtcggtgaatcgctcaagaatgacatgtcacatgtgcatatagaaatgtgtggtagcacaagactgaatagaataagatgggattggtagcacaagactgaatagaataagatgaggattggtatatggatcaggaagagttacacattgtgtttgttgtttctgcagaaaaccaagaattgaggagatgagtggctcttctgatttcaagacagtgggctgactcagattcactcaatacaattcgctttttcatgaaagctggatattcattgggaaggtcttagatgattgtgaaggacatcgatattgttgtttacttggaattttatcatagccgttgtgatgattgtgtggcatgttctgtaaatattcataactgtatcagtagtttacttcagatctgtaactggtttgtggaatttcacatggtattcgaaactttctagatactagagaatattattattgaagccaaacattacatgctaatcctgaaatagcctcctcttcctcaaatttcatgagctacagattcttatcacatttcaacactgttttgagactttctttcattcatctgacatgaggagccaaagtataggatcgaaagagaaacttgtcattactcacgaaatataattgaaagcagtgtagcatatcacacttgacaatggaagaaacaccccacacaaaaatggaaagctcaaaccaacacctccaaaatactatttcaatcttaaccaaagagatcgaatccgaagtctccttcttcctcttctgattcttctttcttcttctcatcttccttaggggcagctgcagcttcacccgcaccacctccacttgaggcagctcctccagcagagaatcctccaccaccaccaccaccaacaattacctacgccacaagaaattgattccaattgataaaaattacaatgcaaaacaggaattatacacaaatattgatttgtactagtttccggagccatgtaaactaaagtcacctactaaaacagagaaggcaaccaaaaacaaattgagtgatttagctattacaaagctgtaacctttaggtatcattgttaacctataaaacaagctacattgacgcaaaatcacatttgatgcaatgataagagaactatagtgagccatgacacttgtatcactgatcaacgaccataattactgtgaatgaatcattcatctgaaaatgcaagctctgattctcacacagtattgccaatttcaaagatgcacgatctcaaactgtaagcttgttcgagcaagagagacttatacctggaatacggcggaggtaggggagacaagagaaaacgaagactgaacgccaccggaggaatcagcggagagagatacctgaacgagcttacgctggagctcgtaggtagaagaagctgaagattcaagttctccttcgtgttgcttcgcgctccacgcgccgcctccattcttgcatacgaatgtgaatactcccatcttcttcaatgtctgctaaaatcgatggcgatagtgagagatttctggaaaaagtgacgatcgagagtggttttgtttttatatacgatgatgaacgaaagctcaaaaagaagttaagaaccctagttttttggaggtctctgagtaaaagactgttttacccatagtggacttataggtcttaaatgggccacttttgagagtaatgaatatatataggcctagagtgaatagcaacaacccaccaaggttctttcacttctttgaaaaaccaaaaaagcaaagatcaacaaaatttatcagattctacgagagtcatttcctaacacatgagatgatgagattattagagtatcacaactctcaactatgtttttccataaactatgcatcgcaccattcaccacatgatattgtaactcttaagtctaagccatgaaatcaacattgaagtaaaagaactcacatagtaaattggttttctattggtttatattttaacaaaattatactgtactcatgtcatctttatgtcaccaaatcacaaactaattttctacttttaaaacaaaacatctaccaattccaccacatatcctaaaaactgactcaaatctctcaaaatctaaaatttcctaaattccacaaaatcatccataatctttaatcctccttagttatgatatcaaaaaaccattttattttaagtatctaatttccttgccataaattttattctctagtttagctaaacttaattggaagtaaagtttattgttgctgatatataataaaatattttcatgtttaaaaatctaaatatagttgaatggactctttaacaagaaagtaaatattggcgtctataaggtcaagagatgtggcgtaatgactacttttgagcaaatcagtggacaaattaagactttccaatctttcattggtcaagtctaaatataaatgattggatttctaagtttcatttcctgtttttaggctcactcgtggactttttttaatttctttcctttgccatatttataaaataaaagagagagaaagaattttcaataattttcaacaagcaaagttcatg

SEQ ID NO: 3165 - DNA, 3000 bp, Unknown
  misc_feature (1)..( 3000): cDNA_ID_1819727_gDNA_ID_1620629_Annot_ID_47200 3000 nt of promoter + ATG
tctccaaaatgactacgttgtgaattgtgtgagcacgagttctccaacgacaccgttttcaacaagtaattgtaggttttctcacactagagtttatttacgtctaatcatcaatatatcactgagagtgaaatcggaatcacaaaaatggcgtcgacgaagccattgattgtcgcagcgaagacgctccgaaaccggatccacttccgatctggatccacatctactggtccaagccggtgggcgacaccgggtcacgaagaacgacccaaaggatatttcatgaaccggactccgccgcctccaggacagtcgcgcaagtgggaagattgggagcttccatgttacatcacaagcttcctcacgattgtaatcctcggagtgggtctcaatgccaaacctgatctttcaatcgagacctgggctcaccagaaagctcttgagcgcctcgagatggagaagcttgcatctgccggagattcatctggttaatcccaaaacttgggagatatgattcaatggttgatctggtatgtatgtgttttgtttgtttttccggggatttgaggagattttcccatttatgatgatgatcacgaatactagtgacctagggtttcgttttgttcctcctctcctcttcgttagtgtcgataaatatgttcatgaaataagcgatctttaactcttgacgatggttttatgtaactcaccttaatttttgatcatgtttcaaagctctcttgcctccaatcctttgcttataacttctcatatttggttacttttttaatattcttggagaaagtgatgaaaagtttattgcttttgctgacattgtatgattcatttgcttagaggggtctggtttgtttctgttcgttatcttatgactctgtgtggtacagtcccaacttcacattagtaatagtcagaagttataagtatagttctggttgggaaaagtttctctcttttgttttctagatataaaaatgtcgagacggttcattaccatagcttaagattctaggttctagcactatatacagtcatggagttaggtaatgaacactagattcctgtttgttttgtttccaaacatattggggggatagaatgattgcttgagtgtgcttcccagtttataaccattatgttagtggctgcgtgtgccgaattgcaagccactgtactaataccaagtgaaagaacatgagagtgtttgatatcggttttcggggaggaggttttgatgaagtacttggatatgtcgagggagagggaggtgcaaacataattacactcaagtaggtagatgaagttttagagtaacagtatacttcatgtcgctgcaggttctgatgaatagatttaggaataggtactgtcactttgaagattattacttgtctgatattttcattagccttcattgttgccttgtgaatcttctaggtaaccctaggttctgtgttggatccctaaatcttttcatctcattttggttgtttggattcttactctgtttcaatatctcccaagagtatgattctaaaatccttttcttcttttatacattgggatgtccaaaccgaacaaacaacgaaaaacgattgtagaaccggaaaatctaaaccgaaaccgagatttgatatccataccacacttgcatgatttgaccaaattggctcaactgaaaaagtgagtctcggtttacttgaatgtttgttggctgtttttgaatagtgaacggtaaaactggcgggtgtacttattgcttgctgccacctgcattgatatttcttaaatcgtatgcatctacatactacaggttccaaaatcacattaagtgcttcttgtcgtttcatattatatgtttataagatatcaaactagcaaaacttttgctttgattattttctagctgtatcttataataaagtttaatattatctcttgtgatctaccatccttagcttggccacacactctctgttcccttgtccacaatcgtaaactcaataatttcattttaaataaacgacaacagcttgttcacatataaaataacaaccatctcaaaataaaatcaagagttctgcttctctatccagttttattactaatttactactgcacaacatcatatatagccattgcaaaaaaatgttgcttctgcctttcacattttgttgtgtagaagcaagatcatagttactgtttagtgtttacaagtggggaaggcaaataagatctgaaggactaaagtgaaagtgacaatacggtcatcattactctgacctaaagtaaacgagtacaatgtgactggcgactcccggtaaacacttgaaccaccgacaaaaacttcccggtttatatgtaacggcatcattcacaacgaccgatcttcacggtccgtaccgtacacgatccatgtctgtagaaggagaaataaagtactagctttttacggttttcagaataaagaaaaaactcatttgctgaacaaaaaacggatttcttggtgatcccaaagtggaagaaagctctgtttcttcatccagattctcagtcactcgtaaattttcatttttttttttccttttttaatatctttcctctatttttcaaatatagaagatcaaaaatcattcttgtgaatgcactaatatctaatagcaactttgggaaattgtgagaatcttactgattgcttatgtggggacttgccgtttttagtattaaaaatgtaaatcattttttttccttttcatgtagattgaaacgaaccataacaagtgtcaataatgttgtcgttttccttatttcatatcctaatttgccttggatttcaggaatatacgcaactgagtttttgtcattttcttctgtttcagactattgatcacagctgttctttttttcaggcttttcttgaaagttgttaagtaactgttgctttggctgcaatggaggaaaactgaaaagagtttgatg

SEQ ID NO: 3166 - DNA, 1804 bp, Unknown
  misc_feature (1)..( 1804): cDNA_ID_2164645_gDNA_ID_1620629_Annot_ID_162627 3000 nt of promoter + ATG
ttctttggatgtgatatcagaagtaatccttatgtcaaaagattcatttccttctcatataccctggtatgcaatcatttatgtttttcgtcccaattttctatttctagcttttctgtatcttctttatttgcattctcatcccctcagaagtcagaatcattttctgctcttatttcaggaaagagattgcggactgcttgttaaagtgccttgatgacgaggaaacatgtatctgtaaacaaacttcagagttgctgaagtcaatcggttggtcttcttttagcctttatccgctattcatttggaagcttttgtttgtggccattattaatttctggtattggcagtcttatgtctcttatgacctctaaatatggcctttcttcatttgataagatgaattttgctgataataatcagtgttttgttaaaaggaggatttctgttaattattcattattcagatgagaaaaacttataaagatccaatttatggggtccaaaacttgttattccatattgcaatggcagttatagttcatattggataacatttattttctgctttcctatataatgaagccaatcaactgaatgatttttgttatcgttttttcttccagagccatcatttgtgctaccgaatttagtaaacctcatttatgcacccaatggaaaagtacaatcatcagctacagaaaccttgcttggggtcctgaaacaccataaggaggattttgatgttatatgtatgttgctgaccagtcttaggtatcgtgctctgtctctttttctcctttccccattgtatacatagttgtttgtttattcccatttaccctaagtgagatgtgagaatacactggattcttaggtcaagtttgtaaaagtaaacttacgaatgctcatacgtgaaaatattgacctgactacctggtttggtttttaattttggttttgcattgtatcaagctaatattgaaaaaggctttctgcttttgatctccacttttctcttgtagtaatatccaagctttggatactgcagaaagtaatggacattccactgaaggtatttggcttcttatttcattaccataggctacatgcgatacagaatctgtgttaaaatttgtcttatatatgtacaatccgaacgtattatataaaattattacaacacttcaaatttaagctggataagaaataaaattactggaatgtgaaacttaaacgatgtgaaatatgaactagtctggctgaattacatagcggacactatcaagttattcttggtcaaggcatgctcatcatcttcttgtactgttacaggtttaacttttgacagtgatcgagtgctaaagctgatcccagagtgggctagaagtgtaagtacaagaatacgtcatgcttgctttgctatctttgaaatcaatccatttttgtttctaaagtgcatgtataggcaccatttacgaactgttggtgcactactgaatagaaaatggtaactgaactattaactctgaaccttcaacacaaactttttcaggcattggttgtcccttttttcccttccagtactatttccttttatctaattgttttcttgtgtatgtgctgggaaactcttcgcatgggaatgaccaaagtgaccaaagcttgtgccagctataattaggcaattagaatatatttctgcctgttgactgaaatcaaattcttacaggtacaaaactggaactcactgatcggacctttgcttgacaagatgttcttggagccatccaatgccatcatg

SEQ ID NO: 3167 - DNA, 3000 bp, Unknown
  misc_feature (1)..( 3000): cDNA_ID_2164629_gDNA_ID_1620629_Annot_ID_162617 3000 nt of promoter + ATG
ccttttggctaagatcaagtgtagtatctgttcttatcagtttaatatctgatatgtgggccatcggctcacacgatattaactctatcttttaagggagaaagcccgctatgatagcttgctatctgggcttccacgagtcgcccatgcgttgcactactgcacgggcctggctcaacccgccaaactagaagtgaaacttttaaaattttagtcacttttgatgtttagtttttaaaatgatgtaggattctttatcattcaaagtccaaaacatccaaaatatacgacaagtaaaaatctgtgaagtaaatatatgaacttttgcttgtctctggcaaaaatctgaatggtaatgtttcagactgaagccaaaatggcattggcattgtctctgcgtcatgtgtgtctcatctgcgatctacagtttgatggataatttgcagaattctcaatcagcatgatgctatgtttatgaatcatgtaagcagaaacgactcctgtttacgttatatcaatgtttccatgggttttgttagttaaagattgccgctggaagcgtgtgcgtatactatcactgagaagaaagatgaagacaagccaaagatgatcgtagtagcttaaggaactcaagtggattcagacatcactttagagatcgaaatagggtttgagaattggaaaacagtgtgaaaataagctaaagcagttgcaatctcctcagttatattcattgcaacgttcgatgagatcttctaacagcatctcccccctctagctcttgatatcttattcctcaactaatcgagaaacacttaactttgaaaaataaaatgacaaaacttgaagacctcacacactctcagttgatcaaaacgaagaacactagctaagatataaagtcaagctgtcgttgttgaatatcccacaaagtcgtccttccaagaaaaagctcacaacaagacttgcggactaatttcatagttctttctacatcacctgaaaactagttaggaagctaaggctttctctgttttttttttgtttgtcattgttccactggttctttgctacaatttaggagactagaacaaaactaaattttttgtttggttatacaatgcaaaaaaatatctgcaaaataagtgatttagtctctaaccgagaaaaaagtaattaaaaacagagcaattactaactataatttctggtgtcattttgagactatagttaaaacttacaagcaatgttttacataaatcatttttaaaattataagtaaaaatgttggcgcctcagtatttcaggttcgattcccattgttctttttcaaattggataatttagtccacattgacaaaaagaaagaaaaatcataatatgtttaaggatgcgtcaagtgtatgcatatatattgttgtaaaaagaaaaaaggtgtatgcatacgtttctaacatattttgtctggcagtcaactatttgttatgaatatgtacaatcacatagaaatgatagcatgtggctatgttacgtgaattaaggcaaatgatcttacgtagggaaaattgtaactaaaaactcaacaacccttatttgttttttttgttatcttttccactttgctgcaaaatttattggagaatctgaataaagcggtgagcatagtacagctgaaaataactagatgatgaacttgttctttagtttgttttgattcttcattatatttaaagaaaatttggttagatagatcaaccacttcaacaatacttttgtaacttcaaatatttaataacaaaaaaattaaaaaatgtttgaactttactgaaatgaaatttcgatattagaatactaaagaatcaaacgtgcacttaaatatcatttagtttatatttatacaaaccatgaaagactctcatactttacaccgcacataaacaatcagaaccataccaaaccatgtgaatagaatcacaaagacgtcatgctttaatttacaagcaaaaaaacaaaaggcatcggctagagaatagcaaaaagaggaagaattgaacggaaaaattgaaaacatatggaacaaagtggagcacttaaacatccacggtaatattagtatattagtcaccttcagactagggccagacatgaacaaaggattcgatgttagtgacaagtagcatatcagactaataaggatatatattaagcggtatgggtaacacattaatcctttctccaattacattctctttaaggttctaagatccgccactaggccattttattggtaaaagtaaaaccattttggtggtcgtctatgagtgttaagaattatgtaacaatttttttggattcacctgaaataaatctgttgatttgaaatatttggacgttacatttccatatataagcttaccatacaaacattataattaattggaaagtccagctagcactttttaccacatgcaaagggaattaatcctaacttaaaaaattaggagtaatcacatcttggtagtgtataccgatcaatttccgacagacgttttttttttccttgcccattgattgcatagttcaaaacttcaaagttggccaatccaaccaagtcgaagagataggagatgttttgaagtatgaaaacaaatagaggggctaaaatcaaaataacaagaaaaaacgcttctgccgtgttcgaatgtgtcctcgtgatcatctccgtatataatcaatcaatcaataaaaatccagagttacaaacactcttctcaaaattttcccattaaatcgcaaagttaattttgcgattttttttctctttttttctggttgggttatttattttccccttttaaaaaacttctgcaacttgtcttgaaatctggggtaaaatatttcttcattggtttctggaaatctcggggaacgatttgttgggttttcttctttgtactctctcctcacattagcttttgttggtgggattttttgaggatg

SEQ ID NO: 3168 - DNA, 3000 bp, Unknown
  misc_feature (1)..( 3000): cDNA_ID_3070801_gDNA_ID_1620629_Annot_ID_162612 3000 nt of promoter + ATG
attttaaacctcattaagggtgttcatgataattaagctttcatataatatacaatgataatagagaattgatatctagtaaaacgaagatcaaatgatactagattagcaccatttcttgtgacatggggtttgtatccagtatattatcccaaatcttatttacagatgaattttaagtaaatcaaaatttatatatgcatggtttaatctcaatgtcactttttcttttggtttttatactaatctcagtgacacttattttgaatagaatttttttttcatatgttgcatctatacacatgcacacatacccatacatatctgtgtgtgaagcactgaagctagagcgtgagaccatcacagaacggaggggcagatgataccaggagaaagaaatagaaacagaaaaggtggaagaaaatcaaatatgattttattggtgctttttcatattagagaaaaatatttatttatatgattggacatggcatcgacttttgtctttccaattactttgaggagagattctattttgaggttaacataactccaaagaaatacccacactcttttcccccatttcccaattttacccatgcaacctttcttacattagttaccactaaaatcgtatgtatacatccatatattcatggttttgacagtataaaaaatctcatcaattgagacctaacaaatctatttcactttaatgtttagatgctttgattggaagatcacaatcaatttcatcaagtggtttgttggtcaactaactagttatgataattttagtatcttacttccatttacaatattgacaacaacaacaaaatggaccacataacataagtaaattgtcagtgaaggtattttcattcaggtactcttttcttttatgaacagtggactttgataagagcagctctgttatcctctctcacttaatttttttgtttttgtttttcctcttttttcttgtcttttattttcaaccctctctttttgtctgcaacaatgtgctttaagtgaaatgtgtctttatctcctttcccatacctcctttgttttcttttttattcaattacttttcagaaaaccaaccaaaattaaaagatgaatttattactgttcttttaaaaaagaagagctacttgatcatatttctttttgtaagggtattcggttaattttctaatttttttttgtcgtttttaataaggactattttagataaaaaccaaaaactaccatatctgcgtgttatattaggtaaatgattttttgtttttgttttggaatacctgtttttttcgtttttttaaaagttatgattctatgtatttgaaaacaaaatgataatactcaattaattatagtattaagggacatgtaaacaaacatacgactggctacatttgtttatatctttcggtaaatcgtatgattggatacttcaaaaactattttgtataatataatcctccttatattagtataaaaagatattttactataatcaagtgggtttgcaatctaatagtgttcgttctatcaactgaactcaataccatataaaaaatatcacagataaagaaattactttcaaccgatcgatgcacttctcacaaggttagctataatgaaaatttccgtattttactaactataagcaattgtatatctctagactctagatatgtgcatgtggtttgacgaatattactagtacttttatattggtaataatgaaaccattaattaagaatttagtctcggaactcataacaaagggtacgttcacgttgggactaatgtgaaagacaaaatacgagagggatgggtttatgaattatgaggaaccccatacttacaaaaatttccttccaaaggagaagcaatcaatttggagatgaagtgtatgtccatcttctaaacattccatctctaaagtcaaaaccctaaatttcagttccaaaatcgataagttatttttcccgatgcatgcacatgcaacactgtaattaatttcattcacgtgtcaaggtggactggatggtgatcatctatgtctatgccaaaaacaagttattaattgtgtattaccttttatagaaagttttcttgagcacacgataacgctaaaacttgaagttgcaataattgtttacgagatattgtcaaaatattcgttgttacaaatttttgattcatgtggattctgaattcataatttcatatttactgatatagagctttgaaaacattctgaggaaattgtaattttattattcaaagcaacatttgaaatatcatctagctaacaacagtgataatttcattcataagtttagttaatcttctaaaaactattttgttctttcaaaacaaaccaaacaacataacagttcgtcatgtccccttgtgcaaaattgagttcccataaaaatctcagtatacatcataaaactaaaagtgtgatccgaaagttccagtctaaggcccaaattgatggtaaattgggccttataattctatttgtacaagtaaataatccagcccatattcagataaaacagattttgactcttaccttcatgagagctgacattacttcttttgatatcgatgccttagtcaggctaactatatgcgatgcgtcaaacataaaatgaaattcatcctaccgagagaatctcgcataaagcaatgggagtcatggctcggattatgatcggtccatcctcagacactgacgttaacgtcagtcacaagtcacaacacgtgtaagatattccagttcttagtttagtttagagatacgcaacagcaaaatctctaagccacaaagattcaagtaggcccacttacagaatcttccataatttgagtttaaatgtcgtaaactttttaaccacgtcattagattagcgatgataaaaggaaattcagattttttcactcaattcactgattgattcatactgattgcaaatg

SEQ ID NO: 3169 - DNA, 3000 bp, Unknown
  misc_feature (1)..( 3000): cDNA_ID_3070805_gDNA_ID_1620629_Annot_ID_162609 3000 nt of promoter + ATG
tagaccaaaaaaaaggagaagttgttgacttttgaagtgacctcgttgacttgatttgttcttgcgtctccgactctctttctttcttgtgtccctttcttcacaactcacaagacaatattcttttctgagtttagagatgttgcgtctgttcagaaagaagaagaagcagaagaaagaagaggagatcaatctccagaagaatgggagcttactgttggaagaactcattgcaacttcaggaggtatatacaatcccatccgtacgttttcttccgaccaaatcctacaagctacaaatcactttgactggaactacgtaatctctgaagacagattcgtgtggtacaaaggcatgattgaaaacagacccgtactgatcaagaaattccaagactgttctgttttcgacgctgacaacttttaccgtgacattgctgtttcatctttgatgagtagccataagaatgttctcaagctcttggggtgttgtctagagtttcctcgtccggttctcgtgtgtgaatatccagaacatggagctctaaactgtataagatgtggaaaagaaggcgtccggtcattcccttggaatgtaaggttgagaatcgccaaggagattgcagatgctgtagcgtatcttcatactgaattccccaggactataatccatagggatttaaagcttgcaaatattttccttgacgagaattggtccgctaagctctcttctttcagcctcagtatagtgcttccagagggtgaaactggcgtaaatgacatggtttgcaggacatcaagctatatcgagcctgattactttaatacaggtttggtcaccgagaatgtcgacatctatagtcttgggatcatcatgctaattattttgacaggaaagtctgaatacaattcagaagtcgctgtttatcttcctgtattgcctgtctatgttgggaagtttctggagcgaggtttgttgactgaactcatagacccgtcgatattggacagcacgagtgatgacattcccaagcattcaagactgcaaatggaagcgttcattgagcttgcttttagatgtgtaagattcagaccaggagagaacgtgcctcgcatgatagacgttgcaaaagagcttaagaagatagagaaacatatatgaccatgcaaccttttctaatgcgacttgaaacaggtctatctattatacaggcttagtagtgaaaattgcaatcactgtatcttgtttttgatcgagcttttattaaatatgttgtatgtaagaatctgagtttccttgctacacaatgcaagaattgtttacttagatttatatagtccaagcaactgatacctcttcttttgggcaccaaagatgctcctatcttcagtcatgttcttgtgatgcctactccgcgaagatatctcaatatccaaaaagttccttgcggatctctagctagaatttttcaatgatgcttcaatctgcttgagttctttagctacttggatcatctttggtctgtcttcatctctctccttacagcatctcaaagccagcaccacacatgcttccacttgcaacctttgaccacttgtgatatctttcatcaacctcggatctatcacttcatcaagcttcccattctcacataactctctcactaagctaagaataccttggagatctccatcagaaatagtcatgatagccggtttaccagtaataataaccagcaaacagattccaaagctgtagacatctgtatattcagtcacaaaacacgtcttatgatataatggatcgatgtacccaaatgttcctagaacccattcagcttctattctcgattttccctcaggtagagatattgagaaggataaatcagacaactttgcggtccaattcttgtccaagaaaacatgcatcggtttaacatctctatgtatgatgatcttagggaatgccgtgtgaagataagtcaccgcattagcaatctctttcccaatcttcaaccgtacactccacggcaataaagattcttcaccattaactataacacctcctcgctgattcatagctccatgttctgcaaattcaaacacaagaaccggaaaaggaaactcgagacaacatcctaaaagttgaagaaagttactgtgattactcatccgagcagacaagacaatgtcgttgtaaacctctttaactctatgtcgttttcctgtaatctcatcctctgagaatctcttgatcatgtaagatctatcttcaatttcacctctataccatttatagtatacatcttgcgagacaaaacagctagaatcgaaattgttggtggctttcaatatctgctcaggagaaaaactgcgaataggaatggatttaccgttacaatcagctacaagttctcttaagaagatgcttccgttatccaagaaccacctcttcgccttgtccttttccttccttgtcccagatccagatttcagatactgcttcttcattagttcctttaccaaagtatcaaccttttgttggcgagatgaataaagaggacacctttcttacctaaaagcttctgaagtgtcaaaagccatttcttttctgatcccaaacgactctcggttgaaaacggtgtgtcataagaaaggaagaagcaataaaaagtcttgggtcaagtttctgggcctatagaaaaataaagcccaactaaaagctcataaggtgggaaaacaatataagcccatccaaaagataataaggtgggaacacaaaataagcctaaccaaaaagttttctacgacaggctgatggataacagtttgtatgggatgtgaggagtccctatcaaaacacgtcaatggttggaatttgtttccaaatttcaaatcgggaagagtagtaactcaacatcttgtatgcattcagatattaagtctttcttgttcaaagaggaaaactgaaacaacagtatttgtttgatgaaatcgatg

SEQ ID NO: 3170 - DNA, 3000 bp, Unknown; identical to SEQ ID NO: 3165
  misc_feature (1)..( 3000): cDNA_ID_1819727_gDNA_ID_1620629_Annot_ID_162601 3000 nt of promoter + ATG

SEQ ID NO: 3171 - DNA, 1757 bp, Unknown
  misc_feature (1)..( 1757): cDNA_ID_2991013_gDNA_ID_1620629_Annot_ID_162599 3000 nt of promoter + ATG
gaattctttttccataagtgtgttcgttgagcttgaagattagtctataaatgacgagaatgaccttaggaagtgtgctagctgtaatatgccattaaggttttgggtttaggggacagattttggtggaaagatcaagatcaaagtgtgttttggggtccatcttttgatgataagtgggaaaaaagttgcaatctttctatggaaggtgaggaaggggtagtatcgtctctaacaagttcggtatctatcaaggaaaaatagaaaatgactcttagaaggacgattaaagcaaatgatcctttacaaaaattgatatgctttgagtcccacatacctaattagttggaaacatgatgtgacactcccccagacagctaattaatcatccctgatgttagaagttagcagcaattattggtgtgatagagatgatgatatggaacatcagtgtttgtttaaaatttggattctataggtgagctgtgaggacttgattgattgttcctttagcccccctagggtatactgattacttgtgattgtagtagataccatttattataatagctttagattagcacgtcattctcttgctgcttttttcactgtgtattttggaatcttggtattttctcgttgaaatattggatcatcttaacaatagttagctgtctagaaagaatttttggtatgtgaaagcagatctacctaatatgaatccgagcttatcagaaagtctttgacctgcagattcaaggtaccgcgctggtgctggatgaaatcattaaccatgtccagtcattacaacgtcaagtggaggtgagactttccgtggtccaatttttgttctttatacctatattttacaatagccctgggcacaataaaagggtcaactcaaaacaatttgaaaatgaatagaattatgtgccgcaatctcatgaaactgtgacttgtgtttccacagatgctatcaatgagacttgctgcggtaaaccccagaatcgacttcaatctcgacaccatattggcttcagaagtaagtatcaaaatctcaaacaataatttggtcattctgattagtcttctctaggaaaaatttaaccatttcatgtgtttctcatttaagttaaccatacctctttgagtagcttctagtttctatcacaaaaggagaaacttttggggtatttattgatacaaacattaatttagaccattttagtgtaaggcataggaagatcacaacgtctactctcatgaaggaaactcagggaaaaataaatacacaacacacacacacacccaatgcaaataacagtagtgggtcaaaactcggaccacctttgttctgtaaaacctttctgtgtcttctgtgacttatgtcggatgtgttacttgatgaaccttttaaaaaaaaagttaattcatccctcaataatttctgtgggtctcttccaaaatcttgttatttcaaagtgacctatctaatttcatgatcacctgtggattctcatcaaaagttttggaccaaactaaataaatgctccctctctctttcttcttacagcttgtaccaccattaaatagccagggaccctctcatcaaaccttgttcttttaggataataataacacagcaacaacagttgacttctttgactagatcaagatctctatgaatgatccctttgctgatatcttttccggttttggctctgtgtttttttctttgacagaacggttctttaatg

SEQ ID NO: 3172 - DNA, 3000 bp, Unknown; identical to SEQ ID NO: 3168
  misc_feature (1)..( 3000): cDNA_ID_1819695_gDNA_ID_1620629_Annot_ID_47210 3000 nt of promoter + ATG

SEQ ID NO: 3173 - DNA, 3000 bp, Unknown
  misc_feature (1)..( 3000): cDNA_ID_1819687_gDNA_ID_1620629_Annot_ID_47212 3000 nt of promoter + ATG
agcatgtatacttgcaatgggaccatgtattgcttccaagtatctacttaagaaagattatcttaggtagaaggtgacagtccctagtgatcatctgatgagatatgagagagtatagcatcatcatattttctcttaacacgctccctgttatgctgtttacatcttttaatctattgtttcatattttctttccttgcagcggtcaggttgcctgggaagcgcattagctgtaatgaagaagtcttccaaattccttccagtatgtgaatattttagcttactgctgtgtgcttgctagatttgagagaaaatagtagtaatctttaattctatttctgaatctcttctataagttagaaatttgatacctggctttgcgtttgagaaaaaatcattgttttaggttaatacacttctccgccttttttatctgttacatattcatagtactcataaacagaattttcacacacatacaggtcataggctggtcaatgtggttctcggagtatctctttctggaaagaaattgggccaaggatgaaagcactctaaaggtatgggtttatagtatccttgtgcaactcatttagtttttgctcctgtgtaaaatgcttattagcacgtgcagctacctcgttcatgaggggattagcctaaaaatgcagaatcttcatttccagaccatgagttatgtgtgtttgtctaaatttacagtcaggtcttcagcgcttgagcgacttccctcgacctttctggttagccctttttgtggagggaactcgctttacagaagccaaacttaaagccgcacaagagtatgcagcctcctctgaattgcctatccctcgaaatgtgttgattcctcgcaccaaagtaagttgtaatatttttcttttgttcattcctggggcaacttgatatcttctctgtgtcctttaaaaagcaaaatgattgctatgatgatccaaaatctcaatgcatgggtagcctttatacgtttcattttcatcagatcgacttggtggttgttattgtgatttctgccctaattactagacttgcttgtatttttgtttcagggtttcgtgtcagctgttagtaatatgcgttcatttgtcccagcaatttatgatatgacagtgactattccaaaaacctctccaccacccacgatgctaagactattcaaaggacaaccttcagtggtaagcaagcaaaaatatgaataggtcgtatagcagttgaatcttgcactcttctcacaacaaatttcaaagtatgcactggcttggatcacatcaccatccaatttactgaaacgaacataactctttatatcacctttacttttataatgtgtaagaaaccgtaggactcatcccatcccaagcctttttcttttaaaacctcctgcgccattaacgcaaaccattgctgctggtttcaaggtgcatgttcacatcaagtgtcactcgatgaaagacttacctgaatcagatgacgcaattgcacagtggtgcagagatcagtttgtggctaaggtaaaaattatggatgtactggtatttccacgtttcagttattggcaataatatatttggtcaagatttgatagagaaaagcttggaaaagctttcattttggtattctctcatctcgtctctgtgatacaggatgctctgttagacaaacacatagctgcagacactttccccggtcaacaagaacagaacattggccgtcccataaagtcccttgcggtgagtctataaaattcataacattctcttggttccatctataaactcacaaatctcttgatctttttctcaggtggttctatcatgggcatgcgtactaactcttggagcaataaagttcctacactgggcacaactcttttcttcatggaaaggtatcacgatatcggcgcttggtctaggtatcatcactctctgtatgcagatcctgatacgctcgtctcagtcagagcgttcgaccccagccaaagtcgtcccagccaagccaaaagacaatcaccacccagaatcatcctcccaaacagaaacggagaaggagaagtaaaaactggttctcacagatccaaacatcaaacacaacaagaagaagcgcgtgtcagttttgttataagaaacagaaaaccaaaaaaaaaagacatccaaatgaaaaatcccttaatattatcaactccgttttgttcagctactatattactactactactactacgcagcctatgtctcttagtcgattgatgtatagggtcatgatcaaatcaacgatttaatccctatagtcccttgggattttttttctcaagtgcataggccttgtataactttctatttttagattggaatttgggattgatattagacattttccttttattattaaactgttttgttccttggttctcattgctagtgtagaatttattaggcacaaaacatgttattacaagacgttttagaagaaaaaacagaatttattcatgtacataaattatctgactagactaatcctactgggacttaattgtgattagacaaaaaaaaattcattttgagaagaaaaaacagaaacccgttcatggaattaactgagattagacaaattcaactacagtatgacggtgattacagggagaatatcgtaaaagaacaggttttattttcttccatttttgatagaacacatttttttttttttaatgagtgtataatataataaacacaatttttattttagttttctcaaccctaaaactaaaaccctttcacgccgattcaaaagaaaaaaaaaaccttcacaagtccggttgctcgcgccgcttttctctctgttttcaaactccgattaaagtcccgacttgtatcaattgataaaccctaattgtctccgttcttgctgaaacactaatctcgccgcacagtttacacagcctccagaagcgacaccgacgacgcaatg

SEQ ID NO: 3174 - DNA, 3000 bp, Unknown
  misc_feature (1)..( 3000): cDNA_ID_1819675_gDNA_ID_1620629_Annot_ID_47215 3000 nt of promoter + ATG
acacggtgtgtggtcttcaactcgtcattcaatctttggtcattttatcctcaaaagtaaaagaaacttttttttcgttgttgtttgagatggagtggtggaagaagaagagtttacgagccataattaaaagggagagattggtccgaggacacgagagaggtgggacattgctagaagagatcatcaaatcttgcaatggcaaagcaaatcccatcaaaatattctccgctgatcaaatcctagaagccaccgacactttcagcgaatccaatcgtgtttctgaactattcgatgagattccatacgattggtattattcaggtaaaaacaataaccatcatcatcatcataaactgttactcatcaagaaatggagatatagatttagtgagcataacggaggaaacttttgccgtgacatagccatctcatcgattgttagtggtcataaaaacttcatgcaattggttggatgttgtcttgaatctgaacatccagttttggtttatcgtgcatcaaagaaacctactagtttagatctgaaaatggttgtgtcatggagacaaagattgaaaatagcagaggagattgcaactgctttagcttatcttcacactgcgtttccaagacctttcgtatataggattctgcgtttagaagatatcttattggatgatgaagatggtgttgctaagttgtgtaacttctcctactgtgtctctattccacaaggagaaacatttgtgaagcttggtaatggttgtataggtggagattatgattacatggatgataattatttgattaatggtattgtctcggagaaaactgatgcgtttggatttggtatttttatgcaaaagcttctgatgggagaagagagatttcatgagctttgttatgatcggagtgacttgacaacttttgaaaacagaagaaagtttgcaaaatgcattgatgagattgtcgattcaaacatgttagagaaaataggtgatgttacagaagaagagcgttgtcgaatggaagctttcattgtcctctcggaaagatgcattggtcttagaggggaagttccaaaaatggttgaagttgccaaagaactaaaaagattccttagagattcttcttcttcttgtggtgaaacaagtttatagattacatatcacatacttgttatagattatataaatggtttaaaaacagattttcaaggtttaaaacagattagcaagtccaagtttcatttttattctgtataaatttagaaattttcttttcaagatgttgcatatttttgtaggcttgtagccacgtttcttcttgtttacaaatcgttgacttcactttttaatttgacataaaaaaaaaaaaaaactaaaacactccataaaattaattaaaatcagaacatatggtagcatcgtccagtaacattacagtatcatgctcagagcagtttgtgcatcgccattacattcaaaagtctctcacgttttcaccacatcccttgagctgcctctctcactttttttttttttttcagtggaatctttctgtttcaatttagattccaaatattgacaacgatttgtggtggattgtgacaatttaacagattctaattagttttctaatggctgattgaaatagtggcacaattcgtcaatttcaatactattggggagcgatattaaataaaaattattgtagtacaaaaaataaaagtttgaatattcaaaggaaaatgtagacttttttttttgttggtaggaaggagagaatgtagactttttaattttacggagtcgtcgctgaaatcctaaccaatgataaagcgctacgttcacgtgagtctgattttcaattattaacataaaaaataaaataaagatttctggaaaaagcgaacacattgctatcaaacggggctagattggtaaattacgtaattgtctgttagaggagtgcgtcacccaccacggtctttctcaagacaatgaaacgataactaaaataaaaaggagacacgtacttaccgttttgcccacagccgtcacaaatcagattatttactggatttgaattagagatggtactgatccggttaaactcggtttggtcagagttgaagtcttgacttggttttgtttgaagaaaagtgaaaattgatgagaaaaccaaaagaaaccggttaagaagatcaaaccgggaatgggcggcgaatggtcagaaggttaagaaaggtagttaaaaatgagagaatcgaagcagaggaggaagatgacgcacacgagagagacgaccacttccataatcaatcaacaattgctttccttcccggccagccacagatctccgtggccatctctctctttctaattattacaaagaagcattattattattattttaattatataattattgtataatcaaatctctctctgtaagtaataattatcgtataaatcctccccattgttgagttaattagttcttgtaaacccatgacgttttccgtcaaagctggtgagtttttgtctctctctcagcttccttatgtttgtttgaatacgttctgtctctttctcgtgattcttcttgtaacttgtttaatactagctcaaatgtctgatttgtaatcatgtaaataattcttctaagtttggatcctttaatgtatgaaaacccatgattcaatgttacttactcctcttcattaatgtcttcgcatttcaactttgaaaactccattgtttctcggtcaaagctcactgctttttgtttatttatgtttcaataattgctcaattatggttgttgcccaaccttgtgggtctatctttcctttatttcagctcagtttctttgacgattccgtaaattccattactttgtgtttcgtgagcatgtgggttttatgtaatcaaactgcttcctttttctgattctcaggcggtcaactttgaaaactaacaacttcggatttccatc

SEQ ID NO: 3175 - DNA, 2815 bp, Unknown
  misc_feature (1)..( 2815): cDNA_ID_1819659_gDNA_ID_1620629_Annot_ID_47221 3000 nt of promoter + ATG
ttctttggatgtgatatcagaagtaatccttatgtcaaaagattcatttccttctcatataccctggtatgcaatcatttatgtttttcgtcccaattttctatttctagcttttctgtatcttctttatttgcattctcatcccctcagaagtcagaatcattttctgctcttatttcaggaaagagattgcggactgcttgttaaagtgccttgatgacgaggaaacatgtatctgtaaacaaacttcagagttgctgaagtcaatcggttggtcttcttttagcctttatccgctattcatttggaagcttttgtttgtggccattattaatttctggtattggcagtcttatgtctcttatgacctctaaatatggcctttcttcatttgataagatgaattttgctgataataatcagtgttttgttaaaaggaggatttctgttaattattcattattcagatgagaaaaacttataaagatccaatttatggggtccaaaacttgttattccatattgcaatggcagttatagttcatattggataacatttattttctgctttcctatataatgaagccaatcaactgaatgatttttgttatcgttttttcttccagagccatcatttgtgctaccgaatttagtaaacctcatttatgcacccaatggaaaagtacaatcatcagctacagaaaccttgcttggggtcctgaaacaccataaggaggattttgatgttatatgtatgttgctgaccagtcttaggtatcgtgctctgtctctttttctcctttccccattgtatacatagttgtttgtttattcccatttaccctaagtgagatgtgagaatacactggattcttaggtcaagtttgtaaaagtaaacttacgaatgctcatacgtgaaaatattgacctgactacctggtttggtttttaattttggttttgcattgtatcaagctaatattgaaaaaggctttctgcttttgatctccacttttctcttgtagtaatatccaagctttggatactgcagaaagtaatggacattccactgaaggtatttggcttcttatttcattaccataggctacatgcgatacagaatctgtgttaaaatttgtcttatatatgtacaatccgaacgtattatataaaattattacaacacttcaaatttaagctggataagaaataaaattactggaatgtgaaacttaaacgatgtgaaatatgaactagtctggctgaattacatagcggacactatcaagttattcttggtcaaggcatgctcatcatcttcttgtactgttacaggtttaacttttgacagtgatcgagtgctaaagctgatcccagagtgggctagaagtgtaagtacaagaatacgtcatgcttgctttgctatctttgaaatcaatccatttttgtttctaaagtgcatgtataggcaccatttacgaactgttggtgcactactgaatagaaaatggtaactgaactattaactctgaaccttcaacacaaactttttcaggcattggttgtcccttttttcccttccagtactatttccttttatctaattgttttcttgtgtatgtgctgggaaactcttcgcatgggaatgaccaaagtgaccaaagcttgtgccagctataattaggcaattagaatatatttctgcctgttgactgaaatcaaattcttacaggtacaaaactggaactcactgatcggacctttgcttgacaagatgttcttggagccatccaatgccatcatggttaggtttcttagttgcatcagtgaatctttggcagatacgtcggacttggtccttccgcatgtactttcacatatgaagaagcaaaacaagtaagtacaatacgtaccataattgtgatttctgtggtaagaaaaactttcaacgactcccaaagataaaacaatattgattatctataatgtcaattctaatttagggtggatgcgagcttcatatccagatctgatactaaaagttcagttgacaaaactaaatcggagaaatctctatttgaccacctttgcccactgcttatattaagactgcttccccaaagagtgtttgatgatattgattcttctacaatttatggtaaattcctcagcggggactctgtgaatggtaagtatgcttatgcctttggttttcttttcctgataagagaggattggatatttatcataaggtcgtttgatccttattctcaattagattcaacgctttagctatattttcctaagcggcatgatcaagagtagatactgacaatcttagacttgattcactacatctatttcttgtcatgtgttacttatcagactaccaagacatcaagtttgaggattgtcaatgcattgctactttcattttggaaaggttattttactctcagtgatcatcaaatacaatctaccctaatacttattttatatctagcgaactaactctagtaatacagggcattttctaagtttgaatttgaagaagttcggaaactctctgctgagttatgtggacgtctccatccccaggtgctaattgactaccttccttgctcttgtattgttggtcaatcttgtctaaatgtttatatatgttttaagcctttgtttcaaagtaaattttatataccaagaaacaatggtagattctccttaataagttttctgtcaagttcactgctatcttcatgcgaaagcaaagcacatgcaaaattttctcccgtcataactaggttctgttagtatg

SEQ ID NO: 3176 - DNA, 3000 bp, Unknown
  misc_feature (1)..( 3000): cDNA_ID_1819780_gDNA_ID_1620630_Annot_ID_47222 3000 nt of promoter + ATG
tattttttagttttggtgctaaatatagatatgcctgtcttcctaacaataaactgtcatgctgcaggccgttcctgggtctagtaatgctcgtgcaataccaatggacacaagcaatcatcgaggtcagctcgagttataaattttaattgtgtcactttctgattaattttgtaatagtatatgatgtgttttttgttttctctcgactttcacactggactcaactggcatagagtgtttggctgatttagtttcccgttgcaactgtttatttcaatatcttgatgctaactctccgtttggcaggaggaactaagatttcacatgaagcccaagtctctgaccgtgtcagaccggctaatgccagtggtccaagcccacagattaataccgctgtagggaggagtctgggttttgatcaagtccacaagaatgtacgtgcttattcatttgcctcttccaaataaatgttgtatcctgcaaccctcccccttgtgttagcatctcatgcctgcatctgtgttgcttcagagttctgcatggttctctgcttaaagcttttacctgttttgcatggtcaattgtcatcaacgagctctatattgtgatatgaactacatatagcataaatgattaaaacacgatactgatcatcacgaaatatgctcttgaccattattttactgaaaacccattgcagatgaacatgccatcatccacttcattatctcctgcgggtacctcaaaaagaaatgtcagacccgaaacctcaaattctgggtttgggagcgggaataaaaccggcggttggacttcaccattcatgtcaccggggaaatgatgcaaaaaaagttggagtatatcattcatctgatctgctgagcaagattatgtgtgcctttgggtctaaactgtgatttctgcagtgaaaagctctagactgaggttgaagatctgaatggagtttttccatgaacagcttactgtttgacaaaaggcatgaagattatgtttgctttccttcaagattctcacaaatgactgacttcaacctttgtataaaatcttgcaaccgggcgtgtaatttggttcttgtgattcattctcccaagttttcttctataaaactttgttcgtatttctgtacgtagttccctgtgttggggcataacctgggtttgctgtgtcatcaacattgtttgcagaaaatcaagagcaaagcatgagcagcttcagcagagatgccttcaaaggcttgagtcaagagttgcttgtggcagggacatgtcaccatcaagctaatgtgcagctgacgagaacgtaaaaggataagctatggctagcttctggaatgctccgagaaacacttccccctttttttttctctgaatttcctattcagtttaatggtattctgtgtttgatttttcttactcgattttgtgcattgaaaaaaattatatcaaaaagcttgacttgatccaaacatgcattttcaattgctattattaaaaaaaaaaaacgtataaaattgtagtctcaatattgaaatacaaacacctagaattgatcgatttggtagagaactagttagtggattaaatttgggttggctgattttcgagccataaactatttcgattctcagctttcacacccggacttttgggcctttaaatttccaccatcaactttcatattcccaaaattacatcatctatttttggattcatgcttaaacatacatttccaattgaaccattcatttaaccgggattaaccacaaatccgcgtttactgtaccgcgattgcgattaacccaactaatacccagacccgttaagaaaacgacgtcgttttcatttcgtttaactcatcaaaaagagaaagaaaacgacgtcgttttcattcttcttctttaactctcaaatcgatttagtcgttcttctttaatctcgacactgtgaaattagggttcttgagagagaaagacaaaaggggatttggggttttcttcttcggttcgaatttttgggtctcgatttgggtttcgaatagggagaaatgaagaattggtgggaggaaagattgatttaccaaagcgatccagatgaccccgatttcgaacctccagagagtgacattgaagccgacgatggaagtgatagtggtgatagcggagtcgaggaggacgaagccaccagaatcgagggagaggacgtcgggatagatggagacagagcttctgatggagaggaaaatagagaagacgatggtgacatagcgtctgatggagacgtcaatctagaagacgatggagacagagatgaaagtcaaaagaagaggactaccaaatcgatttgagagttaaagaagaagaatgaaaacgacgtcgttttcttaacgggtctgggtattagtcgggttaatcacaatcgcggtacagtaaacgcggatttgtggttaatcccggttaaatgaatggttcaattgaaaatgtatgtttaatcatgaattcgaaagtagatgatgtaattttgaggaatatgaaaattgatggtggaaatttaagggcccaaaaatccgggagtgaaaactaagaatcgaaatagtttatgactcgaaaatcagccaacccattaaattttcgaaccttcatcattttgcagaccccaaaaacggaaatcatcaaatcatccaccgtgccagcgtgacattacaaaatcacgtaaataccctcgtgtttgtttataaggtaaaaaaagattggcggacccaaaatggtgcagtagttaggtgtacaaatttttttttgaaggatcactactacggctcaaacaagcctgggtccatgtcactaccaccgatgtcagtcaaacaaaaataataatatatgtttttaagttcctctaatttcaatcttctaaacaacaaccctaaatccttatctctatccttgcgcttgatccagattcggttctgattggagctgccatg

SEQ ID NO: 3177 - DNA, 3000 bp, Unknown
  misc_feature (1)..( 3000): cDNA_ID_1819774_gDNA_ID_1620630_Annot_ID_47224 3000 nt of promoter + ATG
aaactttttctcgtacaatgtttgtctatttaccattgatccagatttattgtgaatataatatacaagaatatttcaacacccaccgaaagttattcttgactgatcactggatttccttgcttaaatcattaaataaaaaaaccttaaaacacgttttaatgatgtcttgcacttttagaacgaactttataaactaatctaaatggagaatcgttgtttacaatgtttcaccacttcatgagtgtccaatctctgttatgtgaacgaaaacaaaccaaattaaatataatctatctaaaagtaaaaccaaaatgtatcaaaatttattttttggttaagcatgatttattaaatttttttcatgaaatcctaaaacaatgtaacggattttttttatctaagccctatgcagtatgcaacgagacgaaaatacctgattaaaaatatggaaatcgtaaggaacaatagagtaataaaacagattgatgacaaacgaagttactattggtaaaatttctgatttggaagaggagaagttgacaagttcatcgaccccatttatttgtggagtcttccccacgtatattcctcggcctctaccacaaccgcgtgagccagctaacagtgtccatcttcttatattttagtttttttttttttttctatctaatatttatttatcaaacacatgttggtgattggaaactaagaaacatacatattcatagtacctttccaggatagcattttctttatattaaagaagttagttctttaattgttatgttgtctaattcatgcatacaaagttcattagatgcacgtcaattgtcaaaactctatactttttggactacgtcaaaatttcgatttcttagaagttatatataaagaaagccttactgacaaacaaatggtgatcgaatagagttccaatccaaaacattccaaacacaaatcaaattcgtaagatggcgggtcttcaagcgaagacgttaatgttcgttctggcagctgccttagcgactcttggtcgcacatttgtggaggcagacttcagtaagaattttattgttacatggggtaaagatcacatgttcatgaatggtaccaaccttcgacttgtcctagacaaatctgcaggtatatagtaatcttataacacaataactttaaaatcagtccatttaattttagtctattatttcatgagaaacttgatagataaacatgtataactgtttttatgtttttgtttgtttttgcaggatctgctattaaatcaaaggtggctcatttgtttggaagcgtagaaatgctcatcaaacttgtgccagggaattctgctggaaccgttgcagcctattacgtaaaattttcttttgaactcgatcgatagaattacaaaaaaaataaaaaaaaatagaatcaatacgcaattcttttatatatagaaaaattagattaatgttttcagatttttctttgtagttatcgtctacgggaagtacacacgatgagatagacttcgagttcctaggaaatgcgactggtcagccgtacacgatccacaccaacttatatgctcaagggaaaggaaaccgcgaacaacaattccggccatggttcaacccgaccaatggtttccacaactataccatccattggaacccatccgaagttgtgtaagtaattaacttatggctatggcggtttcttaagtactttataaaaactccaaacaaatgctaagaaatggtactttctatcaatgaaataccacatcaaaaaaacttaagtaagattaaatgttacttagatagtttagtttgttactgtaaaacaacattaaagtacaaacacttcatgatgaatttttcttttagttccttaatgttttcgaaccttcaaaccaaaaaaactttaggaatctcaaacgattatatgtttttatttcctttctataaataaacgtgtcgcacaccatgttgtatatcttatataggtggttcgtcgatggaactccgatcagagtttttagaaactacgaaagtgaaggaatcgcatacccgaacaagcaaggtatgaaagtgtttgcgagtctatggaacgcagaagactgggcaacacaaggaggtcgagtgaagactaactggacgctagcaccatttgtggccgagggtcgtaggtacaaggcaagagcttgtttgtggaagggatcagtcagcatcaagcaatgtgtagatccaactatacggtctaattggtggacatcaccatcatttagtcagctcactgcttcgcagctgacgaagatgcaaaagataagagatggtttcatgatctatgattattgcaaggacactaacagatttaaaggtgttatgcctccggaatgctcgaagaagcaattctaattcaagtttccggccagcgggcggaacgaggagaggctccggcaatcatagcaccgcggtcgaggttaatggggacggactgtaaattcgtttttcattattttttttaataatttatttttctgaattgtttttgtgaggatttttgtgtgtctttgattcattgataactcgaatgagcaatcatgatgaagaagaagaagtttttttttttccattttttctttgttaaaatcctatacaaaaaaaaacaaattcaaaagctaaaaccctagtaaaaagagacaaaatccaatacaaaattatccccaaaattatccatatttagacacattgcgttgactttagaactagtggattagaaactccaccggtcctacgtggcaactaaatttcagtccacgtcaccgacacacaaattttcttagccttactataccatacaatttacgttaatgcccctattgtctcatctattcgcaaatttcaactctcaaattcaacgaagtaaaaaagccctaaattgatatctctatcccttgcgcatgatccagattcggttgtgatcggagctgccatg

SEQ ID NO: 3178 - DNA, 3000 bp, Unknown
  misc_feature (1)..( 3000): cDNA_ID_1819770_gDNA_ID_1620630_Annot_ID_47225 3000 nt of promoter + ATG
gcatgcgtttgtttcttcttgttgatcgaaatgagtaatatgaataagtttcgtgtatgtgaatgttgaataatgtaggaggatgtgaggatccaaggaggatatccatccataccatcgtcatcaccatccttttcatatgcatcatcatcaccaccaccagctccttatggctttcatccgaacatgatggtatgtataaatatgctacattcaaagttgtgtacatacatatgcatgtgtatttttacatatactgtatctagcactatgctttccacaaactagtgatgtatacacatcacatgtttattcttaaatgcacatctttttagatttagaagaaatttaaatcagattcttaacttagctttagaagaaatcatttcggtttgaaatatctcatcttaattattcgcaagatcttcagttatatccgtcttaattatcttgttttctgcaaaagataaaagcattcttaacaaattgtatatcgtttaattactagtttccaatcgttgacgtgaaataataagatccatgtaattcaactcgatcggtggaataatcaagaataatcattttttatcaataattgtttcattgccctttttgtgatctcacagatgaatgcaaataatgatcaatacgagagaacaaccataagatacggagattctcagcctcacagagcaccaaggtcagtccgtacacattgttattgttaaagattatttgaataaacaatatttaacttaaattttatgttgtttatatatatgcacttaaatgtttgtgatatagttaaaaataaagctaataattttcttacaacagttggaacccgagctacggcatcttggagagccagcattttgtggaaccaaacacaaccagacacttcttacatgaggttattactttatatatacataaatatagtatacatacaaataattaatccatgtcttaagagatatagtggttagaatgtactaagatttgacatgataatttgtgttaattctttcaaaatcgtttctttacatgcggatctctctgaatgattttgttttccaatcttataggatcagagaaatatatcgttgggatcgggtattcagaacttcgaaaccagtgaagcaaacgagctagatttggaattgagattgtaactttgacttatgtatgaactcatattattggatataaggccatggagttgtttatacattcaaagcagttaagagaaataatatataggtcatttgatatgatttggggtatcagattttgatatcaagatgtttctatggtcaatagaccagtcataaagtattgtccatgcatgactccatatatagtactaatttggagtacaaagaaatatcattaattagaatctgcatgacgggaacggctaatactagatcgtagtgtggatattcgtataatacaagaataaaaaactatatacgtaaaggtttcgattggtaactcggggttttgggtaatcgcgtctgcttacctcacttttgtaaactttcttattgtccatttcatcgcctcctctattgaatatccttaatagttagttctttaaacttcatgtaacggcaaatacttgtaaatagagctgaccctcttatgtatacattaagaaaaaaactaagacaaaagttactttcggataaataaaaaagtaagccatatgcttttatatgattatatgttgtaagaagagccaacaatgttacgacatcatcgataaaatgatgttgattgattgcctttgtgattaagattaaatttaattgtcatgtaagaatataataattggttggcctcttcggtctcttttggattgtggtaagcgatacaataattttgactgatggtgattggtggcgttgatctaattatcacaaggaatgaaaatgaaactaaaggttttgaatatataattatgatttcttaacaagattaacaaaaacgcgatcaacatgaccttttactcattatcaaactttttctcgtacaatgtttgtctatttaccattgatccagatttattgtgaatataatatacaagaatatttcaacacccaccgaaagttattcttgactgatcactggatttccttgcttaaatcattaaataaaaaaaccttaaaacacgttttaatgatgtcttgcacttttagaacgaactttataaactaatctaaatggagaatcgttgtttacaatgtttcaccacttcatgagtgtccaatctctgttatgtgaacgaaaacaaaccaaattaaatataatctatctaaaagtaaaaccaaaatgtatcaaaatttattttttggttaagcatgatttattaaatttttttcatgaaatcctaaaacaatgtaacggattttttttatctaagccctatgcagtatgcaacgagacgaaaatacctgattaaaaatatggaaatcgtaaggaacaatagagtaataaaacagattgatgacaaacgaagttactattggtaaaatttctgatttggaagaggagaagttgacaagttcatcgaccccatttatttgtggagtcttccccacgtatattcctcggcctctaccacaaccgcgtgagccagctaacagtgtccatcttcttatattttagtttttttttttttttctatctaatatttatttatcaaacacatgttggtgattggaaactaagaaacatacatattcatagtacctttccaggatagcattttctttatattaaagaagttagttctttaattgttatgttgtctaattcatgcatacaaagttcattagatgcacgtcaattgtcaaaactctatactttttggactacgtcaaaatttcgatttcttagaagttatatataaagaaagccttactgacaaacaaatggtgatcgaatagagttccaatccaaaacattccaaacacaaatcaaattcgtaagatg

SEQ ID NO: 3179 - DNA, 3000 bp, Unknown
  misc_feature (1)..( 3000): cDNA_ID_1819755_gDNA_ID_1620630_Annot_ID_47230 3000 nt of promoter + ATG
cagcgactcacggcaccgagagtcgagcaacagtcactggcggagtatctcgtacttttgcagttcctggtcttggtccgaggggaaaggcggtggcgattgagacggcgggaacacaatcttgggggttgtgcaaggccgaaacagagccggttcagagacaaccagcgacggagacggatatcaccgatgaacggaagagaaaaacgagagaggaaacaaatgtcgaaaaccaggtgagtcagagctcccatatataggttaactttacgcaaacatgtcagcgcgtgttagtcacttgactcgtgcagtttagcagttgaagcttaatttgtatctttctgtttcttggcgtacagggaactgaagaagctcgtgattcgacgtctagtaagaggtcacgagctgcaataatgcataaactctccgaaagggttcttatgcttccattggaatttcaagattctgagtttgaataatggactatctgtttcatctcctttaaaacttgttttttttttgttaaacagagacggagacaaaagattaacgagatgatgaaggctttgcaagaactccttcctcgctgcacaaaggttattacagtttcttttttaattaactagttgttatttaactttaacgttgattctgattctgtgtctactctgatcagactgatagatcttccatgctggatgatgttatagagtacgtgaaatctctacagagccaaatacaggtatgtcctcaaaaacagaatgtgagtttgaacatggaaacagtttgaatgtccgcagattcatttcctggaagatttataaagtttagatgagatggcctaatagccctgttcttgaggtctttgcttcccaaattttgtagggtaaacatttaaggatctttaggtcatgagtgagatttcatatctgaatcgaggtttttatgccagatgttctcaatgggacatgttatgattccaccgatgatgtatgcggggaatatacaacaacagtacatgccccacatggccatgggtatgaatcggcctcctgcattcatacctttccctaggcaggctcatatggcggaaggtgtaggtcctgttgatttatttagagagaatgaagaaacagagcaagagacaatgtctcttctccttagagaagacaaaagaacaaaacagaaaatgttttcttgaactgaaacttgttagttcttttattaagacaagacacactcttatatacatgttcacataactactctacgttggtaacagttgtaacttctccaacaagttacgtctcttactcgcctcctttcgtagtcacatgacgtccgttgacttaacatacaaactataacatatatgatattacaagatttaatcatggactcaattctcaacaggtccatcatcatatccaccaccgcgctacccttttccaaacattcagacctttgacccatccagaattcgtttacaaagtccgcagcctaatctggtgtcgaaccaacctcagatgaatccctatagccagtttgttggtcaccaccggatccaacaacctcgtcctccattgcaggtaattcttcaccagtatcccattgtgcttattcctctctgtccctacgaacgcttacaagatccttttctaaaaaaaaatgtttttatagagtcaaacaagaccacaggtgagtttcagccaagcaagtagtagcaaagaacctgatgatcaggacaacaaaccaacaagttagtacgaatcagggaataaaggcttttcttgctagataagttaatagtcaagattgtgaatttcaatgggtaaagtcatcctacgttcacagtctcacagataaatttataacacatttaataatagattttttagaaatttgcaaaattaagggatagatttggcacaaactcattaacgtcacacaaaatatgtaaaaaaattaaaaggacgaggcagaaaaagatcatgttgttttctaacgtcgatacaaaaaactctgatcaagttctctttagatgtttttgtttattaaaaaaagaatgccaaaagagtcgacgcatagagtaatgacatcattgtggatgctgaaaacgtcatggtatgcataaagacacacttccgagagtgatagagagcttatcctatatatgctcctaaaatagactttctaaaagcacagaattttatcaatagaaggggaaagaaagaaatagcgactcaatgaatctggccctaaaagcaatttataaactctgttaactaagtggtttcttggaggtttctggggtatatagaagacaaaagtaactctttcttttttggtttttaataactcacaacaacaaaaacaaaacaaaaaaccttttcatgataaaaaggtaacatgtgtttggtttctctcatacatttgtttctaatctcagacataaataatttttgttcccgacttcaaaaccaacgatgattatatcattccacattcattttcttctacttcttccttctccttgatctcatttccctagaaaatccatctatcatgtaagttcctttgagattctctgctcttacttgcaagttttatcttgacatgtttgatgattaaggatttggtttgagattaggggtgaagatgatatagtggagctcttatggaagagtggccaagtcgttagaaccagtcaaacacagagaccctcctccaatacaccaccatctcttcctccaccacccattcttcgtggtagcggaagcggcaacggagaagaaaatgccccgcttccacttccacagccttcacctcccctccatcatcagaatcttttcattctggaagacgaaatgtcttcttggcttcaccattctcaccccggcgttacgtccaccccggcttcttctgtctccctgccaccaccacccaatgctccgtacagctccggttttttttttcctcttttaattctcttactttatg

SEQ ID NO: 3180 - DNA, 3000 bp, Unknown
  misc_feature (1)..( 3000): cDNA_ID_3070825_gDNA_ID_1620630_Annot_ID_162660 3000 nt of promoter + ATG
tgcgttaacttgtgctgctcgtttgggattgaattcgagactgattagtaaggtcattgctttctcttttctaaatcgaaaaatttgggcatgaacagattcaactttagtgtagtgatgctaattgatttagtaatgaacattttctttaggtagcgaatgactctcaaggaaaaggcatgttggaggagcttgaagctgatggtgtggatacttcttttattgtggtaatgctcagctttttgatcattgtgtcgagtcttatactctaaagtttgcagttttgtcttcagtttcctaatcttgactgtaattgatgtctttttatctcatctcatggcaggtctctaaagagggtaattcaccatttacctatatcttagttgacaaccaaacgtgagttttttgtgtgccctgatgctgtttgtgaatttgaggacctgtttcattgacttctgttgacttttattgtatcaaatctatttgttaagtattcaagcaaaaagttactctatcaactagaatgaaatggtagtcctatggcatggaattgttttgtttgtctagatcatcagatctttattggttattcttttcaggaaaacgcgtacttgtattcacacgcctggagacccacctatgttaccaactgacctttctcaatcgagtatgctatcagcgctagaccgagccagcattgtatactttgatgtaagattacacgaaacagctttggttattgcaaaagaggtaagcatgcatctctttaccttttagatgggttgtagatttcacatgtttctaaatttctcccaaatacatacaccaaaacaagtgtgtttttttaattgttatccgcagtcatgcaagtagtagattgattgtatgtatgtaagactagtctttgatgtttgaagatttcacaagattttctttttcttctgtgtttccaaaaacttaaaatgccacacaacctacatgttcatttcctcttgtgcttgttgcgtttatccagagcaggcaagtcgcaagaagatacctattttagttgatacagagaaaaaaagagatggtttagatgatctcttgccattcgccgactacgttgtctgtccagaaaatttccctcaggcaagttagtctcagtttctgttcttgtttttccagttttttttttttttttttgctttgaggctgaatattcttagtctctcacgtcttgcagacatggacagaagtgtcttcaactcctggtgcacttgtttccatgttgttgagattgcctaaactgaaatttgtgatcgtgacctcaggtgaacatgggtgcttaatggttcaaagagcttcaaaaggtacaaaacccaagactttatctctctctttaggattcaaaacttctacatgatcctttccccggttcataaacatcatctggctctgtcgacttcagcagaagtatttgaatctcaagagacagacattgaaagcttgttggagacactgaagcatagaaaagactcaacgacaacatttccaacatgtgtttcatcggtatttatgtgttctagctcctaaaagaaattttcaccgtatgaaaacaaacctaccatttacacacattttctcttgcaggagacaacaaagctgaaggccaacggggtaggaacaatgaccggaagattgtttctcggaacagcggagaaaattcctccagaagagcttgtagacaccactggtgctggcgatgcattcataggagctgttctatatggtaaacaatttgcaaaaattcttgtacacgctctgagaaatcagaacccaaaacccaaaactgacctgtctctacttgttttccttgatctgtagccatatgcgccggcatgcccccagagaaaatgttaccatttgctgctcaagtggtaactcttctaaactgaacctctttgttttgttttcaccaatgtatatgaatcttcaacataacctatagattatgtgaatcttgtaactgtgtttgcataaccgagctttgtaatcttaagccaaaaccagactaatcgtttagttttgacctcccacttgccactagtttgagactcatataagtggccattgatcccaatgtttttctagcttcaccaaaccgtcaccttcagtccaaaaatcattcatttccaaatggaacatacataaatcacttccatcctgatctttgtatttgcaggctggttgcagctgccgggctttgggagctcgcacgggtcttcctcaccgtacagatcctagacttgtaccctttctggtttgacactctctgtgttcctttgtcaacctttctgagtcactactttactccattgcccactttcatatattttgaatgttcttctacttattagatgaaataaaagacatggtggtatgcatcaaataatattctggttaggtttgacttttttcttattataaaaagtagtaacatatatgatgatgaagtggtgttattctaatctactaaaatgctagcaatttgtgaacgcttcaaccttgatcgcgtccgtaagatcaacggctaggatttcaccaatctgataatctcagccgttgactgctccaagtcaaaggtggatagctacgcccaacttgccgatgttaaacaataaacactagaaagacaaaatcataattgttgggtcgcctctcattggctaataatgtggaacccatttgctatgtctatcagaaaacttagtgacggcgagatgatcagccgtgtgaaccggtaaaagatgcaaaatggtaataacagtccaatggtaaatggacaacacttgagcaagcgaggtctctccttaggatacgtacacgtgattgtagaccgttctcttcaccttacagtcacatattttcaagtccttttgtgtgaaaacaaacattattacctcgaatgtggacaagtgacaattttcataagaccagtaccaattctttgtttgcatg

SEQ ID NO: 3181 - DNA, 3000 bp, Unknown
  misc_feature (1)..( 3000): cDNA_ID_2152568_gDNA_ID_1620630_Annot_ID_162658 3000 nt of promoter + ATG
acgttttattccatatatttcaacgaaattagtatacttcctcgtatagtaatgaaaccgaccaaattatacgtttcaaaccaaattttggtagcccaaaaaaaataaaatagaatttgtatctcaaacaaaatttacgtcacagactcacagttgtaatgcaataccatatttgattattcaaaatgcatgagtccacttggatctttccaggaccatattgatttttctaaccagagctctggaccatagaaagaaaacctttgtaatattttttcttgcgatatggtacgttaacaccatctccctcgtggtcgtggtacatttcaagtttacatttttgttttttcttctataaggataatcaatgtttttttacaaaaaaaaaggataatcaatgttcgttactcaaaatatggaccaatcttctcccagtataataaatattagttgacttttaagttgcaacgattattaaaagaaaaattaaaaaattaaaaattctgtcggaatttcattaataatacgcgggttcaattgatagatcaagtgtaaggaatatattaagatgaataaaatatttgttgactttaagcttctgttgtttagtttatcacctgactctacgaatatatttacatattcatacttgaatcattgaatattctttagagtcaaaactacaacgttgtggcggttaggagatttagagaaaaacggtctatataacaaaataatacaattatggttcggacaatttgaccacctagctacaacttgtgtcatgcatttattttgaaattatatataccaatagtgctataatgctatttattgacaaaggagaaaagaattgtcatccctattcatgcgtcgccacaaaaaagctgtcaatcccaaaaataagtatcgcatttcgtaagtcggttcgccaaccaaacgataaaatatggttttggaatgcttaatgttctgtttgaaaatatttatttagttattaatttattttgctccctatgacttgcatggacattttctaacaagaaaagaaacgtaacaaatttgagtttctagttatggaaagtccaaatttttttccccacatgtccaacttttagttacgggcataatcagatagactttttcattaattgtctttttcaaatcagatttaatatatgtttagttaaggacgatctaccgatgaactacttacgtaaatcttgcaaggttcgataataacatatagtttataaatacttacatagtttttttgttggttttttaaaaaaatactgacagagttatatatagcaaatgcagtcatgcagaatcacgtgataaaaagaaataccattacgcgggggacgtatagtatacgataatacgaatacgaagaatatgcatgtggcacattatcgtttgattaaatccatataacaattcatttttctaattaaaaaactaacaaaatgagattagtgaagtaaacaaatgtccctagagcaactcaagggttgatctaagggtgaaaggacgtggctcttcatgaatgttcatgcattatcctttttggacgtcgaattttttttgacgttacaaaacttcatctcgattctctaactaatagagccaaataaataattttttaagaaacagttttcagtttcattcggttcatgtccatccgcaattgttagtgttacgtatgttctcgaacgattataaaatcaatgcataatgaaaagaatattcctttcttagacataattatctctagagccgcaataatatcttgatataaaatccttgtgaaacgataatagaaactgaaatttaagtctctcggcttttgtaatgtatatgagtatactcattttaatattttttcggttgataaatagtcatatcatccgtagataaaaaagcaaaaaaaaaaacgattaaaaaccacaaatgataccgtaaacttttttttgacttaaatttctctgatacatgctgtcgtaaaatagccaaacaaaaaaaaatgacttaaattagctcaatttaattgttcatttcacgtaaactttgtttttgaaaaaacttgtcttgcgtctcacgagacatttcttatataagtttaattctaacatgtaaaatacaaataaagatgtaatcgtcatcccaaaacaatattggataataagagagcatacagccgaaatatggtataaaaaatgatcaaaattctaaagtaatctgcatgagtactgagtagctagtaattaagtgaatacattattaaaaatatatatataatcattagttggttaccataatatgggagtttaagaacatggttgatacttgatacccatctgaccacacttagttttattttataaaatatattaatatatacaaataatgttatgtgtacagcatgtggaattgtggatacaagtcatgtaccatgcaagaaaactcttccatggcctgaagttaatcaccatccaccacgtctcattaagtctaaccacatgtttccattatttaaataatctcttatgtaaatcaaactactttttatctttcttggtttcaccaaaaattaatcatactagtttttagatagtactgaagattaatgttttgcattttcttcatatgagaagttatcatatgtaaatatacattttttgatagataatatagggtatgcaacaatagttagatgctacatttgattaatgtgttgaatccatatttgaatcaaaccaaaaaatgaagtaatgcattggtccagctttcggtttttaacttaaattccggtttacagctaaatataataaaaaccaggaccacacttgggttcggagtttgttgatttatgtctcttcattcgaagttgggcggcacctagtttcaagttttttcataacctttttattctttcaacaaaaatatagtagtactttaattaattatatcaaacacagagtctaataaaatatg

SEQ ID NO: 3182 - DNA, 3000 bp, Unknown
  misc_feature (1)..( 3000): cDNA_ID_3092186_gDNA_ID_1620630_Annot_ID_162655 3000 nt of promoter + ATG
tggtaaaaaatgttaaatataatgtatatcatttctatattaattctctcaatttctagtgtattttttttaaaaaaatatatgatcgatgagaccacacgtaaaaaaaatcggcaaattttgaactaaatagatacaaaaattcacaaaacttcaaatattttaggcgtttaatagtttaaatttcatactataaaatgatacaaacttgattttttatcaatttaaactaaacatatcagatttgaattaatagaaaaatttcaaatgaaattatcgatacatttacataggtgttgagtcatatacgggattagaatgtcttctagtagcgtcaaaatcatattttagtgaggatatattgataaaagaaaagaaaaatagatagctagctccataaatagtaaattttaagttccaccaaagtacttgaactggacatgtctataatatcttggaagtagaacttctgatgattatgactatatatctactataacgcttgtatacaccgtgaaaagtctatttcaaaacccatggaggagtgatcatttagcctcatgtaccctcaccgcatgttacctatttagaaactacaaggtgagatgttgaatttgagtgaccattatctttttgctttcttctttgtttttgccatacttgtcacttgtcatctcacattcacacttattctcaatctattttcatcaccttggcaaaaatcctagctagataggcatcatcttggattctagttatgtggtctggttgtgaatatttagctagctagaaatctatcacataggtagatatgcgtcaatatacatttacagtgccatttacttttcttttttacgaaattgcgtaacaagatttcatacgactttgatttaaaagttgtcaatcacaccaattttacatatttcgaccaaattcttattgtttttcaaataaaatacggtctactttgactatcagattaacccaaaaaatacctcaaaaaattgattatatccgaaaaaataattactttttggattaaaaatttttatcgaaaatcgttatcgtgagagttagatttaggtcttatttgaatctacttttgattaattagtatatataaatgggtcaaaatgatttgagagctgctttgaagatattagtgacaaagagtaaatgggtaacacatgcgaatggtcacaaattctgcagtggagaaatcactcatgttcaagggtccacattgttcatcttacacattaccaaagtctgcaaaaactagggtttgttcctttcacatgcctatgtctgttagatgaactacctctcgtgaaaagaaaaaaaatatattcctctacactaaacacaagaaagaagaaaccaacaaacacttgtatttaccacaaacaattttcaaagatttcatttacgtataagtcaattttccaagtccaaagtttaggatagatacgtaatcaaataaataatagacaatgtatgttataaaagtaggaactagtacttctctatcaagtaactaactatacaagctcatcaagttttttttttctttaatgtaatttgtttatagtttatcaagttttagttcttatatatactcaaatatgtacgtaaagaaaaaataattcgaatgtactggatttaatcattgggatggtaaagtttcgaatggaacactactgtacccatatctctatatccctttttatgtacctgcaaccccacacacacatatatatatatagtatgggcattttagttccaatccggctagagattcattctgattatgtataatatttataatgtttctagtatttagaaatttgatatttctgtgtaaaatttcttacacaatattttttcttatcattagattttgtaagcaaatacaaaccttaactagctagcttaatacattatttttgagttgtgtagaagaattccgaaattccacatatgtaaatgcctaaaataattaaaaagaaatagatatttagatcattcgctcggatacagattggatacgaatatctgaattttcttaagtgtttgatttgtaccaatcgttagtatttactcatacacgcatggatggacacagacaacactaggaacttgtacaaatgagagtacttgccaattcttttagtcagttttataatataattgtttataattaaaatgagttatgttttgtgtggtgcatgtatataatatttaatacatgtatgtgtgcatatatttatgtatgtcaatgcaacaaagatttgggcttataaatgaatgaagaaaatgttggtgggatatggacaaaaacaaattggagaaacaatgaaataattcgaacccatgacgttacaactagtcaaaagtccccacatgatcttatcaaacgtaggtccatggatgagttgttttcgatatcataaatttctcacgaattttgttatatggcctttaagtgtaaaatgacaaaacttgccaaacaaatcatagacccaatgcaatttagatatcattggtgaatggttatagtaagtttaatagctttcaattcaaaatcaattgaaatgaatggcttgacttatgttacttagttattattattaatttcatgatatttcttatgtgagattcgtaacatgtttcttcaaaataattcatctttcatctcatcttgtatgatatcatgatgagtgagatatgatttgttttcaagtcttataaagcctattaggcccagaaccacgaatacttttcagagaagaaaacgcccattagtaatagtataggcccattaagtattagaataacaaaaattcagattttttttgttggtcacgaaaatttagctttttaatttaataaaagaaaaatgggaaaagaggacaagtcacgtcacgagacaaattagcatagcacgcaaagaagaagaagaagaagaagctccaagaatctgtcgcagaaatcgccatg

SEQ ID NO: 3183 - DNA, 3000 bp, Unknown
  misc_feature (1)..( 3000): cDNA_ID_1808354_gDNA_ID_1620630_Annot_ID_162653 3000 nt of promoter + ATG
ttactactaagtctactatagtagatatatcagtacatttttatttatatatatacattttcattttaatgcaaacaaaacaattactatatgtttcccactgacgagtaaaaaacttaattagattcacagagagcaaataaatataacttgtccttctaatgtatggccgagtgggcaatggcgaatgatgatccatttttgtgttgtcaaattatcgttggttatgaatatcggtttccccatgcaatttattgtttcgtatactaaattctttaatatgttaccaagaacgtgaaatcgaaatcgagataatgtgtaacacataggcaagccatgtaaattatgcagtcataaaagagacgatacgctaaccaagaatcaatatatggtttcgagccttcgattattagaaagataacgaccacactactattggttctacatgttttatgtacataaaatcaaatcgggaccaaataaaagaaaaactgaaatggaccagccaatataatgtatatattctttaatatcagttgataaaaaaaataacaggaaagagcaataaaaacatagagccatgacattatgtcttcatcattatcagccttaaacgataacaaaattataaagctctagaattcaccaaatatacccaattgaatttctactagtacctaaaatcatagttacgagggctaatggacttctcataagacttatcttacgcatcatttggatcctctaatatttcgcacactattaagtccctagacgaatcgaaccaaggaaatgcgtaattacctttttaagaagaattaatgcacctaacggatattgccgctcaacatagagtggttaatgttcttttttgccaacctgtatttccatttactgaagaaataaatttgacacaactaaatctttgaaaattacaatattttataaagatttacagtttttgggttttataaaataaataagatttgacaaagatagttatgaaaagaaggatgaaatacggatgtcttttcatgaagatttataaagagtactaataacttcatatcttatgattagaaatctaactttgaggcccttgtgtaccttcgaatatagctagtttatagtgacgggacccttagcataaccaaaatcactgacaagccatagcattccacgtggttaagtccatctatactctcattatcatcttccctccggttcgggttcacgatactggtttagcaactaaattatcaaactatcaccagtttcgtagaatttattcacactaaaaccaattatacgttaaatcattcgttagtcttgtaacttttgttattacttattaaacgccatggcgatgttgggtccactaaacagcgcagccaatcacataaataggggaacacgccagttagattgtatttttaataactgttgtccaaacgtgtaatctccaatattttatctgttccataatgctaatgacaaacagaatagaaaatgagagagctatagaagtcatatatacagatagatataattggactcagattctatgtatatagttgaagatataataaaagataaatctaaaataccatactttgaagaatcagagaagaaagaaaacagcatggccatttgttggcactaaataattagtttatggacacaagtaagacaataaactgtactgttatagtgttttgtagtcaaaagtgttccacacttcatgtgactacaccattacactcattacaataatcaatagaataccaaccaactctataatataacgtgttaaaaacatgaaggtgttaatatttaaataatagggcacgatgtttatatgcgttcttaagtttttctttcagtagttgtgtcttgtatatcgatatatatgtagtggtcttacaaagtaggtgtatgtatgaataaaacaatgttaacaatctaatcaaattattgtttactttggagtaaaacaagaaaaaaactcaggttgattatgattgaaaataggatcaaatgataatggataacgcatatatatgtgtatgagaatgagatatttgagaaattttattttcggtagaaatttgcacagaaacgtttagggaaaatgttatatgaaaaaatagttagaaaaaaaaatttagtgaaaattatttactttgtttgtgattatcttcattagatgtcatatataaatatggacatatccatgtttttctaaagtgttggcgctacatcaaccaataacacgttttattgtttgatctgtagtaattagtgagtagtaaacaacgaagcataaagcttcatctatttcatagtcgttggttgatcaattttttttaacaacacatttcaatgactagcgacttaaattgttaatcgctaaaagtaaggtttcaaattttgaattaacgattaattactaaaataagttgttgtcgtcaacaattacaaaatgaacacgattgctacaatatgttattgttatagatctttggcaactgcaaaacgaatataatttaatcacgtacgatacgactatgaaaaatcaaacttcatctaagatatatgttttggttttcattttaagattaattaaaacgagagtggttatgtattaaattgtttttaaatttataaagaaaaacaaaacattttttacatgtttcaagaaacacttaaatatttatccacaaaaaataaaataaaacaatgaatctttatttttcattcacaaaggaaatctgaaataagagtaacctaaaaaccacgtcaccacattatccttaagaatagatatgtaatgtacacgtggcagatctcaagtggagggaaacgattcgtttaacccaaaacatctcaaacaattcctcttttcttagccttacgaacatattactaccaacaaaacaatcaagaaccactctttcgtgtcgcaataacaataagaaagaaagaaaaagaaaaccagag

SEQ ID NO: 3184 - DNA, 3000 bp, Unknown
  misc_feature (1)..( 3000): cDNA_ID_3012928_gDNA_ID_1620630_Annot_ID_162649 3000 nt of promoter + ATG
tccgacccatttgcaaatatcgatgttttcttcgatgaaagctcgaagactattgagttctccagttggatcataaggaagatcctacagaaacaaaagtccagaccgttaaacagaacacacaagacacaagcttcaactgtaaaaaaaaaaacacctcaccttctcccagtgacggtcaatcactatgaatcccactagagctgcttcgataatgattaaaagagttttgagaattgaatactaagacctatcaaggattaaacatcacaactgaatagtattaacagaaacatataggtgcagtctatatataaaaggatacgaaacacaagcaacatccattgatagcttcagctgcaatgaaaccaatgatagtgacaatgcagaccaaaatcccaatcgccatgaaacagtagataaacctacattgaatttgaaaccaaaccaaatcaattcattggaacattccttcaaacatcaaacagtgtcttagcttaacgctttgtcctttttcaacaagattagtcaaactaggcatagatttgaatcgaaaaccataaaaatggaaactttttcaataccatggagcaggaagatctaaagaacggagattgaaacccgaatctccaccaccagacccgagaacgatacccgatacgaaatcgatcggattcttcaaagaatcagaaacactgttgatctcaattattgaattagagaaggaataagaagaatccggtgatgaagctgccggaggctgagacggaggagggtcaacgggaacgtgatgattgtattgatcgagcatccaaatcgagtagattatgattgatataccgatgaaagcttggagaaaattaaggatcttgagaatcgaagcgaacgagacatggcaacaattgtgtcgcattttttctatcacgattcttgatatcgaaatcaaacttctgagcagcgatcgccgaaggaagagtctttgatgatttcggacaaaacagaaaaatgttgttttgacagataggatatattccgaagcttactaattaatcattaacgaaaatttattaattaacgaaaattttcattatcattaatgtaatagttcaaaattttgatatagttgatgaggccaaacaaactaaatgggctagaattcgaataaatgggcttagggtcaggaaagctcattgtgaagagacttcccgcttcagaagttcaagttcaagtgatggggggactcaggttagagatatttgagacttgaagtgatgcaaaaggtacagctcatgatgattgtattgtgatgatgataatggtatgaatatgatgatgagaattaagtatgcatgtgaatgttagatgactgaaaaagatagacaaccacttatataactaaccaacaacattttaggctttcctctttctctctctctgtttttatttattgatttttgggtacactaatgtttaaatctgtctctttaattggacggcctagcattcttagatctctcgatactgttttaccaataaaaccatattcagaggtgtcattttgtcatgtgtatttgttgtttttccccatgtatcacgtaaatgaatggtacatttaggggtgattacttcaaactttcatttttttctgaacaaaatgaaaaccaaggaaatcatgagttcacacccggattaataggagtattttggaatcgaattgaaattgcagttgaatttgaactttggactatatccacaaaagtaaactaggtaccactaaaccattaaaattttgttgaatttgttggttttaggcaaatgtttgagttttatgatttcagtgcaacttttataaggacataaatatctatttaattagtccataactaaaagtagcaaagttgtaagatattacagattctaaaagtcattttgtaagacataaatatatcatacctttttaatatgctgaaacatgtcagaacaaaatttataagtatcaaaatggattatcaatctttaatttataaaattaactgaataaattggaactttattagactttcaattaagttgtccttttaaaaatattttcaattaaagatgattttttttttgtcaaacaaaatccatgcatgatggataatattaaatccaaaatcttttttttgattacccacgcctaatctaaaaattcctatatcccatatatatatgtgtgtatgttacataatatccatcagagaaatcaacataaaccaaaaagtgatggataacaaaacatctttgtggaagataaggaagatcttaacagagaaaagtgatggttggttggactttgataataacaacgatatcgagaatcatattttgagaagtttgggcgaatccataattagtagagtgaaaaaagactctataaagataaagatcgacgattatgatacagggagccagcacgaggtaaccttcgggtataatcatgaatctgatacatattacattggatcattatggagattgaaggagcttgctgctggagatgaaataggattgttttacgatcctatttcaaagaatttgtgtttctctgtgttgaaacaagcaaaatcctgcttgatcaaaaaatgaaataagcaaaaccctgatgatcacaacttgtttaattatggttaattatacagcatagtaattaataagatcttgtttgaaaggacatatataagaatatgtatcgacgataatcatttctatatattaataaatatacaagttttgacatttcacttttgttcctcttaaatatgacaccttgtttctcaccattagatcgaccgacgacataagtaataacatttattacatacaccaaaaaaacaagcaaatcattaatacaattttccattagtgtatataacaaacaagagactaatcttttctttaacatttcatagtattacaaaacaacgccaaaagtcaaaaggtttcgctttctagatcatg

SEQ ID NO: 3185 - DNA, 3000 bp, Unknown
  misc_feature (1)..( 3000): cDNA_ID_3070832_gDNA_ID_1620630_Annot_ID_162648 3000 nt of promoter + ATG
atgtatcgacgataatcatttctatatattaataaatatacaagttttgacatttcacttttgttcctcttaaatatgacaccttgtttctcaccattagatcgaccgacgacataagtaataacatttattacatacaccaaaaaaacaagcaaatcattaatacaattttccattagtgtatataacaaacaagagactaatcttttctttaacatttcatagtattacaaaacaacgccaaaagtcaaaaggtttcgctttctagatcatgtccacatttctcctaacatggattattatgaccgtcgcgttaagcgtaacgctttttcttatgccgcaacaaacaaatgcggctagagcgttcttcgtgtttggcgactcactcgtggacagtggtaataacaattacttagtcaccactgctcgtgccgattctccaccgtatggaatcgattatccgactggtcgaccaaccggtcgtttctccaacggcttgaacctccctgacatcatcagtacgatcacgttttcagttacttaattctctctttttctttatatatcttttggtgatattgcttggtggtttttttaggtgaacaaattggatctgagcctacattaccaattcttagccctgaactcactggagagaagctattgatcggagctaactttgcctctgccggcattggaattctcaacgatactggcgttcaatttgtaagtcgtttaccgcgtttaatttttatatgaaatttgactaaggtgtatacaattttacattcattcaaaaaaaaaaaaattgattaaactccaaagtaaagcttcattttaaaatataaatatttttagttgaaaaatgtctaaactattttggactccagtctaatcttttttttgtgtggtaatttattgcagttgaacatactaaggatcggtaggcaattcgagctgttccaagagtatcaagagagagtgagtgagattataggttcagacaaaacgcaacagcttgtaaatggggctctcgtcctcatgactctcggcggcaatgatttcgtcaacaactacttcttccccatctctactagaagacgccaatcatctctcggtgaatttagccagcttctcatctccgaatacaagaaaatcctgacggtatatatatatggtttcttggtttacacgttaggtttacacgttaggtttacacattaggtttatagagttatatttatcacgttcttctacttatgtgatacagagtctttatgagttgggagcaaggagggtgatggtgacgggaacaggacctttgggttgcgtaccagcggagcttgcctcatcgggaagtgtgaatggagaatgtgcacccgaggcgcaacaggctgcagcaatcttcaatcctcttttagttcaaatgcttcaaggacttaaccgtgagattggttctgatgttttcatcggggctaatgcctttaacacgaatgcggatttcatcaacaatccccaaagatttggtgagtactcttaattggtaaatttgtctcatgattcatttttagacctaatttgatacattttcataggttttgtgacgtcaaaagtagcatgttgtggacaaggagcatacaacgggcaaggcgtttgcaccccattgtcgactttatgctctgaccgcaatgcctatgctttctgggaccctttccacccgaccgagaaagccacccgactcatcgtccaacaaatcatgactggttcggttgagtacatgaaccccatgaaccttagtactattatggctttagactccagaatataattaaggatgcaatcttttacagaatctatttccagtttttctcgtatgataaaatatcgcgagtctgccaaacaatggtaaggaactaaggattctatttttccaaattatggttttcttagtttctctctaatgctaatggggagtctctgtctcggctctgtcttttctgttatgtttcaattttgtggttagttgccacttctttcttacgaaggctttataaaactttgtcaattttacactctattttctttataaatacttcgcacaaatatcagttgaagtgtttatattttctaagattatgagcctacgatataacgtaaaccgtaaggttttgaatggctaacatcactccatgtcgaaagaaatatttattacgtttaatatcattgctgaagtgtggacgttttcaatattcataatgacatcatcaccctcggcatcaactcttttgtcactattcatagcctacgtactccatttttggtgtctttgatggctccacatgagcatacatatgggagcaagcaaggaaatatcaattttttgtaatttttgttttgttttgtttcatctactatcattttcaaagaaatcgaaaagaaaaccactgcagagccaatatctaaatgtttattgatgttgtactacactcagagagatttgcttaagaatgaagtttacctcattcttctttttggatgcttttgtttaaacaaacgtaccagtttgctcgtacaaaatcatagatatgtccattgatgtactacattaagacaagaataacaacaaaaaaagccttcgtggtgagtgatgacgtctctaggaggctcgtagtagtatatcccactaaaggacgttttacttcaggtcagagcttatcttagcacaaaattcggagaaaaagtaatcagttgaagaaactaactcaccactataggccaaaacaccattataaaatattcagtttcttggagctttgtggtttaaacgagtcaaaaggctacgacaaatgtttagtttccttttcttttaagggacattttaacaaattcacaattatttttttctgatgaaagtggacaagtcacaaatgtccatatgagtttctgggcgacttctatcagaatttttgttcataattttttttattgtatcaagggatg

SEQ ID NO: 3186 - DNA, 3000 bp, Unknown
  misc_feature (1)..( 3000): cDNA_ID_3070836_gDNA_ID_1620630_Annot_ID_162647 3000 nt of promoter + ATG
gggaaaggcggtggcggttgaggcggccggaacaccatcttcaggagtgtgcaaggccgaaacagagccggttcagatacaaccagcaacggagtcgaagctaaaagcgagagaagaaacccatgtgagttagtactcccataggttaacctaagcacccatgtcggcgggtgttactcactttaccggtgcattttatcagtcaaggcttatttttttttctttgtttcgtggtgtacagggaactgaagaagctcgtggttcaacgtctagaaagagatcacgaactgcagaaatgcataacctcgccgaaagggtttttatatttccattggagtttcaacaatggactctctgtttcatttcctttaaaacgtacttttgtttgtaaaacttgtttttgtttaacagagaaggagagaaaagatcaacgagaagatgaagactctgcaacaactcattcctcgctgcaacaaggtctcccaaaatttcttatattcctcgttgttttattgaactgaaggttgaatctgattctgtttctactctgatcagtctactaaagtttcaacgctggatgatgctatcgagtacgtcaaatcgttacagagccaaatacaagtatgctcttcaaaacagaatgtgttttaaaccaatggttcaacatggaaagagttcatatgtatctagttttgttgaggttactagagttatttttggtctctatcaaccagcgtctccgaagagtttgaatgtttgatgtccgcagattcatcttcttggaagggttataaagtttcttgggagataaatgcaaatcttataagtctctacttcgaaacactggtacctcctttagatgggatggcctaatagctaattcctcttattatgcactgttcttgaggtcttactcttctgttttgcttcccagtttacaggaggattatgtataatatattaatatctgaatcgatattgttatgtcagatgatgtcgacgggacagggtatgatgtcgccaatgatgaatgccgggaatacgcaacagttcatgccccatatggccatggatatgaaccgacctcctccattcatacctttccccggcacatcttttcctatgccggctcaaatggcaggtgtaggtccatcatatccagcaccgcgctacccttttcccaacattcagacctttgacccatccagagtccgtttaccaagcccgcagcctaacccggtgtcgaaccagcctcagtttccggcttacatgaatccctatagccagtttgctggtccccaccagttgcaacaacctcctcctcctccatttcaggtaactctttaccatggtatccattgtgttgttgcaggtaatccttatgtatgatgatgctcacaagatccttttttaaatattctcttagggtcaaacaacatcacaactgagttccgggcaggcaagtagtagcaaggaacctgaggatcaggagaaccaaccaacagcttagtaagaatcagggaatgaagggtttccttgggatgtaagttaatggtcaagatactgacagatgcatctccattgtgtcgttgcaggttaaagtgtggagctgaaacggatcagttcttcaagcaaattacaactttgaagataaaccagagttgtaacatgtagattttgtctgttaagtttaatgtaagtactttttagttaatgggaaagatactgacaggttgcaaggtggtcagtatttgtgcatcacgcttaagattcctcgatgtggccagtatctcccttttctagcatgtgaggtccctactctctggttctacggagaccaaatgttcgactgattaaacacacaatgacttaccaaaagtacacgcggcccatcctcgtctttatgttccaagtgcgactgtttgtttatttgtaagcatttttcttataataataaaacagctctatcttcgttaatatcaacctttcttagaagcttttcactggagataaatgtgaggaaaaaatcccctacgttataagccaagtataagctattctgattggcttaacacctcctacgtcaaaactcaaaaagaaacacttagtagtattatatgaaaaaagaagagtgaattgcagctgcctcaaaagtaatatttactttattataagatttagtatgaacttatctacatgtattttgtttgaaagaaaagtaaacaaaaaaaaaacaatagaaaaagagaaagacgcaacatgactttttttttgtattgatattgtagagaggatggcgtaagaagaagtctgtttgtttcctaaggttaatctaatcattatatatttggaatgttttgtttcttacagagatatcttagcacaaaattctgaaaaaataatcagaagactgtggaaaaataaattcaacgaatgtgaccaaccactacaaaacaaaacaacattataaaatctaggtttcgaactcgcaaatcaaccaaatattatgcaggtcttttctactctgtgggtaaaccgacagaaacagcgacgacgtttgttttatttcttttaaactgttcacatttgtttattgttttcctcctgttgaaagttaacaattcaaaaatttccagtacatgtgtttctgttctcttctcttctcaaaattttttgtttctttttgtctcaagctatgaacttccatactttgaatcttctacttctctttcttcctcttacttgatcttcctatagcatacttccatcatgtaagttcctttttgtatttttatttctcttacttgctaaagttttatcttcacattttttgatgattagggttttggtttgagattaggggtgaagatgatatagtggagctcttatggaacggccaagtcgttcgaaccagccaaccacaaagaccttcctcgggtaaaccttctcctactccacccattctgcgtggtagcggaagcggcagcggagaagaaaatg

SEQ ID NO: 3187 - DNA, 3000 bp, Unknown; identical to SEQ ID NO: 3178
  misc_feature (1)..( 3000): cDNA_ID_1819770_gDNA_ID_1620630_Annot_ID_162642 3000 nt of promoter + ATG

SEQ ID NO: 3188 - DNA, 3000 bp, Unknown; identical to SEQ ID NO: 3176
  misc_feature (1)..( 3000): cDNA_ID_2152530_gDNA_ID_1620630_Annot_ID_162639 3000 nt of promoter + ATG

SEQ ID NO: 3189 - DNA, 3000 bp, Unknown; identical to SEQ ID NO: 3185
  misc_feature (1)..( 3000): cDNA_ID_1838422_gDNA_ID_1620630_Annot_ID_47231 3000 nt of promoter + ATG

SEQ ID NO: 3190 - DNA, 3000 bp, Unknown; identical to SEQ ID NO: 3184
  misc_feature (1)..( 3000): cDNA_ID_3012928_gDNA_ID_1620630_Annot_ID_47232 3000 nt of promoter + ATG

SEQ ID NO: 3191 - DNA, 3000 bp, Unknown
  misc_feature (1)..( 3000): cDNA_ID_1819751_gDNA_ID_1620630_Annot_ID_47234 3000 nt of promoter + ATG
ggtaattacgcatttccttggttcgattcgtctagggacttaatagtgtgcgaaatattagaggatccaaatgatgcgtaagataagtcttatgagaagtccattagccctcgtaactatgattttaggtactagtagaaattcaattgggtatatttggtgaattctagagctttataattttgttatcgtttaaggctgataatgatgaagacataatgtcatggctctatgtttttattgctctttcctgttattttttttatcaactgatattaaagaatatatacattatattggctggtccatttcagtttttcttttatttggtcccgatttgattttatgtacataaaacatgtagaaccaatagtagtgtggtcgttatctttctaataatcgaaggctcgaaaccatatattgattcttggttagcgtatcgtctcttttatgactgcataatttacatggcttgcctatgtgttacacattatctcgatttcgatttcacgttcttggtaacatattaaagaatttagtatacgaaacaataaattgcatggggaaaccgatattcataaccaacgataatttgacaacacaaaaatggatcatcattcgccattgcccactcggccatacattagaaggacaagttatatttatttgctctctgtgaatctaattaagttttttactcgtcagtgggaaacatatagtaattgttttgtttgcattaaaatgaaaatgtatatatataaataaaaatgtactgatatatctactatagtagacttagtagtaattgttgtgaaagtagcagaaacaaaggatatggttgttgtaacataccaaattttcatgaaagcattcattgtgaatgtgaagttgagcgtatctatccgtgcaaccaaaaatagaaagagatgaagtatatgatcataatctgatttcttttgcttttagcacactaatcattgaagtttaagcatcacatctcttttctattttcctttccttgacaaaacttgcgaatcgttttgatgttccatacgtcttttgccatcattcatacataagtaccaaccaactattattaaacttttatttgttaattatacacaatattgactatatatattattatttttaccacaaaaaaaatttaaaatttagactatatagtaccaaccaatatagtattaatttttttttattttttacaaaaaccaatgaataaatttgattttccgaatgtggtttcttaattaaatttatattatttcagttccaatatttatatatatagataataaaaacaaaagagataaaagaagagatattggaaacaaaagaaaatgaataattgagagaacacaaaagaggaagaaagagagtggagaagagaagagaagagaagagagcaacttcctccattttcttttggcttcctctctccttctcggtttgttttgtctgtacctgagagagtttcccctaacaaaaaaagactcttttttcctcaaaatccatttcgcttccgacgccattctcagtcggtgtgaacgcgtgagagaaagagagagatttggcttactttatctccggcgggcatctttttccggcggagtttccgatgtatctactctagctaagctcagctcttaactgttacaggtctctctctctctctctctctctcttcccccgagtaaaaaagccacaaaatgtctgaatcatttagctctgatctcactttccgatgctttttacctattttctcgtttcgatttctttgtttgcttttcactgttcttacttcaattagattctgatccctctttttaccctttctctctctctctttctctgcttttgcttttactgtttccttacaattgtgattgtattgagctaattttggtcggattcatttactcttctctttgtcaatttgcttgtttttgttaaagatgtgacatttattactaaaggtttcttctttttgggggaaacaaatttgagttcatagatagacttactagaggagtgttgtatcactgatgctggaatctggttaatgtaggcagatccacagtgcctgttgattgtttcttcctatcatcaatctcggaatttgagggggtcttattattaagggtgagtcaattttgatttgtaattttcacaaggagtttgtgttcagacttcagagcataaaaagtgactggcttgattgtgataggtcatgtgaaaaaatggtaactggttcatcttatcttttgttcagtcactataaagtgtccctctgattacagaatcttattctcctttctttttttccttacaaagttcttgttttgttatgcttgtcctgttcctctttgctgctagaaatattctcttcttctactctctcttcacttttcctggatcttttaggtttaaattttgaagcttgcagagctggaaagtttcttcattaggaatctttgcttgttagtttcgtgtcacctcagataataactaaatagctgtgaaactgcagggaccataatgaatgaactccgaggcagaaaggctcaaaagattgaaagtccagttccaggatgcttagggaagatggttaacctatttgatctaggaattgctgttaatgggaacaagttgcttacagataaaccacatcttgatggtaatcactagttccctctgtaattgctttgttcactagtcgaagctttctgttatgtttctgaactgagtaggatgtcctagtatccacctgtgttattgacacgaggtagtttcatggcaggatcctctctgtcaagaagtcgatctgatgtgactcgaatgccaggcccttcttataaaggccattcagaagctgaattggtacgtttggttaaataattagaaatagtatgcatgctagcaacagcgattttaatattcagaagctgaagtctattgcctgcactgtttgcacagattatg

SEQ ID NO: 3192 - DNA, 3000 bp, Unknown; identical to SEQ ID NO: 3183
  misc_feature (1)..( 3000): cDNA_ID_1808354_gDNA_ID_1620630_Annot_ID_47235 3000 nt of promoter + ATG

SEQ ID NO: 3193 - DNA, 3000 bp, Unknown; identical to SEQ ID NO: 3182
  misc_feature (1)..( 3000): cDNA_ID_1819747_gDNA_ID_1620630_Annot_ID_47237 3000 nt of promoter + ATG

SEQ ID NO: 3194 - DNA, 3000 bp, Unknown
  misc_feature (1)..( 3000): cDNA_ID_1807311_gDNA_ID_1620631_Annot_ID_47244 3000 nt of promoter + ATG
taattggtttatgaaagaatctacatatacaacattagcctcgcttttaacgaggactaacacacgtgaccgatacagaacaagaaaaagacatgctagtagacggaccacgctgcaatctatcagctaagggatttggcttgaatctgaccctaaagacaaatcctggtggttgaggcacatgtagagtaattgaagtatttgtgagcatatgaaagactgtagacatcgttggacgatcagcaggattttcttgaacacataacaatccaatgtgaatgcatctaatgacttcatttctatcataattctcccccatgggtgcgtctaccagttccaacaatggttcattgttccaaagcctccatacctattcaagtcatttatcaagaaactaatttaaatgttgagagctatgatcattttgctaagagaagtagaaaagtttgagatggcattggaaatatactaacatatgtgactaagttacttattgagccgtctgtctcgttgatgctactattctttttcccaccaataatctccagaatcaatactccaaagctatacacatcagatttcgtcgagaactgcccattcgtcacatattcgggtggcatgtaaccgctgaaaaatacaacgcataccagtttcaacttttatcaacaacaataagtacaaacagattatataactaaaatggaaaattacttacattgttccaactactcttgctgtggtagcttcagtttggtccactctaaaattcctagccacaccaaaatccacgattttcgggttcatatcggcatctaagagaatgttacccgctttgaggtcacggtgtatgattgtaagccgtgaatcttgatgaagatacacaatccctcgagtaattccattaataatgttgtatcttcttgtccaatctagttgacccttctttaccgggtctgcaaaaatcccatgtattaagcaattagactatgagatcaagaactaaggtttcagagaatataaccctatcatctgtttcttttcttaccaaagaggaagtggtcgagacttttgttaggcaaaaactcgtagactaatatcttttcgtctcctttgacagcatacccgagaagcttaacaagatttctatgttgaagctttgctacaagaaacacctcgttcttgaactcttcttcaccttgtcctgacgttttagacaacctcttcacagcaacttctgttccattcggaaatgttccctgccaagtcatatgatcttcacataattatcagaacatgttctgttttttctctctaacacaaaaaaagtactagagacaaacattataccttgtaaacttcaccaaaaccaccatgaccaagcttgttaacattatgaaaattacatgtggcagcttcaattgctttaaactcgaactgaagtgaacctgaagttgtaatatcatctgctactgcaaaacgaaatcataattatatagtgtatccagagagtttctaagggacattcaacatttatatctcaaattcttattcaagaccactatcaactttatgttttcaaaacatgagaaaacttacttttagttgtctttgttttatatgcttttctcctcttccaaagaccaactcctagagcaagcaataagatgggaacaacgataatcgccacaatagctcctgtagaaatgcttttgccatctgcacgaaccctaggaaaaatattagtctcaaactacgaacatagctataaaaaaaacttaaaacatggacccatggtcttacctttttgacgaggacgaatattatcaaaaagtcccaagaacggataaagctcccatcgaatgaaacagcttggcctcaaaataatacctccttgtctcccacggcaacatgacctatactcaaccacgttttgttgtagacacttggtgcagttttgaagagataagtctctactgcattgcacaaaaccgtaaatgcgtgagatagacgtctcaagctttcgtatcccggctgcatagtacaaatatgaagcttggtctatcatacgaatcatcaaagcctcccatgtaatttccaaatccgtcaagttagcttgaaaatctctggtatagttatcactcctcagaatctccataccaagggaactataaaacgagcggtttgagtaacgtacaagacaaactgttctatcaattctccagactatagcttctgtctgattagtacaattctgcaacaatctagcatttgaaggatgatacaatcagaacaagagtgtgcatcagtacctgggacacacatccctagaccatatgctctgtttggatgttccccgatccatgtcgtgtaaaagccgtcgatagctgtgacattagaggaagagaagaaagcaggactcggcggtttaagtcgtaagtactattgggtgtgaagaaaccagatctttcaaggcatacctgtgcagagacatgactaaagcttatgaccacaaaccagaagattactaaaaacttgaccattttatttactctttccttttttgttttgatgtctgaaattaaaacctcaaatcttggaagatgtaatatttatacaggcgtttcaatttcaacctcttgtgctgtacaaaatttgactaatcgtcattgaattttctaacgtagacttttgatgatgagtcaatgtctagtttaggtgacttatgtcttatacgagcctgattcacattttttaccactttgtaccatatgaattggtatttttcctccaatgtggtaacaaatcttgttgaagcttcatcaaagcaaaacagcaaatgcatgattcttgaaagggtattaaattgaaacttttaaaatgtttaagcatattatgaaaagttaaaatattagtggggtggatttgtagttttttaaaacttggagaacagatacatcttactgtcattactgaggcaacatcgagtacattcaccggaaa

SEQ ID NO: 3195 - DNA, 3000 bp, Unknown
  misc_feature (1)..( 3000): cDNA_ID_1821121_gDNA_ID_1620631_Annot_ID_47245 3000 nt of promoter + ATG
tctctgcattaagtttcctctgctttttcacttttatacatgttttcttaacattttcatttatgtttttttttaatctaaattacattaaaaaacaaaaatctcaaaagttgttaattttattgatatattaagaaaaataaatctggtggtaaagaggacgagatagagagagaatgagaaagaaaaaggagactccgtaatgaatctggcatgagttctggcaaagacagaagagaaattcaatgagaaagagttctggctaaagtttggtgacgaagaaggaaaaaagaaacacaaaaagaagaagtaagcaaaatggtaatatagaccaaaaagtcacagaagatctgtaacaaatggaaactattttggtcaaatgttattttgttaattatttgtcagtcaaggtcattagtccatattctttttatttgaatgaaagataataaatgatacaaaaatgcatgaactaattgtgtcaatgaatttagttttcatgtgattttctacattataaataaatcattttgattcatttcttgtttgtagaagaaagaataaagataagagcctctttcatagtatcaatggcttccttcaaccactttgtgttactgcttctgttaataatcactcttattctatccgctgaagcaactaaggaacgccgagcaataccatcaaaggcagaaaggaatgaaatgaagagacaactcaaagctatcaacaagcctgcaatcaagagtttcaaggttggtttagccttccttcttcttccatgcttatattgtttcatatctaacttttttttcttatgaacagactgaacatggtgatatattcgattgtatcgatattcacaaacaactagcatttgatcatcacctactaaaaaaccactctgttcaggtttgattttatacatatttaattctctctttatctactgtcttttcaattaaaagatgcctctccttagagaatgactgactttgtatatgcagctaaggccaacaacagtacctgaatatatcactggaaacaacatttcagagagttttagtcttttgcaagaaggtataagctgtccagatggcacagtaattgtaaaaaggactacaatgcaagatcttatgcatgcacaacgtttgaaatccatgggattcgagggcccgagaccttttctcacagagacaaacaacatgaattttaatggaaaattctacgtaagaacccttataagttgatagtatatatagcaaccaccatttttgttttccactttcattttctgagtttctttcttctttatggatattaggatgcaagagctgattatggaccgaacccttttgctggagttgcaggaaacattaacatatggaaaccaaaaatcttgcaagatcaagttagtattggatacatggcagttagtggggggcctattgaagaagatttcgccagcatttcagttggatggattgtaagttaattctggttccttagcaaaagtgaccatgttcgtcaactgtaagttgcatgaatttaaagttgacaaaagtttgaaatatgtatatacaacaggtgaatccatcgatgcaccatggtgatcatgttcgtttatacgcctactggactgtaagttttgaattatactagtaagagcttacaccaatagtttctttatcaacttgtctgtgtcttataagttctttatgtatatgtttccttataattgtgttaatagttacatggaagcagtactggcggctgctacggcatgtcatgtcctggatttgtgcaagttagcaagactataccagttggtgccgttcttcaaccattttccatctataatggtcgacaatatgaattgcgtttaggcttgtttcaggtaaagtctactcaactttttatcacttctcttaaagtcatttgaattcatatttcaaaattgggaacaggatagtggcacgggaaattggtggtttgtatttaaagaggagattattggatactggccagcatcattgttcaagtcctggatggaatctaacagcgcaaattatgcatcttggggagggcaagtgtatagccctatcagagagaagagtccacctatgggaagtggtcattggcctagtgagggctttcataaagctgcttttattagtggcctcaaactcttcgatggtcacgggaaagtttataatccaggacgcgggacagtgaaggtacatgagagcagaccaatctgttacaaagccagatatgttcatgatgttgataaaccttggttaaaatctgtttactttggaggtcctggagggtgcatagggtaattgatctacgagataaagagtaacaatatcataagattttaattttacacaggctataggaaaaatcaacagatttgaaatatatctaagcattacttgcgctctaataaataataataaagtattagaaattcacaactttcagcacaaatttctatagtttattgagcatagattgatagctaactcaccttaaagtacattaaaaataaaaatctcattctcaactgcaaaaaaatgttacaaagtcacatatgttcatgatgataaggatccttggttaagagctatttactgtggaggtcctgcaggatgcatttggacataatatatgatatgcagagttacaagataaatcttatatatgtttgtatgaataataaagtttccatgaatcctcccaacttttttgcaataagtttgatgtttatgcctaattgtaaaaatgtcacaatctaatcatcaatttacaatcctttctaatacagacataatgataaccaaaaatgtgggttctactgttactgcatttgtctgaaacatttctaaagcctcttttaatcatgtcttaaatatatatacccctatccatagcatagcttgcccctactcataacctctaaactctttagacaactaaatatataatataatg

SEQ ID NO: 3196 - DNA, 3000 bp, Unknown
  misc_feature (1)..( 3000): cDNA_ID_1819837_gDNA_ID_1620631_Annot_ID_47246 3000 nt of promoter + ATG
aggtcatttagtccatattctttttgtttgaatgaaagataataaatgatacaaaaatgcatgaactaattgtgtcaataaacttaagttttcatgtgattttcaacattataaataaatcattttgattcatttcttgtttgtagaagaaagaataaagataagagcctctttcatagtatcaatggcttccttcaaccactttgtgttactgattctgttaacagtcactcttgttttatccgctgaagcaactaaggaacgccgaccaataccatcaaaggcacaaaagaatgaaatgaagagacaactcaaagctatcaacaagcctgcaatcaagagttttaaggttggcttagccttccttaatcttacatgcttattgtttcatatctaacttctttttcttatgaacagactgaacatggtgatatatttgattgtatcgatattcacaaacaactagcattggatcatcatctactaaaaaaccactctgttcaggttttgttttatacataactaattctctctttatctactgtcttttgtattaaatgatgactctccttagagaatgacgaccaactttgtatatgtagctaaagccaacaacagtacctgaatggatcactgaaaacaacatttcagggagtattaatcttgtacaagaaggtataagctgtccaaatggaacagtaattgtaaaaaggactacaatgcaagatctgatgcatgcacaacgtttgaaatccatgggattcgacggcccgagaccttttctcacagagacaaacaacactaattcaaatggaaaattctatgtaagaacccttataagttgataccatatataccaaccactattttcttttcttgtctactttcgttttctgagtttctttgttctttatggatattaggttgcaaaaggtacctttggaccagatctttttgctggagtaagaggacacattaatgtatggaaaccgaatatcttgcaagatcaagttagtctggcatacatagcagttggtggaggggctaaagaaaatttcgccagcatttcagttggatggaaagtaagccacttctggtttcttagcaaaaactgaccatgttcgcaaatacgtctcatcaactataagttaataaaattttgaaaaatgtatatacaacaggtgaatccatccctgtactatggtgatcatgttcgtttatacgcctcttggactgtaagttttgagttataccagtaagagctagcttgcactaatagttcctttatcttctgagactcttatgtatatgtttgcttataattctgctaatagttacatggaagcaataccgggtgcaacgacatgtcatgtcctggatttgtgcaagttagcaagactatagcacttggtgccattattcaaccactttccatctataagggtccacaatatcaattgcatttgaccttgtatcaggtaaagtctactcatctctttgatcacttatcttaaaagtcatttggatttatctttcaaacattgggaacaggatcaaatcaagggagattggtggatttcatgtaatgatgaagacgttggatactggccagcatcattgttcaagtcctggagagaatctaacgccgcaagttatgcatcttggggaggtcaagtgtatagccctgtgacagagaagagtccacctatgggaagtggtcattggcctagtgagggctaccagaaatctgcttattttagacacgtccaaatgagccttggtgatggaagagtttttaatccacaaacgggtacagtgaagttatatgagaccagtcgaaactgttacaaagccagattagttcatgatcattataagccttggttaaaatctatttactatggaggtcctggaggatgcatagggtaattattgatctacaaaataaagagtagaaatatcttaaaacttttaaataggctataggaaaaaaaccacagatttgtaatatatgtaagcattacccgcgctctaatgaataatcaagaatttgaaattcacaacattcagcacaaaaactaatatgtttactgagcatagattgagtgcaaaatcacctcaaagtacaagaaaaaaacatctccttcttaactgcaaaatagtgtaattataagattaaggaacattgctatattattacgacatatatattattaactagaagctctaagttaataacacgattaaagaactgcgaactgtggtatgatgcacattctagttaacatgatgtatttcaagttatttcaagttaataacacgattaaggaactacaactttatctgaagctatcttctacagaggaccaggaaatgatgcacattttagttaacatgttcttaaatctctctgcattaagtttcctctgctttttcacttttatacatgttttcttaacattttcatttatgtttttttttaatctaaattacattaaaaaacaaaaatctcaaaagttgttaattttattgatatattaagaaaaataaatctggtggtaaagaggacgagatagagagagaatgagaaagaaaaaggagactccgtaatgaatctggcatgagttctggcaaagacagaagagaaattcaatgagaaagagttctggctaaagtttggtgacgaagaaggaaaaaagaaacacaaaaagaagaagtaagcaaaatggtaatatagaccaaaaagtcacagaagatctgtaacaaatggaaactattttggtcaaatgttattttgttaattatttgtcagtcaaggtcattagtccatattctttttatttgaatgaaagataataaatgatacaaaaatgcatgaactaattgtgtcaatgaatttagttttcatgtgattttctacattataaataaatcattttgattcatttcttgtttgtagaagaaagaataaagataagagcctctttcatagtatcaatg

SEQ ID NO: 3197 - DNA, 3000 bp, Unknown
  misc_feature (1)..( 3000): cDNA_ID_1819833_gDNA_ID_1620631_Annot_ID_47247 3000 nt of promoter + ATG
ctctttatctcctttcttttcaataaaagatgaatatttccttagagaatgatgtaatttgtgaacacattgacgtatatatacagctaaagcctacaagtgtacctgaatggatcaatagaaacatttcagggagatcatttggtcttctacaagaaggtataagctgtccagatggaacagtaattgtaaaaaggactacaatgcaagatcttatgcatgcacaacgtttgaaatccatgggattcgacggcccgagaccttttctcacagagacaaacaacactaatttcaatagaaaattctacgtaagtaacccttataaattgagagtataccaaccaccatttttagtttctactttcattttctgagttttttggtctttgtggatattaggttgcaaaagctaactatggaccagatctttttgctggagtaagaggaaacattaacatatggtcaccaaaaatcttgcaagatcaagttagtgttgcatacatagcagttggtggaggtgctaaagaaaattttgccagcatttcagttggatggaaagtaagtcacttctcgttccttagcaaaaagtgaccatgttcgctaatacgcctcatcaactataagatgcatgagtttaaagttaacaaaagttgaaaatatgtatatacaacaggtgaatccatctctataccatggtgatcatgttcgtttatacgcctcttggactgtaagttttgagttataccagtaagcgcttgcactaatattttctttatcttctgagggtcttataagttctatatgtatatgtttgcttataattgtgctaatagttacatggaagcaataccggctgcaacgacatgtcatgtcctggatttgtgcaagttagcaagactatagcacttggtgccattattcaaccaatttccatctataagggtccacagtatgaattgcgtttgaccttgtatcaggtaaagtctactcatctttttgatcacttcttttaaaagtcatttggattcatctttcaaaaattgggaacagaatcaaatcaagggagattggtggtttgcatgtaatgatgaggacgttggatactggccagcatcattgttcaagtcctggagagaatctaacgccgcaagttatgcatcttggggtggccaagtgtatagcccagtgacagagaagagtccacctatgggaagtggtcattggcctagtgagggcttccataaatctgcttatgttagcaacctccaaatcattaatgttaatggaagagtttttaatccacaaacgggtacagtgaagttacatgagaccatgcgaagctgttacaaagccagatttgttcatgatgctaagaagccttggttaaaatctttttactatggaggtcctggaggatgcatagtgtaattattgatctacgaaataaagagtagcaatatcttaaaagttttaaataggctataggaaaaaaaccacatatttgaaatatatctaagcattacttgcgctctgtacgaataataaagtttccatgaatcttcacaactttttttgcaatatgtttgatgtttatgcctaagtcaaatcatcataaattaccatcctttataaaaccaacatggtgataaccaaaaatgtgggttctactgtgcttttgtctgaaattcatctaaaagcttcttttaatcatgtcttaaatatgatgacaaaaaaaaaaatcatgtcttaaatatatatacccatatacatagcctagcttgcccctactctttacctctaaaccccttaagactaaagagtcataaagattgtcttgatgataatagcatagcttgcccctaccctactctttcacgagagtatatcaattgattcaccagttcaaaagactcataaagattctcttgatgagggaaaagattctaccaaagtgtgtttagcaactgtcatggatacttaaggctagtgaactacacacctccacacgacgtagagaagcaagaagagctcgttgaaggtctttgaaagcataaggatatgagctgcataacaatagtctatcaagattccgttggtgggcttcaaatgaggtctaaagaagggaaatggatcgatataaatccgtgtgaggatcaccttgttgttaacattggagatctaatgcaagcatggagtaacggtcggctgcgattgtctgaacatcgagttgtattgagaaagttggtgaacagagtctctctatcgtttcttctctgttttgtgggcaagaaagtgatacttgcgccacaagtatcatcaagatattgaatgcttaagtaaagcagcttatgtgagaggcatcaaaatcatcgatggttcgggaacagttttcgatccagaagtggatataatgatggtacatgaaaggagaccaaaatgttacaaagccatatatgttcatgaggatgatgagccttggttaagagctttttactttggaggatgcatagggtaataatgatctacgaaataaagagttgcaagatcgtaagacttttagatagggtataatagaaaattgacataattgatatatatatctaagcattacttgcgctctaatgaatactcataagttcacaattcagcacaaaatatcgaatgaacatagattgagtgcaaactcacccttcaagaaaaaacaaaaaaagaagaggaaagcaaaatggtaatatagactaaaaactcacagaagatctgtaacaaatggaaactattatggtcaaatattattttgttaactattcataagtcaatatcatttagtccatattctttaaatttgcataaagataataaatgatacaaaaatgcatgaactaattgtgtcaataaatttagttttcatgtgattttctacattataaataaatcattttgattcatttctggtttgtagaagaaagaataaagataagagcctctttcatagtatcaatg

SEQ ID NO: 3198 - DNA, 3000 bp, Unknown
  misc_feature (1)..( 3000): cDNA_ID_1819822_gDNA_ID_1620631_Annot_ID_47250 3000 nt of promoter + ATG
agaagatgaagaaatacttgcgatgatggtgttagaccagttcagttcggcttagatgttgttctatcaaattctacacattttacaattatgttgctaatgtttggtattggaaacacttattgacaatgttagcaacttagcatacctatgtccagttcagttatgtctctgtgatattcaaacaagattctgagcttacacatgtacacaatgtattcttccattgacataattaatgttacaagatacaatgccattgatacataatagattacacatttacactgttacaagatcaaagctctagtggtacatatagagatcatcacacatgacataggaaacaagaagaaagcatatagaattaaagattgatatattcttagcttgatgatgatcagagaatatgtaggaaactttatgtcttggacttgaaaggaatagctctgatgactatctgatggtacagagcagcaagcgcagcaccaatgaatggaccgacccagaagatccactgcagacacataaaacaaaagagacaacagataagagcagaattatcaaaaattctgagttgctatttagatgcaattcataacttatcatacttagcacaaccgttgatgtaattaaagaggaaaacttacatggtcatcccaagcatgatccttgttgtagatgatggcagctccgagactcctggccgggttaatgccagttccagtaattgggatggtagccaagtgcaccaagaagacagcaaacccaattggaagcggagccaagatctgcaaaatgttcgataaccaaaaaacacatgagctctatgtgaagaatatgaactcaacacaactcaaggatactagagaattagcaacatacagggacatgagagtctctggcacttctcttagcatcagtagctgagaaaacagtgtaaaccagaacaaaagttccaacaatctctgcaccaagacctgaaccctttgtgtaaccatgagccaccacattagctccaccgccattcgtctggtacagccctggttgaaaccctttaaccacaccagcaccacatatagctccaaggcactgcattactatgtagaacagagctctggttaaagatagcttcctcgccaagaacaaaccaaaagtcaccgccggattaatatgtcctcctgctcattaccaaaccaattcgccacacacaagtcaaaatcagattatgatcttcacacagaagaaacaaagtggggcaaactaaccaaagtttcaaactttaagaagaaaattactcaaagtttcaatctttaaatgtgaaattacttttaagtatcaaactttcttcattatatccaagtttctcacaaccaagtaaccctaattccagattccttcaacctaaattcgaaaactttaaacaaaattcagagcaagaacagatcctgaacctgagattccagcagtacagtaaacaagagcaaagatcatgccaccaaaagcccaagcgatgccttggattccaacagaggcacacatattgggagctctcttaacacccatgactgtcaaaacggtgacgtagaggaaaaggaaagtggctatgaactcagctatccctgctctgtagaaagaccaagatttgagctcgccgggttcgaaaaacggcgccggtggtggttccttatagtccttgctctccgtctgagccgccgtaccgatcggctgtctctctgggaacttgttggctccaacattgacgtcttcttctttgccttccatgtttctctctcactctatcaccaccaactttagtttgttgtctctgtaaatttgatgactggtgtatgtggaggttttatagtttggttcatttaggcaaaaataattattaattaaatttgctactaatttccaaaatcttatatttgttattcatgcaaatttctaaattatcagaaaatgtgtaaataaataaatatagttaattactaattatagaaaataaattagtgaatttagactaaattaacttaatctgtctaaaatttttgtgatagataattttaattgcaatggttgatatagagtcgcactcaagtctcttttgattgatgatttgcattttttttattgtcaatcataactcgtggtttataaacctacattttccatgtaagacttttaattcgtttaatgtttaataacggttttctatctagttagtctttgagcataatacttaaattaaaaaatgttgttttaagataagaattagaggtaggtagttgaaatggactggacaactaggcgcgaaaacgatgcatagaagaagatggacataagattaagcaactaccatataatttgttaaaacagaatatattacagctcaaatgatgtggacaattctaacataatgtttctatcaattatgtgaatgatattatagaggaaattattggatgtcaaaaatattatagatgaaagaagacacttcacatggaaaatgttcgccttatcgatctctactgtttatagatcaattcatggtttatttaagttcctttgtgtcactactgtgttttttttttatattgggctttgatctaaaaactttttttggggtcaattgatccataaacaagcttttcctttttcttatggaatatactttatacaaaaaaaagtacattaaaaaaaagagaaatcttactttagcatctacatatgggcaatagagatagagggagatacatttgtcatttactgtgtataggttctttggtggttataaatgatctcagatttatgtgacacaataaatatagttgttctgcttcattttttcttttgaaaaatatagattaagatccttgattcatcatgaggtattccaataaactaattatcttgctaactttatcaacaatagctctcattttagttggagagagtcacaaaacaataccttcgaaagaggagaaagaagagatg

SEQ ID NO: 3199 - DNA, 3000 bp, Unknown
  misc_feature (1)..( 3000): cDNA_ID_3070844_gDNA_ID_1620631_Annot_ID_47251 3000 nt of promoter + ATG
aaaaaaaaataattatctaaaaatcaagataattataagattaaaaatccattttattgtttaactaaaactaagcagaggacatatacactaagtgtataaagttcttaagacaagtaaactaaaatatgcatcctccaggtcctccaaataaaatagctcttgaccaaaattcaccaacacctaatattttttggacattataacagtttggactgcttgcgaatgtctttaaagctgaagctaacggactcgaaacttcttttgttatatcagtgattatttttaaaccattcacataggctgctttcttgaaaccctcttgtgggaaatgtccacttcccatgcttgggctcttctctttcactgaactgtacacttctcctccccaaaacacggcactcgctccatcagctaaaccttgacgtgtgaacaatgattttggccagtatccaattggctcgttatttagcacaaaccaccaatctcttgtaacatgatcctgcttaaatcaaaagttgttaacataatcttgacttttcgatattagtttgaagaaagctaatgttgtatatttatatatatacctgatatatgctgacttctagttgatattgttgaccatcataaatggaaactggttgggcgagcattccaattgcatacttggtgctcacgtgtacaaacccaggacgtagtgtattgtagcaatgagtcttattatttccatccgcctatttaaatcaaagatagtagccataatatgaatgccacatttaagagtcaagactttaagaagttttgaaaaacttacagtccagtaagtgaacaagtgactttgattattctgatttagccctggatacacctaaaaacatattttggaatgttagttccaaatttttgatttagaaaataagtaaaaatagggtctagcttgacttacaatccatccagcagaaatgctttgaaatcctttgttgcctgatacagccatagccgcaagactaaattgatcaggtgagacgtttggattccatacgttaatgtttccttttgctccatagtggtcatctttgtaactaattgtggcaaactaaaatccgaagagaaaaagaatagataatcaaaaaatattataagcattgtggacaagttacaaggcgatctcaattcaactacgtgtaataagaaatgattcttacatgatgaccagttaaatcaattttcttgtcctttgcagacacttgtcctggatagttgaatcgtaaggattgcaaacgttgagctcgtataagatcttcaagtataattcttttgacaatgactgtcccaactggacaacttatgtcatcttgtcgaaatggcagagaactagttttatgagaagcgttgttatctttggtccatttaggtatagttgtgggtttcaactgcatttatatttcaatccatccaaacattaataagaattttatttatagatattttttcgtggtttgtaggataaaccttaatagaatggttcttgagcaaaggatgatcaaaagctagctgtttttgaatgtcgatgcagtcaaatatataaccatgttcagtctgtcgaaatcaaaagcaagaaaaaattggtgtggtctgaaaataaatgtaacttgatgatagttgtaatattgttacaatagtcaacaatttttgtaatgttttatgaaaatttaagaaaagaaaggctaaatttacttggaaacttttgactgcaggtttattgagataggtaagtagcttcttcatctcttctttctcctctttcgaaggtattgttttgtgactctctccaactaaaatgagagctattgttgataaagttagcaagataattagtttattggaatacctcatgatgaatcaaggatcttaatctatatttttcaaaagaaaaaatgaagcagaacaactatatttattgtgtcacataaatctgagatcatttataaccaccaaagaacctatacacagtaaatgacaaatgtatctccctctatctctattgcccatatgtagatgctaaagtaagatttctcttttttttaatgtacttttttttgtataaagtatattccataagaaaaaggaaaagcttgtttatggatcaattgaccccaaaaaaagtttttagatcaaagcccaatataaaaaaaaaacacagtagtgacacaaaggaacttaaataaaccatgaattgatctataaacagtagagatcgataaggcgaacattttccatgtgaagtgtcttctttcatctataatatttttgacatccaataatttcctctataatatcattcacataattgatagaaacattatgttagaattgtccacatcatttgagctgtaatatattctgttttaacaaattatatggtagttgcttaatcttatgtccatcttcttctatgcatcgttttcgcgcctagttgtccagtccatttcaactacctacctctaattcttatcttaaaacaacattttttaatttaagtattatgctcaaagactaactagatagaaaaccgttattaaacattaaacgaattaaaagtcttacatggaaaatgtaggtttataaaccacgagttatgattgacaataaaaaaaatgcaaatcatcaatcaaaagagacttgagtgcgactctatatcaaccattgcaattaaaattatctatcacaaaaattttagacagattaagttaatttagtctaaattcactaatttattttctataattagtaattaactatatttatttatttacacattttctgataatttagaaatttgcatgaataacaaatataagattttggaaattagtagcaaatttaattaataattatttttgcctaaatgaaccaaactataaaacctccacatacaccagtcatcaaatttacagagacaacaaactaaagttggtggtgatagagtgagagagaaac

SEQ ID NO: 3200 - DNA, 3000 bp, Unknown
  misc_feature (1)..( 3000): cDNA_ID_2990323_gDNA_ID_1620631_Annot_ID_47252 3000 nt of promoter + ATG
ctgtactgctggaatctcaggttcaggatctgttcttgctctgaattttgtttaaagttttcgaatttaggttgaaggaatctggaattagggttacttggttgtgagaaacttggatataatgaagaaagtttgatacttaaaagtaatttcacatttaaagattgaaactttgagtaattttcttcttaaagtttgaaactttggttagtttgccccactttgtttcttctgtgtgaagatcataatctgattttgacttgtgtgtggcgaattggtttggtaatgagcaggaggacatattaatccggcggtgacttttggtttgttcttggcgaggaagctatctttaaccagagctctgttctacatagtaatgcagtgccttggagctatatgtggtgctggtgtggttaaagggtttcaaccagggctgtaccagacgaatggcggtggagctaatgtggtggctcatggttacacaaagggttcaggtcttggtgcagagattgttggaacttttgttctggtttacactgttttctcagctactgatgctaagagaagtgccagagactctcatgtccctgtatgttgctaattctctagtatccttgagttgtgttgagttcatattcttcacatagagctcatgtgttttttggttatcgaacattttgcagatcttggctccgcttccaattgggtttgctgtcttcttggtgcacttggctaccatcccaattactggaactggcattaacccggccaggagtctcggagctgccatcatctacaacaaggatcatgcttgggatgaccatgtaagttttcctctttaattacatcaacggttgtgctaagtatgataagttatgaattgcatctaaatagcaactcagaatttttgataattctgctcttatctgttgtctcttttgttttatgtgtctgcagtggatcttctgggtcggtccattcattggtgctgcgcttgctgctctgtaccatcagatagtcatcagagctattcctttcaagtccaagacataaagtttcctacatattctctgatcatcatcaagctaagaatatatcaatctttaattctatatgctttcttcttgtttcctatgtcatgtgtgatgatctctatatgtaccactagagctttgatcttgtaacagtgtaaatgtgtaatctattatgtatcaatggcattgtatcttgtaacattaattatgtcaatggaagaatacattgtgtacatgtgtaagctcagaatcttgtttgaatatcacagagacataactgaactggacataggtatgctaagttgctaacattgtcaataagtgtttccaataccaaacattagcaacataattgtaaaatgtgtagaatttgatagaacaacatctaagccgaactgaactggtctaacaccatcatcgcaagtatttcttcatcttctttcttctataagagtctttcattttccactttttataacatgcttataactgaattttcaacttttgaatcacagtttcagttatagatattcttggatgatgttcagttcggggttttggttttggttttggttttggttgatagtcatgaaaatgcatgttctgttccacatggtagggttccagtaaaataataaaagaaccagatttagtaacatctttcacatgaatgataacatatttcacatgtttgatgcagcaacttgtaatatggatgatagtcatgaaagaatctaatgggccaagaaatgtgaaagagtctacatgactatcatccaaaaaagagttgtagcaatatggatgggccaagaaagtgcaagacttcagcttgagcttgactttaagagaataagtaatttgcatttgccctttggtcatgtagtactcgggttgtttacatttatcaaacaaatatcagagttgtttattgttatttgggaaaatctttaaactttctacataatctttgagactagtgggaattaagagtggtgatgtagtggatcaagattaaaaaaagttgattgtttaaaacatcgagtatcttgcaatacaaaacaaaacccttaaaccaatcaatacgaaaaagatgaagatgtcaactttccttttcaaaaatatgcaagtttgaatccggatggtaacatactgatgttactagttacacaaatatctaggctagatgtcctaatcatcttcaaaatattttgttgatgttttatcttaaataatcaaagtttttcaattattgtgggtgttgtatatatttaacataatcttaatccataaacaaaaagtaatataaaggtgttgcgggaaaaggttacttaatggttaagaagtttggcttatgatcatcccactttgtgaagtatggcatgaactttctttttaccgatattagagccaaatgaaagcggtttcttaatcgccaagttccaaccaaaaaacaaaaagcccacatttacgaaaaatactcttaaaccaacattttgaattcatatgatacaaagcttcaaatatccaaatcgaggaaattattttttaaaaaaaacaatacataacttttaaatataaattgcgaaaaaaggtaaagccactcatcaaaattcaaaagtgatgagattaaagcaagtgaagacgcatacattatcacattaaaagtagcaaacacaccaagaaattagataaaaagataacaaaataattccatccactttctttttcttttgttttgtcaagattttgttttttgtatttcagtcatacgtgtgaatgtatatcaacaacattgtttttaatgtataaaaatctcaactactataaagtagctgaatgatatgtgattaagatatatatcgagagagacaagccagcaagaattttcagcacacatacacacacaaaagattcaaagaatcatctagtaacaaataaaaaaggagagagaaggaaaatgaacaga

SEQ ID NO: 3201 - DNA, 3000 bp, Unknown
  misc_feature (1)..( 3000): cDNA_ID_1819804_gDNA_ID_1620631_Annot_ID_47257 3000 nt of promoter + ATG
acggttagcgaatacacgatacaccgtgtttcacatccttcttgccgatggaagatgacaaacccagctgagattaataccatcgtcgtctacaagaaacccgaccctcatctatgggaaagggtaagtaaaatatcatcacttttagcatatgatttatatgtgattaatgttatgtacttaatagtttttgtgtgtgttttatgtacagtcacctaggaggaattgttgcagagtattacaaacaaagaggaataatacgttatggatcaatgttggtgtatgtagagcaggtgaagtcactgaagttaagtaattttttaatatagtttatttttgtgaaagggaaggaaattagagtttttttaggctgttttaccgctcttaatttcttgccacgttatttaaaatttttattcattgagatcccgccctagttcttctctcagtatatgatcgttcataaaagaactgctctcaaatacaatttaccgatcagaatctaaaagtcatcacttcaagctctttatcaggacaaaatgtttttcctgtatatacggtgcgtgaattgtattggactctgtagtctgtactttcgaaaaagagagaatttaaaaggaaaggaaaaagtcatgaaatctcttagtccaagagggacgtttcagaaaacaacaacaacatgcgaggtcaaaatctcatacaaacaacgacctcaaaacaatcagcgaacgttcaattcttgacccgtaacaagacagcattaaaaaaagatgaaataaaattttccaatcgggagagaaaacaggcaaagagtgatcactttgggtaagcgggaggaggaggataagccccaggagggtattgagaataagctgagggaggagggttttgaggatagccagaaggtggataaccttgtggagggtgttgaggataaccagaaggtggataaccttgttgtggaggataaccgactgcgggtggggtggcttgatcaaaccgtgacatttgctgagccggaggcactgccattggctgtggcccgaacttaccgtccctcttgtccatttccatcttgtgttgtgtctacaaaagtattatagatattaccgtaagtgtaggatttaagtaaggagagattggaatgggttgatatgatatcatcactgctcgtacctgcatacatgcgcaaaccctgcagaccaagcaaagtacgatatatcaggacaataggttaaaattgggttttgatcgaaacttataagaatggcactttggatgggggattcttacgtgcagtacaccatgtcagagcaacatgtgagtatctgagaagcttctgaaagctcatccataccgacaatacatgcaactatggagaatatgcaagccacttggctgaggcaaaccatgaaaccctacacagccaaaaagccagcacagattacgaaacttgtttatcgtgtttgtaattgcttgtgagtgtcagtaacaggcatggtctgggcaatgaggatacttacaatgatgcagttgtcacattttgtcgtttgaatttggaactcatcttgcagaagaaagcgagttgaggccacagagtttgcaaagcagcagaagacctgcgattgatctgctatttagaagaccagaaatttgctaaaatttcgcgaggttgcctcacaagtcacacctaggtatgactgagattgtatgcatatgctacaggaagcattcagatgctgaaatcgaaatttctagactagctgtgtctatagaaaagacttcatttttgttgtccaaaaaaaaaaaagacttcatttgaagataatagctaacaaaatcaagtttcttacctcagtggcaagacaaagttgaggacatttggcttctccacacctaccactacaaggcatgtaaccggcacagcagacgtacctgcgagacaaaaaaaacaatcttcttaaactaagaagatggaattggaatggagctatatgaaagtgactgaatgtgtgatataccttgacatatcatcgtaaagcgcacgcttgcgaagcaagtatgatgcacaaggggcactgcaatgagaagaagaagaaacaagacatttccatatgtatgctaaacatatcagacccaaagagatacacaaatcatacaatgtcaaactcctaatgcactgaaattatcacatacaatgatcagagaaactcatattatctgtgaaattcagatcactccatacacatttcttgatgaaatgaaaatcaagccgatctaagaatttaaatcgaagtcaactcttggtcaattcaaataaaccaagatccgactactacaaatatccaaattccaaatacagagagaacaagcaacgaaaaatctcagatcaatcgaaacttaccaccacaacgcgaagcaacaatctgcgaacaacacagaaatcgatcaaatcaacaaccaaaaccaatccaacccacaaatttcaaaaagagagagtgagaaattacaaggagtatcgttctggatactgtgggtaagatcggtatgccaaacattacggaagttcttacgaagctccatcttctccatatcctgtttcggcattttcacaaggatctgatttcgacgacgaaatgaggtcaagcgagagagaagcgatttaaggatcagagactcttcgcgaaaagtctttgagaatctgatccacaatcacatctaaaagctgttctctcacaaacgtgtttctgacttcatctctctcatatcgacaacttgagaatacaaattcttcttctcccctcccctggatggcaactggcgttgactagacgaagtcacgaggcaatttcgtcaaatatcaataatactagggttaaactgtaattagttttattttaaccccgacctattactttttgcaatttcgtgtctttgtgtctcttgtcactgatcgtctcggaggagaagaagtgtggaggttgaagaagggagaaaatg

SEQ ID NO: 3202 - DNA, 3000 bp, Unknown
  misc_feature (1)..( 3000): cDNA_ID_1819796_gDNA_ID_1620631_Annot_ID_47260 3000 nt of promoter + ATG
tagggattttacatggaccgatttagttaaaggctcgtccgatccaacaactataatgttaggccatactaattacaaaaaaaaggcccagttctgcagctagtccgtgcaaaatcatattaaaatcatatactactcgaaatttcataaacaacactgaaggaaaacataatttccctaggagattgaagctaaagacgaccacagtcaaccatgcggttcaaaaacggattggactgaaacacaaccttttaaacagaaaactaaaataaatccaacataaaaccatagaccatgcttgcaagagatccaaatacatgaagactttttgagaacaataaacctaaaccaaacggagaccaacacaatggagatagattccttttacgacgaatagatactatctcacgaatcatataatcataggtttgtaagactgacaagatagaccaactagagatcatccagttttatgaaaacagcgatgtcgttgagatacgacaaatgaaaacgcctctgcaaaagactattgaacagtccaacactctggacagtattagctccatacatttgcattgcattcaaatcatctaaaaacataaatatgacatgatatatggtttgactcttgatttgagcaattaggtgtataaagtggctttaataaagattaattaggtgtaattaagtacataatctacctacaaaatgttaattatattaaatattaacgtattaataatgtagttaatggaatggctccttcgtatagtctatagctgtcctaccagtgcccttcccacccaactaattctagtggacaaaacgtatgctcctgtgtactgttccatgattccatcatattttcttaataaccttttttgttaattttatgcggacgagttttggttgcttttctagatcacaatgagcagtctagagttggagatatttatatgattgatatttatcttgctatagtatatatatgattctgactggtacgtggatgtgaaccatctcctcgaatttttcatgcaaatacatatgtagataaaaccgaacgaggtagttgaaatgaacgatttacaaattgttaaaaaatggagttaaaagataaaatgataattatgaatatttacaaacagaatctgaacaataaacccaaacacaatcattaaaataaactatgaaggtcctaataagaaatgatggtttggtacaaacatatatatttaggaaattttctctagttagactttcccatttatggataatctggaaatgtcatttttgtgaggaattaatctttaattagttagccatttcccatttaaagagaaacaaggcaatttcatttttcttttagttgcaatcatagtactcttcgatttaaccccactatttacgatactttaattttctagtcccttcactaaatgataaaaagactgatatgaaaattaaataatttaataaaggttcggcccaacccacctggttctgtcgattaattaatagcctataatttgttcagaagatgtgttcgtaagctagctgctcaattttaatcatcttcatgcatattttatgttgtatattaacaaattataacaaatttgtaaactaaaacatttaaaatcatctctaaaagcttatcaaaatcataagttcgaacatttgaatatatatttatgagattgtatatatatcactcttacaagttacaatctctactaccatctctatttagacattagagtaaatgtacttacgagattatacctcttacactacgtctacaatcgctaccgccacctctatttaagcttctctgtcttacaatatcttgcttagtactcagcattgtctgattaagctgtcgtacaaaacaagtcagctatttagttagggtttggtcggcaattaaataatctatcaacctaattggctctcaatcggaaaatgagccgaggtgggagctttggaggcggacaaagctcgttaggttatctttttgggtcagacaatgagattccaaaaactcccgctccaccggtagccccaaagcctgcaccaccgtacggtgtagattccacagaggaggaccatgaagctgaccaaaaacccaagatctctaacaacaactaccaaagagttcagggccaaaactccggcaacttcgtcaccgtaagtctttattaattaaactccactttctttctttttccgaaaagaaaattaaacaaataagggttataattaaaatttcaggatcgtccaacgacgaaggtgaaatcggttcctggtggaggctcatctctaggatacttgttcggagataagtgaagaaatgaaaatgaagttaaaaaactagggtttgtatctctctagtgaggcttttactctatatcatacgtacgtaatgtaatgtggagatccctatctagatctctacacatcacttatttatatttacgtatgaaaatgtgtgttttgagttaacagttaattactttcaacttgtggaaaaagggtttctagtcaatattttcagcaatatatatgtactatataagtattgaacattggacattaactgatctgtccttgcattacgtgattaagtgaagtttcttcactctttagtatatcggaaagtgaagcttcttcttttgcacatgggtgatgggtatacattttataactcggatcattcgtgaaacctagatattaacagaaaagaaaaaaaaaaaaaaaaaagacatagataactttcaaaaatgtaacgaattaattttcttgtcatatttacaataccaaatgtagaaacactagatgagggcttgatctcttatcccgactaacaaaacaaatttttacttattagctcactatgtttgctaaattgtataaaaccgaaaaaaaaagcagaattttataaattacactttgtttattttgatgtttttatcataaataattacgtcatgtaccatg

SEQ ID NO: 3203 - DNA, 3000 bp, Unknown
  misc_feature (1)..( 3000): cDNA_ID_4254584_gDNA_ID_1620631_Annot_ID_47261 3000 nt of promoter + ATG
tttattatccatatatatatatatatttgttttattttaaaatcataatattatttttagatagtttattttcttttttaatttatccaatcatatactttatgcatattaaccggatttttaataaacttgccaccttctttcttctttaaataaatttcattttctcttgctctccaatcccatacgtctccatgatcttccataccgaaaagcttgaatgctgtaaaattctgataatgtctgtaattaggcccttgtttcaaagtacacataaaacgcgttgtacgccaaatgttaacactaaaataagttacaaaatgccctccgattggtattatttttggacctaatacatcatctttggaataacacctcatccagaggagtttttggaatttaagttcgttcccgatcctaattccggctcccgatacatgatcaaacatgcaaagactaaaaacaaatataaaaactaaaagatttttcatttattttttacttttttgtaatgtttggatttttgggtttgttaacttggtttttgtgtttctcgtactttatatacacacacatttgtattggtattggtacacaatttgtttcagtattagtttccaagtttcaacatagaatgacataatcaatcatgtatatcgtgattgatatccttaatatatatggcataagattttatatagttacatgtgaagatatctataataatcatacttggtaatgaagatatccttaatattagtatattataaaaatctatagaaattgaattttgaaagaaaagatgaaatcaagaacccaattttggataatactggaaagattatacggggagatcaaatgataatcaattaaccaattgtgcataatcaattgataatactggaagttcaaacgtattcaattatacatcacctattacaattttacaacataatcaaatgataatatctttttttatctggaaacaaaaaatctttccaaaatttatttatcaaatttcattcctttttaatcagttaattataccgatttttttttttaaacgtgaatatattaattagtattaacatagttttacataataaaagcaaaagtgggaagggaaaatccgttttataccataaaaacaaaagtgcgtaggaaaaatccacaaaggtaataattttttcttcaaaatatccttattaaataaataaaaacaatttaatcgaaaatctattattgtgttttacgaattaatgaaagataacaaaaaaaaaaaaaactatttccgaagattatgaatcataatgataaatcgtctgatgattatgatttattatgatcaaaaatctatttttggacctaatacataatcttttcacattgttgttcactttaagaattgtaaatataaaacacatcaatatgttactgtaatattttggctgttataattgcttaaaatatagttattaagtacaagtgtacaactaaaatcatagtaataatttatatttctattactataaatgtaaaaatattacaaacacactaatatagtattataaatacatacacatctgtatatatatttttctgaatgcaaatttattaataaaataaagtacatatgtacaaatgttaagtggaaataggcaaagctagagaaacagagcaaccaacgaaacatcattagagaagccgtccctatgagaattaacgctattggatatacatcatagtttctcaattctcataacattatttttctacaatttacattatttactgttagaagtttgtgtgtatacgtatgtgtgtgagttttttttaaattataaattcgttggttccaccgcgttggttttgttagatcccttcagattgattaggttaatttagccctattaggtttagtttggtgttctttttgactttaggtttttgataggtagcttggaagggtttagttagagattttgactacgaattctttagcaagagatgaaaagtctcaactaccaataactaatcttttcatttaacatattctcatagaccccatgtgcatgtatatacgtaataagctaagatatttttaaccgttacagaatttgactaacgatactgaacgattagggtaagtatttttttgacatgtataaattaatacttattaacggcatcattatatgttattatgttaagttccgaaatagaggcaaggttcaattaggtgggtgggagtgactcagtaaaccattgtggctctagttgtatataactttttcttcactatataatttcactaaaattttgttgatttatgacatggctatacaattttgttgatttatctaagagttgtatagccatgtgatatatatacatttataaacaaggttacattatttagttttgaaatttatttatgtgatatacactaacaaacattttctttatttgatgacattctcacataatttaatagatgaggataacaaaatcttcaacgcaattgctcaaatgggggaagtctcatcctacaatgctggtttcaaagtcaaagaagttagcggttgcatttccaattttttttgttgctcaatcaattgaaactttacccatagcatttccttgtaaggcattgttgtatttaagtttttctttttataaaagtatataagtttaaaaaaaaaaatcaaatcccttagaaatacaaaaattattgataaagttttttttttcgtttctaaatgattcaaaactattccagtcttcttataagttagaagtattatattacttagactcaaattccgcaatgatcgaataacattctctaaaatatataaaccgtatcctataaaaaacaaacaaaattaatgctattacaattcgaactatttatgttgttcccttatataaagaaactcttcctttcataccaaaaaaaaaaaaaaaatccattttcatttctcctcttaaaaaaccgcc

SEQ ID NO: 3204 - DNA, 3000 bp, Unknown
  misc_feature (1)..( 3000): cDNA_ID_2105430_gDNA_ID_1620631_Annot_ID_162696 3000 nt of promoter + ATG
tacaattttcgaagtgggatttaagtattggctgaaaagggaccgtatgtgatacaagctaatgatgtgtgcttttttatgtcggcttgcacgccacgattactctgcccattatccgtgagctagcctcagcaatagcatgaacccattacccatgatatatcttctcccacttcttataatttgtttttattctattttgtttgtagttattttatctttcttcatagactcatatgcaagaataagtataatagtattttctattttgataaaggtataactaacggaaataagcggaaatatcaacatgcttcatctttaccgtttacatattgtatagtgcaaggctatgcatattgcttgatattttcaacaactttttagaaagagtttacgtttctttaagcattttccatcattttgtttgtatttttcttccttttgttatatggtctatacgtgcatattaaacgtacacaacaaacaggatagaactatatcatattactataacggattagtgtaacataactttttagtgatatagaatctttgatcctttagtgaaaaaatgtattattttgtaccacgaaagtggggttgttgtaataataattgggaaaagggaacttctcaagtcacgggaaattgcgaagcaaccgaccaagcattttgatcgatagtggtggagtgcacgagagataaagagagagaattattttcatattgtatttaataataatacccgaaaaaagtaacaaaaaaggaattaaacaaatatcagtttgacagttttttttttcttttttttttttttgacaatgttcgacagtttatatacaatccattatgccaaacttagctcgaaactttttttttttttttttttctgttttctccttcttactcagttaaaagaatttgtatattgtagacatgttttgcattgcaaagtcaatcctgaatttaccgtgaaccatttttctaatctaaaatgtgaaaatgtttttgcaataaacaaacaatggatagggattttacatggaccgatttagttaaaggctcgtccgatccaacaactataatgttaggccatactaattacaaaaaaaaggcccagttctgcagctagtccgtgcaaaatcatattaaaatcatatactactcgaaatttcataaacaacactgaaggaaaacataatttccctaggagattgaagctaaagacgaccacagtcaaccatgcggttcaaaaacggattggactgaaacacaaccttttaaacagaaaactaaaataaatccaacataaaaccatagaccatgcttgcaagagatccaaatacatgaagactttttgagaacaataaacctaaaccaaacggagaccaacacaatggagatagattccttttacgacgaatagatactatctcacgaatcatataatcataggtttgtaagactgacaagatagaccaactagagatcatccagttttatgaaaacagcgatgtcgttgagatacgacaaatgaaaacgcctctgcaaaagactattgaacagtccaacactctggacagtattagctccatacatttgcattgcattcaaatcatctaaaaacataaatatgacatgatatatggtttgactcttgatttgagcaattaggtgtataaagtggctttaataaagattaattaggtgtaattaagtacataatctacctacaaaatgttaattatattaaatattaacgtattaataatgtagttaatggaatggctccttcgtatagtctatagctgtcctaccagtgcccttcccacccaactaattctagtggacaaaacgtatgctcctgtgtactgttccatgattccatcatattttcttaataaccttttttgttaattttatgcggacgagttttggttgcttttctagatcacaatgagcagtctagagttggagatatttatatgattgatatttatcttgctatagtatatatatgattctgactggtacgtggatgtgaaccatctcctcgaatttttcatgcaaatacatatgtagataaaaccgaacgaggtagttgaaatgaacgatttacaaattgttaaaaaatggagttaaaagataaaatgataattatgaatatttacaaacagaatctgaacaataaacccaaacacaatcattaaaataaactatgaaggtcctaataagaaatgatggtttggtacaaacatatatatttaggaaattttctctagttagactttcccatttatggataatctggaaatgtcatttttgtgaggaattaatctttaattagttagccatttcccatttaaagagaaacaaggcaatttcatttttcttttagttgcaatcatagtactcttcgatttaaccccactatttacgatactttaattttctagtcccttcactaaatgataaaaagactgatatgaaaattaaataatttaataaaggttcggcccaacccacctggttctgtcgattaattaatagcctataatttgttcagaagatgtgttcgtaagctagctgctcaattttaatcatcttcatgcatattttatgttgtatattaacaaattataacaaatttgtaaactaaaacatttaaaatcatctctaaaagcttatcaaaatcataagttcgaacatttgaatatatatttatgagattgtatatatatcactcttacaagttacaatctctactaccatctctatttagacattagagtaaatgtacttacgagattatacctcttacactacgtctacaatcgctaccgccacctctatttaagcttctctgtcttacaatatcttgcttagtactcagcattgtctgattaagctgtcgtacaaaacaagtcagctatttagttagggtttggtcggcaattaaataatctatcaacctaattggctctcaatcggaaaatg

SEQ ID NO: 3205 - DNA, 3000 bp, Unknown
  misc_feature (1)..( 3000): cDNA_ID_3434600_gDNA_ID_1620631_Annot_ID_162694 3000 nt of promoter + ATG
gcattgcattcaaatcatctaaaaacataaatatgacatgatatatggtttgactcttgatttgagcaattaggtgtataaagtggctttaataaagattaattaggtgtaattaagtacataatctacctacaaaatgttaattatattaaatattaacgtattaataatgtagttaatggaatggctccttcgtatagtctatagctgtcctaccagtgcccttcccacccaactaattctagtggacaaaacgtatgctcctgtgtactgttccatgattccatcatattttcttaataaccttttttgttaattttatgcggacgagttttggttgcttttctagatcacaatgagcagtctagagttggagatatttatatgattgatatttatcttgctatagtatatatatgattctgactggtacgtggatgtgaaccatctcctcgaatttttcatgcaaatacatatgtagataaaaccgaacgaggtagttgaaatgaacgatttacaaattgttaaaaaatggagttaaaagataaaatgataattatgaatatttacaaacagaatctgaacaataaacccaaacacaatcattaaaataaactatgaaggtcctaataagaaatgatggtttggtacaaacatatatatttaggaaattttctctagttagactttcccatttatggataatctggaaatgtcatttttgtgaggaattaatctttaattagttagccatttcccatttaaagagaaacaaggcaatttcatttttcttttagttgcaatcatagtactcttcgatttaaccccactatttacgatactttaattttctagtcccttcactaaatgataaaaagactgatatgaaaattaaataatttaataaaggttcggcccaacccacctggttctgtcgattaattaatagcctataatttgttcagaagatgtgttcgtaagctagctgctcaattttaatcatcttcatgcatattttatgttgtatattaacaaattataacaaatttgtaaactaaaacatttaaaatcatctctaaaagcttatcaaaatcataagttcgaacatttgaatatatatttatgagattgtatatatatcactcttacaagttacaatctctactaccatctctatttagacattagagtaaatgtacttacgagattatacctcttacactacgtctacaatcgctaccgccacctctatttaagcttctctgtcttacaatatcttgcttagtactcagcattgtctgattaagctgtcgtacaaaacaagtcagctatttagttagggtttggtcggcaattaaataatctatcaacctaattggctctcaatcggaaaatgagccgaggtgggagctttggaggcggacaaagctcgttaggttatctttttgggtcagacaatgagattccaaaaactcccgctccaccggtagccccaaagcctgcaccaccgtacggtgtagattccacagaggaggaccatgaagctgaccaaaaacccaagatctctaacaacaactaccaaagagttcagggccaaaactccggcaacttcgtcaccgtaagtctttattaattaaactccactttctttctttttccgaaaagaaaattaaacaaataagggttataattaaaatttcaggatcgtccaacgacgaaggtgaaatcggttcctggtggaggctcatctctaggatacttgttcggagataagtgaagaaatgaaaatgaagttaaaaaactagggtttgtatctctctagtgaggcttttactctatatcatacgtacgtaatgtaatgtggagatccctatctagatctctacacatcacttatttatatttacgtatgaaaatgtgtgttttgagttaacagttaattactttcaacttgtggaaaaagggtttctagtcaatattttcagcaatatatatgtactatataagtattgaacattggacattaactgatctgtccttgcattacgtgattaagtgaagtttcttcactctttagtatatcggaaagtgaagcttcttcttttgcacatgggtgatgggtatacattttataactcggatcattcgtgaaacctagatattaacagaaaagaaaaaaaaaaaaaaaaaagacatagataactttcaaaaatgtaacgaattaattttcttgtcatatttacaataccaaatgtagaaacactagatgagggcttgatctcttatcccgactaacaaaacaaatttttacttattagctcactatgtttgctaaattgtataaaaccgaaaaaaaaagcagaattttataaattacactttgtttattttgatgtttttatcataaataattacgtcatgtaccatgtttaatacaagttgttttaagaaaaaaaaaatcttcggtacgttttcattcaaatgtatttgtcaaagacgcaaaccagctaaatcaatggactatatctctggacctgaatgaaattatatattaaatatgcggcaaatatgaaataatgaaaaagtacgaggctattttataaaattatttaattaaaccaagagtcccggaccttctcaaaccttcctctgcctttgaaattatccaaactaaaaacaaatctgcgatcagtcttcactgaagaaaagctttcgcaaaagaagaaaccgagacactcatttgaatttgctcagactttgaaatctggtaattatttccatcttcctcttgtacgttaataatctctgttttctcatttaatactacgattcttgaagttcttgatcattcaattccttgtaatttaagaataattatttgattgtagttggtggtttatagtctctcaagtgttgcaagagatctgatcatatgttactctactgttcttgtttgcttgatagatatatattgagatcaacgtagaacctaacctcatg

SEQ ID NO: 3206 - DNA, 3000 bp, Unknown; identical to SEQ ID NO: 3201
  misc_feature (1)..( 3000): cDNA_ID_3070840_gDNA_ID_1620631_Annot_ID_162690 3000 nt of promoter + ATG

SEQ ID NO: 3207 - DNA, 3000 bp, Unknown
  misc_feature (1)..( 3000): cDNA_ID_2142850_gDNA_ID_1620631_Annot_ID_162689 3000 nt of promoter + ATG
tcaacaaaaactcattcggccttgcagctgtcggatcacttcaggtaatagtagttggatatgctctacatctacgcctattatatatcctggattcctgaaactgatgtccaggttttgtactattataggttccgcctctgcaacccggagcatctgccaggacaatgatgccaatggtattgtcccaaaacatgtctactggctccaccagctcggtattgcaagttgccgtcaaaaacaaccagcagcctgtctggtacttcgaggataagattgtacttaacgctcttttctcagaagatggtcggatggagcgcggaaccttcctcgaggtaaaagactaatatatgataaagagttcattaacaatacagcaccatgttagtcattgactaatagtggagagggcttatgatattaagatgggcgagtaattagtgacagattttgtgccttaagaagcctgggggagttagggtgctgtagatcttaacatatgatatggttttcatcgatttaagtttctagactcagtaagaactgaaggaagatattgatttctgatcataactatataccacagtcttaaaaaccagttcttctgagttataaaacatttgtttttttgattagacatggaaatcgttaccggattcaaacgaggtgcagaaagaattccccgggataaccatcacgagcgtggagtcaacacttgatttactcgccgcatcaaacatgttcttcatagcaaagcgtaagaatgggaaccaagacgtcctctatctttcggccaaggtaccaagaggcataccgttcctgatcgaactaacggccatagtgggtcaacctggtctgaaatgtgcagtcaagactccaacccctgagatcgctcctctcttctttgaagcagtcgaaattctcttcaaggcttgatttgattttacactgccctaaggtaagcaaatttcttcttttagtgtatgtagtaagtgaattgttgccgacttcttgtttctaatttttgtgttggaacccactcgtttttttattctcgtaagagctttgatttttgatgttgtcgttgcgtatatgccccaaaaggtttttgattaaactagtgtgataatgacttattatcagcaaatgctatttttagtgttcagtgaccgacatgaaatcaaaaagtttcctaagtggagcgaagagattcgtacacgtaaaccagttgagaatttggtaccttcttcacaacagataggcgtagatagatagatactgggcccgtaatgcgacgtagcaatttcctaatatcaatatcaatcatgatttcctgtaacatgcggttacaaaatagcttcgtcgaaactaatcttcttttaattatcgattgattattaaatcaattcaaaaccaaaactaattgaaaattttaaagcttgagggggactaatagtaacgtgagattgaagtaatgccaccgaatataagggttgagtaagggcgctacacgccatcacataaaagggattatactatcaatcaactaatatttttgtaacttaaaatgaaataccaaagtttcgacattattggtttatgaaagctcaccattgtattttaatttgatcaaaactatacattttagttgagaccgtaagtacaacaaaggtccaagcttgaaaatacttttttagacaattttatcatttactaaatagaataattattatttgtccccaccaagggtttatactttatatcagtttatctgtagataatgttttaaatctgttcatatccaatattttactaaatataaaaaaattgtttttctggttaatcagtttttaattttattttgaaccaaaagtatgaatcataatttttagatttaagatactataagtagtgcaatcattaatttaaaacttgcttatatagttataacttatatggttaatattgtatatcccataaaataatactaattaccttggtggtcaaatcatgaaaatcttattataaaagggctaatgggaaatattcttaagaaaatccagagtttccttgtacgatatggtttgtgattaatgaatataaatacaaaaaagtttgattaacaaccaaaataacaattaaagtaaagaaaattgtgatcccttgattttatctctctgataaagtcgcctctttcgtcgcagctagtcttcttcgtcgccatcagaaaattctcattcaacacaaaacctcaaaaagttttcccagaaatcctatcaaaagaaggactatatcaagcttctgtttctgttttttaggtaactaatgatttttttcttctccgttacaaaagtcactttatatttttgttttgtaggatcactaactctgtttgtgaggttcttcttttctgttttcgtttgttctgtttggttgttctgagattttttttttttttttttttacttctgtttcagcccacttttttagtttccaggttttactgttttttatttttttaaccactctgttttcagttcttcgtctattagggtttggtaactaatagtatctctgttatggtaaaccaagttttttttttcatttgaaagctcaagatgttcttaggatcatatgattttccatgagtattcaacatgaaatttactttcttcataatgaacctcataagtacacgagagtctttaatcttatatttgtcatcacaatggatacacatatttgtattgctttaatctctgtgactattattctctcattgttagtgtatagttagctatgttacattgaagtacttgtggtgtttgagtttggttttccagttacttagtatgatcacagagctagattttgcctcccattagagtttcaattaggagtcttatgaattttttctggatactacaggtcttttggtaacctaaagagctgctatacactgatctgagaactgtcaaaactttatcataccaaagaatg

SEQ ID NO: 3208 - DNA, 3000 bp, Unknown
  misc_feature (1)..( 3000): cDNA_ID_2142838_gDNA_ID_1620631_Annot_ID_162685 3000 nt of promoter + ATG
tcttgtttactgtactgctggaatctcaggttcaggatctgttcttgctctgaattttgtttaaagttttcgaatttaggttgaaggaatctggaattagggttacttggttgtgagaaacttggatataatgaagaaagtttgatacttaaaagtaatttcacatttaaagattgaaactttgagtaattttcttcttaaagtttgaaactttggttagtttgccccactttgtttcttctgtgtgaagatcataatctgattttgacttgtgtgtggcgaattggtttggtaatgagcaggaggacatattaatccggcggtgacttttggtttgttcttggcgaggaagctatctttaaccagagctctgttctacatagtaatgcagtgccttggagctatatgtggtgctggtgtggttaaagggtttcaaccagggctgtaccagacgaatggcggtggagctaatgtggtggctcatggttacacaaagggttcaggtcttggtgcagagattgttggaacttttgttctggtttacactgttttctcagctactgatgctaagagaagtgccagagactctcatgtccctgtatgttgctaattctctagtatccttgagttgtgttgagttcatattcttcacatagagctcatgtgttttttggttatcgaacattttgcagatcttggctccgcttccaattgggtttgctgtcttcttggtgcacttggctaccatcccaattactggaactggcattaacccggccaggagtctcggagctgccatcatctacaacaaggatcatgcttgggatgaccatgtaagttttcctctttaattacatcaacggttgtgctaagtatgataagttatgaattgcatctaaatagcaactcagaatttttgataattctgctcttatctgttgtctcttttgttttatgtgtctgcagtggatcttctgggtcggtccattcattggtgctgcgcttgctgctctgtaccatcagatagtcatcagagctattcctttcaagtccaagacataaagtttcctacatattctctgatcatcatcaagctaagaatatatcaatctttaattctatatgctttcttcttgtttcctatgtcatgtgtgatgatctctatatgtaccactagagctttgatcttgtaacagtgtaaatgtgtaatctattatgtatcaatggcattgtatcttgtaacattaattatgtcaatggaagaatacattgtgtacatgtgtaagctcagaatcttgtttgaatatcacagagacataactgaactggacataggtatgctaagttgctaacattgtcaataagtgtttccaataccaaacattagcaacataattgtaaaatgtgtagaatttgatagaacaacatctaagccgaactgaactggtctaacaccatcatcgcaagtatttcttcatcttctttcttctataagagtctttcattttccactttttataacatgcttataactgaattttcaacttttgaatcacagtttcagttatagatattcttggatgatgttcagttcggggttttggttttggttttggttttggttgatagtcatgaaaatgcatgttctgttccacatggtagggttccagtaaaataataaaagaaccagatttagtaacatctttcacatgaatgataacatatttcacatgtttgatgcagcaacttgtaatatggatgatagtcatgaaagaatctaatgggccaagaaatgtgaaagagtctacatgactatcatccaaaaaagagttgtagcaatatggatgggccaagaaagtgcaagacttcagcttgagcttgactttaagagaataagtaatttgcatttgccctttggtcatgtagtactcgggttgtttacatttatcaaacaaatatcagagttgtttattgttatttgggaaaatctttaaactttctacataatctttgagactagtgggaattaagagtggtgatgtagtggatcaagattaaaaaaagttgattgtttaaaacatcgagtatcttgcaatacaaaacaaaacccttaaaccaatcaatacgaaaaagatgaagatgtcaactttccttttcaaaaatatgcaagtttgaatccggatggtaacatactgatgttactagttacacaaatatctaggctagatgtcctaatcatcttcaaaatattttgttgatgttttatcttaaataatcaaagtttttcaattattgtgggtgttgtatatatttaacataatcttaatccataaacaaaaagtaatataaaggtgttgcgggaaaaggttacttaatggttaagaagtttggcttatgatcatcccactttgtgaagtatggcatgaactttctttttaccgatattagagccaaatgaaagcggtttcttaatcgccaagttccaaccaaaaaacaaaaagcccacatttacgaaaaatactcttaaaccaacattttgaattcatatgatacaaagcttcaaatatccaaatcgaggaaattattttttaaaaaaaacaatacataacttttaaatataaattgcgaaaaaaggtaaagccactcatcaaaattcaaaagtgatgagattaaagcaagtgaagacgcatacattatcacattaaaagtagcaaacacaccaagaaattagataaaaagataacaaaataattccatccactttctttttcttttgttttgtcaagattttgttttttgtatttcagtcatacgtgtgaatgtatatcaacaacattgtttttaatgtataaaaatctcaactactataaagtagctgaatgatatgtgattaagatatatatcgagagagacaagccagcaagaattttcagcacacatacacacacaaaagattcaaagaatcatctagtaacaaataaaaaaggagagagaaggaaa

SEQ ID NO: 3209 - DNA, 3000 bp, Unknown; identical to SEQ ID NO: 3199
  misc_feature (1)..( 3000): cDNA_ID_3070844_gDNA_ID_1620631_Annot_ID_162684 3000 nt of promoter + ATG

SEQ ID NO: 3210 - DNA, 3000 bp, Unknown; identical to SEQ ID NO: 3197
  misc_feature (1)..( 3000): cDNA_ID_2142817_gDNA_ID_1620631_Annot_ID_162677 3000 nt of promoter + ATG

SEQ ID NO: 3211 - DNA, 3000 bp, Unknown; identical to SEQ ID NO: 3195
  misc_feature (1)..( 3000): cDNA_ID_2134230_gDNA_ID_1620631_Annot_ID_162675 3000 nt of promoter + ATG

SEQ ID NO: 3212 - DNA, 3000 bp, Unknown
  misc_feature (1)..( 3000): cDNA_ID_1819788_gDNA_ID_1620631_Annot_ID_162701 3000 nt of promoter + ATG
tgattcgactcaggaatgagccttgaaattccgtcgcacgagccattagagtgtagtgtgttgtgatatgaatcaaaagcaacagtgagtgaatttttccggagataaaggagaggtttttttgaagaattggggaaaaaagaggttttggggattttagaagaaagaaggaggaagtgatgatattaaggaaggaaccgaattggtggtaaacatgtcttgtcggagagagagacaagacttgttttcaatgttttaagtttatttttaggttttgtttctttgggactcgggaagtgaagaatattcgtctttggtcacttggcgactttttctttcttttatacatcctcatgacgtcattttatctcaaaatgaaaagaaacttgtcaatattttatctttttgggactaacaagtcatactataggccaaaaaaaaacactatttctatttttgaagttatctgaaaactaattttgctaggtcatatttgctaggtcataaaaagccaaataaaaatatgcagaatagtttcacaatgaaataatattctactttttcaattaggcttgtgagaggtatcaatgaagaaaaagcaatggtaggttagtttttaagaaggaaaaagaagcatgtgaggttagtattttctctcttcattaatttactctcgttctatctaatgtatatgtcactaaagcggtagatatatcattacaacatagttttatttggaccgaatttaataggtactttatgtttcaccaaacagatctcgtggacataattttcgctttcgcatgtggcaaagttagccatgaccttgacaaaagtaggaaagaaaatttgttaatctcaagaatactgttatagtgagcaactactgattaggttctggcaaaaatgatcatatatttataattggttcttatatggatagagttagtgtatgatcacgtttatgaaaagacgttcaagcgccagaagaaacctgattgatatgtaaagaatgatgacttaatcatcgcttttttagtaaaaggtactcagacccagctagatctcatatggttcggtgacgtagaggaagcgtgtatgataaaaataaggatacatcacaaatttgctcgtataatttttttttaaaccaaattttttttgaagtctcaaatcacagaaaaggataagcattagaagttaaaaaacatgaaaactatttgaaaaacgaaacatataaaaatcaacttttgaaaactatatatttatttggggagaactaatttgttgatgcaaaagtaaatagaagtgagaacaaacggatcggatactttgaccaagtgacgtctccctttgtagttatttggagtcatttgtatttgtataatttgtttatttttgttttgaaagttttttaattattaaccatttagtttatatcaaatatacttgcatagattaactgatcaagtaacatataatctagaaaaatgatattggttatgaaaaaatgttatactctgattttacagatttattaatgaaaaatcaagaatgttgatagtttttacaaaaattatttttcgtcagaagtgacatcaatcagttaaaaaatcgattctttactaaattactttactctgaatatcaaactgcccggataattataaaagtaaaaagacaaaatctcaaattttaaaatgtaaacagacagaaaaagaattagagatgccgatgcatgcggagaatattatacaattttcaggatatatatttgtcagatatcaatgtactttttctttcaaaatctcaaattcaacacaaacctatgactccactgaattttacgagaccatccgatactatggcgaaaatgaatgcggtcagataaatggatgcggtaattgcgggcatcaggactttggtctttcacaatcagtttaaagtcatttcttatggtcggttaaattaaccgttaatgacggttataaaagaacatcaaatagtcttataacattgtcggtccaattttgtattatattattgtgtaattcgttatttcaaaaactttctttgcatcacctttctttaacacgagagagcaatgatgagaatgccgtggcaataaagtgatcattaccttttatattttgtagaaatatgtaaaatagtcaacgtatattgtttatattacgctctacaaagtttataattatttaaaactttgaaaattgttttacttatgtaaacagttatttaaagaagcttttttctcactaagatcttcgactatacactaacacctctttctaaattatggggtttatcaaacactaacattcattttgcattgttgaaaaaataaggtatcttcttatcaaagattttttttatcttttagtttatttaaaaattataaaattaagagaaaagtaggattaacattatataaaaatattgctggacaatgctaatcaataaaggtatagttggaaataaaagatttttttttccggatatttttccatctatacttattactatattatcaattatgactcaattactcttttaatagactaaaccaaattttcctctaagtatccttttgaaattgtctaaaatttggtgtaatctagtaaaaagggtaattttagacaattatgttaatttagtaataaaggtacagctgggaaaatctccaaataaatttctttcatttccaagtttccccttgtaaaattaaaaggattttcttaaactttatatatagaaagattgaaaacgaattctaatagtaattttgactcaagattctgaatatatatcgaataggtacaatatatagaagtagctgtaggtcaagaatttaaaaatcaggattaaattcatatatatccaaacacaaacacacgtaattggctacgataaaacccatcattcatttgtttcggaccaatttgcaatatctcatagtcactaagaagaatatacaaaatg

SEQ ID NO: 3213 - DNA, 3000 bp, Unknown
  misc_feature (1)..( 3000): cDNA_ID_2142875_gDNA_ID_1620631_Annot_ID_162700 3000 nt of promoter + ATG
actcgccggagatcagctcccagagtcagttgactggaggcaagaaggtgcagtgtcggaaattaaagaccaaggcacttgcagtgagtacttttactagtcttcacattcataccctaatattcgtacggtgatttatttaggtccgaattttttatttttttttcgcttattcaacaaattcttgcctttgtttttcttagataaatttaggttttttatttccgaatatcgaaatttgacttcgtgacctaaattaagtttgttattccctttagaatgcctttatatgtagtatagtagagtttcatacttattttttggcgtgctagttacttttgttaaattatttgatatttttagtatcttttcggtaattttctttttttatatatatatttttcttttaaaattttttgttttgtttgaagaattagcaaaacattttaactactttatgcaactacgtacatgcctttgaaacaatcagattttttttttatattaagaattttgaaaggcatcacgattagtactttaatatcttttttttttgtatattaatttaaataaaagacagctgctgggcgttctccacagtggcagcagtagagggattaaacaagattgtgacaggagagttaatctcattgtccgagcaagaattggtcgactgcaacctagtcaacaacggttgttatggatcaggactaatggacacagctttccagttccttatcaataacaatggtcttgattccgaaaaagattatccataccagggcactcaaggctcctgtaaccgcaaacaggttcacctattagtgctgccgtaattaaacactcacatatatgtgcatatatttataagtagctaatttcaatttttgtttttggtacgttggtcgcagtctacctcaaacaaggtcatcacgattgatagctacgaggatgtgccagcgaatgatgagatttccttacaaaaggcggttgctcaccagcccgtgagtgttggcgttgacaaaaaatcccaagaatttatgctctatcgatcggtatctatcataccttataaaattcatttttttgttgcatccaagtatatacaattaataaactcatatggtctatgtttacatgattgatgtcattaagtgtatatataatggaccatgcggaacaaatcttgaccatgcacttgttatcgtcgggtacggtagtgagaacggtcaggactattggatcgtgagaaactcatggggaacgacttggggagatgctggctacattaagattgctcgtaactttgaagatccaaaaggtctctgtggaattgcgatgcttgcttcatatcctattaagaattcggcttccaatgcatgagagttatcatgtgtttgtttcagtatgtctaaaggaatctgccctagtactttgaaaagagactgttatgagtgtctggatttttaagatgttttaggcttttagccatggttgctgactcaataaaatgtttctacgttcgctttattcaaatttaatgtgaaaacgtatcgtattatgtgtatgacttggaattttagtttttttttttagggccattagggttttactcgcgtctcgactacatgatatttcaaggatatgacaaaagaattcaaaaatttgtaactggtgtcagttgatggaattttggtagtgtttttccaacaaaatgtcgaaaatatttgattttttttagacaagttttacaggattttttctgttgtcaactacatactaattagaactcaactctctatgatattggtagcccaatatatttaagagtttacaaacaaatcttaaaattaaaattttgttgaaatgtgctaagcattcgattttcatatgacaaaaacgagaaataatatacaacgaggaaaggaaaacgagaaagcagttttttttttttttttttttattaaacgagaaagcagttgtggaacaaccaatctcttttagtagattagagaaaaatgtgtcaatcatcatacacaccactaagactaactctgtataatatattacgaacatttgtcaatctgtctttcttaaaaacatatatttatagttcataataaagtttacattttctgaaactctcaaaatcgatcaaaacttttagagcaaatcaatgttttcttttgtcaaacaattatatatataaatctgaattgtttttgtatccaattgaaatctgagtttacatatctctgttatatgaatttaagatttccatttgcatgctcgtaaaatgagaccagtggcctaagtagattaggacgtaatatccttagttactaaacacatggatcgttaatgtccattattggaacgcgttaatatatatatatatatatatatatatatatatatatatatatatatatatatcatttggtcaaaatgactaaggcgattggttgacaaaatgacatattgtaaagaaagactcaactgatggccaaactattgtttatgaacaaaatcattgattaaatacttggtacatagtaacactgaacccatatactagtatccatcagcataattatggcagtgacactatgataccctcttaaatcatttttaaatatttggtacgtatagttaaataacggaatttatttaaatttgtcttcgctcccacgttagcttgtttgatcagggatagcatgtgtaccatttatatattgtgagagaaaaaccccatagaattgatgtttcctaggaaagttagatggtgaaaactgaaacgcgtaatgtgagacgcgtcaaagtttcattggatcaattttgatatactatttagtaaccaaggtttagtacttattagtagtataagtaagtatagacccttagattgtttggttgacttttctttatcactctcaaactttgtattctctctagtctctaactagcaaaacaaagatcaaactctgtgtttgagatatg

SEQ ID NO: 3214 - DNA, 3000 bp, Unknown; identical to SEQ ID NO: 3203
  misc_feature (1)..( 3000): cDNA_ID_4255208_gDNA_ID_1620631_Annot_ID_162698 3000 nt of promoter + ATG

SEQ ID NO: 3215 - DNA, 3000 bp, Unknown
  misc_feature (1)..( 3000): cDNA_ID_2134228_gDNA_ID_1620631_Annot_ID_162674 3000 nt of promoter + ATG
tgttgtagacacttggtgcagttttgaagagataagtctctactgcattgcacaaaaccgtaaatgcgtgagatagacgtctcaagctttcgtatcccggctgcatagtacaaatatgaagcttggtctatcatacgaatcatcaaagcctcccatgtaatttccaaatccgtcaagttagcttgaaaatctctggtatagttatcactcctcagaatctccataccaagggaactataaaacgagcggtttgagtaacgtacaagacaaactgttctatcaattctccagactatagcttctgtctgattagtacaattctgcaacaatctagcatttgaaggatgatacaatcagaacaagagtgtgcatcagtacctgggacacacatccctagaccatatgctctgtttggatgttccccgatccatgtcgtgtaaaagccgtcgatagctgtgacattagaggaagagaagaaagcaggactcggcggtttaagtcgtaagtactattgggtgtgaagaaaccagatctttcaaggcatacctgtgcagagacatgactaaagcttatgaccacaaaccagaagattactaaaaacttgaccattttatttactctttccttttttgttttgatgtctgaaattaaaacctcaaatcttggaagatgtaatatttatacaggcgtttcaatttcaacctcttgtgctgtacaaaatttgactaatcgtcattgaattttctaacgtagacttttgatgatgagtcaatgtctagtttaggtgacttatgtcttatacgagcctgattcacattttttaccactttgtaccatatgaattggtatttttcctccaatgtggtaacaaatcttgttgaagcttcatcaaagcaaaacagcaaatgcatgattcttgaaagggtattaaattgaaacttttaaaatgtttaagcatattatgaaaagttaaaatattagtggggtggatttgtagttttttaaaacttggagaacagatacatcttactgtcattactgaggcaacatcgagtacattcaccggaaaatggatgccggagctgaaattgatgtggttcggccggtggaggcagattcggcggcggaaattagtccggaacaagaccacgaaggaagatcggagccttcgtcgttgaaccaaggggagattttaaaaacacttgctacggtggagaaggattcgcaggcaatcgcggagagcttttcgtctctctttgtttccctccgatcaactctttctgaggttagaagacgcttctgtgaatcgatttttgtttcttcggttacattgcctagaaaatttgacatttggggaaaactaaagtctagggttcaaaatccatcaattttgtgaatttctcttttcatgtcataaattaagaaactttaggagctagcagagctcaaattatgagatttcatcaataaatggaaaaccaatttcaatgtttatgttttgagctgtggaatgatcataatcttttgctgcattgaaaccattgctaagtttgttcaatgtcctatgactgtttgttttcatgaaaactgtttcttttccttgtgtgtgtgttgtttatgagacttccttgatggtgttttaggctactggtagctcggttgatcacatggcttgctttggagaggcagcgggacggcttcaggaaaatggtaataacactacctgttttgagcaatagattcagttttccatttatatatgagcaatcaacttgagccacctttctttgttctatgaatttttttagctctagatgcagccaccaaagggaaccggtacatcaactcttgcctcaggtactttcataacggtctcgttattactctacgtaatcgcatagtccagtgagtcaatgtccaaatatgttgcttattagtttaagacagagatatctcacactttgtttcatctgaagttttaataagattcctgagcttgacctctaactttcaagatgcgtttctcctgcgtctttttgcttccggtatgatttcttttttggttcaacatgtagattaaacgaggaaattaaaggcgttgagaatttggcggctcggttgtatccttatatgtgtgtcaacctgtttgtgtctgaatgttgaacacagacacacatgtctgctcaaagctttcattatcgtattttagacagaaatttgttctagaatccttaataaatcaatctgcagaaagcacctgaggaaaaacgtggatgttcttgacacggctgtaaacaagcttctccggcctccatgagaagtcgtcagtttttcacagacttggatcacttttttattttttctttcagactttggattacgtatttctcgtacataaagattttgattataaaactgatgttaaatttcaacattacatattttctagggtttctggtttaagaaaaacaaaacactctgttttttaaactgttttcggtaaaccgactcgaaaagggattatttgtaatttattattgtttgtataaataggatgccaaaaaattctaaacttacgtttcgctccctctctaagtccctctcgctctttggttcttcttctcccgcaagattgaatctttggtttctttggattggtttcgtaagtgttcgcaccgaatcatcaaccatttcaccgctgggtatgttttctacactcgctcaaaagttttgatagtatgaactgaattatgggttttggagaattagttgtttaattgtaaaatagaaaactttatgattctgcttccattgattttagctggtgggtttgtcaaaatttcaatcttttctttgatttgatgattaatatttcattgaaatcatcgttgtttcaggttagtaggagtttgctggttattaagactttagtctgaatccaggcctggctcttggggtttgctctgttgctagtgcacagggtccaaccctgtctgaatc

SEQ ID NO: 3216 - DNA, 3000 bp, Unknown; identical to SEQ ID NO: 3213
  misc_feature (1)..( 3000): cDNA_ID_1819792_gDNA_ID_1620631_Annot_ID_47262 3000 nt of promoter + ATG

SEQ ID NO: 3217 - DNA, 3000 bp, Unknown; identical to SEQ ID NO: 3212
  misc_feature (1)..( 3000): cDNA_ID_1819788_gDNA_ID_1620631_Annot_ID_47263 3000 nt of promoter + ATG

SEQ ID NO: 3218 - DNA, 3000 bp, Unknown
  misc_feature (1)..( 3000): cDNA_ID_1819913_gDNA_ID_1620632_Annot_ID_47268 3000 nt of promoter + ATG
ataacaattcaaaagaactagtatcaaattaaattctgaaacccatttcttcctctattgactgtgccccataaccaaacagaacccattgaacagccaacaaattacagtgtgagaatatgaacaacatagaacagtacagttaccagtagaagaaaaaaacgaaccttggattatcaaaagcttttgggataacgaatgagaaagaacacaagtgaagaagaaaattctatttaaaaatccaagaaagccctaatctttctctgttcgcttcttctctgtgttttgtattcttattttgtttcttcttcttcttcttcgtctctctctctctctggacttgggctctgacaatggtagggttacgtgtaggtgaggaaagatgaaaattgaacggacaagatgcgattagtgatataatctaacggtacaggatttggctgttaaagggttaagtgaaccgctggtggtgtattgttaagtaaagataaatgggctaccttcaaatttcttttgacgtcgaggcctacttcattattaggcccactcacatacgatcaattaccaaatacctaatatgactttatttaaaaactagttgagaagttaaatttgtactaaacaaaatatatactttgggtgcctaaaaacttaaaatctttgaaaatttaagctatccaatcaaaatagtacatattgaaggggttgtataatactcagtccacaattcatttggttttattatattatagaaacaaaaataataattaaccaagataggagaaaaaaaactttgaaaataaaatagaaaagcaaagagttcaaagtaaactctaaccaaattaaaagataaaaaaagatataaaagcattttatatttggttagttcaccaaataaaatctcaaattcatcgagtacatccaagatttggggagatttatgttgattagtccatttaaagtaaaaaaaaaatgttagtctattctgacaaactattaatgttagtagatgaataatcatgctatgcatgagttgttgttttgaaaattgttaaaaatatgttgtatgttctttgttgctagtttgtgtagttacataaatatttagattcatcttatatagttacaatttttatgctttgattcatcttttgacgtaaaatatcaagtatatatttttcatgtgtaatataattatctatatacataagatcttaatcttttttttgctatcataaatacatagaataacaatataagatatattgatataatagttgtaattataattgagttatacattagcatgattttgtatttttcaatttttttgaagaaataagttaatagtattgatggaagatttaatgatgtggaggacttttgattttcttaacttaattttgctaaaatttttattgaataatataaaaacacatgtaattttcttgtatgataatgtgacattcatatggagagagttaaccaactttcatatatatatttttttcgattcaaagtaattctatgacataaattttgtgaattatttgtgcattataaacttaaaaatttatttggttatttacatgggacacccgtgtatcgaaaagtagagagaagattgaacaaaaaagctaacaaactttatttatctcaacaaaatattgttacaagcgttagttagaactgtgtatcattaagcttatatatatttgaacttaagctcacttaatcaaagttaaccaaatattaaaccaacattaaaccagcgaaccatacatcataatacgcctctctcaagtctttatcttcgaagtgtctggtttccgaagataaaaacatcttcttgagtaaatgatgaaatgaccccggatgtagtggctttgtgaagtacaactatccacaattttcatttataatatctaatgagagcatatccgacaatgttataaacattttctatcgatttgttagtggtttacaaaccaccaatgacaatttatttcatgatagattcattgtgttttaacttatggacaaccagcatcacaatgattgtttttgtctatggtttgagtcacaagtccgattcataattgtttgtaaataaatatttttttgttgactaataaatattatattacaactttttcttgcaaattactaaaactcaagattctttttcattttttcaaacatatatatatatatatatatatatatatatatatattacaacaaaattctcttataaattattaaaattcaaatttttttatcgcaattagttccttaagagaacttataaataaattaagtcttacatacaaaatatgttttcaaaagagtacaatgtgtttgttggttttgctttcgtgcaatatcatgaaatatgtttatggtttcttaattatttataccaataggtgattcaccacatgatgatgcatatgtacaatttatctattataatgagtttactatcttgactcccacaaatcaaaacccttatttttctttaccgttgtccgttgagatgataaaataataaactaaaaatgattgtacatatttttgttatgatttgagttagagtttttttttttcgtttatttcaattctacgtaaaaaaaattatataaagaattcattttatttgtgactaataatatctaaatattataatacaatatttgtttttggtaatttaccaaaattcaagattttattcttatttttttcaaaatcatgacgtggaacgctagacgatccaacttcgcttatctcctcctaattttccctccaattacacgttgaaacaaaacaaaacaaaaaaatcagaaggaacctgaaactatctcacacagtaaaaaacatcaccatctcaattctcaaccacacaaatccaaagcttctaacttttttttttgttcttcgtcccggacaagagaaaacaacgatctcactcaatcatcggcgtgagggataaagacgatg

SEQ ID NO: 3219 - DNA, 3000 bp, Unknown
  misc_feature (1)..( 3000): cDNA_ID_1819901_gDNA_ID_1620632_Annot_ID_47271 3000 nt of promoter + ATG
attctgcttgaaaattcacactagaaaatgaagtgcttctgcgagtcatttgtctcttgcataagatacaaagtggaattgaaataactttatgtgaaatatatataattctaaaatatgaagctaaatataaaccaattttctacataagctttttcaaattttaaagatatacttacaagaatcgatcaataattgattcagtttttttatttttttttatttttatactggtgcatttgaagctctcctaagtcctataacacaacaaatatgttcaactactctcatcccgaaataaatgttgtcttaattcccttcaaaaatgcttttggtccaaaacccaatatcctttgaaacacttttgtctaaaagtatatgtaaagccatttacattttgtcctacctatgaaccacaaaattaaatatttgtcttattctctaaatatttcttttagattaaagtatgtgtattcaatcagcagtaaaaaagttacatgtcaagacttaatgtagtttgcattttctgaatattctggtttgaattaaactatatatgcttctgactcggtaccactttcaacagtctatctatgtgtctttttcatgcgaataaaatccattgctcattaatggtaatttgtcatctggtgaaacacatgcttttctataggaaaatgactttcaaattcagttacacattcaagagattttaaatgttacacattacattcaatgtcttaaaagttttaggctttaattaggatatttgggtggacaccaaataacaaaatatttcgttaaattttaaataacagtgtaaaccatacaccgtaaaaaaagatctcacattagaaagttaaaaaaatgaaaaatgatttgagtagtatataagtaacttaccaatcaactcattgtcaattaatttgtagttgaaatcctataaaacttaaaataatattagagcccgaacacaattaccctattaatctggtcatgaaaatggttcgattatcaccactaattaatggttaaaaaaaaaggttcaattctgtccgcatatttagaaagagcattatcttctgatggattctatcaaaatacagtagaaactctataaattaatactcgataaattaataaacacgataaattaataaattttgtcggtttcaagtcgggccaatgtaaaaattaacaaattgataagataataagataataattttttaaaaatccttatgtaaaattatagtcccaataatattataaattaataatcatagatcttaagtatatattttaagactcatttttatatgaaatttttgttcaagttacaattacaatttttttaaaaatacaactagtatgatatctgttttactcacataactatttgcatatttgatcggtcataattgattttgtaaaatcttttatttgagaaatcattgctaagatttgtgtaaagagaaattggattaagcttcatgtttacgttcacgttaatgtcatagacatacagacacaatatcttgccgaaaaataaattaaaaaaataaaaataaaataaaaatctaacataagtatatatgcaaacaacaaaacatatagaaaattaaattaataatatttttaaaagaatatagtattgtatttacgtaaatatatctataaattaatatcactataaattaataaaattgcatggtcccaacattattaatttatagagtttctactgtaagtagctaaaagaaccggataaattcactcattgtcaattagttttgatttagaagagcatgaaactttaatatagacataactcattttagttatagtagataaaataaattaaaacgcgcatttggccggtttggataactttaaacaatttcgacttgtttttttataacatgttttatttatctatgaatattcgaattattgaatgaactttcatctccaacatatcctcattcgaatatcattgattattcgaatatgtcacttgtacttatatgaggaaaattgatgttcatttcatagggtatgactgattagtatagatatataaaaagaaatgcaaagtaaaataaatattttcaattattctacttttaatttgttgtccaaataaaacaattaaagaaaaatctcaattcatctacttttagtagaaacaagtgacaatattcaccccacaaatacatgaaagaattttgtttcctctaactttcattttcatttttttcctgttttcttttcatttctttcctttcattttcttctaattactcccaatcacatgcatagttttcttatccacatgtaaataaacttatccaacaagatttagaaaaataccaaattaaaaaggttctaaatcaaatagtcaaagactagatttattaccatagtacaaaattagaataatttgtaaaatagagatttcttagcaaaaatagataaagccaggtcaaaacgtgacaaacgaatgcaactgttggtggcagaatcgaaaataatccacaattccctcgattccccgccgaaaatttcagtctcatcgaaagcacaaaataccccttacgtcacttcctgcgaaagttacggaaaaacccctacactctgtctcagacaggggtattattgtacccctctcaacagtccaatcaaattcaaattcatttgttgacataataatccacgtcaggaactgcacgcttcttacggtgtcgttttgtggttctgtataaggaaaaaataaataaatttgccgttttgtcgctctggagaaaaaaaacagtgacgtttatttccttctctgcaattcttcttctccttctgttcactcatcaaatccaatgatgttaaaatcacacataaattagggtttcttgttggtgagtgacgttaaaaacccaccagtgaattctctctgtttctgtgttactgtgtacagtggagattttaaagagagatatggagatg

SEQ ID NO: 3220 - DNA, 3000 bp, Unknown
  misc_feature (1)..( 3000): cDNA_ID_1819893_gDNA_ID_1620632_Annot_ID_47273 3000 nt of promoter + ATG
ttacgacatcataatctttagaggaggaaaacctaagggtcaaaaagagaatattagcaagaatgttttgagacataaagctatattgatcaccgatttccgctattcaaagagtttcataggaataccgatcgatgatttttttgtgtattaccttggataaggattccctttaacaactttctgtccatatttccgccacctatatccatcatctaaattatcaacttcactcgttgtttggaaaataaccctaggctctctcacggttctatctgaagcatcagctagttccgaaacctgaacttctgtaattctgcagattccatgatctctccactcaaaaaaccaaaaatatggattatcaatcatcaacaaagcttataactttaccttctctttggttcaggctcgtcttcatctttctctccctcactagtttctccattactgtcttcttcattgtcacttgcctcagacatgtactctattgtcgtagctagacttgctgcttcctgttgctctatcttagtcttgttggagctaaactgtgatgctgtcaattcagagctcatgcaattgatgtgtgtcgaactcccacttagatatgtggtgctaccatcttttccttggttaggaggttcgtgattgtgtcgatctttgtagacgatttctgctacttgtccatcaagagatctctcaaccttcctcttggaaggacatcctagatatgtgcacttgtaatagcttagaggaaacttgctgcctttaactttcttttgcccatacttttgccagttatagccatcattaacttgtttgtcaacatttagaggctgttgtgacatgtgctcgatgatagttatacctgaggtattacttttagctagtagtgaagaatccggagctgaggtggggatctgaggttgacccgatgaaaatgattgaaccgcagaggaagaagggtactcagtttgaggttgcatattggcattggcttgaactgtttgagcttgctgatatgtcatttcataaggtccctgcacattgttacatatcgagttaaaacaagaaccgggaaaacaaatccaagcacacatccgacttggtaagcttagatacagagtcaagataaagaagagcaatagaagggaaaccggctagttaccttgagttgaaaactaaatccccctattaaaagaaaataggaaagacctatctaaaataaccaagtctacctgatcaaaaggcaccgagaaaaaaattgtagatgaatcttaaacctgatcatgatgaaataggtatcgggtttactacattatatacatacctcaaccttgtcaagaaaatcgatagggaaatcatcctcgggcagaatggttatttggtactcctttgacaagtaggtattaaaacccaaaagtaagtcgtcatggcccttgaacaaatcttttaatctggctatgacgccactagtgtcaactctacatccaacatgagtcaccacaaaaaattaatatatttcctgctgtaagaagagagacataatggaaagatagaagagagtacccctgatgtttacagtcattcaagacttcaaggaaagtgtcatatttctcactgtcttcaaacttgtccttcacagctttgagatagttcaaggcatcacctgttgttacccctcccatatttcctcctccatcaatcgttagaggccttttagttatgcatgctttgcagaacattttgctccctttcgctccttttgtgcatccaatagattgacatcgccgaccaccaccatgggatatgcagagtcccgaaagaccttcagcgcttttagtgcagttctctctttggcatctctttcccccaccgtgcatgagacagagtcctgatcttcccctagcaaatcctgtgcaatcttcatggctgcattttttaccaccaccatgggctcggcagaatggcaaaggaccactagcgctttttccgcagccgtatgttttgcatctcgctcctccaccgtgcttgacacagaattctgttcttccccaagcagatcgtgtgcaatcttcatggttgcatcttcgaccacctccatgagctatacaaaaatcagtactgccttctgcgcctttggtgcatccaagatattcacatctgcgaccacctccgtgggctttacagtacactgttttaccttcagctcccttctggcaatcaggtttctggcatctacgtccaccgccatgggaaatgcaacgaccagatgcatctcttgctcctttttgacatccttccacttgacataacttggaactagaagaattattaagctgctgagataaaccggaacctgagcttattggtggtgttgctgccatgctagatgacagttccagtacacaagcagcatcaagaacacaatttttttatcagatcaggaaaattcatattcacacaagaaagaaaaaaagaatgtttatcatcctgcaattcacatcccaatcatcattcataaccggaactaacccaggcggtacggtgcacatcgacgacgattgggaaatcatcaaacccgtggggctattctgcatgaacctcgggtcaacatcactactcgagctactaatcccttcaccggaacttcctactctctgatgataatcactagtcgcggtggccgctccgatggacgtcaatgtcaacggaagttcttccttctccgacatcgatccttaaaattaacaaacgaagaatgaggaagaaaacttttaaaaccccaataatcaaaaacacaaatttactttgctcacatatcgatttgttgacttttcgtgttttttttttcgtgccactaattaagtattttatattggataaattgtttttgtccggtctcgcaattatgagagaaaccaaaccacaagccttgtttttctcagctcatcgttgactttaaaactggacaaattggatcagagcttttctcccatg

SEQ ID NO: 3221 - DNA, 3000 bp, Unknown
  misc_feature (1)..( 3000): cDNA_ID_1819889_gDNA_ID_1620632_Annot_ID_47274 3000 nt of promoter + ATG
ttctggaaaaacctctagttgtgagcaacctgagagtattagctcttgaagacatttcagcttataaagatcagaagaaagatgcttcagctttttgcagttcttcagattcagcaaagcaagtcttctaaaggtttgaatggattcgggaaggctctttataacagtgccatctaaaagtagaacttcaacattttccgagatcagtgggaatttctttaagctggagcagccactgagaataagagtttgcaaggattgagttttgattccttttggaagactcctaaggcttgtgcaatccctgagattgaggtatataagcttctccaaacaatttatcgttgacggcaattttttcaaacttgtacatccttctagattcaacctctcaagattatgagcattagccaaacccaaacactgacgtaaatttatagaatgactaaggtcgacccatttgagcattccaacatcctgtgaaaaaaaatacaaccacaagtcaaatttttgatgcaaatcaaaattcactttagcttaggactgatcaaactgacgtaaaacataccttttcatcatcccaaatttcttctaattgactatgtggcaatttaaggtctacaagattcttagggtcaaagtctagagggatactctgtagtggataaccatgccagtgtagatatgtaagctcgttaggaaggaaactaagtcccctccgcaagtgtagtttaaactctgcttcgcatccacgggaacaatgagaatcataaattttcaagtatttgagattgtacatcccttggaaggctttggcacttagacgcattgctcttagttttgatgtgtcgagaaaaatgcctcttatcttatcagttccctatcaatcaagtagtaaatgtacagtttttaattcaaagcatgatactgtaacataatacaaaattgtagacaatagaatatcatcaagatatgtcattactcattaccaggccttcggttagcaggtcacaaatatcttcactgtcccataatctgatatgccattggcactggttaccatgtcgtgatagccacctacagtctcttatacctattgtttctacttttaaactaatctccttggccatcgtttgcaacatgtcatgcatctcgatgcgattatcagaaagagtgatcagacatttgtcaacgagatcctttaccacgccagagacgtccacaccatgactgttgagaaggcttgtcacgtaatccacattctctgatctgaagaaacatgcaatatccagaaaaacattcttctgttcagtggtaagctcctcatagcttgtttctagaacttcgtagatatctccatgtgatctacttttcagtctatccagtttagcttcccagtacagatcatccctctcacaaagatcagatcctaacaccttaagagccaaagggtggcctttagcgtaatcaagaaccatatttgtcaaaccttcgaactctttcaaagggaaagagttactaaaagcattcaagctaaagagcttcaaggcttctctatcattcaatttcgggagcacgtattttcggcctttgatcgtctcaatcagtttactatctctagtagtaatgataattctacttcctccttgataccatttgcaatgccccataagatatctgatttgcttttcatcattcacatcatcaagcacaataagtagcctcttgctcttaagccgccgctcaaatctctcatgtgcatttccaggagctccaatctccaaatctctatcattaagtacagtggaaaagagtttctgcagcaaagattctaacccgcttctacctgaattttcgcggatattagtaaggaagcagctaccgtcgaactgaccacgcatacgtccatacaaacaatcagcaagagtcgttttcccaatcccaaccattccaacaatgcctatgatatgaacggtatccaaatcctcccatgataacaacttttcaagattcttcagacgcgattctatccccacgagaccttcgttcccgcttggagccaaatcattcaacttcttgaatgtgtcaacggctatttcatcaacaagtttggcctcagacgtgctaacaaaatgacaaaaaagctggatttagcataaactttaatagcatctctaagaagataaatgtagaactttgacacaaagacttggtaagtttttttgtgtgacattgatgacatcgatctagattttgcaaagttacctaatttccttgactacataacctaggatgttggatgctgaggcaagagcagccttccacgatgaaatttcttccggcgtaactccgggaaaagtcaattctggtaacttgaacggcaccgcaaaactattcctctgtttctcgacgtccgatttgtcaactttgtagaagattggtaccactagctgttggttgctgttcctacattcgaggatcttcactaactctcgaagacaccacgcagaatttgcatagttcgtggagaagacgatgattgcaatcttggatttctcgattctatcgaaaagcgcagtgagattgtctcctcgacggagtctgtcgtcgatgaatgagtcgattcctcttagacgaagtgctttttggagatgaccggtgaagttgttgcgtgtgtcaaagcctctgaaactgagaaacacatcgaactctgctgaagatggagaagatgattccatgggagaaaagctctgatccaatttgtccagttttaaagtcaacgatgagctgagaaaaacaaggcttgtggtttggtttctctcataattgcgagaccggacaaaaacaatttatccaatataaaatacttaattagtggcacgaaaaaaaaaacacgaaaagtcaacaaatcgatatgtgagcaaagtaaatttgtgtttttgattattggggttttaaaagttttcttcctcattcttcgtttgttaattttaaggatcg

SEQ ID NO: 3222 - DNA, 3000 bp, Unknown
  misc_feature (1)..( 3000): cDNA_ID_1819873_gDNA_ID_1620632_Annot_ID_47279 3000 nt of promoter + ATG
gcagaagataagtttcacaaagttatagagacagatcaagctagaacagagacaaacctgcttttagattctgatccagagcagagtcaagtgctctttgagcatcttcagttaaaggaggatgttccgggctaaagaaatacatatctgcctttcctagtaacttgaccgtttcttcacgcactttgtaaagcataatcttattcgcccgcaaaaactttgaagtaaaactagttcctgctcatcaaaatcaaacactatctcattccaaatatcactcactaccaagatcctagtaaccttttgtatcatctcaagcaataaaccagaagtaaagtaagtaagtaccttcaatcaaaatacccatgagaagtgcttcagttccagtatttggatacttgagcttcctagcttcaagctctcccattgcaaatgatttaattgccctccatgaccatctacattcacaacattaccctctaactttctttaaaaacctaaatcaacccaggaactttaaaaacaagcaattcaattcaatcttaggtctacaagaaacaacacttacttgggctttttcgcatcagaaaccactaaatctggattcctgcaacaaattaaagcacataattgaacaaaatcaaccacaattgcgaaaatggagcaacataaaattgatcaaaatcaactaaaatccgatcaaaactttagaaatttacgcggtgggtaagctggagatggcggatttatggattcttcttgggcgattagtttgtagagcggagactggagaagtgagagagagggatgaatcaacaacgcctaaccaaggattcgtcaatgcttttcttgtagagaagaagtataatggaacagatagtttcttcttagagaaagaatcgatttgtgagatgatcggattcgtcaaagcaaagttgcaagaagagtgagccgccattttcgcgagtgtgtctggataacgggaaaaatgaaagaacgtcaaattgggaaaggagaagaagagtcctggagaatgacgattgtcgaaacgatatcgtattcgttttataaatcttaaaactttcttatatgggcttaaaagatgtgaataaacccaacacaaaataagtttagttttgggcttattgcttatcattaaacgggcctatcaacgagtgaaagagtcaaaaacaaattttatcacaagacaaaaaattcaaatagtcaaaaagaaagtgaatgctgaaacctaatttattttctcacatatgtttgaatacgaatggtggatttcatgttttcactctgccttttaaaattctacctttcattttctaatagacacgagttaatgacaaccattagctttatcattaactaagttgattttttactactccgtttaaaagtttaatgccaacacaaattcaacacagttttcagaaaagtaaatccactatcatagtaaaccattgttagcttggaacaattatatatctttttagagaaattagtctcaaatatgattgggagtgagacaatctcggatggttgtatctatttttcttttactgaaaaatagagatttttttttttatgtcaatgctttttcaaaagtaaaaatctctatttgttagaaaaaatagaaatttttattttttattctatatataaaaaaactctattttagagataaaactatagatgagttagaatgaaataaatacaaaaataaagtatagagataaaaatagagatgagttggaaatgatatgaaggaatagattagaaagaatctatatatacatttttgcagccattttcgcaaataaatcctagacttgtacttatttacaatctaatgccattagcattaaatcttttttccaaaataattaattttactttaaatttttgatttaaattgtcaatcacattatcaatcaaatttaatcccaacaaacttcaaatcaatctcttaaaattagcataaacatatttgttaacaatattttaaaacaaagttttttgttaaaataaatattattcttactaaacgttttttgtttaaataaataaattttgtatttgaacttatttacaatgtcatgtcactgacattaattatttattaatgaaaatatttaattaaagatttaaatcttctaaatccttacttttagagttattatgtcattactttgtaagcaaaaatattattttttaaatattattatttatatatttaaaatttataaaacattattaatatttaaacttataaaaattttgatatatcataattttttaacatcagtttaaaaaaatcttaatttttgccgtcatattttatgattcaaaattttaaaaatgaacatatattaaccaattggcaaaaaatgtgtgggttcaacgtcccgcatcgacaaaaatatttagacaataatttataaacatatcataaataagatcaacattaatataaataaatgggttttttacaggacgaatttgacgggacgagtttggcaggacgttacttaataacaattgtaaattataaaataaaaatatattatagatatacaatttgcaaaaaaaaaattatactaactttaaaaagataaattgtctccgcagtgtaccgcggattaaaatctagttagaaaacaaaagcgttgtcattgattttattctattttaatttatatcgaatttttttgatatttcaacactaagattttttcacattttttaatttaagaatcttgaaattacttattaaagaaccaaatcaaaatttctaaagctctagttccttgacaagtggcgttgtttaagattttaaataatcctaatatctctagtaaaataaaataacagccaagtacgacttttttgtattcactctctctctcaaagattccgtctatagaatcattttcacaattagaaatccgaacccaaactcatcaattttacaaattctctcttatctct

SEQ ID NO: 3223 - DNA, 3000 bp, Unknown; identical to SEQ ID NO: 3222
  misc_feature (1)..( 3000): cDNA_ID_3070862_gDNA_ID_1620632_Annot_ID_162731 3000 nt of promoter + ATG

SEQ ID NO: 3224 - DNA, 3000 bp, Unknown; identical to SEQ ID NO: 3221
  misc_feature (1)..( 3000): cDNA_ID_3089720_gDNA_ID_1620632_Annot_ID_162722 3000 nt of promoter + ATG

SEQ ID NO: 3225 - DNA, 3000 bp, Unknown
  misc_feature (1)..( 3000): cDNA_ID_2161566_gDNA_ID_1620632_Annot_ID_162719 3000 nt of promoter + ATG
atctatattctgcttgaaaattcacactagaaaatgaagtgcttctgcgagtcatttgtctcttgcataagatacaaagtggaattgaaataactttatgtgaaatatatataattctaaaatatgaagctaaatataaaccaattttctacataagctttttcaaattttaaagatatacttacaagaatcgatcaataattgattcagtttttttatttttttttatttttatactggtgcatttgaagctctcctaagtcctataacacaacaaatatgttcaactactctcatcccgaaataaatgttgtcttaattcccttcaaaaatgcttttggtccaaaacccaatatcctttgaaacacttttgtctaaaagtatatgtaaagccatttacattttgtcctacctatgaaccacaaaattaaatatttgtcttattctctaaatatttcttttagattaaagtatgtgtattcaatcagcagtaaaaaagttacatgtcaagacttaatgtagtttgcattttctgaatattctggtttgaattaaactatatatgcttctgactcggtaccactttcaacagtctatctatgtgtctttttcatgcgaataaaatccattgctcattaatggtaatttgtcatctggtgaaacacatgcttttctataggaaaatgactttcaaattcagttacacattcaagagattttaaatgttacacattacattcaatgtcttaaaagttttaggctttaattaggatatttgggtggacaccaaataacaaaatatttcgttaaattttaaataacagtgtaaaccatacaccgtaaaaaaagatctcacattagaaagttaaaaaaatgaaaaatgatttgagtagtatataagtaacttaccaatcaactcattgtcaattaatttgtagttgaaatcctataaaacttaaaataatattagagcccgaacacaattaccctattaatctggtcatgaaaatggttcgattatcaccactaattaatggttaaaaaaaaaggttcaattctgtccgcatatttagaaagagcattatcttctgatggattctatcaaaatacagtagaaactctataaattaatactcgataaattaataaacacgataaattaataaattttgtcggtttcaagtcgggccaatgtaaaaattaacaaattgataagataataagataataattttttaaaaatccttatgtaaaattatagtcccaataatattataaattaataatcatagatcttaagtatatattttaagactcatttttatatgaaatttttgttcaagttacaattacaatttttttaaaaatacaactagtatgatatctgttttactcacataactatttgcatatttgatcggtcataattgattttgtaaaatcttttatttgagaaatcattgctaagatttgtgtaaagagaaattggattaagcttcatgtttacgttcacgttaatgtcatagacatacagacacaatatcttgccgaaaaataaattaaaaaaataaaaataaaataaaaatctaacataagtatatatgcaaacaacaaaacatatagaaaattaaattaataatatttttaaaagaatatagtattgtatttacgtaaatatatctataaattaatatcactataaattaataaaattgcatggtcccaacattattaatttatagagtttctactgtaagtagctaaaagaaccggataaattcactcattgtcaattagttttgatttagaagagcatgaaactttaatatagacataactcattttagttatagtagataaaataaattaaaacgcgcatttggccggtttggataactttaaacaatttcgacttgtttttttataacatgttttatttatctatgaatattcgaattattgaatgaactttcatctccaacatatcctcattcgaatatcattgattattcgaatatgtcacttgtacttatatgaggaaaattgatgttcatttcatagggtatgactgattagtatagatatataaaaagaaatgcaaagtaaaataaatattttcaattattctacttttaatttgttgtccaaataaaacaattaaagaaaaatctcaattcatctacttttagtagaaacaagtgacaatattcaccccacaaatacatgaaagaattttgtttcctctaactttcattttcatttttttcctgttttcttttcatttctttcctttcattttcttctaattactcccaatcacatgcatagttttcttatccacatgtaaataaacttatccaacaagatttagaaaaataccaaattaaaaaggttctaaatcaaatagtcaaagactagatttattaccatagtacaaaattagaataatttgtaaaatagagatttcttagcaaaaatagataaagccaggtcaaaacgtgacaaacgaatgcaactgttggtggcagaatcgaaaataatccacaattccctcgattccccgccgaaaatttcagtctcatcgaaagcacaaaataccccttacgtcacttcctgcgaaagttacggaaaaacccctacactctgtctcagacaggggtattattgtacccctctcaacagtccaatcaaattcaaattcatttgttgacataataatccacgtcaggaactgcacgcttcttacggtgtcgttttgtggttctgtataaggaaaaaataaataaatttgccgttttgtcgctctggagaaaaaaaacagtgacgtttatttccttctctgcaattcttcttctccttctgttcactcatcaaatccaatgatgttaaaatcacacataaattagggtttcttgttggtgagtgacgttaaaaacccaccagtgaattctctctgtttctgtgttactgtgtacagtggagattttaaagagagatatg

SEQ ID NO: 3226 - DNA, 2764 bp, Unknown
  misc_feature (1)..( 2764): cDNA_ID_1819983_gDNA_ID_1620633_Annot_ID_47289 3000 nt of promoter + ATG
gaattcgaatagtatgtttgcggattatgcgttttggggaatggttttactgttaaattgcggttaatctcggttgaatagagtagtggcaatgtcaacttattgcattgatgaaggaacatgaatgaagaagaactttgaactgttacattgtgaagaaagtgtaaatctatgtatgaatgtttggtttgttgattgatgttggactggattggtaggatatacgtgcaagccgaaatatgaaatttatacaaattttgagaccaaaacattttaatgatcttatgaaaacactagaacccccatctcacatacttgtacgatctacaccaacgatctctttgatcttgcatatacggcaagtcggcaaacaataactcttaccatacattacaaaggaggtgtgatcatttagttttggggattgctttgattagcctgggtaaaatacccgaacccgaagaaccaaaccgaactcaacccgaaaaaacctgatccgaatctaaacctaaaattttaaaatactcaaacagatcttaaacttcaaaacccgaacccgaacccatccgaacctgaacccgatcaaatatccgaacatattcgaaatatatatatatatacatagaaataatttattagtaagaatcatttttacatcaacttaagtgtctaaaatattaggattttaggatattttgtatagttttagatattttacctacttttcgatagattcggataaaaaatactcgtttaagaattttttgtgtattttcaagtaatttgaatttattttgatacaaaattttgaattttggatactccgagtaaacccaaatctcaacccaaaaaatccgattcaaacccgacccaaatccgaaatcttaaaatacctgaacggatcttagatttctaaatctgaatatccaaacccgaaaaactcgatccgaacccaattcaaataccggtacacctaagcctagttttgatagtcaaagttccatttggtttacattccattagttattttaatctaaactaaaaccattaattgtaaccgtataaaggattttcagcaaaacaataaataaatataaaaaacctgtctccaagtcatttttcttactgaaattcatttttctatagttaactaaaagggggtgctattcaatcatggatttgaggaaattcatttttcagtgttaattgttatcctatttttcagtgttaattgaatgaggtaaagaaagaaaacaaaaatttattttgtgatttgaatttttttaaaaaccaaatgttcggacatattttaagactgaacaagctttgattttacaaaaacgacgtgtccaacaacaaaatcatgatcaagaaactccttttccatctacttcatttagacaatattttaactattttggcagatttacaaacagtttaccaaaatattaaattattaatttatgttatagttttattattcctttcaaatttagtactttgtttgcttgttaattttataaaactacttttccattttcgtaataataatatatgttttcggttaatccgatgaacgttacattacatacttctagttttctatatatcatacacattcatcgtagtacccatactattagatcaatagaataaatacgtcgattctaattcgacatacgttacataccatgcaaaataatctcatttaatattgagaaagtgtcttttgtggaaaagaaaaaaccaacttttaaacgattgtattttgtgttgtagttgttgttcgtaaaataataatatgtattaaataaaaattaaatttaaaggagtaaagtataaataaaaagtgaaattctaaagtgtaaaaaagttagatttactcctctattttaaagtcgagtatagagtagagttgaaaatgtttttagagcttttacaaatagagtaaggttagagatgtcctcactaaagttacgaggtgtgggagggacggagccaatgaagaattataggggtcaaatgatcccagtgaacttttaaaaaataattgaatttttattaaaaaatatttattgaccccagtcaaacaaaagtattgtcccctatgaatgatttgttgaggtacaagtaaaacaaagtccaatataattttgtgaattataaatacaaaagctcaataattttattgaattatactaatgttaggtccaataaaaatctgtcaaaattaagaaagtaaaaacctaaataattgaacatgtatcgtggtagcctaaaacagttgagcttcttcctcttttgttttttttcatacaatcatcacatctttgaaaatcagattaaggctcgagactatagatttcaaggtaaactcttttatatatatatatatttttttatataaagtttaatttactatcaaccaatttcaatttgatcacttaagcaaaattcgtttgtgattaatttagtttttggtgttgttattctgtcattgaaaactcaattcgtcattatttcatgagttttctttgtaacgttagtcgtcaatatactcttttcttcttaatttttgatgtaatttgttttagtttctaatttaatctcacagtaatttttactaatgacaaaaattaaagttgtcatgaatcatgataaggccacggagaaaacaatttttatgtttgatttaagtttcaactcatgatttttatattgtttcttatttttgtatgtaggcaaggcaacaacaaaaataatg

SEQ ID NO: 3227 - DNA, 3000 bp, Unknown
  misc_feature (1)..( 3000): cDNA_ID_1819979_gDNA_ID_1620633_Annot_ID_47291 3000 nt of promoter + ATG
ctcttttatcctttttaattttctatttaatttttgctaccaaacaatctattaaaatcaaccaatcatatgcattctctttcttatatcattaatcacttaaacctacaaaaaacgctggacaactgaaaccaataggtacaactatgttgatggacttctacgaaaaacatataattacatatcgttttctttttctctttcattttcaagttataataaaaaagacttcagtcatacgtgttgcttataatggatactattaattttcttgtcgtatttatacaaattaatatgttttgtattggtacaactaagtacaacccgcacaactaaggtctattcacttggctagttttcagaatattataaaatatgaaaatttaaaaccaaactaagaaaacttaaataatgcatacacaattgtaatgaaattacataattagtttttgacaaaaatcatattttctaaattaatgaaactcttatcacaaaatctaacattcatacattaacaaccttatactttcatggttactttgtatattttaacaaaacaaattaaaaaatttaaatacttgtaattagataaatataaatacactgatacaaagtaatggtattttgatgggggaataccatatgttccatccataaaatttaattttgagttgataacaactagatttattatattctcgatattgtacaactatgacaaaaaatgtgcaaccgaatacaactgtacaactatgggcaatatatttttcagatatttatagatattttttagatatttgtagatattttataataaaaattagctttattcttttgtgataaaaatatttatttattttttgtcatcaaaaatatttaattttatagttaaataaactattttgttccctttcaaactttttttttccttttcaaaacactgttgtttaataaaataaaatactaacattcataattttttgtgttttgttttggatcaaaatacgttgatgtgttgattcatatttattttggagttttttttgacaaaaaatcttagattcatacataaacccagatacatagttgtacatgagcgtaccagttgtacctaaacgcttagatctattatcttagaaaccgaaagacagccgaacaattgtatctaaaccaaaaacccaacataattatatctaaaaatttagccacaattatacctaaaaccaaaaacacaatactatctaaagactcaaacacgaagtcttattgttctcgttgtcattctccttctcaatttctttctccttagctttctccttcttcccttttcttctagtttttatcattcaaaagcaatctcataatattttgttttaatgcatttcacaaactatctctaaggaacaaaattcaaattcattcgaatcccaattgtaatcctaaaaactaagtcataacagctattacaagaggcttttaagggacaatttcgattttaaatcgataattaactcaaatttgaatctatatatacatttttgcagcaattttgtgaaataaatgttatagttggaacttatttacaatggctgccactggattttaatgtttgtttttgataattagaaaaaaaatcttcaaattaaatatttgacttttaacaatcttccctaaatctctccacattaactacacgattagttactgaaataaaacttccaaaatatttaatatcatttatttactacaaaattatcattttttatattgtttttctccatgactataacaatttaattataatcgtcaaaccgcagagatatttgatagcatttaattattacaaaattacaaaatatttagacaataattcataaacatatcataaataagattaacattaataaaataaatgttttttttatgggacgggttggcgggacgggtttggcaggacgttacttaataacaattgtaaactataaaataaaaatatttatagatagatacaatttgcaaacttttatgtatactaactttaaaaaataaattgtttccgcggtgtaccgcggattaaaatctagttgtactcataaaaatccaaattataatcgaaattttatccaaaatccatcatttttaaacaaaatcaaagagaaaaagagatcaaactatcaaatctaataagaaataaaaccctaattaaacacaacaccatcaatcatcatatatggaatagagatggatctttggattgatagaaacaaatgaaaaggtaaaaaagatggatctttggattgatagaaagaatgaaaaggcaaaaagaagacgaaagattatacatggaatagagagaagagagtaaagagaagaagaagaagaaacaaatcaaaagttttgtttttgttgaattgagagaaaaataaattgaagatgaaaaaaatttgatatgagaaattagatttttttttgttgagaataaaagatccaaaattgttatggatctagatccaacatagaggttgggttgtaaataagtaaaaaactctagttttacttgtcttttactattattctgaattaaaataaataaataaacatatgttttttataaaggggctaactagagaatctttgaagctaagggggtggactagataaaaatccaaaatgaagcaaatgacctaactgctgtttgcaacatcatttggttcatttgctgttagctaaccttagtttttgataaccatagtccataggctaaatatcacagaatggtaaagtgtaagccatttcgtcaacgctacacctaaacggcatgaagttggagcttctaattaagaagaacccggtcgggtcaaaattcgggtcactcttctcgggttccccctctaattcaccctctttttttcattcactccacaattacaattacagtcgatggacgacagagccaccgaaccatcacggcgagtctaaaaatactcagagctcctataa

SEQ ID NO: 3228 - DNA, 3000 bp, Unknown
  misc_feature (1)..( 3000): cDNA_ID_1838672_gDNA_ID_1620633_Annot_ID_47295 3000 nt of promoter + ATG
tgtgtaatgtacagtacaaaattgtggctaagatcctaactagacgtttgcaaccttggttgtcagagttgatctctttgcaccaatctgcttttgtaccaggccgagcaatagccgataatgtgttgattacacatgagattcttcactttcttcgtgtttcgggtgctaaaaagtattgttctatggccataaagaccgacatgagtaaggcgtatgatcgcattaaatggaattttctccaagaggtccttatgaggctgggttttcatgataaatggataaggtgggtgatgcaatgtgtttgcactgtctcatattcattcctcattaatggatcgcctcagggaagtgtagtgccatctcgaggactgcggcaaggtgatcccctctccccgtatttgttcattctatgtacggaagttctttcgggattatgtcggaaagctcaagaaaaaggagtaatggtgggcattcgcgttgctcgaggaagtcctcaagttaatcaccttctatttgcggatgatacaatgtttttttgtaaaacaaatcccacgtgctgtggtgctcttagcaacatcctaaagaagtatgaattagcttcgggtcagagcataaacctagcaaagtcagctataaccttctcttctaaaacccctcaagatatcaaacgcagagtgaagctttcgctgcgtatagacaatgaagggggaatagggaaatacctcgggttaccagaacactttgggaggcggaagcgagatatcttctcgtcaattgtggatagaattaggcaacgctctcatagttggagtatacgctttctgtcaagtgctggaaaacaaatcctgctcaaggctgttctctcgtcaatgccatcttatgctatgatgtgctttaagctgcctgcctctttgtgtaaacagatccaatcagttctcacccgtttctggtgggattcgaaaccagataaaaggaagatggcgtgggtctcttgggacaaacttactttgcctataaatgaaggaggactaggtttcagagaaattgaggagttcaacgatgctctctaggcgaaacttagttggcggatacttaaagaaccacattcccttctctctcgtgtcttgttggggaagtattgtaatacatcctctttcatggactgctctgcttctccttcctttgcctctcatgggtggagaggaatccttgcagggagggacttactacgaaaaggccttgggtggtctatcggacagggtgatagcatcaatgtttggactgaagcgtggctatcaccgtcctctccgcaaactcccataggacctcccacagagacgaataaagacctttctgtccatgatcttatctgtcatgatgtgaagagttggaatgttgaagctattaggaaacacctacctcagtatgaggatcagattcgaaaaattaccatcaatgccttgcccttgcaggatagtttggtttggttacctgtgaaatcaggggagtataccaccaagacgggttatgctcttgcaaagttaaactcattcccagcgtctcagttggatttcaactggcaaaagaatatctggaaaatccatacttcccctaaagtgaagcacttcctctggaaagcaatgaaaggagccctacccgtgggagaagcgctttcacggagaaacattgaggcagaggtgacctgcaaaagatgtggtcagactgaatcttcgctacatctgatgctcctctgtccatacgctaagaaggtctgggaacttgctcctgttttgttcaatccttctgaggctacccactcttctgtagcactcctcttggtggatgctaagcgaatggttgctctcccaccaacaggattgggttctgctcccctgtatccgtggttgctttggcatctatggaaagcacgtaaccggttgatctttgataatcatagctgttcggaagaaggtcttgttctaaaggccattttggatgctcgtgcttggatggaagcccagttgctgatacatcacccttccccgatttcagattacccttctcccactccaaatctgaaagttacaagttgttttgttgatgcagcttggactacttcaggttattgtggtatgggttggtttttgcaggatccatacaaagtgaagattaaggagaaccaatcttcgagtagctttgtcggctctgcgcttatggctgagactctcgctgtgcatttggctttggtggatgcgttatctaccggtgtgcgacagctgaacgtcttctcggactgtaaagagttaatctctcttctcaactcaggaaaaagtatcgttgaactgcgaggactgcttcatgacattagagaattgagtgtttcctttactcacctttgttttttctttatccctcgtttaagtaatgttgtggctgattctttagctaaatcagccttgtctgttattctctcttcctccgttagtggtgggtaaaactcgtttgcattttttataatgaagtttgataaaaaaaaaaaaaaacatattccaaaaaaatttaaaaaatctatacccaaaccgatccgaattcgattagatctaaatcaaaaccgaaccgatattttagatttactttttgatcctaaacttttctacccaaaagattcgtaccggatcgggtttaatcctaactcttccaacttacccgaatacccactcctaaattctgattctgttttttttttttttttaacacggcaaatcaaaattctgattctgttattgtagtaaaatcagattcatctctttggaaaaaaacgataagggatctctctctaattggcgctcctttactaattgccctttaattccatccatcttcggattcttttcaaatcaacaaaaaaagtacaaatcggatccctacaatatcctctccactcttcacaaatccttctccgagatctacaaacgctgtttcattcttccgattaca

SEQ ID NO: 3229 - DNA, 3000 bp, Unknown
  misc_feature (1)..( 3000): cDNA_ID_1819964_gDNA_ID_1620633_Annot_ID_47296 3000 nt of promoter + ATG
tcgtgtattgattatgtgattatgtgaagtctttaattggtgaattttagatatgtgcataagaagtttagtatgcagtataaagcaacgattggtgctgattttgtaaccaaggagcttcagattggggaaaagcttgttactttacaggtttggggcctttttcttttggttttgaaattacttttcttcgagatttgtgtgttttactttttttttttttttttttgtggtttttagatttgggatactgctggacaagagagattccagagtcttggtgctgctttttatagaggagctgattgttgtgctttggtttatgatgttaatgtgttgaggtcttttgataatctcgaaacttggcatgaggagtttcttaaacaggttcgtatgacaatttccttctttctgtcacactttgttttggtatgatccatttgttatatgttttgctttgtgtgttatgttataggcatggaacataggaatgtggtagtttttgttttaataggaattgttagcttttgagtatttagagtcacaatcttcagatttttggttaacatttcgtttaaacaaaacccagagtcaaactctcttttttgatgatgttgtgggaagagtttttgattatcgtcgtatgtcttttggttctcaggactatagctgaagttttgttttcccgtgagtaacaagatgattgagcaatggaacatgttttttatgtttgaatgatcatttgcgtttttttacctagcggtttactggttaagccaagtatattactaacttgctttcgtgttcataacagttttagaattcatgactctataaaccctgttctctaatcagtgtgttttcctgcactcacactttcaatccttttaacaatgtataacatgctaacttgtattgactcccttttccatggcatcgttttgggactgtccaggcaagtccatcagatccaaagacatttccgtttatagtgcttggaaacaagattgacgtagatggagggagcagtagagtggtaagaggaagatcaagatatgtcttccatcgtgctttaactcttttactcagtcttgtttaattcctctctaactacaggtctctgataagaaagcagctgactggtgtgcttcaaatggtaacataccctatttcgagacatcagcaaaagatgacttcaatgtcgatgaggcattcttaaccattgccaaaaccgcccttgctaacgaacatgaacaggatatgtaagttttctttttggtttagctctactaaatgagagctcgaaagtgtctaattgttaaaccggagagtctgaatattgtagaatctcaatctaaatctgaatatgacgtttaaatgtagaaggcagatagtgtagcttaaagacagtgacattcttacatgtctatctgcgatttgtctacttctgaattccaaactcttgtgtgatccgaattggaaactaagaatgcattaaaaataaccgctgaatacttatacagtatgtacctcatacacaatggcttgggttaattgcagatacttccaaggcataccagatgcagtgactgaaaacgagccaaaaggcggtggttgcgcttgctgaaccacagatttgaggattcaatgacattcgtttttttgatgcattcatttgaaggttggtgtactcttgagttgcagaacgataagcttgtagaagcaattttttgtcattccatcatatattaattgattggagaagtctgtgtatgatcaatcgattctgctggatacaaattttatttttgtaagaagaaccattattgctcttaatccctatggcgatataaagttgcatgctacactatttcagtttggtttgactcaactgtcggatatgttactacatctatagttagaccatatgttcattttgcatgtatagtttttttcatagaaatattgtaaaactttgaagtcaaactttaacctagatcatgtgatattttaaaaaactttgtgaatgtaatacactcgaatagctattcaggtgacaaaacctaaacagagattgtcttaaacaattcagagaggatatagcatggtcgtctattttctttagttctcaggctgtattattacccggacgtgatctgattctagctgctacagtgtactatctccaacctggaggctacatccctgcagaagaaggtggtggactcagtgaatctgcaattatactttcaatgcaatcattacagctttgaagaactaagagagatatcattgtccttgcttttcttttgctatagcctaagtggttattgcctattggtcatgttggtgggtattgtactattgggtattgtactattgttcactcaagtatatgtatatgaccataaaaaaaaaaaaatggttattgcctattggtcagttttttcttttaagtttgacccaaatctttccataaattgtgataaaacttaattcataaaatatataaaatatattttatatgtcttttaaatagaagtattattagttaatcatgcagtgtatcattcatccagtgtattatatgttttttaaataaaagtattattaaaaaaaatgtcattttacgagacatggttatatggtaggacgggtttcgatcgatattaatacacaacgatatactagagataaaattgttgaattaacaatcgaaatacaattatacgatcttaaatactaaacaaaaaattaaaatttaaaaattagtttaaaaaatcgaccggtatatccaaattcaaacataagttttaccttaatgggccaacatatgggccttaaaaggctttggatctgttactattacactccacttgcaaaaacctatcttcttcttcttcttcgctgaacaacaaacaacgcttcacaaaaccttccgataaacctcacaaccctcttcctcctcacactacagtaagaaaaacacgcgcgaaagct

SEQ ID NO: 3230 - DNA, 3000 bp, Unknown
  misc_feature (1)..( 3000): cDNA_ID_1819960_gDNA_ID_1620633_Annot_ID_47297 3000 nt of promoter + ATG
gcgaagtgtacattccaccagaggcaactgtaatgactttggcgtctggtgttgctttctccaacaatggaagcatcaactctgtcattgtgtatgtcccaagtacattcaccgcaaaacttaactcgaatctggtatgacagaagatcataggagtgtaaaattaaatcaagatgaaatgatactggaacgttcaagaaagataaatgagaccaacccttcaggtgtagtagtacgtttgttctcaagcaaaccagcattattaacctacaatttgaaaaccagaatcaaacaagtgaaatgttattctaagaattagtaaaagaaaagaccacataccagcacatgaaccggaacatccttggaagcgaaactcgaagcaaatgatttgatttcattaacggaagacaaatcacatacctaagaaagaagcaaagctaaaatggttgataaagagtatggaaacttgcaaaaaatgaatttgaaagtagaaaatgatcatacttccaagtacacattttggtttcctgttgaggtttgaatcttagaaagagcctcttgtcctctttccttgttccggcacaccatgtaaacagttgctccactagaaaaacataagcagacattataaaatttggtaacactcttccaacacaagaattcaattggttccctcaattccataacttaagtaacctaccgtgaagcaagaccctctgcagcagcaaaaccaatacctgaattagctccagtaactacacaattctttccttcaatttgtaactgcatatcttcaggtttaaacttctttgaatgatctctgccacacaaaaaaaaaaaaccacaagtactacatcaaccacttctccataacagagttcctcaaggtatcaaaattttcatgtgaagcaaatgttgaatcaaaagattgaatctttctatgttaatccaaagaacactaaacagcctgaatcgtataagtctccaaaatccataaaaattcaaactttataattccacaggattgaaaatgtagaaatacgcaaattcaacttacaagaaaccactcttggtgaaattcatgtagccataaaccccaaaagcggttgatctccatgtctacagatcaaaatcagacaaaagtaatcatttttaatccgacataagacagaaacaaacaaacgatggtaattagaggacataaaaaagaacgtacctttaagagaaacattttcgtgagttgtggaagatagttcgagttcctgagtttttggagaatgagatgttagattagcaatggtgcagagttacaagtcatgcgacgacgtttggaatccttaagtcaagtttgtcgattgagagaatagagaggttcccggtaagggttgtgccacgtagaagagagactcaccgtgaaaaggatttgatgacgtggctttttgttgagaatttgcaaataaatcctttttgtttttcatatttcagttttggccaaactattaccgtgaaaagaatttgagattctcacgtctgcttttctttggccttgtccggatcttaaccagaaaaagcaaagattgcttggagtgacatttgtaaaccaaaccaagaggcaggtttggaattacatttgctatctgaaacaaatactataagtatcttgaagctaatatggagaccggtctcggaaaatgactcattatgggttttatggagacacaaaaacctgcttcggaacggttctctcttgtcagtttgtggtaacacttactctggttccttgatgtggaaacaaatcttaaaatactgagacttagctcgaccactgcacaaaatggaggtaaagtctagaagggaaacttatttttggcatgtctccttgtgccctctggggaatctatatgcactcttaggctcacgaggaagtattgacatgggagtagttgttggttattttgttgctgatgtccttgtgttgcggtatgattttcaactcacaattcatagcttattgtgagagcgcaatgaacggcgtcatggaaaggcaccaactcctgcccccatacatgctcataaaattcattgatatgtccgaaatagactaagcgcaaatgacgggttcctctgactatgatggtacggtggcctacgtttctggtttcaaactcgcactcaataatctctccttagtgtaacactttaaatttttcgaaactttcaaacattcatatttcatgtcgcattcatagtaacactatcttcttttatcaataaattttacattctacaaaaaaaaagtaataaaaaaaatcttctcatattttcatatattttaaagtcaagttttcagatgcataactatacacaactttggatcgttaattacgaagtatttttacattactacagcaatatatttgcgtcagaccttccaaatttatggaaattacatgacgtaaagtatttgtttcttaagaagccgatttaaattgatataggttttacatattgtttattagttttaaaaaaaacaacgataacaataaataaccatttacaaaaattaagtagtgtgattcaatatttgttttgttttgctgtaaatgagccaaaacagcctttataatggaatatattacaactccttcattaagtaacgatttataaacgttcagagatggaagagaaaaaaataaagtatggtggttagaaaaaaaaagatacgatgtgaataactacaacttgctatatcaaaaatattttattgtaattccgttatcatctaaacttaatttttgttagagaacataataacagtacatccaaagttaccctaaaattacgtgaaacatctcatgcaatgaatttacgtacccaactttacttgcatggggtatctataaataccctctaaaacacatttcatgcaaaatcaagcaacacttaaaaacccatttcgaaagagaaacatttctaaaaacagtctagtaataaaaaatg

SEQ ID NO: 3231 - DNA, 3000 bp, Unknown
  misc_feature (1)..( 3000): cDNA_ID_1819956_gDNA_ID_1620633_Annot_ID_47298 3000 nt of promoter + ATG
aaatattttaaaacataaaatgtcttgttaagtaactcatttacgtcaacgtgaaaatatatctatgtatatcagtttgattacctggtagcctgagtgtgagcagtagaaggggcaagaagcttggtaagaacctctgtacttatcagcaaattcaaatagctaccacaaaatagataatttatacgttaccttatgattgaactgatgtaatgatatttatagacttaattaattaatatgaatttacactcacggatttagcattgtttagtaatttggatgaatatgtagaatcaaccagtttgaaaacaagtgaggccgcggcaagagcggctgcggcttcacctgcggcttcggaaccgggggaagaggaagagatactatagagagttctaggtgtgtccatatcttctggtctctcccaacaactatgatctgaatttccatctcctacctatttacatccattaccaaaacagaaccaaaaataattaattgaatttcgatagtgaatttgttgaatattgtagaagtatatagtatataagatacgagatatatactatttgggacatttaacatgaaatgaaatatttgaataattctctatactagtatacctcaaaacaaaccaaaatgtgacagttcggcttggtttagacgtgtaaaccgaggggaaaagttagtttacctgtgtatatagcatgttggtcgacgtatgagcacggaggataaaattagttccccatttgatagtagaccggagataaccaagctggttaacgaaagtaatctcattctggtattcaagtgcagcccaactcaacaaggttgtggtaaatgacattggccacacaaattttacattgtcaccagcatcgtaatatcctccaatcaaattcacctgagaaatcaaacacccgaaaatttggttaagtctataagagataacataatgccaaaacttatgaaataaggttccatttcggaagacatatatgcatagatatagagatgtttatgaatatagtcggtttacattagctgatgcaccgtcagacaggccagaatcagctcgccatttaaccctttgattagtcgggagtttaccagatctttggccttcaaagaacaaaattgatttgttcagtgcatctccatagtcaagagcttccaagctttcgaaagccaagaacatcccaattaacattacaaccaagagtttgcccattttttattactagactgtttttagaaatgtttctctttcgaaatgggtttttaagtgttgcttgattttgcatgaaatgtgttttagagggtatttatagataccccatgcaagtaaagttgggtacgtaaattcattgcatgagatgtttcacgtaattttagggtaactttggatgtactgttattatgttctctaacaaaaattaagtttagatgataacggaattacaataaaatatttttgatatagcaagttgtagttattcacatcgtatctttttttttctaaccaccatactttatttttttctcttccatctctgaacgtttataaatcgttacttaatgaaggagttgtaatatattccattataaaggctgttttggctcatttacagcaaaacaaaacaaatattgaatcacactacttaatttttgtaaatggttatttattgttatcgttgttttttttaaaactaataaacaatatgtaaaacctatatcaatttaaatcggcttcttaagaaacaaatactttacgtcatgtaatttccataaatttggaaggtctgacgcaaatatattgctgtagtaatgtaaaaatacttcgtaattaacgatccaaagttgtgtatagttatgcatctgaaaacttgactttaaaatatatgaaaatatgagaagattttttttattactttttttttgtagaatgtaaaatttattgataaaagaagatagtgttactatgaatgcgacatgaaatatgaatgtttgaaagtttcgaaaaatttaaagtgttacactaaggagagattattgagtgcgagtttgaaaccagaaacgtaggccaccgtaccatcatagtcagaggaacccgtcatttgcgcttagtctatttcggacatatcaatgaattttatgagcatgtatgggggcaggagttggtgcctttccatgacgccgttcattgcgctctcacaataagctatgaattgtgagttgaaaatcataccgcaacacaaggacatcagcaacaaaataaccaacaactactcccatgtcaatacttcctcgtgagcctaagagtgcatatagattccccagagggcacaaggagacatgccaaaaataagtttcccttctagactttacctccattttgtgcagtggtcgagctaagtctcagtattttaagatttgtttccacatcaaggaaccagagtaagtgttaccacaaactgacaagagagaaccgttccgaagcaggtttttgtgtctccataaaacccataatgagtcattttccgagaccggtctccatattagcttcaagatacttatagtatttgtttcagatagcaaatgtaattccaaacctgcctcttggtttggtttacaaatgtcactccaagcaatctttgctttttctggttaagatccggacaaggccaaagaaaagcagacgtgagaatctcaaattcttttcacggtaatagtttggccaaaactgaaatatgaaaaacaaaaaggatttatttgcaaattctcaacaaaaagccacgtcatcaaatccttttcacggtgagtctctcttctacgtggcacaacccttaccgggaacctctctattctctcaatcgacaaacttgacttaaggattccaaacgtcgtcgcatgacttgtaactctgcaccattgctaatctaacatctcattctccaaaaactcaggaactcgaactatcttccacaactcacgaaa

SEQ ID NO: 3232 - DNA, 3000 bp, Unknown
  misc_feature (1)..( 3000): cDNA_ID_1024126_gDNA_ID_1620633_Annot_ID_47303 3000 nt of promoter + ATG
atagttttattggttttctcatatcgttttgggattttctcggtaatgttttgtagttctaactgaaaatatgagtagacaataatgtggttggttagctaatggtgtaagtaatttttttgtttgaatctttgtctacataatatatcacaatggctgatggtacctaagaggaatttcatcattaaatacttgaggttttaaaaaccgatgaaacttaggaggagtaccatcattaaatacttaaagaatttttttttttagtataaaaaagttcttgagttttacactcacacacgatacaaaatcatttgatattacttgccaatgataaaatatgattaacataacgataaacccaaatcacacctccaattgtaaaacaatatgataatataacgattgaaaacggtagaattttgtaggcacacatctgttgtgctagcatgggagcatcggttctctcgccggttaccccttcttgttacatggcttcataccatcggttaaaccatccccggttttgacctcatattttcattcttagtcggaattttgatcttacgataatgaaatcgggagaaaacccttttgaagacatgtctcaatagattcaataaacatttcctcgagactatacttgaagttaaaccccatctctgtgagcttcttggaactgaactcaatactctttagattctcatcaacaccttcaaacctgttatatagagttttgtttaggacaaaacaattatgggccaaaacattttaaataatagtcaacacacttttcagtattttgtttagtaattttctaaaaaaaccaaattttaatcttacacattctattttgctatataatttaactatctatttcattataataatcccgattttgattatgcacacgttattttaatggataaatgttaaattttctatcaaaataatatgtataccatatcaaatgaatataattacttcatactaaaataattaccaaataacaaaacataatgaaccaaaaaaaaagaaaaccacaaaaatgttttagaaaagaaaaattgcttaagatatagttttgctatattctataatttcacaaattaattttacctaatgtcaaactcatattaaatgacttaaaatttataaataaaacactaaaattttatattaactttttttttatatcaaataataaaaacaaatcaatccctttaagccctaatttcctaatttttggttttttcactaatggctacatgcattaaaattgttagactaaaaaataggtataactatacaaatattctcattaagtatagaaataaaatactatattacattgaaaaatacaattttaaccaattcaatttatgttaaataaattattttgttattttaaataaatcattagttattattcatactaatgatttttttttaaaattaatacatgctagatttatttaattgaccaataacacatgtaaaatcaaatttgttaattttccttttgatgaataaaaatgattatatatgtatatatatatatatatagacataaaaattagtatatgtcaatttgtttacttttttaggttttttattttgtaagagaataaaaaaattaaatctttaatgacatatgtaaacatcttatcgttagacttgccacatgtcatgatctcgtgagttactaactttcaaaaccgtactttatataataagatatattgaaagtacaaaaatgggaaaacatcttattattgatttggaaaataaggaaaacatattattatagatatgagatttcgtcatggccgacgacgacgtgagacaaaaaaaggatggcaatttcatttgagaccctttctatccaaatctccacctaaaacctaagaaattgttctttacattttacactagaatttctattaaattcttgccaaatcattttgtcatacaaaaatacaataacttgaataacacttgcttttaatagaattcagaaatccggaaattgaataacactaaattttaatagaactagatgatcacccgcgctacaccgcggttttttcggattttttttattgtttaatttaaatataatcttttttatctactcattcactcatgcaatgagcaattacttttagtattaaaaatatttttttctaacaacgttctcaacaatgcatcatacacataattcataaacaacgtttgtctttaaccaatttaacaaagggtagtgttggattctaaaaacttaagaatttgatgatggaaatccttacgtattatataaatatcaatttaaaagaatataaatatcaatttaagagaataacttactcaaatcattaagtaatccacgactattaaacactcatactttgagtttggattacgaaaaaaaatcttcgaatatgagaaaactattaaaatagttttattgaaaaatcatgtaatattaaaataaatttagtaatagtacagataaatatataaaataaaataatatgtaaaattaaataagaaatatatcattaacctataaattagaagttgaagagcttacattaattattttaatagacacatggcaaatgctaagtgatgatgtgtcaatcatacggaaagagttagccatgattaataaaatacctcaatgacactagaatttgaattctattaaactctgtcaaattccacggtttaataaccccctttataaaagttgatcaactctgatataaactttttgttatttatataagtgttccatcgaaaataatattttaataaatattcatgaagggtaaaatggtctttaactatttcagtattacgataaccctactaatgtgtaatatatataaatcattgaaaaaccctagcagacctcttttgtgttcttcactctccagcgatcgtttattgcttgaagacggcttcttcttctcacaaacctcatctctgctaatcaaa

SEQ ID NO: 3233 - DNA, 3000 bp, Unknown
  misc_feature (1)..( 3000): cDNA_ID_1819936_gDNA_ID_1620633_Annot_ID_47305 3000 nt of promoter + ATG
atttctggaccaatcggatatccacgggtttactaaaactctacccaataaggaaatttcctaaaattttaacccgccctaacccggttttttggttcgggtattgggttggttatcgggtccgtattttgtcagccctatcaaagataatctaatatatgctccaattaggtccacaaatataaccaaaatactatacaaagactaattctaagttaggccaaaaattagatccactaatacaaaggaaacatgtttcttaccaaaacaacttgtatacaaattttacacatttacttaaaactatatatgttatatttattataaaaataacatttttaaacaaagtcaatccaatgcagcattatatgctaatagtaaaaacattgaaaaatattatgacatcgcttttatactatactatttcttatgtaattgaaacaaagtatacaatttaatttatacaaaatattaatgctcgtgctgtatagcacgggttatgatctagtaacacttcatttccaaaggacaaatcataccattatatccaccttaggatcatggactcatggtgccagatattttgcatcattgccaagcagaatgaaagattttcctccacaagagatttgagtttataaatatttggtgagatttaacaaaaaaaaaaaatatatatatatatatatatatatatatatatatatatatttggtgagataagtcttaacttgctacattcaaagaaactaattaaaccaaaaaccaaacactaaaagaatagtaaatcgtcaatttcatattagatgagctaataaagcatcacagcaataaattttgtctatctccatcacttacaccctttttttgtagataatgtaatttcttcctcaagatctgaagaatcataaatcacatagtttagtcaatgttacaatacacacgactaaaagaaaaattacaaaattttattgatagaatttaaaatataccactagacactagacttttgtcttttcattagtcattaccgcttgatatttttactatcttacgcatgttatgaaagattataaagcttaggttttgggtagcaaaaaagggttaggaaaaagaaaaccatactatttgttatccgaaaatgtcaaactaattcctctaactgtggtaaaaggttataaaatcaaatcctctagattgatgtaagtgatttttaaatcgttattcggtcagatcacaagttaatgatgaacttttcagggttcaatacatggcgattttagccatggatccccaacgggatcatgggattacggtccaactgaccggtttggaccgggtcttaatatattgaacaaaatacaagaaatctctcattcacacgaatgattacatttcagaaaaagaaagaaaaaataactcaaaaaacttcacaccaatttgcatcacactatattacccattatttttctacaattatgtggtccacttttcaaatagttcactctcatcataaaccggccggggtccttcaaagctcatgcagttgtgcgttgtaaagatatattgtattccaacaactaattcttgccaaaacacttttggctaatgtcattttcattgaaaacaaagcattataaataggaatgatttgtcatttctggaatggaagaacttgggttttagttaacatttgtgcctaaccaacctctcgtttatgtactaaagcattgtccttgtgattgtgaataaccaatcgctcatttctgtgttagaacagtattgtttattttctgttatttgaatcatttccaatgagaaatgagttacataacacctttatttataaacacaaagatgcacacaaggagaagcaaaatcaataagaagaaaccactccacgtggcccgtcgtcagagttacataattggtgaacgactaaactcagaagaaacaacatgtaataagaaacacagaagcagaagcaaaagccaagcaacatttattttgtcgacaaaaaagccaagaaacattcaatgttgattttgtctaagtaaccaggtgtacatacattacccttaaccatacccaaaatcgtatgtactacgatatgtgtacgtaacagtatctatctacatttatattttataagacattattaaatgggaaacttatagtggctagtggctgctacttggctagcaattaacatcaataatttaataactcaaatgtgaaacatctcattcttctcctttattacaccaaaccatttctcattctttacttaccggtcaggtcaacaattctaccattccccatctttggttaagtttatcttttcattttaaagaaaatatatatgaatgttcatccaataattccaacttcttaaaattgttaatgaacattttaatcaatatataattttaatatcaattttataaataatagaaatgtgaaaaacgcaatttctttgctccttgtagcagtaacacaagtcaaagcaacatttgttttcatttgtttgtcagttagctattttatctacaataatatgttatgctttctgaacaataaataaatatagcattattagatatattcattctgtattttgatttgtccaattagtatatgacacgtctacaagatacatagatctttcattatttcactttctcatccaacgtctggtgaaccaaccattcaaaaatcaaaagtcaacttttaatgcacttgagttttggtcatgcattcatatacatacatatatacatagaagtcattacatgcattatactttacttatgtcaacatgttgcaaaagcactaagatgatatacgtatacatgcatattgcaaaaatcagtggtcccataccattttaagtcatcatgagcgtatgagagtaaattcttctcacatattaataacaacccttcaaagttataagatttttagagagagagctaccacgttttcgtatctccgggaacg

SEQ ID NO: 3234 - DNA, 3000 bp, Unknown; identical to SEQ ID NO: 3232
  misc_feature (1)..( 3000): cDNA_ID_1024126_gDNA_ID_1620633_Annot_ID_162773 3000 nt of promoter + ATG

SEQ ID NO: 3235 - DNA, 3000 bp, Unknown; identical to SEQ ID NO: 3231
  misc_feature (1)..( 3000): cDNA_ID_1819956_gDNA_ID_1620633_Annot_ID_162765 3000 nt of promoter + ATG

SEQ ID NO: 3236 - DNA, 3000 bp, Unknown; identical to SEQ ID NO: 3230
  misc_feature (1)..( 3000): cDNA_ID_1819960_gDNA_ID_1620633_Annot_ID_162764 3000 nt of promoter + ATG

SEQ ID NO: 3237 - DNA, 3000 bp, Unknown; identical to SEQ ID NO: 3229
  misc_feature (1)..( 3000): cDNA_ID_2158039_gDNA_ID_1620633_Annot_ID_162762 3000 nt of promoter + ATG

SEQ ID NO: 3238 - DNA, 3000 bp, Unknown; identical to SEQ ID NO: 3228
  misc_feature (1)..( 3000): cDNA_ID_3089318_gDNA_ID_1620633_Annot_ID_162761 3000 nt of promoter + ATG

SEQ ID NO: 3239 - DNA, 3000 bp, Unknown; identical to SEQ ID NO: 3227
  misc_feature (1)..( 3000): cDNA_ID_3089325_gDNA_ID_1620633_Annot_ID_162758 3000 nt of promoter + ATG

SEQ ID NO: 3240 - DNA, 3000 bp, Unknown
  misc_feature (1)..( 3000): cDNA_ID_1820040_gDNA_ID_1620634_Annot_ID_47312 3000 nt of promoter + ATG
attctaatgtttttttttttacgtgtaaacgtttacacttttcagggtgtgaagaacaatccgtcccttatgattactcggcaacaatagaggtaagcaatgctctgttcgttcagacattttttttttttttttttttaatgttcattaagacatggtcatttgaaattctgattacattttttgtcttggtgcagtgtctagagaacccttataaaccacagtacaatggagggatcatcgtgaatcctgacttgcaaaatggttcacaaggctggtcacagtttggaaacgccaaagtcgatttcagagaatttggaggcaataagtttgttgttgccacacaaaggaatcaatcttctgacagcatctcgcagaaggtgtacttggaaaaaggaattctctacactttctctggtaaaaacaattttgaatttgtgtttcttgaagcgcactctttataacttcatctgatgtattttatgttatacttgtagcttggttacaagtgagcataggaaaatctcccgtgagcgctgttttcaagaagaatggtgaatataagcatgccggttcggttgttgctgaatccaaatgttggtccatgctgaaaggtggtctcactgttgatgaatctggtcctgctgaactcttcttcgaggtatatctctgtacacaaacatactcattgtctccattgtttgtctacatttctgcattttgcaagctactttatacacctatatatggtgatccattatccctttttcatgtgtagagcgagaacacaatggttgagatttgggttgatagcgtctctttgcaacctttcacacaagaagagtggaactctcaccacgaacagagcattggcaaagtaagaaaaggtaccgtgagaatcagagtcatgaataacaaaggcgagacgatacctaatgcaaccatatccatagaacagaagaaactcggatacccattcgggtgcgcggtagaaaacaacatacttgggaatcaagcataccaaaactggttcactcaaagatttaccgtgacaactttcgggaacgagatgaaatggtacagcacagaaagaataagagggcaagaggattactcgacagctgacgcgatgttaagtttcttcaagagccacgggattgctgtacgtgggcacaatgttttatgggatgatcctaagtaccaacctggatgggtgaattctctgtctggtaacgacctctacaacgctgtgaaacgaagggtttactcggttgtctcgcgatacaaaggacagcttttgggttgggatgttgtgaatgagaatcttcatttctccttctttgagagcaagttcggtcctaaagcctcttataacacctacacaatggcccatgccgtcgatccaaggacaccaatgttcatgaatgaatataatacgttagagcaacctaaggatttaacttctagtccagcaaggtatttgggaaagcttagggagcttcaatctattcgggttgccggaaagattccgttagcgataggtcttgagtctcatttcagcactcctaacattccgtatatgagatcagctcttgatacttttggtgccactggtttgcctatttggctcactgagattgacgttgatgcgcctcccaatgtccgggtaacttaattattctcttatacaagtaggaaaaaaatcatcatttcagaattttcatttccttctctgatgttttgtttttcttgcaggccaactatttcgagcaagttctaagggaaggccatgcacatccgaaagtgaatggaatggtgatgtggacaggttattctccatcaggttgctaccgaatgtgcctcaccgatggaaactttaagaacctacccactggagacgtcgtggacaagcttttacgtgaatggggagggcttcgcagccaaaccacaggtgtcactgatgctaatgggttatttgaagctccactctttcatggtgactatgatctccgtatatcccatcctctcaccaattcaaaggcttcttacaactttacgttgacttccgatgacgactcctcacagaaacaaccatctctatatgtctttcgtgtttgagaagctaagtttacaactactttgtatttgagtagtttgattcttattggcagattagtgtgttttccattataactttgtgtgaggaaactcccatgggatatccatgagcatcgttgggttggtttcttatactttaattaagccgtgatattgtaataaaattatcaatgatattgaacttcctttaactatttcgtcaagtattttgagctcttgaatcattacattttctttattcgagttaattaaaatagtaaaattattcatttttccaaagctaattcatatatcattcatttgtttattgatttttgctattgtggaatatacttgcattatataaaaacaattctataaaatgaagatattaattaatcctttaacaaaaaatatacattgtataaaacatcatttttcctaaaaaaaacacccagggagaacatattagggaaatatttcaatacaaacttgtagttttgaccaatatttactgtcaaaacgcaggaagtttggccaaattcgtagaaaatgtaagattccatcagattttttatgtggtgtacgccggaatatcaatggaaacagccatcttctatataattttacaatataaaataaaatcgtttacaaaagtaataaaaaaagtcaattaaaagataaacaaaataatatttaaggtgatacaaaaaaattatagtgttgcctttttttgttttaactctgaccaaacgtatctgttgactattgactagaatttaagctattgatggcattttctttccatatttggcctccgcgcaaaaaatgagattttcccaagagttaatatgcagatgtaaacggaggttaatatcttctttttttctgaaaacaaatatg

SEQ ID NO: 3241 - DNA, 3000 bp, Unknown
  misc_feature (1)..( 3000): cDNA_ID_1819997_gDNA_ID_1620634_Annot_ID_162821 3000 nt of promoter + ATG
catttatctggttaggttcttgcaagttcttcatctggttttgctgtaaacaggatgaaatatgtaaatctattgctgaatccggtggaatagatacacttcttcggtgtattgatgatagcggtgagcaaggcaacaaaactgctgctaagacatgttgttccctgttgtctaaggtgagtagcttctaatatgccctgcaggctgcctctgttgtcttcattgcctttggttattcaaaatccttctttaaaactcaggctttcaagtattttccgcaccatattaaggagtagcttatgttcatgtgcttctaataaatgcatgttctcaaattttaagcttttccaaagcctattactgatttagattagcattgtaaccacgcatgataaatgtttatctaaaatttgtattttgatctctagttggcaggaagtgactctaacaagagtaccatagttgagaagcaaggtctggacaagctaatcacactcgcactacgattctctgatgatcctctagtcatacaagaggtaagtatataaaccaaacgaaaaccctcttatgacactatgtcccatgcgcaattttaaatcttcctgtctagagaagatacttgtgactacaggtcacgtctttggcagttttccactagatagaacgtaatgtcgtgtgaagaatgtttcttgtagcattagggtctgagtgcataatccttgtggttgatccaagatatacttgattggttcaggtgatgttgataatctctataatctgtctgagatcaccagaccacgcagccaaggctatagaagctggagctggtgatctagcggtccaagcaatgaagaggttcccagtagctgctcaaatgcagagaaacgcttgcaacatgatacggaacattgctgtcagaagtgcagagaacaggtttttgctctgtttccaattcttgtcatccaacaatatgcacatatcgcaaactcttttataatatcaagttctgtctgcatgcacactacagaactattctgcttgctaatggaatcgagaagctgataagaactgctaaagccaacaatgagacatgcagagccgctgcaactgatgcactgagagaccttggccttgataactacaataactaaggtcaatctttctccattggttggtactcgcaacaaccggaatgaatccagttttttttttcaaaaatttcataaacagtttgcattgagttctctcttttgggtagaaggcattccgatctagtcttttttgcaacgattgcttttgttcgaatgcttgaacatgtagtaaaattgaaaggaattgattgaaaatttcggtgaaaggtactctaaatagtaaaaaagtaaatagagaaacagaggcttcacaatgagaaattttcattcattcactaaaatcattcgtttagtcaatgaatttcctttatttagaagaaatcgattttagtttgaaacaaggacaaaatgtttgtttgactaaagggaagagaaacaaagacaaaatgttcacgtccatggaatgatcgagctctagaagagtgtattgggaatattaagtacggatatatgtttttaaaagatgattaaaaaaaaagtttgcagcaaaatcgtcatgtggatgcgcataaacaaaaactttagatagtaaaaatgatgggctatagtgatgatgagtgcaactctatcggtttcagcttttaggtgaagatctgacaagctagccaacaatatctcgacatttgtggtaacttgtttttcttttattttccgtttttaaatgcggaaaccctttttatataccgaaatagaaagtaaatctttttagtggtcattaatacatggaggttcccatgattagccataagcttgtttaatgcgagtatatgtttcatcagctccgtttcaggacatatttaaggggcaaaattaatccagtagccaaaaatgtacatatgtaagggacatattacgatattaatatatagatccactaacagaaaaactaattgttaatttaaattatttctatttcatttttcactgtgtttgattaaattaaattgggatataaaatcaattcaaaatctgttattttaaatctcataccattctagtgctatatttttgaaaacttagatatttttagtaactgttctaggcataaatttaatcaattaatattttcatattttttgctatactatttacaataagacatataataaatcggaaaaaattaatgcataatattatggagagataaaacttactgaaaaataaagagtaacaaatcacatagtttatactaatactttgccaataaaaagaaagtttatactaattaaaatattattttctatactagtcacggtaaaaaaaaacatttctaaaaactacaggccccattgtttgtcagaacgttgtaagtagaaagggtaaatccgtcatttcaaactatctcccatgctttgacaaatcacaattcaacagttcacagaaaaagcgaaaacttcttctatctctctcatctttctgttttgtatagcttacttcaagctgtggtttaaacagaacagagaaagctgtttcctttttatattgacagagaaaaggaaagctgatagagagagagacagagagagagaaacagagttcaagatcacgagccttccttcttcttcttcttcttcatcgagagcgatcaaaggaacaaaaaggatctcaagaaacccacttgtgttgttggttagatacttcacgggtctctgaaaacgtctctttctcacaaccataacttgatcacccaatactccttttctcatcttaaaggctcaaattcatccacgtcacaccgttgttcatttcctctgatgtcttggtgtcgttagatattgtctcccaaaaaagaaatcttcttgacacagagattgaagtcgcaaagagacagaggaaagagggggagaaa

SEQ ID NO: 3242 - DNA, 3000 bp, Unknown
  misc_feature (1)..( 3000): cDNA_ID_3070924_gDNA_ID_1620634_Annot_ID_162804 3000 nt of promoter + ATG
tatatatacactactttttcttaatactttttttcttttagttgtgtgtttaaaacttttattggaccaaccaactagttcacagtatactccaatcgtgatgtaggagacaagtacaccaaagattaacatcatcaatacaaagttacaaactatatgtgatcaccttcatgactataatgctttaaccaattttctcttttgatttctagaatctagacccttcatcgtttggttcaattgttgaatcataagctcgtgaaattctagaaatgttttgactgatcctatagactaaaggtgaaagtgattgtacttaaacaaaaaaattaaaaaaaaaacctctaatattaactagtacttttttttgttgctttgttattaaaaaaatataactctttatttgggaaaaaaatatctgtaaccaaaaaaatatacgaaacaacttaaccgtctgtaacaaattgccgaaccgactaattgaggagcaagggcaaattggtaatttcgtttagatttcccgcttctttcatcatctccaatttctcacttctcgagtgttaacaaattacaatcccagacgaactagatcagaagaaggagagaagaagagaagaggatgaggttcctcggagactacaagttcgctttacttacttgctccgttatcgctctcagcatctacttcgcgattaacgtcgaatttcgtttcgcgtacgattcaccgggaactcgtaccggagttaaggtttccgagaaatctcccttcgacgacgaattcatgtacatgtcaatcgctgaagatatcgatcgatcttacctccactacgattactaccgtgaatcttgccctaccgccgagaaaatcatcgcgaaagctatcagagatatctacaatgtcacacccagcgtagctccgcctattatccgtctcctctttcacgattgcttcatcgaggtcagattttctgatttctggctttccctttcttgtaattttgatttcgctaagctagatctatggaagattgtttgggatcttgtttcgggaatgtttgattgtgatgtctctgtatcggatttgaattcatctctgttagtgtaattatgcttggtcagtagatttttaagtgtgaatctctcaatcttggctacggatatgcagaactcatgtgtttgatactcagatttgatgttattagcatactttgtgaatcaaatacggatatgcacaagttatttgtttgatcctcagatttgctcagtttttaatatcaaattctatgttttctttagcacttcttgtagtttgctcatgatgctatttggggaactgtgtttttgctgcagggatgtgatgcatcagtccttctagacgcagatgaagcacatacttctgagaaagatgcatctccaaacctatccttgaaagggtttgatgtgattgacgccgttaagtctgagctagagaatgtctgtcccggagttgtttcctgtgctgacctacttgtattggcagctagagaagccgtcctagttgtaaatttcccctctctcactctctcttctggtttgtgcatgttaatagtgctgcaacgcttgatcatgtctttgaaactatcaggctggtggtccattctatcccctagaaactggaaggaaggatagtgcagcagcctacagggattttgcagaacacgagcttcctgcaccagacgctactctgtcggtgattcttcaacgtttttctttcagaggattcaacgagagagaaaccgtcagcttattcggtaatttctcacttttagatgtcagcatctctctttgtttagctaaatcttctccgtattggggtatatcacttcttgggagtggctctctttgtgacatgattcttttcttctgaatgatcttaatgcaggagcacacagcattggcatcacgcattgcacattttttaagaaccgcctctacaacttctcagcaaccgggaagcctgatcctgaactcaatccagggttcctccaagaactgaaaacgaaatgccccttctctgtctcgacttcatctccatctgctccccctgacattggtttaccaccgtccttacctgcatcagattccgaaaacagctacggtatgagctcaggaaacaggaatgatgaagtgatcgacttgagctacaacaatgaaggaggtgatgaaaattttggaacacgatacttccgaagactaatgcagaataaagggttgatgtcttctgaccagcaactaatgggtagtgaagtgactgagatgtgggtgagggcatatgcttctgatccgttgttgttccgcagagaatttgctatgtcaatgatgaaactttcaagctataatgtcttgactggtcctctaggacaagtgagaacaagctgctcaaaggccctccccaggaactgatctctcttttaccactttagcggactcctgttgataagatttgattttgttttcgaatatatgtagtaactgaattgaggattttgagtttgatttcagaaggctgataaataagttgagagttcaatccctcattgtgtatgataaccatcaccaatttttctactacattttttggctctgacctcatttatcaaattttgataggaaaatgtcactttggtttgtgccaaaaaagggcaggctctgttatattattgacggcagaaaatggtaggcatgcttaaacgtatgagttagtgttaaattaggtagaaaaatgacaagcttggtatataacgttcaataatataaggaagatgtggcagagttagtgttgagaatgggctagtctacttgtgtttaggcccatatatataaggcccatatatatttgaagaccacaaataactagggtttacaaatttggttatatagctctctctctcgagccgcacatatttcgtcttcttgatctaatcgctttgagctgttagcagagagcagtcgacaatcatg

SEQ ID NO: 3243 - DNA, 3000 bp, Unknown
  misc_feature (1)..( 3000): cDNA_ID_2992361_gDNA_ID_1620634_Annot_ID_162835 3000 nt of promoter + ATG
gtaaacatcaagtttagcatcaacatctggtaatccaactgggcgtacaaaattagatacacatactaaattggcaaaattcttgcagatagcatcccgcttcaggataaggtgcatcaacgttgaacagatgatacttgtgaaaagtctctggagttgaggtggtttgataccatcggaccgttatacttcggtttaagatcagtaatgagacatcttctaactgtgtttcttgaacaagatgctttcaaacggttactgccttggatactcatgcacaagcccttctgaaacactccttgctctagcatgtccgaacagcttgctaacaatagccagggaaaatttggtaacagttgcgagccccaaacttgtaatcacgtttccatctataacaacttcggctccttcgatcatttgttgattcataggctcgtctgactctgaaggatacacagtcgttctcttctcctaaaataggattccaattgtttatggcgtttgtccatgtatatgacaaagaaaagaacaatagttgtcttcaccttaccttgagtaaaccatgtttatgcaaaacggtagatgaagagttggtagctccatatattcgcccagattcatgttgttccctgagcagtttcttgagaattttggacttctgcagacgttctgagccagtatggcctcccttgggaatttccatcaaagaaaagaaatcatattactcaccatggaacaaccaacagttgtagtttgtctaaaagcttttcctaagcgcattgatttgacatggcatataagttatactgaaacatgtacatagcaagatttatttaagaagaagtaaactagcgaaatggtatgagtttattatgagactaggacatgcagggttttgcttaaagccttaccggaagaatgattagatcatatgatgactcagcagcttcaccaatcaatttgtcagtgataattttggtgccttggaatgccgtaatccgcaaagatcgttcaactgatgaaaccgtgacatctactttggctcttctaagaacatctgcaattgagaccagttcaaccgcttcagacccgttggctaccgggataagaacctggatttagatgcatcattaaaacaagtttctcagctttcaaactaaaatgaaatgttcttagaatcagctaactttttcatctttcaaaactaactgagcgtgaaaggagaaggaatggataaaagaaaaaactccataggtatagaagataaaaccaagatcagttctcatcatatatcatgagattacatggaaatgcattgatcatagcttcatgcgacttacacgaggtgtgtggtctaaagaccagtcaatgctattgaactctttgttcttaggattctggtaaccatcacgcagaagctggagaaatgattggaaaagaagactatgagaagattgttgcatatcgagaaggataaagaaaagcatgatccagaaaagtataagtgaataggatatagaccagaaactcttcaattgacttggctgtggtttctccgaagagctgctccgccaaggaaagagcaaactggaaagaagtgccgggtccacggctagttgtaagctcccctgaaatctgaatgtttgtcttaacagcccagaatgtaggaagcttcccgaaaaaagcaggatgtcccgttgtcttgcacgatgaactacaccaagtttagaaatcaaaacatgaagagaaaagattagttactagatgacatcaaagattttgatttataccctctttcttgtcaaaagtccccatggaagaagagtaatagctggagccatggatatagccccgtataaccgcttatcttcagcttgtctcttcatgatcttctcgagaatttcacagtctcttaacctaacagcaccaggcatgcctcccttcacaatttgtatttccagaccatccagaaacaaatacacaaaaccattaaagtaaagctcaaagactgtcctcacttatagtttatgaatcagcaaaagaggaacttaccggcaaagcaactaaatcataaacttgatcagcacatttcgagataagaacatcagcaagcaatctggtccctgaggatccttcaacctctagcttctgctccacagaagcaacagtaacatcagcaccagctcgccgtaaaacatcaactaacacaacagcttctatttcctccgtcccatatccaattggaacaagcacctacatagtttctcagttatctccaatctcaatctctctacacaaacaagctggacaattttagttatagataacaagaaaaaaggagaaacctttttagtagttgcagaagacccgacgccaacatcggaatctagcgttgttaccatacccggagacatggaagatctaagctttaaagttcggtccctccttgttgtccctagtgaagaagaaactacagagactgaagaaaaactaggagcaacagtcatcgagacacaacccatcgaagagataagccttgactccatcaaagttggactcagcgaagctatcattgaaatcgaatatcctaaagaccccattgacgatagctaatgcagcagtctgataatcccgccgctagacggagagtgagttgcgtcttatctactagtatacacttcttgaagaaagctaaaaacgtcgtcgtatcgttgtcttattgcttgattggataaagcttcaattttttcctccaatttttgtcgaaaatgtaacattttttttgctttccactgtgagattgtcacacacgattctctaaagaaatgagacgaattttgaaaacgatttataaaaatagtatttttgtttccttgagcttatctcctcttttctctttggtttgagatatgaattacagacaatcaagtagtcagtcacaacagtgtgtataaatatgtcttttaagtgaaatcggtttcgagagacagtgagacgaaa

SEQ ID NO: 3244 - DNA, 3000 bp, Unknown
  misc_feature (1)..( 3000): cDNA_ID_1008767_gDNA_ID_1620634_Annot_ID_162826 3000 nt of promoter + ATG
tgaatcatatcactagagtgtacgcgtcaaatttatgtaaccatcgtgagaggtttaggatgtgtatattcaagtattacaatgatgttccaaaagtacaagtatgagcacttcttagttctttttgttatgtcaagctatcaagcaagtattacaattatgttgctaagtgtttcagttatgatgtcattatgtattgcggtgaccagttgtatatgtgggcggttggtttgctctttcatgaagttcacaaaatggtagcattactatgactaaagacgaaaagtcgagacgtaacaaaccaaaaatagtcgcagatagaagacatgacaaatatgtctcaaattattaactggagattaagcaaaacgagaaaaatggaacctgtgtgtgtacacagtgcaaaaacttacaactacaaggattatacgatgaggatgtcatgcttaatttatttactagtaatattcccaaaacatggtataaaaaaagttcaaatgatcctttctagaacaatgacgtacaaatatcatggttaaccgttttcaagtcaattgacatgtcttgcaattttatattgaacagatttaagaaagaaaaaaacagggggtacacacacacaaaaaaaaaaaaaaaaaaatcaatatccacaaacaagattacgtgaaatttggtcatgcatgtatacgtacgagtgagtagatatcacatttttaaaggaattagataatgttagctaggtttaacaacattccagaacataggattttaagaaaaacatctttgttaagagattcaaacccaccagaacattgttagtgttagactgcagagaagaaaaaaccagtaatctacttatatacatatacatcatttactctaccccaactagatatatgcattaggatttaggcataggcacatagccccataggattacaaaaaaaataaaaaaatttatatcaatatggctgtattataacaataatgtcgtatgttgtaatagctatcaagagcttatagagttgtatattattcgtaacaatgtacataggaagactttaaggagataggaagactttaaggagaatgatctcgatggacatgtacacatatatgttatacctaaagactaaaatagagaatctagaaaaacataattggctccacatgagattattgatatttattaattggctccacatgagatgattaattattgctaattggttgatgtttgacatgttcaccgaaatgagagaatccgcggttggtgacggtggaggcaatataattatttccaaactttggaaaatcgatctatctttagttttttttcttttctttttcatatagactctgattctactacagaacttgtaaatttttatattatgattatcattcataagaatgtacaaaatttatatagagttcaagaaaggaggatctcaaaaagaaaatctcgatggatttgtacatatctctaaagatggagtctatatgattataaaaagataatacatttcatccaaccattagcaaagtggtctacattaggatatgaagaagtggtctacattagaaaactattattatccgcgagatattttgttttaggttgtaaaaagaaaagggcagatattttcgtttgtaacgaacgaagcggcagatattttgaagcaaccactgtcccacgtcagcaaaatgtctcttagcgcaaatggatatttgcgaaaccaatggctaattttttaattagttgtttattcgaatttatcctatcaacattttatattttagataatgatacttaatttctcttggactaatctcattatccaaattcaaatgatatttaatgaaagttaagtaactgttttattaatatttttttgttgtttttttctctttaattcgagttgacaaaaataatattagagatgttacaaaattatccagataccatggtttgtaccatctgcattggaagaaaatgaggaaaaaaactcataatttgaccataaaaattagcttaacatgtttgcatttcattttcatttttcatattacttgtactttttagttaaatagtggcaattgtgacaaaaatgacacgtgaagtaaactatatcatgttgagaccgcatcttcagactcttcttcattctatccattttataacttaacctacataatttgtgacgagtatattgcgtgcttgaccaactaatgttaaatacattttctcgagaatctcttatgtttgagctgacgaagttgtctcatctccaataattcactgataaggaaggatgtacttaaccttaaaactctgaaatttgtaagcatccatcattctttaataaaatttgttacaaaatccgtatgaagccaatttgatccatcatccatatatatgtatattctagaaaatgtaagaccaaaccctagagaggctcacacgaattctggtctttctttacaaaaaaaaaaaacaaaaaaatattcatgtgatcataccacttgctaaagaggcctcgtgtaaatctgatcttaatttaacttataaaaaatctacaagtcaaaaaaaaaacaacgaaataatgacataaaagacaagaaaccaaaactaccaaaataaaaaagagcatccattatctatatatcatcagaagttgacaaaagaaaagatcatttttatttttatttaacacaacctcccttctccttgagctccaaaaaaaaatatctggctgatatttgtcggagatattattagcgacccagatgacgtggcaatactatgacacgtgtaaaagcgacgccatgtggaccttttgtctctctctttttttccttttcatctccttcttctctcattcctctctctcttaaagctctcttctttggctctttcgaagaagaaccatttttatttcctaagagagacgacgcagttcttttctaaagcaccggagaggaggagaagcaacgatg
